United States Patent 9,029,523 (PROMOTER, PROMOTER CONTROL ELEMENTS, AND COMBINATIONS, AND USES THEREOF) - sequence listing, part 6

SEQ ID NO: 6023 - DNA, 3000 bp, Unknown
  misc_feature (1)..( 3000): cDNA_ID_1829639_gDNA_ID_1620836_Annot_ID_50811 3000 nt of promoter + ATG
tccatatagaaatcatggagggatttgagacatgcataattggtcgtacgtacgtgtgaggtggtggtgttacttaagaccaaaattatgctatatgcaacatgctacggaaaaatattaactgatgttgttcaaggtgagacttgcaatcatttaaattgtttatagcatatttttcattttaattaagaattttagctcgtactgagaatgagatataaatcaatacaaattcaactttattgccaagccaatgggggacacatgaaaagaataaaattagaaaatgttaaacgagatatgagtgcattgaaaccttgtttttgtagcatactcgagtttttatttatatatggcccatcatgctatgctttctctttcgcttataccattgagcttcgcgacatttgaggaaaagacaagcccaacacattttactttaacaataactaatcaacctctacttcttttctattaaacaaaatgttaaagggtttttttattttcttataatgcattcatttaccttgtcctaatgtcccgataaatcttgccttttaagttctttgactagtggctaccaaattcttttagaatctgtaatgattatcattgaccaactgtgtctgtgttttcctaaatttacaaagacatcacgatgtaaaagcttcggggtggattgtttatggaagcggtcaagcaaagaatatggatgggttcacgaggaatcactagtgtgtgtgacattatgatattttgttatcggtttaatggattttgccaattataagagaatctatgttgcaagatggtagatgatcgcactacaaaaaagtgatgagccaaaaatatagtcacacgttgtccaatggaatcttcaccacgaaatgaaaaaagttcaagtgatcttttggacgtcatgcaaaaatggaagatgatgacggttacaaattgatctgtctagacatcttatcttctttattcatggcaagtctttggtactactatacgtgtgatgtgaacgcatttcagataagttaagtagatatatatcttgttgtatgtgtgaatgcatctccacatcttgagatttggttggttaacattgggttaaatgtgaacgcgtctttggaatagtatataataataatttagacgcgcgtttgttaactttcaaacatttttgtgaaccacgctccaccaaataagacatgtggtggacgttgcaactagatttacgcatcttgatgggtttccaaaaatggtaagtagaaattggttttctctcaaaagcaccattatttagggtttgggaatgaaaaaagtttgtatctttatcgttatgattttactcatgctaaaccaaaggtttcttcatcgcgttttggacttcgtcttatctaccgccctatgtgttacatgatacgacatatatgatacccagaaaaaaattcatgtgtgcgggacaaaaagcctcagatgacttttgattttgaaaaactatgatcatttttaaaaaagttgtagaaattaaatcattttgaactattcgatgcaaccaacctatctaaaaatgaagtaaattccgcaattttagatagatggacatcctcagatcacatccatttaaactaccataatacacgtagatggctctagacctctagtagaagatatgatactactatctttgatatgtcgacattggaagatacattttacaccgtagagctttgtggatatttcgaaagtaattagtgtataattcaaatcaattaaatttagatatataaatgtaccattctaatgcaaatcctttataacaaaaaaaaaaaggactttcccaaaggccaaacaaatgattgttgacattgaccacacgatcgtttagaaacatcacaaattttcaatctcctcctagtctcctaggctcataccacttacgttcgcatgttacataccttttttgaaatggccagctcatttttgatcaaatgaatactggatttacaatgggaaaaaattctgcatctatgttcttagatttacaaaataaactagaaatgttcgttttagtattttctttctatgaaataacttgttgttttatgaattatgagtctaaaaatggcatattagaaccaaaaaagattagcacatgacatttcaaaatcttaaatggtaacattttcaagatttttattctatcattagttgtttctatcatgacatttcaaaatcttaaatggcatattagaaccaaaaaattatttgttttattttgtacgtacaattaccatatttttattcattgtcatagttgttcaggtggatcttagatatttcaaagtataaaatttgtgatcgtattttagatgattacacacatatcacatatgtaatgcacataatatttccaaattaaaggtaaaatattatttttaccggagtatgtatatattcaatccagattatttttaaaaaattagattttttttgaatgatcagtcttatcaagaattcaaaagatagtgttgttgtcaatcaaaattactaaaagaaaattgtttagtcaacatatatacgtaccttaataaatatttttcttagaatctaaaggaatttacagatgttaaaataaaatccaataaagtgtaaatttaccaaacaagtaaagaccatttttcaaaaagaaaaagaaaccaaggagaccaaattatgattgagttttacaaaatacagaaaataaagaaattaaataaatatcaaaaactcaaaagagacctctcttctctctctctctctctctctcgctactctcatcttcaccgtacgcttcttcgatctacgcttctctctagctatagcttccattgtcacgattcctcccaaagcgtagaatgtggaaccctagatacctcaaattcagctagagatctatctactttcacctctattactttctacttctgaaacccctcatcagagctacacacagtg

SEQ ID NO: 6024 - DNA, 3000 bp, Unknown; identical to SEQ ID NO: 6013
  misc_feature (1)..( 3000): cDNA_ID_1829635_gDNA_ID_1620836_Annot_ID_50812 3000 nt of promoter + ATG

SEQ ID NO: 6025 - DNA, 3000 bp, Unknown; identical to SEQ ID NO: 6012
  misc_feature (1)..( 3000): cDNA_ID_1807217_gDNA_ID_1620836_Annot_ID_50813 3000 nt of promoter + ATG

SEQ ID NO: 6026 - DNA, 1808 bp, Unknown
  misc_feature (1)..( 1808): cDNA_ID_1829627_gDNA_ID_1620836_Annot_ID_50816 3000 nt of promoter + ATG
caacaaccgtctctccttatttgaccagagtccttctgtttttttttgttttttttttgtggataaataaacagaataaattagggctcgaaatacttatgatatgtattccaaaagacatagctttgatcacttaaacaagccacgcctagctgagaaagaaaaggctttggctggtttataagaaattaataataactttctggcctttaatttagataaatagaacatttaatttgtaattatatattttaatcatgcaaataataaattatctcaaccaacattataattttatatatctttgaggtcattatttttgtaaagaaaaacgctagaattgaaatatttattaatttagacgaatataagttggacaatttaatccatgtaagattaagattttgtatgccatcaatctaacaacttgtctagacaactaatgtttaacaataatttttgatactgcaaaatttgtttatgtgaagttacagaacttgtaggagttagattgttaacgttacaatactatatatagttgattcacgtgtttataggcaacatatcaaattaacatgtttgctttgcagttaaaaaattgttcaagaaataagccaaaattcatcgacaaatttggagctaggggagattcggtaggtacaaattatacaaaacttattcaagtaattaacaagtaaaataaataatcgtttaccacgtgcccatccagctgtgattccacttcaacttctgactaaggaacggaaaggcattccaagtttcctcaattaggctcaacttttcagagatgaaaagaattagtatgtgcaaaataacgtatagattcacaggatgatacaaaatctttcaatgacatggttagtcaacgtaaacaaatttgttttggaagggtccatagagatttttactaaagcaacgtggagttttcatgtgtttgcaaccgttaccaaaacccaacagttagttaacaactttattataatgaataaaaataacacacgagaattaatgacatagtgtcaaaaagaagaagaacaagcatgatattttatgccgactaaagtattgtgaccatttgttgttgctgaatcgtcatctccaactcctaacgttaggcacgttcttgaaaaatatcccataacgcaaattctagattaagcccggtaaagtaaacttgaaaaaattataatatacaggttctttatttaaaggaaaatgtgacatggcagtgaggagaaactaacccatcttcctaatggacaaatgtcagcagagccatacatttataaagtattttaatgattaaggggacgatgatgatgtcatcagtagttgagttgggggtagaataggtaattcaagaaatatgtgattgaaagtggaaacgtaagctttctggcttttgtgtcctctctgagtctcagtgtcgggacaagacatgcatcagcatcacacatccgtgaatcggtgctttatcctcttctatcttttttaacttcacgactagaaaattgatttttaaattttgttttacacaaactgatattaactacaaattaagaataacatagaaattaagaataagtttctagaaatgtacatcaagtattggccgttaagtttcaacatatttataccatctggcctcaattacaatcataattcataaataatcttctgacacttaataagataacttttcaccgagtgatatattcctgaaagtaaattcaacgctttagaataatgttcttatatatttaattatttaccaaatacacactatg

SEQ ID NO: 6027 - DNA, 3000 bp, Unknown
  misc_feature (1)..( 3000): cDNA_ID_1807967_gDNA_ID_1620837_Annot_ID_50818 3000 nt of promoter + ATG
ctcttcgtcaaccacaaacgcgtttcactcttcgttcacgtcggggaatttaaaaaaatctccttcgtaacaaaaaagagaaagatcaagaagattgtcgtgatggctgccggatccatggacggaatattccgcaacatctttgaaggttgcatctctagctgtgactcttccatccaacgacgtccataccacaagaactgcggttgtgcccttcacgagagatctcgcggtggaggttcagcgactccttgtcgtcatggaaggtctgaggtcgttatgttccctatccaacgatcttggagtgaaggaaacagtttggctctgcatcttgcctcatcttcttcttcctctaacctccagtcactttcgtcgtcttcgtctatttctacccttgcatcgttatcttcgaccgtgtctgatattgattctcccatttaaggcatgaactattattagttcccattcattaattttttgtcttttatttgtttgtttcgaagagagtcaaattatgtttggtgtgtgattggaaaggtttcatgagtttccttggatatcaaaggaaactaattcaaatgttgtaatataatggtcaattgtagggaggcttttctataaaatttgtacagaatcatgtatttgagcgtaattatagttttttttgtatgatgtaaatttatacataaaccgtttgtaacatcgagagatgaaatttggattggaatgcgagaaaaataattttattttaatttttgtaatatgatcttcaagctatttcttcttattttatgttcttcggttaccactgtcttcatattgttttgattatactacgctatcatttgcccaaatctcttgacattctaatgtagagttgttgagcgacttgctaagattgttttccaagaaaaaaaaaattgtgtattccatacgtctaagagaaaatatttgtttactatgtgacttaaaaaatatataaatttaattattttatagttatatttggtaatgactaatgacattcaatccgaatatctgatcattgacattcaatttgaattttggctcaaatagaggttagcagagataatccgtctactggattagctatactggaggagaatgtttttttttggttattgttctttcattgatcggtatttggagaaaaaatataatttttcaggatattgttcgaaagattaatataacgaaacatcaaatatgagtttgtcttcaacggagcctacttccctgcatacaaatatagaagcattaatttgggcgaagtaatgtctaacggccaagcagaagaatatagtttctttcgtcacgaacttttatgaactcataaaaatggtgacatggtgtacatgtcttcaccaaaagagtggcccatattttcgtcatatctcgaggaaatcgtaaagtgtaagtaaaaattttctcttgtttttctgtttcatttgtttcttatcgagttaatgctagaataggcacatgtacactagcataaaatgtccgcactaatccacaatttgatcatgcacgtaaatattgttttctcaggttgcctacctacttttgtttgttatatccttgataacattatcatgttctaacattttcaaccttgctactattgtaatatggtacaaaagaaattgaaatattttatgcatgagatgagacaaccaaaagaaaataaaaatggttaataaaatatgaaaagaattgttaacaaaaaaaaagtaaaccgcaataccttttttcgtctagtaaaatagtaaaactggagaattctctttctttttctctagtaaaccgtaatagtaaaatccgtcccaccatctaatccagtttggtaaaattaaacattttttttttgttctaataatatttttattaaaagaattataattcaaatcaatttaaaaagttttcttttgaaatggttatttaattttatagatttcatatattatatatattctaaacgtttttcgttaaatattctaaacattttagaaactttaaataactataatatttatctttaataaaatcctaagattttttctttttaaaagtaattaaaattgatggagatatattaaataaggaaatgctaataattaggaatattatttaaatgataataattaatgttaatgacattccttgtaaataagttccaacttgaggatttatttacaaaaatggttgcaaaaatatatatgtagataacatgtagataacatgtatttttatttcagttgtctttgatgtcagattgaataaccagtttgagtttttgtctcaagaacagtggttttgtaagatatttctttcataataaagaaacagtaaaaaagaaaaaccgcaatacttttcaaaaaacaaatatgaaaagaattaaataaagatagtaaactgaaagccttgtccctattgcattttgccatctccgtccgattggtgaggtgtgatggtgtttgtacttgtgtctctggttttagcatcctcttgattttctctctgtcggtttgctactggtttgacttcgatgtaaggtctatccaattttattggtgcttccgacgttcacattaggaaagtttggtgagagtttctgatccttttgctcatttttagtgcttaaatcttgtttttctcatagtttttgaccttcattagaattttgtctcttggtttgatttctttgatttaaattagttttcccatatctgttgggttttttcttccctcttttggattgagtttctggagacaatccattgatccaccgatttatatattttaacttgtatcctactttggtttttaataaaatttagaggacaacaaaaaaatagtaaactgcaagcccgacccagtaacctattaaggtccaaaacgacatcgtagaacatagcaagtaaaagaagaaaagatatagagatagagacaatgatatcatcatcatcatcatccaac

SEQ ID NO: 6028 - DNA, 3000 bp, Unknown
  misc_feature (1)..( 3000): cDNA_ID_1829692_gDNA_ID_1620837_Annot_ID_50819 3000 nt of promoter + ATG
tagtgagtcttggagatttggtcttcattccaccaccatgtgggctttgtgtagatttctcggtggtgaccggggatgatggtaggtcgtcgggaatgttgtcgtggtggtgatgattggtcgtacgaaaacatccggcgatgcaaaaccttgatttgagtttcttttgtagagacaagttggtcattgtttcgcttcccattttttttttacaaaaccaatgtttgttggttagatcaacaaaggaatgcaaaagagaaggaagacattgaaagaaagatcaaatctgtattagaggaaagaaaaacaaaacagaaaacaagtgatcgacgagatatttggttgattttcatttattattttttcttgaaatgaactgtttaaccaaaacttcggaggagaagttgaaattctttactattttaggaatatttgaatttccaattaaaatgaggttcaattttgtttcacgttaaatattaatgagtcttttgactttgtgagcaaggggggacatatttagggtaggaaaaataatatttatagtaatttattaaattagttaagattataaagttaaaaggataatatgaaaattttggaccaattttgatttgtgaatatagtaacggcatagctaaagcctaaaaacatttaatattaaaagacctcattggattttattttctcgactgtcacatttttgttttggcagaggtcttttatccatgtaactctattcagtatccacaaacagttttggaggatcaatatgggccttagaaatgaattaagatcatacttcactagagaatgtgcactcaaagaatgtgttgcgaggtttcatcgttaaatttgcattaaaggtaaggaacttgaagatcccatagcaaaattccatctctttggtgaagtcgttgtctagttgtcaccgaagctataaaggcatacttggaaatccttcatttgaaccaaattatttgctgccaggctgccagcagtgcctgtcttgtgaaaaatgaggctcaaaataactttttttttatgggtttatagaagaattttttttttttgagaccaaatcttaaaatgttatgaaaatgaaacctatgtattcaatagaaaatagataaaaattaaaaattgagactaaatctaaaaaatttagaaaatgaggcaacaaatatttttgaggtataattttgatactaaaaaccttaaaacttttggtggctcaatacccatgtttcttagaaatatgtcatgggccgggcctgactgccagtcaatggaaggaccatgagggtgtagataatgctatatatttgagattgtaaatatagctgataaactatatttacaacgaaaaatatttaaattctgacttagttaatgtaagtttaggcataatggaaacttttgtttataaatacgataaaataagccgtgggaaaatcgttttcgcactttcgctttaaacttttactcataattggtttgaaatttaaatcaatgaaaaaactaagttaaaactttaaattgcttcaaccttagttggttttttgtaagttcttcttatttttttcttgtttatgttagatatgatttttcatcaataaaagtagacgttaaaaaaaaaaaattacaaatcatttatataaaattgttgcattttcgaaagaatttttttatagtttccatttgatttttgtttctagaagtgtaataagaaaataaatccacttttaagttttgatgaattggataaccggtttgaacgaaacctggttttgatgaaatttttcccgacactgtaacacgataattagatttgttgagttataacattacgtgtcgaattttaattggatgtcctgcgtggccgtcttattagtcacatcaccgcagctaataacactcgacgagcgacctcatcgtctacatcgccgtcgcctgttaccgtccggtgctattctccttcacaatctcacatttttcgtaccggttagaagatgagaatcacgcagatcttgttatgtctggtaatagtggcattgtcttcaagctcccatgtctggtccgatcagatcttcccagctcatctaggtctatatcatttcctctcttctcataattttccgatcaatttcgagttttgtcttgattcaatgttttatgtatagttggaacattcagcagaaacaatcgtgaaccaaagtacaagattgagttccttcctgaagattcaccttttcacccggtaataacgcaatcttaagatagatttcaaaaagcttaatttttgcactaattgaatattaatagtagagattctctgtgattttggtgtttgatctctaatattgttattagtcacactttagatagatttgaagcttacgttttctctatgacatgatttactatgagtagagatagttgtaacatagagattgtcactaacagggttagaatctggaatctatggttatggtggattagattagcttttttaaatcacaatttagattgatttgaagcttatttttgccatgtgacctgagttacaatgattagtgatagttgtaacatagagatcctccgttgttttggtgttttttattctctaatattgttgtttatatggtggtaatctggaatctgtggttacgatggataagagtatagtagttttgaaacttattttgcactttgatcttaagttacaatgagtagagatagttttaagttagagatcctctgtggttttggtgtttagattctctagtattgttttgtatagggtgagaatctggaatctattgttatggtcgataagtgttggcttttttttttatcacaagctattgatttaaagcttatttttcactttgacatgagttacattgagtagagatagttgtaacatagagatccctctatgattttggcgttttggttcgctaatattggcttttatagggtgataatctggaatca

SEQ ID NO: 6029 - DNA, 3000 bp, Unknown
  misc_feature (1)..( 3000): cDNA_ID_1829684_gDNA_ID_1620837_Annot_ID_50821 3000 nt of promoter + ATG
cgagctcctatctcaaaagatctttttgctctcccacgagcgcacatctccaaaatcgtcaagctctcccacgagcgcctatctccaaaatcgttgagctcttccgtctcttgcgagcacatacatccaaagatcttaaagctcttccacgagcgcctatatccgaaatcatcaacctcccacacgagcgcctatctccgaaattgtcaagctctcacacaagcgcctatctccaaaatcatcaagctctcacactagcgcctatctccaaaatcgtcaagctctcccacgagcgcctatctccaaaatcgtcgagctcttccgtctcctgcgagcacatacatccaaagatcttaaagctcttccacgagcgcctatctccaagatcgtcagacactcttgctagcgcctatctcagaagatcttatagatctcccacgagcgactatctccaaactcatcaagctctcccatgagcacctttcttcaggatcttcaagctctctcgcatgcgcctatcttcaaagatcttccagctctcccacgagcgcctatctccgaagatagtcaagctctcctacaatcatctatcttcgaagatcgtcgagctctcaaacgagcatatatctttccacctattgcgattctccgactcttgcaaaaatccacacttgctcaaacaaagaatttttctttggttcgggccaaattggcatgtttccggtttcagaaaaatattcgccaatcgcaagaaaccttctctcgacgaactcgggggggactaattatgggatacgggctttgccctctatgcccaattcggcccaaacacaaatagaacaagtcaataaggctcctaacaaggaagaacggcccatcagaacaacggcccatcagaatgactgctcggcccatcacggctcggcccagcctgataaattcagaagggcaaaacggagatatcgcaagagagactaagagaaccctagatcagcttcttgcctataaataagaggagatccactactaagaagggattggagaacctaagtcaccacttagagaatttaagagagaattgttgcctagctctttatctcttactttttggttttccgttctgtattttcaggttttccgaccattaatattagttttccgacttgtactttcggttctccgttctgtacttacggttttccgttctgttaattactgtctttccgttcgtcattaataaagaagttactccgttctccccaaaccccttagttatttattgttacaacctcggtacaaacaagaggaaagacaatttagatttaatttcaccttatcattgattatcgtttttattataatcgcttcatatgctccaactttctaatgcattaccttgatgatgagtctttagatttgctgacttctttagcagaattggcagtaaaaccctgaagttgtttggaaagccaacagatagacgaaacagatttttaaacaccgagattacattacggaagacatctgaaaacataagaaaaaatgtaaaactctgaacttaagtaagatgctctctggctttttctgttgatcaaaactcgaccatgggatcattggttcatgggtctattcaagcgtccaggtaattggttcagtttgtaagtgattgaaaaaatctcttaaacaaagaaacctgataataaaatggatgatgagttgaagttgatgttcgaacttttttgacaaattttttccggtgagtttccggccaaattccggccaaacggctgaacggatttgtcgggtgattagtgcattggaaagctggtaaagagttttacaaaatggtatactcatacgtcaaaaacggagttgtattgaatgagaaataagggtgtaaagtgggacacttgggccaaaccggaccgaaccaaacaaaaccaagctgagccgggctgcgggttgtcgggacgtcccgtcatcggctcaagggctgtcgggcttgcggaccgtcatgcttgtgagttattgggcttgctgagttgaatcttatggaaatattttcaggatagtctcaaaatattctcagaataggatagtctcagaatattctcaggataatctcaaaatatatcatgcatatcctgaaaatattctcacaaatcttatccccctctactatataaagagatccagcgtctcattatttctcaagctctcaaacacaaaacactctaaattctaaagtctctcctctctctctcttgcttcttaaaagtaagttcttagtttagtagtttcgagagtatatcgtagatctagttcgcttgagtctaatacttgtgtgctcgggtattagttcgtgatcggttgtatcctgggattcaaaaatcgtgatgtccaaaaagcacgtacggccgatttattgaattaaggaaaaagatatcatatcttgcctccgtgatttactttctgtccttaattactgttactgtaattttattgttattgttatcttaataaaattcgtacttgtttctcaattcggtttttgggctcctacaatcttaattcaataaatccgcttttagcttatcgctctagacggattgagaaattttcgaattttttaaaacgatttcaaaatcttctaaaaattgtttccgctatcatctttgggtgcttacgtagaaggtttatagaagaacgttattacttctttctttctcctctttctaaactgcttcgcaaacgctacgtagcgattgttgtgaacagtttcttatataaacttctctagtttccacgaacactcatacttgaggagtttgggaaacgcgaaacaagtttctgcgaatgcttcttaagcgagtttgcaaaactaattcggtgaacagaatgactgatatcggtgaaatttgcaaaacaagtttctgcgaacgcttcttaagcgaattttttggttaatatactaatcagatctttttttttgtgaaccga

SEQ ID NO: 6030 - DNA, 3000 bp, Unknown
  misc_feature (1)..( 3000): cDNA_ID_2135207_gDNA_ID_1620837_Annot_ID_169928 3000 nt of promoter + ATG
ttgctgcctcgttaaaaaccttttcatggaaaaatcaagtgggataaaaaccatgataaggaaaaaagagtacagccacgctcatcatcatatgtctcctcctggaagcatcttcttcaaaagatgaattttgatatgtgaagaagatttctgaatgttgtagctcgaagcgcttttctgctacattgtgttttgggcgaacgtactggaaatcaatttcttgatttttcttgaggtcttgaatgtaacagaagaatcttggagaaatatttcttgtcatgtcgctcttgacatagcttcctttgaactgggaaacatatgcaacattgtcttgttgttgactcttcattggtgactatattgcttgcttcttatatatgttgatgacgttaatctaagccatacatctttttgacatgcttcatgaagtgcaataattttggcatgacttgagcaagctacgaccaaagtctgctactagaaacaccgcgagcttgttgttttgcgatatatttttatatggtttgatataaatccttcatctataaaacttattaaaccaaaattcgagatttctagaataaaataagtccaactcaatctaaccttgcagattataaaggacatgttcttacttatctcgatgtctagccgagggagatgagttaatcctgcaagtagatcaatagcaaatgctagatacaattcacaaaatatataaatactcgtcagcatttatatatagtgtttcatgaccaaatatatagagtcgacttcctttagaagtgactaatataacatcaattactttagatgtttagttggaatatctggagacacttttgtctttccaagatcttttattccaattaactctttaagagttttgatgatcaaaatcattatgtttataaattccagggaatataattataatatatatctttcaaggattagttctttagacatcccatgaggcgtagttaagttatttatatagcatcaattcaatatcgagtgattttgacaaatcccggcgcgacacaccgttttgtcttaagtatcataacactctttttgatgtttggaccatatgtccagaaattactcgtttcttatacgagattaatatagacttgactctctttatttattggccaatatatctctttacgctcacagagcggagattcatgatcctcattaattacattacacgctagatcattataaatgattttatttaggtacctgattttgttattaaccatgtcaatcggtctctttactcttcttcaggagtctctttactcttctttaagagtctatatgctcctcttttaagagtttaatcctctatataacaatttgctcttttttcttttcgagggttttctttatatttgaaaccaaaaatgtttatcacgttctttaacgtgttatagacaataatatgtcatctgccagagacatattttttttttggagcatttttagctgggatatgagtttttctatgaactctctaagttcatatttatttgtatgaggatcaataattttataaaatctcattcatcagctgtttgcatttgatttgcaatatactctgaatagtgatcattttgaatttttgaactcttaagttcatatttatttgttcaaagatccaaactattcaataaatcttccatagtgatggagaatttttatcatcaacattatgatttgcaaatcttgcaattggcacatctctaaaagatggctcaatattaatagagtgaagatttatctccaacatctctaaatttcatcctctttggatgatatttttatgtggtgcagaagagcatttataatatatatctcacacccataaaatttaaaatgataaatatttgatctctaatcatgtataaataacatgagagaaatatttcttatgaatcgttggccttatatagaatcatcatgttccatataaaaacatggagattaaatcatcataaattgttttgcaatcacttggatttgcattatgaacgatttattaaagctcaatttgagagtaaacatcatttttagatgttccactttatgttaaagtgataacttttaggatatgacttcaccagagttatctcgctctagggcgtcaaattcaccaaagtttatcgacttattatcgatgtgggattcctttaattctccccctcgagataataactcttaaagtttattcatctcgaaatgaatctcactttaggatcaataacatgtatgaacgggatcatatatttaaatttggatcctcttaaaaatgtgggacttgtaattattcctcccaagattatggcttttcaagcctatttctcttgtaccggatctaattttagatcggttatattttagatttaatttggagaatatttaggaaatcgaccatcatatactatgagcttattaaaaaaatggtgatttggccaaaaatcatatgattctggaggcatagcctaccacaaaatgaaggagaaggtatacaaccatcgaatccataatatataaataaatttaccatatattaaattttaccatctttatttttgtatgatataatcatacatgtgtgtgtctccattgtggtcaaacatttgacaccatattaatttatagtctcaatataataataataaatatctttaaaactgtacgagtttccttggagactttggaaaacacaaaacatcgattattatgaatctgatgtatttggaagtcgagagactagctcatctagatcttctcattatttgtgcactttctaaacatacatcgacaagtgcttcatatattctcataagaaaactatatttttaattttaaaaatactttaatgtttttaaatattatgtaacacatattaattttttacgaataaaaccaatataaataattaagcatatatgttcaataacaatttgtagaatagatgaatgaatg

SEQ ID NO: 6031 - DNA, 3000 bp, Unknown
  misc_feature (1)..( 3000): cDNA_ID_2135234_gDNA_ID_1620837_Annot_ID_169937 3000 nt of promoter + ATG
gattcagcttggtaaaaagtgttaggttcgtaacgacagagatagtgtctcatgtagttctagttcgcattttttggactagataggactgggtgggcgcttatactttaggttgggatgtgtttaaaagaaaaaaaaggggttgattcattgatgagaaaaggtaaaagactctaggtgaagtaagctaaagaagcagaaaaagtctagtaaaggttttgggatttgtaaaaaaaagaaagagttcttgttagctattgaagatgggcaaaagccctcggttttaaaatgttaaaaacaggaaccttagttgttaaagaaatccaaatccgctagatgtatcaaagtgttgagaaagcttttcctagagttaagagaaaagaaaagaatgattagaaaaagggcttaaaggattcatgaatgcaaagggtagaggtaagttcttatactgggattggagatgggattaccattaaagcttcatctgatatactctaggtagatgggattttatctctgcatgcatagcttgggacttacctttagcattctactaaagcttaatcattttttgagagatcccctgttactgaagcctattctgtaagggaccatctttgtctcttgaccttttaccttagccaaatgagttcattgatgatgcattgcttgattcacgttccagaactaatgaatgttaaagggattggtagatttgaaaacatgtgtaggtcgagcatatgagtcggattgattgatagtaaggcatggctaaagtttttcagtagaattcgatcatatcgcagcttagaactatcaacttggacattgatttcatttggtttatctagtgctttggctctgagtccccgatttcaaacctcacctctagcttgttcttaattgtttgcttgagggcaagcaaagactaagtttgggggagttgataagtgtgtattttgcatgttttaagcatccatttgtcatcactttagcaccatatcatcactattttataccatttctcatcatttgtcatcactttgcatgtttaggatagttttgcatgcatgtggcatatttgtgttgttttcaagtgattcggagctgttgaagaactaattggaagaagcggacctgatcatgccaaaccactcgacctcaggtcgagtagacgcttcacgacctcaacacaccactcgaccacctggtcgagtataggatttcaccacttcacctcatcactcgaccccctggccgagtaccccacgagagtcactcgatcacttcactcgacccccaggtcgagtgtcttcacctccaccacctgaccatcacttgatcacacgactctacctggaagtcgagtatcaccatcaccaccactcgactacatactcgatgtcgagcttcagagtcttctccattccgcactcaaccagacactcgagcacaaggaaaaaaagaagattctagcttatcactcgacctctcactcgaccacctgggtcgagtacagttcttaatccgtctcaatactgcgtcgttttgagtattagggtttcggaatatttttgctataagtagcacgtactttacattttcgagaacaagttttttctaagttttatttcgcagacactgtgttcttgaccttttgtaatccggatttctctttatctattcagtattaaatattcggtatttgttcttgatttcgtttactgttgttcatcctgttatcaccttgctattacattgttgttatcatgttttcactccattcaacgtttatgttttcttcaatgatgtctcagtagtgaataggtttctgaggatggattagagtagtttagaattctcagtatgctaggtggttgagtttgattgatagatcccttctggattagttgttcttaatgcctattgctttctgatcaaccagaatttgagcccagacatttccgcgcccaaaaggtgttcgatgaaatgtttaaacaactaattccagagattcgtgtccctgtaccaaagtattggttgcagggagcgttttgcctttaacttgttgattcgtaatgcctgttaggttagctctcgtcaatggtgattgagtctgggactaggttaacttgagggtctctgttgcggtggtacttagatttggttaatgaacttgttgtgtagggataatttattgagccatgtcaatcacctgtaaactgaggaaacaaaactactcaattaccccatcctcgagaattctttatctgattaattttattttttactctaccgttgtttactgcatcttgtcatctgttgcttagtccctgcaattctttgctgttactcgacctgatactcgaccacccagttatctggcaacagactctgcagtcaagtatccctgttacattttctgtccgttactcgacctgtcactcgaccacaccctgtgttgagctgcatcgagctgtgttggtcgagtgttttattgtttctacttgattttctgttttctgcatgttcacttaggactgctaggacacaccaaaatctgttattgcttggcttgacttagtgacttctgatcacatcttgattgttagcatcacacccatttggattgatacctaaaatactacaacgacatgattggtgttttaggataattgactaaaaacctattatcaacccagaacatgtgggggaaaactttgcttaccactaactacatccttaataggataccacataaggtgactgcaaagtcaccacattaactttggaaaggtacagtaccctcgtacaaatacctaaaagtgtgggggtgtctaacaaaagtggctgtaccacctcccaaaaaggtcacaattgggcctaagactatagactatatcttcatcggatatgcgcacaacagcagtgcttatcgatttcttgtttataaatcggatattccagatatccatgaaaatacagttatagaatcaaaga

SEQ ID NO: 6032 - DNA, 3000 bp, Unknown
  misc_feature (1)..( 3000): cDNA_ID_2135271_gDNA_ID_1620837_Annot_ID_169951 3000 nt of promoter + ATG
ttatctttgtgtggatggatctattgggggaagtaccttgtatcctaccacagacggtagtgaaggtattagcgaagaatacgattacaacaagtggaatgatgtaatagtagaacaatatgtacaaggaaatcttgaggaagacgtcagtctcactcaacagactgctcaacatccaggggaattcagtcgtttattggaaacgtgtatgtacacgggtgttagtgtacctggcggagatacaggggaattcagtcgtctcttggaaacatgtacgtacactggtcttagtgtacctggcgaagaaacaatttctccattgggtttatggtacacgctgcgaagggcaaagggattccaatcttatttgtatagacgaagtcaccgcggatgaagtgatcgacggtattggagcttcctcaactgggacactgaatgataatggggtagttaccgcagctgaggcttaccaagtgtataatgaatttcctaagttacatggtggcgagttggcgaatctcggtaacgatgctgctcctgtgttcgatgacttactcaattttcgagctgatgagacacaggctgaaatcagcaccacatgcgaaactttgtttgttggaagtgtttttaagaatagaaaagtcctgcaacaaacaatgtctcttcaaccgataaagcaatgcttttgcttcaagcaacctaagtcatgtcctaaaacattgaagatggtgtgcgttgatgagacttgtccatggcatttgactgcctgcgtcgtgaaggattcagaaagtttcaaaatcacttcgtatgctacgacacatacgtgtaacatcgactctcggaagaactacaataaacatgctaattataagctcctcggagaagttgtgaggagcagatacagttctactcagggtgggccgcgagctgtcgatttaccacagctgctcctaaatgatctgaatgtgcggatttcatattctaccgcttggagagcaaaagaggttgcagtggaaaatgtaaggggggatgagatagcaaattacaggtttttgccgacctatctgtatcttctccaattagctaatccgggtacaataacacatctacactatacaccagaagatgatggtaaacagcgcttcaagtatgtctttgtctctcttggcgcttctatcaaaggtttgatatatatgaggaaggtagttgtggtagatggaacgcaactagtcagaccttacaaaggatgtctccttattgcatgtgcccaagatgggaacttccaaatattcccaatagcttttggtgttgttgatggtgagaccgatgcttcttgggcatggttttttgaaaagttatcagagattgttccagacagtgacgatttaatgattgtctcggacagacattcatctatatacaaaggcctaagtgttgtttacccgagagcgcatcatggagcatgtgctgttcaccttgagcgaaacctctccacctattatggtaagtttggtgtgtctgctttatttttcagcgctgccaaagcttatagggtcagggatttcgagaaatattttggactgttaagggaaaagagtgctaaatgcgcaaaatacctagaggacataggatttgagcattggacaagagctcactgtagaggagaacgctacaatatcatgtctagcaacaactctgagtccatgaatcatgtgttaacaaaagcaaaaacttatccgattgtttacatgatcgagttcattcgggatgtcctaatgcgatggttcgcatcgaggaggaagaaagttgctaggtgcaaatcttctgtgacacctgaggttgatgagagatttctacaagagttgcctgcgtcaggtaaatacgctgtgaagatgtctggaccgtggagctatcaagtgacaagtaaatccggtgagcattttcatgtcgttctggaccagtgtacgtgtacgtgtcttaggtacaccaagctaagaatcccatgtgaacacgctctagcagctgcaatcgagcatagaattgatccgaagtcttgtgtcggatggtggtatggccttcaaacgttttctgattctttccaagaaccaattctacctatcgcggatccgaaagatgttgtcatcccacaacatatagtggatttgatactcattcctccatacagtagacggccaccaggaagaccactgtccaaaaggatccaatctagaggtgaaaaccgggtatgtactaacatcgttcattcatctacttgtattttgagtattaccatgcggagatttttaacttcctatgtacgtcacttcagaaaaagagacagaaaagacttttaccaaatcagtgtttcacgctgtcgacaagcaggtcataacaagaagacgtgcaaaaatccaatctagttctggtgacaagtttctgagccggccaatatagtgtacgcttctgtgttttctcggtgtacgtaagtttatatataatccacctaactatgtacgttgtgtacgtacgtttaaactctacgttcgtataactatgtacgtttttgtctgtgtacgtgttaaagttcatgtaataagggtacatagaggtggttgctcaatattttgagtaatttgaaataagttttttgaaaatctaacttattccccctcttaaatgaacggagttggagatatggttgggtatattgtggttatgttggtatttaatggaaaggacgtaactgttgctgtttattgtcaaattaacgttataattaccctatatgacggttaccaagctattaccaaaaatttgaatcaagtgtagttggaaccgcattaataactgtagctgttccagatttcttctatttaagtctcctcccttccttaattttatccacaatcctcattctaaatccatttcttctgccggcagttatatcattcacaaaaattttttttgtctttcgattcgcttgttcttgctatccgtgag

SEQ ID NO: 6033 - DNA, 3000 bp, Unknown
  misc_feature (1)..( 3000): cDNA_ID_3079216_gDNA_ID_1620837_Annot_ID_169950 3000 nt of promoter + ATG
tcagcaactttatagagacgacaagggcttcatatgctgcccgaccccatggataagtcttcatggctttgtcgtcgaaaactcttttggcactctcaaatggtatcctagagttagtatgcaagccaaaaagtctaatggatagaagagtcaataacccaaaccatctacgcttttcagtaggccaagctctgcacgttactaagccctgcctaagttcatctagattaggaccttcaccggttggcacatgcaattcactgaagaacgctttgtagtcagctgcaggcacaaacttttctgtaggcagttcatctatatttaaacccgtgatatgatgaaattcgttcaatccaaaccggatgggtttaccagccacgatacaccaaagctccttcttcagtattctcagttgtctgcatagtagataatgtacggtcttaccagaccatagaaaataactatcaacaagcttagcaattaatctaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtcataacataaaacaaactcatccacagataccataactcaggcaaaacataaatctaactcagccatagataatataactccgtcataacataaacctatctcagccacacataacataactcagccataagataaatctaactcagccatattttaacagaaactcagacatcgatgtaaggttaaaccataactcagtcacagcataaaacaaactcagacacggatgaattgataaatcataaatcagtcggcaaacaaatagtaactcagccgtcaaatcaaatagatctaagaaatcggccaccatatgtcaatcaacgacgacgttaaaacccagctttaaaaaccatcgttacgcatcggaaaacgatttcagtgacgggaatcacttgagattgaacttagatgtcagagtcttacttaatggaaacatactcactggaacttagatgtcagatgtgacttcgcgcttacagaaatgcgactccggcgtctgaatttcggccggaacagacgagaaaagagcaaaacggcgaaagaaatcgattttgttccgtcgagagagaaagaggaagaaagcgacagtttttttttttttgggagatgatgaacagtaaagccaagaaataaaaaacccaaacgttatgcggtttggagatgattaatgacgtggattatcgtaatgacatggaatgatgacatgtataatcactgttttttaatttaatttttagttaaaaacgaattaaataataataattaattaaaactagttagggttgttaattgtaattacacaagaactgaaaacatctgagtaataaaaaaaaaatgtgttctattctaggaataaacatacaaatgtgttctatcttaggaattatttctatataatatgtatatgttcaattgtgatccaaaaataaatgtttcactacatattatggaaacaaattcgaataagtgttgatgcaaaatcacttaataatcagataactgaataaattttagaacaaaaaaaatggatcttataatgtcattgttttctagcaaaataatatgatctaccggggatcccatcctcggtggtgaactctactgaagtgtggttaactctgttgaagtgtgatgaatagtgggggagtagttaggtgacgactctgcttcaaatgtgatgaagtctggtgacgagtaacatgagctatttcacttatccctacaaacccatctacattaataacatcttgagagaaggtcaatctctactcccccactattcttttcggttaacttagatgccaacgcttaaaataaggtggatagttgagtccaatataactctaatatttttgaaagtgctgttacgagtttttttgaatgcttgtttccgagttcatagattgcatggtataggttattaatagcatacatgttcatcctacagtagtaagaaaataatgacagataaaggaaattacgtcacatattattggttcttatttgacttttcagcattttcccgttgttgttttattttagggtaaattgcaggccacacctgttgaccatgttttatttccatggattgtcaaaatcaaatgtggttttcaccatttatcttttcgcctgcaaaatgacgcttctgcccttgcgcttctctcttagtaactgttgaaatgtacggtttagtttagcaggtttagttacgtacactgttccggttcagttgaagattttttgtttcacgttgacgcgattcggttccgttacaagtgagattatttccattattccgaagtgacatcaacatttaatgcccccaaaaagtttagacgtgactattgtcacaattaatgcaaaatcatcattacatcaaataatattaaaaaaattattgataataattaataaaaaaattgttgagataaagaagatgaacccaggaacaaagaattattgagaacgtacattgctgctgaagaagtgttgatcttgtttttgtaccaagtttggagccaaaacaagcattgttcgtgtaagtaatgaagttcttttaagaagttttttgttatgtcatattaggatcttgattgtgttcgaactccatttttttatcagaaaatttgcaaaatctatatttgtttgtttaaaatagtcaaatgataattggtatttaggtttataaatgtgtagtatcgacattccatttgtttttttatatgtatagtatttttcagttgcatttaatgtgtgtctcctgaatttatgatgcaggtgggttatggatattcccgtatttact

SEQ ID NO: 6034 - DNA, 3000 bp, Unknown
  misc_feature (1)..( 3000): cDNA_ID_2135224_gDNA_ID_1620837_Annot_ID_169934 3000 nt of promoter + ATG
aatctcgtccatctcatagcacacatagtcttatgcttgctaattagctcgtcaatccgatatacatgcccgtcaacgctgatctcgtcaatttgacagttcgtgctcaccaactatcaggtcgtcaacccgagaattcctattcgtcaactgtcagctcgtctatccaaaagttcctgctcgtcgaatgttaaatcgtcaaccccgacagttcgtgctcatcaactgtcagctcgttaatccgatagttccagctcatcgactgtcagctcgtcaatccaaaagtttcttctcgtcaacagtcaactactcaatctaccagttcttgctcgtcaaatgccagctcgtccaactaccacatcgggctcgtcttcaagcttttcacatctcctcagcaactatctcctcgtatacatatcggttcgttacttaattgcaaagctcgtccagctcgtctagctcgccgacccagttaagaagcaatgccaaccttagaagaagtcttaccgaccaagtcaagtaacctcatcgaccttttactcggagaacttgcgatcgagtaacttaaagaccacaccaatcaggtgcaagaggccttgccgactcgaccaactagtcgacccgacgacttgaagttgctccaaccttgggaagtaatagcgtaaaaccagtcaaaaggtctcaccgaccagagaagaagtcttgtcgacaaggcgccaaacacaaaaatctttgaagtacaaactcattggagcaacgacaatcggcaatatcacatggccaaacatctcaaaagaaagagggaaagattattcgcaaccaaattgtcaaacccgttccccaccatgagacgatccagtccaccatactcgctgaactctccctcatggtcgctaagatccaatccattgagctccgcattaaatccgcgataactggaggtggaacgaatctctcaacctcgctagaccgcacatcatcttcgccgagctccgcttctggctcctcaagctcgcctctccaacgaatctcgccaactcgtcgagcatcctctaagccgagctccacacttaacagaattgtcgcaaaggatagctcacggtgatcaaagtaatccgcaaaacaaacttcttctatgacgagcttgcttctccctgtgtcgatctctccactatcctcggtgtgttcacctcatttagatctcacgctgaactcatcgcctagcatgaagacaacccacccagtccctaaacccaacttaccaacgtccctaatcctctttggcagatcaacatggctaagcgtgacaagccttgtgttggtttcctgaacctgaatttccgcgacgacggatacgctcagctctaagcgcatacatcaaaattaaaaaaaaaaaaaaaaaaacgctcgcttccgagctcatttgctatatagacaacaattggtttaatcccttctgggtgatacatatgcaacttcttctaaacgttatttttctaacgcgcacacaagttactactacaagtctaacttttacgagtaacacttgtcatccccacatcgtctccctggccaggagttcgattctaaaacgcgttcccacatggatgcagtggtgctcgttagataggtctaaaaaacctgttttcgaagaaataatccacatctttacttaagtaagctaaaacttacacttaaagatttaaagccgacccagattcgaactaaataagctgatagtaaggcagaacaatataagccgagtccgctcgcacgttctcgcttacctagaggcatccacagggtaagccggacaccagcgtcgcacctacaaagtacgacgagtcagtctcgcatacttcatacgtaagccttgtgattcgagttcaacgtatacaggataagtcaagggacgccttgccctataatacgtttcgaaatcaagcttaaacgccaaggaaaacctcgcaaaatataagcttaggataaccttgcacaaaaaactcaagaacaagcttcaagtcatcactaaattctccgtctgtctcatcattgtcacttcgtctctaagacaaactcctaattgcgtatttagataggataagccgagctgcagatcgcaccgaatctaaatttcgcaacataagccaagcccagccttgcattctaatctgaagtcaagcttagtctcgctcccaaataacaaacaatatcatgctgaatcaaactaccagttacggttaagccgagctcgatctcgcacatacaaagatcatttcctttactaaaatgcatgacgaagacatgatccacgacataacttaaagtcgtgccgatctccccatgcctaaaagaagatccgtaaaatcaacatcatcactcagtcttacgtcatctcctcgctcgccaaaacaagtttgccgcactcacggccataacaatccatcgtaatgccaaccaagtttggtaccacgcaaaatcaaccaacattcacactaatcgttttcgacgattgtgctaagcggacctacttccttgctactcgacacggatccacaaaacctaatgccaatccccgtaaatctatatccactaagcaagcgttccctgtcaagcgttccttgtagagcattactcaccaagcgttcttaacaaaactgtcaaacgttcctagctcaaaaacctcgaacgttcaatccttgcctaacaagcgagcgttacttaccaagcgttcatcgcagaaccaacaagcgtttctagctctaaaacacagagcgttcagtcctcaccgaactacaaagcattctcatcgccgaaccaaacgattgagcgttcttcaccaagctacaaagcaatcttcatcaaatcgccaaactaatctccagtcttgctaagcatcaataatcataacgagctacacctttgtcgatgccacactacatttatcacttacaaaacgttcaacctccaccgaaccttctcactatacaaagccatcac

SEQ ID NO: 6035 - DNA, 3000 bp, Unknown
  misc_feature (1)..( 3000): cDNA_ID_2105868_gDNA_ID_1620837_Annot_ID_169927 3000 nt of promoter + ATG
tttcgagatcctctaaaactgacaaaaatgagtttttattgtaaccctctgcctattccatattgctttgtggaaatgcttcattggatttgattctctcgaataccaacatttaagtgcaattttagtggcagtggacatatatgcgcaagtgtgcacatcttctcggcagtggatgttacagtcacttttcgagagattttcagttacatggccttcctcgatcgatgttttctaatcgttattgtgtcttctcataacaattatttcgtctagtattgctttccacctacaagctggtggtttttactcatctatgatcgatttgcttcttttcaacttaacaagtggtctttttggcatgcatgtacagagttttggaataattcatccatccattcttctttacaatatacacatgaccatgaaaaactacattttctatatcgtctattctggttctggtacaagagttcattatgaaacttctacaattctttcatatttctctatgttatgatcaacaaaaaaatttgaaacgacgacattagcattggcatgcacatgtcaaatagtaaacactgtccgatcccaactattattatatcaacaacaagttttttttttttttttttctcaaaacaacttttgtatttacatttgctaaaaacatcagattatttggtagatagaaatgtgtgattcattctttaccgcaaaaggttttgaaccgtatacgaagaatccgcggccttggccgaagaaggcggtgaatgaggcagcctagcggagaagttacgtagcggaaaacggtcgatattgtcatcctcatctcctttatcaaagttaagcgcatagctcgacggatcgtaatgaaagtcagcagtatggcggcgaatatgcttcccgtgaccgccaacgccacctactccaccgcccattcgatggatcagactcttacatttttcatgtgacttggacaacgtcctagtgagtcttggagatttggtcttcattccaccaccatgtgggctttgtgtagatttctcggtggtgaccggggatgatggtaggtcgtcgggaatgttgtcgtggtggtgatgattggtcgtacgaaaacatccggcgatgcaaaaccttgatttgagtttcttttgtagagacaagttggtcattgtttcgcttcccattttttttttacaaaaccaatgtttgttggttagatcaacaaaggaatgcaaaagagaaggaagacattgaaagaaagatcaaatctgtattagaggaaagaaaaacaaaacagaaaacaagtgatcgacgagatatttggttgattttcatttattattttttcttgaaatgaactgtttaaccaaaacttcggaggagaagttgaaattctttactattttaggaatatttgaatttccaattaaaatgaggttcaattttgtttcacgttaaatattaatgagtcttttgactttgtgagcaaggggggacatatttagggtaggaaaaataatatttatagtaatttattaaattagttaagattataaagttaaaaggataatatgaaaattttggaccaattttgatttgtgaatatagtaacggcatagctaaagcctaaaaacatttaatattaaaagacctcattggattttattttctcgactgtcacatttttgttttggcagaggtcttttatccatgtaactctattcagtatccacaaacagttttggaggatcaatatgggccttagaaatgaattaagatcatacttcactagagaatgtgcactcaaagaatgtgttgcgaggtttcatcgttaaatttgcattaaaggtaaggaacttgaagatcccatagcaaaattccatctctttggtgaagtcgttgtctagttgtcaccgaagctataaaggcatacttggaaatccttcatttgaaccaaattatttgctgccaggctgccagcagtgcctgtcttgtgaaaaatgaggctcaaaataactttttttttatgggtttatagaagaattttttttttttgagaccaaatcttaaaatgttatgaaaatgaaacctatgtattcaatagaaaatagataaaaattaaaaattgagactaaatctaaaaaatttagaaaatgaggcaacaaatatttttgaggtataattttgatactaaaaaccttaaaacttttggtggctcaatacccatgtttcttagaaatatgtcatgggccgggcctgactgccagtcaatggaaggaccatgagggtgtagataatgctatatatttgagattgtaaatatagctgataaactatatttacaacgaaaaatatttaaattctgacttagttaatgtaagtttaggcataatggaaacttttgtttataaatacgataaaataagccgtgggaaaatcgttttcgcactttcgctttaaacttttactcataattggtttgaaatttaaatcaatgaaaaaactaagttaaaactttaaattgcttcaaccttagttggttttttgtaagttcttcttatttttttcttgtttatgttagatatgatttttcatcaataaaagtagacgttaaaaaaaaaaaattacaaatcatttatataaaattgttgcattttcgaaagaatttttttatagtttccatttgatttttgtttctagaagtgtaataagaaaataaatccacttttaagttttgatgaattggataaccggtttgaacgaaacctggttttgatgaaatttttcccgacactgtaacacgataattagatttgttgagttataacattacgtgtcgaattttaattggatgtcctgcgtggccgtcttattagtcacatcaccgcagctaataacactcgacgagcgacctcatcgtctacatcgccgtcgcctgttaccgtccggtgctattctccttcacaatctcacatttttcgtaccggttagaag

SEQ ID NO: 6036 - DNA, 3000 bp, Unknown
  misc_feature (1)..( 3000): cDNA_ID_1829680_gDNA_ID_1620837_Annot_ID_50823 3000 nt of promoter + ATG
agaaacatagtcaaccttttgccccaacaaccactcgatgactgacgaaaagaatcaacaaaatggccatgtcaacattggtgctggagatgcaccaagggaccatcgttagaagaaaggaattgcacctcctgctatccagaacaacaacttcaagattaagagtggtctcatctcgatgattcagggaaacaaattctctggtttgccaatggaggatccactcgaccaccttgatgaattcgataggctctacaacctaacaaaaatcaatggtgtcagtgaaaacggattcaagctccgtttgtttccattctccttgggcgacaaagcacacatctgggagaagaatctgctccatgactcaatcaccacctgggatgattgcaagaaggcttttctatcaaagttcttctccaacgccagaactgcaagactcagaaatgagatctccggctttttacagaaagctggtgaaagcttctgtgaagcatgagagtgttttaagggttataccaaccaatgccctcatcatggcttcactaatgcctctctgctcagcactcattatagaggagttttacaacgcatcagaatgcttctggataccgccagcaatgggaatttccagaacaaagatgttgaagaaggctgggaattggttgagaaccttgctcaatcagatggtaattacaacgacgactgcgataggaccgtcagaagcacaactgactctgatgacaaacacaggaaggagatcaaagcgctgaatgacaagctagacatgattcttcttagccagcagaagcatgtgcacttccttgttgatgacgagcaatatcaagtctaagatggggaggataaccagttagaagaggtcagctacatcaacaacaaccagagtggctacaaagggtataacaacttcaaaaccaacaaccccaacctctcctaccgcagcaccaacgttgctaatccacaagaccaagtatatcctccacagcaacaacaaggtcagaacaaaccttttgttccctacaaccaaggtttcgttcccaagcaacaatttcaggggaactaccagcaaccaccaccacctgggtttgcacctcagcaaaaccaaggtcctgctgctcctgatgctgaaatgaaacacatggtacaacatctgctacagggacaagcatctaactcgatggaaattgctaagaaattatctgaattgcaccataagctgacctgaatgccaaaatggaggcattgaataccaaagtcagatacttagaaggccaatcagcatctacctctgcacctaaagttacaggacttcctgggaagtcaatacagaatccaaaggagtatgcaactgctcacgccatcaccatctgccatgatcgagagctaccaactcgacatgtccctgatttaatcattggggacaatgatgttcaagaaggggaggcttctactcagattgaagtctctgttgttgaattcaaccattctgatggttttcgccatctcattcaatccacctcggaagagaaggccgccactatcaagagaatagtgaaacgattcaaacctactccattaccctcacgtgctcttccgtggacattcaggaaagcgtggatggagagatacaagtctgctgcaacaaagcagctggacgagattgaagcagtgatgccactgatggaagttctctacctgattcatgatcctcacaaagatgtgagaaatttgatactggaaaggatcaatatgtatcaagatttagatgatgaaagtgatgccactccatctcgagctgctgataagaggattgttcaaaaaaacttagaagatcctggatctttcactctaccatgttccattggggaattagcttttagcgattgtctttgcgatctcggagcctttgtcagcttaatgccactctctgttgcaagaaggttagagtttattcagtataaaccttgtgacctgactttgatccttgcagataggtcttacagaaaacccttcggcatgctgaaagatctaccagtcatgattaatggagtagaagtccctacaaacttcgtggtgctggatatggaagttgagcataaggatcccttaatcctgggaagacccttcttagcttcagtgggagacgtggtagatgtcagggaagggaaaataagtctcaaccttggaaagcacaacaagttgcagtttgacatcaacaaaattccacaagagtcaacagaagatgaaaaaacctctaaagactatagagtgatcccaggagaagggtatgagactgagaaaataaaaaaagcttaaaaagaggtctgataagcaaaaagaaactatagagaggctagctcactctgttgaggaacttaggagtaagctgaatcagatgcagaaggaaactcaacctaaaggcgggattaacactatcccgagaaaaaagttcacttcaagatggtctgaagagacagattaccctccagaagagaaagaagcttattttgaagaaatgagaattaagtattctgctggagacctctctagggaagacgttgagtatgatgatgatatcagagaggattatgcagaccctctctatcattcactttcttcttgataagtgtgaggagtcaagctagagactttaaacaagctcccttgggaggaagtcccatgattatccttgtaaataatttttactttcttgttatttttgatttgttttagttgtgtttgtggttctcaggaaaaaaaaaaaagaataacgtgaaggtagagtaaaaattcaaaacttttactctacttatggcctagagatcgagtacattggtcgagtatgagtgatgtttaaaaactcaaaaaaatttaaatcatcattttactcgaccaacagaagctacagagtcttacagagagttcattaagtttagagatgattgtaggatttcctgagattttcctagtgaagatagagta

SEQ ID NO: 6037 - DNA, 3000 bp, Unknown
  misc_feature (1)..( 3000): cDNA_ID_1829676_gDNA_ID_1620837_Annot_ID_50825 3000 nt of promoter + ATG
attataatgatggttggtttctagtaacaatcgtaggtcaagattcgaacaacagaaataaaaacttaaaagccctactcgatcattgggtcgagtagaaccaacaggcaacaaaattaagaattaaaaatgcaatcaacaggtgacacaaataacaggtaaataaaagtgcaatcaatgggtgaatacaaataaatctaagaagaatagaagtcctaaggatggattcattgataagggcaactttagggttcatcaggtggctaacaggtcaaaggtagataccctagacgatagattcaagaaccgagtcaatccactcccactctcgtgacagagacccccataactctaccacttcctaatctcaactctcgttgatgaaacatagcaaaacatggtttaagcaacaaactaccaaagccaataaacatactagccaatctcttggtctatagcctacaaatttctggaattcatagatcaggcatccatttgaacgtcttttggacgctggacgtctatggtcgaatttccacattagccaccgaaaaccgcataggggccaacgaatccacaagggatctaacctaatcttaaccacctgactaacctaaagattatcctaatctaatccatcctcaagaaccctaatgactactcaagcaacataattaagaacacaaactcagaaattactgaaatcataccaaaatgtagatctaaagaaactaaacaactttactcaaaactaaatacaaaaactaaatagattaagagtaattaaattttgaagattcaagaacataaagaaaaactaaaggataaaagctagatcctttggacaaatcccaaagtgatctatttatagtaaaatgttgaaaaccctagattcactagacgacaagagacttgaggcggtttgggcgagtgctcgatcttggagatcgagtaaagagggtgctgcaaagtctgcgcctttgtgtccatgctccgagtgatcaattggtcgagtagatgtttcttcctctcctatctgtatgctcagatgtctggttgagtggggaatgaggaggatccgaagacgctttgatagatcaaaaagtctagtagatttggtcgcccttggtcgagtagaagatcgagtaagaggggcgagtataccgatctgctgcttcctctatggctgtctggatcgagtaagtgggtcgagtgaattgatttctcctctgtgcctacctggatcgagtgaactagttgagtagattgctctgctgcttccctcctggttggatagagtagagggtcgagtagagtccttgtaagctccttctacacctgaaaacataccaaaacatgcaatatgtatgcaagatgatcctaaatggcgaagtgtgcaaaataagctaaatgtgatgcaaaatgatatgaaacaatgagtgatcactaagctaaatgatgataaacacatgcctaaaataagtaaaataaagtgttatcaatagcgctcgtgagaccctaacggacgcagatgtagagacacagacaaaggatagcgtggatgagatgcagacgctggagaaaaattaaggattggttgaagtatttcaacaactgagttttcaatatgatatatgaaccttctgctagcactacattacttaccacactactcaaaaatctcgatatggaggcatgcttagacaaaacaaaatattctctcccaatggacatgagaagaaatctcaaaggcagtgaaggaaagatcattagaacattataggtggtttatctcctttcaaactcagaactcaaaactcttgtctctagtgggtatgattttggttgttatgtgtccttttgctatgattttgaacacagctagaaatctcatcataaacactcatatatcattattgcttcgttttttcttttcagccattatcttccgtagatgtagagagcgttgaccagaatgaaatttatcaaacagtagtaatgtttccaatgttttttttttgttatataatagggagattaactgtgatgggtaggaaattaggtgttattaccagaacacgacagaactttttttaattactgttatattatcgaattttttttattacccagcgtgcccctactaaacgttatcggaaaaaacgtaattacagggaatgccactgccacatcagaatttgttgacgtggattaaatgaactcagccggctgagttacggtatgttatatatgagtcataacgaaacggcgaagtatgagtataactcagccagacgttacggctgagttgtaaaatgttgcctgagttattgtataactcaggcaacggtatggttgagttaaggatggtcggccgagttataagaagttataagataacccagccaacaatatggctgagttatgagaaaaaggctgacttctttcctcgacgcggccgagttatagttttgattggcttagttatggaaagatgtgacggctgagttatggtcgagtgctataaatcagccgccaatagctggattacgatataactcagccatgttatggctgacttatttttaaaagattaattactataatatcatgcagttatggccgagttgttgaacgttacggttgagttagttgagttacgacatacaacggctgaattaactttgttttttttcctgttttaattactgtaatagtattcatgtcacggctgacttaaagatttgcttcatggctgtgttatgaactgtttgtttggtggctgacttgccacgtcatcacttcaaaacggcgtcggctgtaataatccatgtcatcattccatgtcagcatcctcgacggaaatacgaaacgtcccttgcttctttaaatcgttttcccagactgtgtccaccgcctgaacgttacaacatcaccggaactttcttttcttcattcatcttctcatacatcttcaatttctttcatctttctcttgat

SEQ ID NO: 6038 - DNA, 3000 bp, Unknown
  misc_feature (1)..( 3000): cDNA_ID_1829665_gDNA_ID_1620837_Annot_ID_50829 3000 nt of promoter + ATG
cactctcaaatggtatcctagagttagtatgcaagccaaaaagtctaatggatagaagagtcaataacccaaaccatctacgcttttcagtaggccaagctctgcacgttactaagccctgcctaagttcatctagattaggaccttcaccggttggcacatgcaattcactgaagaacgctttgtagtcagctgcaggcacaaacttttctgtaggcagttcatctatatttaaacccgtgatatgatgaaattcgttcaatccaaaccggatgggtttaccagccacgatacaccaaagctccttcttcagtattctcagttgtctgcatagtagataatgtacggtcttaccagaccatagaaaataactatcaacaagcttagcaattaatctaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtcataacataaaacaaactcatccacagataccataactcaggcaaaacataaatctaactcagccatagataatataactccgtcataacataaacctatctcagccacacataacataactcagccataagataaatctaactcagccatattttaacagaaactcagacatcgatgtaaggttaaaccataactcagtcacagcataaaacaaactcagacacggatgaattgataaatcataaatcagtcggcaaacaaatagtaactcagccgtcaaatcaaatagatctaagaaatcggccaccatatgtcaatcaacgacgacgttaaaacccagctttaaaaaccatcgttacgcatcggaaaacgatttcagtgacgggaatcacttgagattgaacttagatgtcagagtcttacttaatggaaacatactcactggaacttagatgtcagatgtgacttcgcgcttacagaaatgcgactccggcgtctgaatttcggccggaacagacgagaaaagagcaaaacggcgaaagaaatcgattttgttccgtcgagagagaaagaggaagaaagcgacagtttttttttttttgggagatgatgaacagtaaagccaagaaataaaaaacccaaacgttatgcggtttggagatgattaatgacgtggattatcgtaatgacatggaatgatgacatgtataatcactgttttttaatttaatttttagttaaaaacgaattaaataataataattaattaaaactagttagggttgttaattgtaattacacaagaactgaaaacatctgagtaataaaaaaaaaatgtgttctattctaggaataaacatacaaatgtgttctatcttaggaattatttctatataatatgtatatgttcaattgtgatccaaaaataaatgtttcactacatattatggaaacaaattcgaataagtgttgatgcaaaatcacttaataatcagataactgaataaattttagaacaaaaaaaatggatcttataatgtcattgttttctagcaaaataatatgatctaccggggatcccatcctcggtggtgaactctactgaagtgtggttaactctgttgaagtgtgatgaatagtgggggagtagttaggtgacgactctgcttcaaatgtgatgaagtctggtgacgagtaacatgagctatttcacttatccctacaaacccatctacattaataacatcttgagagaaggtcaatctctactcccccactattcttttcggttaacttagatgccaacgcttaaaataaggtggatagttgagtccaatataactctaatatttttgaaagtgctgttacgagtttttttgaatgcttgtttccgagttcatagattgcatggtataggttattaatagcatacatgttcatcctacagtagtaagaaaataatgacagataaaggaaattacgtcacatattattggttcttatttgacttttcagcattttcccgttgttgttttattttagggtaaattgcaggccacacctgttgaccatgttttatttccatggattgtcaaaatcaaatgtggttttcaccatttatcttttcgcctgcaaaatgacgcttctgcccttgcgcttctctcttagtaactgttgaaatgtacggtttagtttagcaggtttagttacgtacactgttccggttcagttgaagattttttgtttcacgttgacgcgattcggttccgttacaagtgagattatttccattattccgaagtgacatcaacatttaatgcccccaaaaagtttagacgtgactattgtcacaattaatgcaaaatcatcattacatcaaataatattaaaaaaattattgataataattaataaaaaaattgttgagataaagaagatgaacccaggaacaaagaattattgagaacgtacattgctgctgaagaagtgttgatcttgtttttgtaccaagtttggagccaaaacaagcattgttcgtgtaagtaatgaagttcttttaagaagttttttgttatgtcatattaggatcttgattgtgttcgaactccatttttttatcagaaaatttgcaaaatctatatttgtttgtttaaaatagtcaaatgataattggtatttaggtttataaatgtgtagtatcgacattccatttgtttttttatatgtatagtatttttcagttgcatttaatgtgtgtctcctgaatttatgatgcaggtgggttatggatattcccgtatttactatggtcggtgagtggaaatgcaaagaaggagaatggaaatttgaacctgaggaaggcatctttggtcgttgtgtacgagttcaggaaacc

SEQ ID NO: 6039 - DNA, 3000 bp, Unknown; identical to SEQ ID NO: 2575
  misc_feature (1)..( 3000): cDNA_ID_4254803_gDNA_ID_1620838_Annot_ID_50836 3000 nt of promoter + ATG

SEQ ID NO: 6040 - DNA, 3000 bp, Unknown; identical to SEQ ID NO: 2575
  misc_feature (1)..( 3000): cDNA_ID_4254803_gDNA_ID_1620838_Annot_ID_169983 3000 nt of promoter + ATG

SEQ ID NO: 6041 - DNA, 3000 bp, Unknown
  misc_feature (1)..( 3000): cDNA_ID_3079288_gDNA_ID_1620838_Annot_ID_169978 3000 nt of promoter + ATG
aaagcaaatatcgtcatatttagtttttgaaggaagttttgtcgaagaatattgataactgttaaccaaatctagtagatatttttaaattcacttgccaagaacgtcagaaaaacaacgtggtcattccatcaagtggtttccattagagaaataaattttattaacttaaatttaacaatgcattagttgctaagaagaaaaaataaaaaaatgttctataaatactttcttctatggtatataaacagataaatactagagacaaatttatatccacggatttgttggcggtccgcgggctacgaatatttaacaaaaataaatataaaatatgaataaataaacatttttatataattttaaaaataaaaatgtaaaatatgtgattgtgtaatgaaatttaatgtataaaattataagatttataaaaataataataataaatattttttaaattaaaaattgttaattaacgcattaaatggaaattacaaatggatttacaaaaatttaaaatatccaaccagtctcacatctttaggtgtgagtacaataggtccaaatacatttcttttattgagtgaatcaggttcagcttatattacatctttccattttatctagtcatgtctcttttgacattaatatacatactttggttctcgatcctcattttcctcatcaatttcctttgacaaaaggtatgagaaaacatcatcaacatcatccattttattttgatcctagatctttccattatggataaagttgataaaaatctcataatttccttcagtctcatggtgctcatcattgtcattagactcttgatttgcttcttccaaaatgctttctactattctaggaatatcatgctttccaacttcctttcattttctaggattttatccttagaaccaaatggtgtaccacgtttcaagcgtgttatggactcaattgtagtatctatattccacattcttgtggtatttcaattcgagcagaaacatttgcagctggtatatatgatgttgctaccttttggtatctgcaaaaagcatcaggaagttgatctgaaatactttgcaaatgcataattcgttgaacttctatttctgattgttttataagaggatcaaggtgtaacaaggatgatacacactattagatttcttttcctacttgcttattttcttttctaggaaaagaaaatatgttctcatcaaaatgacaagcggtaaacagtaccgtaaagacatcaccggtctgcagttcaaggtatcttgtaattgatagagaatcacaaccaatatatatctccaaccttctttgtggtctcatctttgtacgttgtagtggtgctatacgcacatacactacacacccaatatttttaaataggatatatatatatttggttctcaaccaaatgctaactagcatttcatcatataatctacatgccaccaacaatgtggtattccttttttatccttaatgaactgatttagataaataaaaaagaatttcgaaatagaaattaaaagaaaattaaaagaaaaaaaaagaaaccagtgttaaaaaaaaagcttcgccatcgttcttcttcctcttctgctttttccttcctccatcaccatcgattccaaacatccaccatcaacccgccgacctggatatccatcgcaacaggcggtcgaattaggtcagtttcttctcctctatcctctgtcgttgctgcattgtgatgttagtttaggtttttgaaattatataagattctcatatttcatatgaatgtttgatgttcgggttgtaaagttaagataaatcgattttaggttgccgaataggtattttcagtgatccttaatctaatgtataggttgaattcgagttgaattccatgatttcatatgaaagtttgggatttgggtttgcaaagtttagattaaccgactgttatgctaaataggtatgtattttcattggtaatcaattgaatggaaggttgaatcgatttagaatcgaggtggaggacagataggtttcatgtatacgtatgataagattacaagtggtataattggtacaatcactacaagaaatatgggcattgatagcacaaaagcatagcaaaattattgtaaatgctttaacagtattttatctggaaatgagactatataatagtagttttaaaacgttaaaccgaaatatatctttgcgggaagctaaaaagacagttttccgttaacacttagaccaaaaattaattaagcgccataacaaaataatatttcccaacacttagacaaaaaagtgatatttgcagaaactcaaaagttggaaggaatttgtatttttcccccatcagtcgttcttcgagctctcgccgacgagtacctgatttcatatattcatcggctttgtcgacttcatttccatcctcgtcgcatcggcatctcacaatcttcagctctgtcacaatatatgtatgaatctatagccgttgttatcctttaattcaattaattttcttctcaattagggttctcccaattttcaatttcatttcctttgatattagggttctttcgagttagtgtacgaattagggatctttactaatttcagttctatgtatttcagatcttgctaagaacttatataattcaacgctttctttcaaaggtttgtccaagtcgatagatttcttatgcctttgatttcttacacaaaaactttattgcgaatgtgattgttttttgtatcatacatcttgtgtgttgctgtctgacttgttttctttcttatacatgttttgtgttgctgtctgattcatgcttgttttgggatactgtctcaacggttcaaaataaggataacagataaaattaggcctcgacataaaaaccgtactcgcatacccgaaccggaaccgaacaaaaaaaaacgattcagggcgggtacgagtataaggattttacactgatg

SEQ ID NO: 6042 - DNA, 3000 bp, Unknown; identical to SEQ ID NO: 2574
  misc_feature (1)..( 3000): cDNA_ID_2113272_gDNA_ID_1620838_Annot_ID_169964 3000 nt of promoter + ATG

SEQ ID NO: 6043 - DNA, 3000 bp, Unknown; identical to SEQ ID NO: 2576
  misc_feature (1)..( 3000): cDNA_ID_1829711_gDNA_ID_1620838_Annot_ID_50837 3000 nt of promoter + ATG

SEQ ID NO: 6044 - DNA, 3000 bp, Unknown
  misc_feature (1)..( 3000): cDNA_ID_1829753_gDNA_ID_1620839_Annot_ID_50847 3000 nt of promoter + ATG
acaaaatgatgctctcttactttagtttcgccctcttttattcgtcctcatttttccctttcattgacgtcgtttgtttgttttttactaactatttttatgagttttcgaaaacaagtaactaattcattgacatgcatgttatttttgaatgttatttactttaatagtagtacattattaacaattaaattaagaaataaggtacaagtcaacatgcattgttaagtaaattattttctccctctctcacttttaaccttaaaactgcaacaatgatttaaacaaagaacataaactttaggacaaacaatcataggtttaaaatacatgaaatatcattgatcgatgaactttcttaaaatctttaaggacgctctaaccctcggaaagaaagggagtttaccaccctttcccaacctccacgtccacttatccaatctggttgatcagcgtgtatccaaacattagatcatacggaacaactcaacactatctagtaatatattttttctaaagtttatgatcaattataacccaaagagttacggatacaaatcctagtattttgatacattattgtcaatgataatttgcatataaatgcattgcattgagtctacaacgtaactactttttcctcctaacaaaatgcatgattaatttacagctcatttctagtaatggcaccaatttgaacgatattagccaaaccattggaccaaattgatggccaagcatttgatctacttttgtctttttcttggtttttatagctattgatctttcaccacttcgttcatttcgaaaaatagtcctctcaacaggaccttggaagaggcaagtcctactctcatgaacatggcttctcgaagataaaaccaaagtcaatgtcaacctctctccaacttgaaaattttaaatgctcaatcatttgaaaggcggcgaattcttttgtatttcccattacaaactatacaaaaacatcaccgtgactatataattttctatgcacataaaaacatttaacttatgccaatatatactttttagtttttacaaccaattttagtccactttcgactacgcaaagatgattttataaaacttgaaaatgacagaattaagaggttggcatcggctaattgattgcatgttataaaaatataactggatgactttctcattacagttttttttatcgacggctaattcgattttatccactgcatttagtttcttataagttctttactgcatatatatatacgtaatatatgtatattataatttttctttcttcctctactcgtcctaataattttgatgaaatggttttgtatttaaaaaatatactaattatattttcaggatacaacgacatttgggtagtgtaaatgcaaaataccaaaacaaatatatactatatgttatacaaaaattgtttaaacatgtaaaaaatgatatgcataagacaaaatcccattttaattgaaaatataatatatcattcgtgacgcagctgacgctattattaaaattgaggtgatgatctatgagattttttcctcttacaacaaatatgtcaaaggagacaagccagttgtatatacaagggattgagtgttttttccgttgtaatgatattcttcaattatgctattgtttgtatgatttcttaagactcgacttaagctagtagctttatataaataaaatagctttgttgtaaactaatcatcatgaaatttcaaataacaaaaaaaaactaatcatcatgattgtatttttaaaaaggaaactctctttcctataatacgataataatgagaacgcatctcctatcataatatacgtttctaaacacttattgttgttctcgtgtagaagcatgctcgaaattaatcaaaattatctttgtttttgttttgtttcacgttagactagcctcatcgatgtaagattaatgaaagattacccgttacaagtcggtaactagtaacattagtgtgtatataaataagaatattagtggttacgcgaccaaattattgcatagtggaaacatttaaggctatttttccaccattactttgcgtacttgaattgaagaactctttacattctcagcacatcaaggtgtctcctttgagatcaaaaaagtaggaaaaataaaacgaaaaagtactataaatattaatttcgtttacgaacaaaaaagtattaaaattccgtagacatttttggggggacaataattttagactcgtacaatgctttcatggaaatgagtttgttgttgaccgatggcttccctttatttttctttccacttttttattactaattaggaaactagtaatatttatactcgatgtataattcactaatcatatactttccaaaacgtagcaaataattcgactagaatatattgtccgtgaattaagtttcctcttttctttttttatgttaaccatcatgtttctgttatttgttgattttaataaccatactattttatacttttttaaaaataattgaaaataaattcagattacaagtctacgataatgattcttcttctttttcattgtagataaatttcttaaaagttgactacttttctgtcagtatatgtcacatttttctatctatcgttcgagaaaaaaaaaagaaaaaaaaaagtttacaagtgttacctctaaagtcttaaccaccatttctttctattttgtaaaggaatcaaatagttatttactatgtttgagttcatctcttgagttttctgaataaggtggtcccataaaaggtatcaattaattcacccaacgattataaaacaaaagtgtttacaccagaatatcgccaatcatagtttctctcattttataataattttctccatcttcttccttcctcttcaagcttatagaacctccaagaaccataaaactctctctgcaacaatctatactttcttcattacttttataaaaa

SEQ ID NO: 6045 - DNA, 3000 bp, Unknown
  misc_feature (1)..( 3000): cDNA_ID_1829749_gDNA_ID_1620839_Annot_ID_50848 3000 nt of promoter + ATG
ggcggttacagagaaagttagcgaatgcgaaggtgttgtctctctctctctctcagggaactttgccaatttggtctcctcacgccggcgatgataattgttttcccgcctcctcaacacgtgtgggcgctagagtctgattaactttatgaggcctttaaacctaatgagcccatcaggttgttaaggcccatcatatagttaaggcccatgagtcatagtccaaagaaatgttagtggaatcgaaactctcttttaagatgcatcttatatgactatatactttttggagctataaagttataagttgagagagagaatgttcaatgtagcccatataaatgttctgagtttcgttatatgtaagggtatgctattcttttggcattttatttccctaccaatacagtgatgtcttttttgctggagacaaatccattctaagatccgatttggatctgaagccttcaaaaaacatatagttctcatcaaacctgactatgggttgataaagaaattcgaaatcagatttcagcaatccgactctcttaggcgacatgcgttataacgatgcttaccaacactagatttactctcgagactagttatcactgattcttagaaagctttaaaattttcagaagtttttagagtttacttttcaaacaaacttagcacaagttgtaaaaacgtattttttcttttaaatctaatttgatattatattaaaaaaaaaaaaaaaactaactatcgtatcgtgatcttgtttttattatttttaccaaaattataatattttaggtaatgttctccgtaatatctttcactttcattttattatttcaatgatattaacattcataacaaaaaaaagaaaacatatagttggcatcgtaatttgttcttggttttctcatcctaccacggtgtgggatggttcattagttaaaaaagaagaaggtagatattgaaatctaaagagaaagtgtgtacttgattataaatcatgtagatctagcaaacgaaactgtacttgagttgccaaaaaatcattttgattttataaatatgggaggtttcattattcgtgcatgggaatcgaatgggtcaaggagtaaaaaacaaagaacgtaatggtggtgaatggtgtgatacgtgggttttattttatttttaaacgtcaacattattgatatctacaacaaatataatcattgtgtaagtataagaaacggtggtggtacgtgatcatttaaatatagttacgctaaaaaaagacgttcaccgacaggattttgtggagaaacgtacatatattcattacgcaccacggaaaaatacaacgatatgtccttagttaacaccttcatcccaagtttacaattaattccccaaaactttcaactttatgtagcatcctattaatgttccaaacattgcaaggattatatgtatatatatatagaaaatagattgtatataataaacaaacaaaactatcgaaggtagttagctcaattggtaaagatcctacgcgaagcttaaaggtcatcggttcgaataacgtttgagacaaaattaatattacatactgtgattttgggcttgggaagattacgagtttcggttctagaaagattataggtttcgctccaaaacctcttaatattaaaaaaaaaaacaaaaaacaatcaaacaaaactttacattttagataaaatgcgaattgtttttggaaatcacctgttcaatggtaaaatagtagtttactagttttttttttttgaattttaatagtttacttagaagtttaaataaaaacttggatgcatcaaattgaatgaagatgtaaatattaaattattaataaatccagtgattaaaagtacatagtttagtggacgatagatagcaccgtaccggtttgggagtgtttattttgtaagagcgtaacatgtgcatcggatttacaaacagccccaccactctctttcttcttcctctctcagccattagtttcaaaccgataaattatgacaattattttggttagtcaaagagttttggatttattggcctaaacttatcctggacaaggaaacgagaataatcctatattttttcttacaacaattactaattttgaaaagaatgattcaaattaagtaagagatctatattccttgtgcaggatctattggtacagaattccttaaatattttaaattttatttgccactctttgacaaactatatggttgtgtattaatttgacatccttgattactttagactcaatccaaacaatgatagtatgtgttgaaatatcttaaaagaatgttttaaatccaaattacatgattaccacttccgtaattatcgctcatgattttattgcatcctggaaaccattagatagattggtaggtgtcggggataaaaaaatcacagataaataatatatattaatattgtttttgataatgattttttccaatgcgtgatttagaaaatatcataaacatcaataatgaaaaatcataggtagatatcacaatttatatagttacctcttgtgtatgttgatgtgtgtttcaagtatgaaaccaaacaaaaagatggtctccttgttttacgacgaatgctaaattagttataattagtagtttagtagtactactactattttctttaattaaagattagtgtaattgtaacttttaagtataattaattaagacaatcgaggtaatgagattccaaacgtgaatccagccataaaatctcttttttaaaacagtcttcttcacttcacttctctgctctgctcttgcctctgtctctttcttcttcttcttcttcttctcattaaaagctgaacacaaagatctattctttcactaacacattaccagtttctgcatttgtattatatccttttctaaaacttttaaccattctttctccattcccagttcttagaaagagtcaagagcaatg

SEQ ID NO: 6046 - DNA, 3000 bp, Unknown
  misc_feature (1)..( 3000): cDNA_ID_1829745_gDNA_ID_1620839_Annot_ID_50849 3000 nt of promoter + ATG
cattgctcttgactctttctaagaactgggaatggagaaagaatggttaaaagttttagaaaaggatataatacaaatgcagaaactggtaatgtgttagtgaaagaatagatctttgtgttcagcttttaatgagaagaagaagaagaagaagaaagagacagaggcaagagcagagcagagaagtgaagtgaagaagactgttttaaaaaagagattttatggctggattcacgtttggaatctcattacctcgattgtcttaattaattatacttaaaagttacaattacactaatctttaattaaagaaaatagtagtagtactactaaactactaattataactaatttagcattcgtcgtaaaacaaggagaccatctttttgtttggtttcatacttgaaacacacatcaacatacacaagaggtaactatataaattgtgatatctacctatgatttttcattattgatgtttatgatattttctaaatcacgcattggaaaaaatcattatcaaaaacaatattaatatatattatttatctgtgatttttttatccccgacacctaccaatctatctaatggtttccaggatgcaataaaatcatgagcgataattacggaagtggtaatcatgtaatttggatttaaaacattcttttaagatatttcaacacatactatcattgtttggattgagtctaaagtaatcaaggatgtcaaattaatacacaaccatatagtttgtcaaagagtggcaaataaaatttaaaatatttaaggaattctgtaccaatagatcctgcacaaggaatatagatctcttacttaatttgaatcattcttttcaaaattagtaattgttgtaagaaaaaatataggattattctcgtttccttgtccaggataagtttaggccaataaatccaaaactctttgactaaccaaaataattgtcataatttatcggtttgaaactaatggctgagagaggaagaagaaagagagtggtggggctgtttgtaaatccgatgcacatgttacgctcttacaaaataaacactcccaaaccggtacggtgctatctatcgtccactaaactatgtacttttaatcactggatttattaataatttaatatttacatcttcattcaatttgatgcatccaagtttttatttaaacttctaagtaaactattaaaattcaaaaaaaaaaaactagtaaactactattttaccattgaacaggtgatttccaaaaacaattcgcattttatctaaaatgtaaagttttgtttgattgttttttgtttttttttttaatattaagaggttttggagcgaaacctataatctttctagaaccgaaactcgtaatcttcccaagcccaaaatcacagtatgtaatattaattttgtctcaaacgttattcgaaccgatgacctttaagcttcgcgtaggatctttaccaattgagctaactaccttcgatagttttgtttgtttattatatacaatctattttctatatatatatacatataatccttgcaatgtttggaacattaataggatgctacataaagttgaaagttttggggaattaattgtaaacttgggatgaaggtgttaactaaggacatatcgttgtatttttccgtggtgcgtaatgaatatatgtacgtttctccacaaaatcctgtcggtgaacgtctttttttagcgtaactatatttaaatgatcacgtaccaccaccgtttcttatacttacacaatgattatatttgttgtagatatcaataatgttgacgtttaaaaataaaataaaacccacgtatcacaccattcaccaccattacgttctttgttttttactccttgacccattcgattcccatgcacgaataatgaaacctcccatatttataaaatcaaaatgattttttggcaactcaagtacagtttcgtttgctagatctacatgatttataatcaagtacacactttctctttagatttcaatatctaccttcttcttttttaactaatgaaccatcccacaccgtggtaggatgagaaaaccaagaacaaattacgatgccaactatatgttttcttttttttgttatgaatgttaatatcattgaaataataaaatgaaagtgaaagatattacggagaacattacctaaaatattataattttggtaaaaataataaaaacaagatcacgatacgatagttagttttttttttttttttaatataatatcaaattagatttaaaagaaaaaatacgtttttacaacttgtgctaagtttgtttgaaaagtaaactctaaaaacttctgaaaattttaaagctttctaagaatcagtgataactagtctcgagagtaaatctagtgttggtaagcatcgttataacgcatgtcgcctaagagagtcggattgctgaaatctgatttcgaatttctttatcaacccatagtcaggtttgatgagaactatatgttttttgaaggcttcagatccaaatcggatcttagaatggatttgtctccagcaaaaaagacatcactgtattggtagggaaataaaatgccaaaagaatagcatacccttacatataacgaaactcagaacatttatatgggctacattgaacattctctctctcaacttataactttatagctccaaaaagtatatagtcatataagatgcatcttaaaagagagtttcgattccactaacatttctttggactatgactcatgggccttaactatatgatgggccttaacaacctgatgggctcattaggtttaaaggcctcataaagttaatcagactctagcgcccacacgtgttgaggaggcgggaaaacaattatcatcgccggcgtgaggagaccaaattggcaaagttccctgagagagagagagagacaacaccttcgcattcgctaactttctctgtaaccgcc

SEQ ID NO: 6047 - DNA, 3000 bp, Unknown
  misc_feature (1)..( 3000): cDNA_ID_1829737_gDNA_ID_1620839_Annot_ID_50851 3000 nt of promoter + ATG
catcggatcgattcgttgtgatagatttaatttagtcttagtaagtatcgaccgattttctgaaatgaagagagaagtttgttagccaaatgaaggaaaaaaaaaatagcaccaaccaatattatggtgacacgttctgtttcttccagtatcagaaaaatgtcttctcacagacatcaaagccacagtgtctctcctgttcagcgcattaattcccatttttctattttttaattttattaaaatttgaagataccctctaaatttgtccgatggggatggtctaatagatttttcgggttttgaattatatttgattaagaagatgtatttatttatttgaagtttcaattcaatcgtctctttatgaagtcatcttttattaaaagatatggacacgccaattttattgtatatagaattttcatttttcttaatttgcgacatcatagtttgcccattctagttgaactaattctcagtaatcatttcaacaacattccctaatattaactcttaattttgcattttattggctctaattagtatattatattagggtaaacaatagaaacaaaagtttttttttgttttgagtccaaaggcgattgcaaattataaaagccgagctaccaacacatagagtagttgaagcttttaacatgaggcccgagattggccgtccgcagcaaagaccgataagccccggatcacatactattcccaagtcatgtgaacacggtttatcggacaattccatgaactatatcactaaatagaatctcacaaaccaaaatatactaaacggtgcaaattcactttattaagaatggctaacactgaaacttagatgccgaagaaatgaagaaactattttctatttttgttttgaagttgaaaaacaaaaaccaaaccgtaaacaagaatgtacacccctctaatagaatattataaaaatgctaaagaatcacaaactgaaaccaaatatagagaataaagccggcgtaactactcctttatcgagatccgtttcaattttggtaacttttgcttgggacaaacaaaacaacaatggcaagtataaaacgtgttcttcatcaaaaccagtaataagattttatttttcagtcaaccaacaataataataagaaaaaaaacagtaataataataataaaatttccatataaaaacagcgatatacccgaatctaataaaataatactaaattaataaaagtcgttaaacacacaattaatttgtgagagccagcgaagattttttctgattggggaaaaacctaagtgaagaagagagacaatacaacaacaacaacaacaacaacaacaacacaaaagcagacctcaatttcttcacaattctgatctgggttttgagaaattcggaatctttctttttctcgtttggttaatgcctgggaatcacagtgagatttcattgaatgaacaaaacagagtcgatgataacgataccaagacgaagacgacgacaaggaagaagaagaagaagaaagatgtaacaatcgttgatgatgacgataatcaattcgataccaccaatcaattggtaaagagtaagaatcgatttttaggtaagtttcgtaagaaacccaaatcgccaaaacgatggtctgggtcgcgtaaaggtgggtgctttcgtgtgatgagacctcgaaggagagaaggaggtgatgatgattcttcggtttcgtctccagtttctgatcctaatgatgaaaggtttagtcatgagatgttgagagttatgttagagactaatgatttctgctctgatgagtgtaatccacatcggtgaatattttgtatgtttcgttattgggatttggggttgcttgattcttatatttatagattttttggttttgggtttctttctttggatcaatctgtatagaatctctccatcaaatggctatgagtgttttgtttcttatgttttagaccagtgatgattctttaaaagggcaattgtgtattgaatcagatttgttatcggtagatttcatttagttgagttagctttgtgggagatgatcaaacttatagtaagttcaatgtatttagattaagattggcttcagtgcagagtaaatttagatgatttttttgtctctctaatgtgccaaatgtgtaagatgatagttcaagacagataatgtgtgtattcgaagaagtttaggtgctcaagacttagtctattggtctactaaaactagcctaggactgaatatagcctgttgtgacttggtttacagagattttagtgatggctaggtttataatgatgtctcggtagattgtttaggatgtgtggtgtgcacatttggttgagagttgattgatagtctttctggtttcgtgaatcgaacaaaaagcaggttaagcaatgaccttgtccaaagaagagggaccatttagcattggatttcagtggtattgctaaatgagtatctggttacttcccattccttagttctattggcacagtgtttatctgtttcgattttttcctatatgagtctatgagagattttagttcaaagatttgtattgccttttagcttttctgaattgcctctgcattggagctcccatgaagtattctctcttgaaaagagaactgcagagacactgatacagaaaccagtcacataactcatataaccaaggatagttttagtatagtatgattctccaaatgatgtgtacataccaatttaactacttattactctaatccaagttgagttaaaaaaaaaaacactatgtaaagattgatactttatggactaaaaattgaaaaagttgacaacttggagccgcccacagttaaaaaagtaaaaacctaatcctaagacccgaaaccactcaaccaaaaaactagggttctgtttctcgtctctctctcaaacccacattgcacaatccatttctcgtttctctgatttagatccaaagatg

SEQ ID NO: 6048 - DNA, 3000 bp, Unknown
  misc_feature (1)..( 3000): cDNA_ID_1829733_gDNA_ID_1620839_Annot_ID_50852 3000 nt of promoter + ATG
ttgtgaaaggcagttgcaccacaagtccacaaccattggttagagataccatactacaacatattgatgccttcatgtagctacatataaaacaatatcatgtcaaagatgatacatcttcaaaaaaaaaaaaaaacgattataatgaatgagaaatatttttttaaatgtaaatagtagattaagaaaaacattatttacaaaagtaaaatgggtgtattttaaaaaactttatgaaactataaaatagtagatgaattttgtcataccaaattaggttgaaacatgttataatatttttcaaactttatgaaaaattatttaatatgtgtcattttttacatctaattggtcacatagattattttttcatgcaagtaatctgttactttaaaacttatctttaacatttaaattgttgttatagacattaagttaatattaaataaaatgttcttaaaatactttaaataatattgtaccaaaaatgttttcaatattcttttttcgttaatttattgctaatacagtcgaccttaaaagcaaaagtagatttatatagctgttgccgacaaaaaacatttccactatattaaaagaaaagtagaatacaagatagaatacgattctaatacacgaaaccgataaaagttgaaacttttttaaaactaagctggtgaaaactaagtcttaaaaagaagcaaagtaagagaaaaatgaagtaaatgacaaaagaatctaataagtaaatcttaaattcaaaaccatcaaaacccgcaaacaatctcagagaaacagttggcgtcgaacctgaacaaaaaaatataagcttaaaagaacaaacaaacagacaatttccaatataccataaccatagaaaacttaaactgaaagctcaactagtcacaaccgagtagaactgagagaatgaataatccaaagacattatcctgcaaagatataaaaaatgactacttctaattagaaaatctcataagaaatttgagtctctttggttgattaaaaaaatcacataatttttttatataatatacctttgtcttagtaatacaacgaacaatatagtatttgaccttcattgagacatagccaacgatttggtcaccaaaacaccatatgaagcaatgacatccctatggaatatggatctgcctctcctttcctcaattacacatgtgataatccccaattgggatctacaaccaaacaaattacccatcttgtttttggcaaatctttaccaaaaatgatcaataactccaaaaccatcctcattctcattcttatggaatacaagtctctcaaaccaagtataggatcttcattctattttctatggaataaaacataaatctttaaaaagggtgaattttttcatagcagaataggttgaaacattttatgactctttatttcagccctaggggtgaacctctttcattcaccttctcttaattaaccaattaaaatttatcatgtcatctaattaaataaattaaaacaattaatattaaataaataaataaatttattaaaacccactaaacttatttaattattaaatctaatctctaaccatttttttataaacccaaaccgatatataatcccgtttaattacaaaatctaaaccataattctcttttgtaaacccaaactaccatttaaactcgtttaatcgtaaaaaatctaaaccttaatcgtattttctaaacccagaccaacatttaactttgtgtaattataaaatttaaatccgtttataaacccaaaccgatatttaacattgttttatcataaaatttaaagtctaaccctttctaataaacccaaaccgatacataatttcgttttaataaaaaattaaaatttttaattaaataaattattatttttattattagatgataaatcctgattggctaaaattaagagggtaaacagttaacccaagtatttttcttttataatcctttttgaactttatgacataaaatatatgtttcaccttttacatctcatttgtcacatagatttatcttacaaacttgcaatctattattttaaaacttttcctttaacattatacatctacaccaacattaaattaaatattcttaaaatacaatcactaatcttataccaaactgtttttcaatattcttttctcctttgatatataacaaaatactaaaattcaacgatatttctttctttatttgctattgcaaaccagaaaaccttatgtatcctttgccgacaattttaacaaactaattaacaattgtaatcattgaattgggtaagacttgtgaataaataataatgttaaacaaaatagattattccaaaaaaataaaataaaataaattatgaaataatttagggtttgaagttcacaggctgtattggatggacgttgaatcgattccacctcatctaaataatctcttcacaaaaccaaaattaaaaatcattcctttttaacaatcttctgcattttcgaacttgctttgctgtgataaagttctctcctttcctttctaaaggaagaagaaaggctttatctctcaaaaccctcatccacaaaatcccctttaatccgctaatcagagggtttttctgtttttgtgttgcttcgttactacggttacattcttctcttccccttttgatttcaaaggtacgaattttatcctcaattgcgtttcgatcgtatctcaaattctcttcgatctctgacagaaagtttccaactttagtgaatcgcgaaattgggttcgtgttcttgctctgatttcggtgtaacccttcaatttcagaaccctcttgataccttaagaagaggcaatttgaagttttcttcacagatccgtcttagctctttctagaggtttgttgtataccaaagatctctttttttttttgcatttgctttgatgagtttggtcatggagatttatgtgtgtttgcagaatg

SEQ ID NO: 6049 - DNA, 3000 bp, Unknown
  misc_feature (1)..( 3000): cDNA_ID_1829731_gDNA_ID_1620839_Annot_ID_50853 3000 nt of promoter + ATG
ccaatacagcctgtgaacttcaaaccctaaattatttcataatttattttattttatttttttggaataatctattttgtttaacattattatttattcacaagtcttacccaattcaatgattacaattgttaattagtttgttaaaattgtcggcaaaggatacataaggttttctggtttgcaatagcaaataaagaaagaaatatcgttgaattttagtattttgttatatatcaaaggagaaaagaatattgaaaaacagtttggtataagattagtgattgtattttaagaatatttaatttaatgttggtgtagatgtataatgttaaaggaaaagttttaaaataatagattgcaagtttgtaagataaatctatgtgacaaatgagatgtaaaaggtgaaacatatattttatgtcataaagttcaaaaaggattataaaagaaaaatacttgggttaactgtttaccctcttaattttagccaatcaggatttatcatctaataataaaaataataatttatttaattaaaaattttaattttttattaaaacgaaattatgtatcggtttgggtttattagaaagggttagactttaaattttatgataaaacaatgttaaatatcggtttgggtttataaacggatttaaattttataattacacaaagttaaatgttggtctgggtttagaaaatacgattaaggtttagattttttacgattaaacgagtttaaatggtagtttgggtttacaaaagagaattatggtttagattttgtaattaaacgggattatatatcggtttgggtttataaaaaaatggttagagattagatttaataattaaataagtttagtgggttttaataaatttatttatttatttaatattaattgttttaatttatttaattagatgacatgataaattttaattggttaattaagagaaggtgaatgaaagaggttcacccctagggctgaaataaagagtcataaaatgtttcaacctattctgctatgaaaaaattcaccctttttaaagatttatgttttattccatagaaaatagaatgaagatcctatacttggtttgagagacttgtattccataagaatgagaatgaggatggttttggagttattgatcatttttggtaaagatttgccaaaaacaagatgggtaatttgtttggttgtagatcccaattggggattatcacatgtgtaattgaggaaaggagaggcagatccatattccatagggatgtcattgcttcatatggtgttttggtgaccaaatcgttggctatgtctcaatgaaggtcaaatactatattgttcgttgtattactaagacaaaggtatattatataaaaaaattatgtgatttttttaatcaaccaaagagactcaaatttcttatgagattttctaattagaagtagtcattttttatatctttgcaggataatgtctttggattattcattctctcagttctactcggttgtgactagttgagctttcagtttaagttttctatggttatggtatattggaaattgtctgtttgtttgttcttttaagcttatatttttttgttcaggttcgacgccaactgtttctctgagattgtttgcgggttttgatggttttgaatttaagatttacttattagattcttttgtcatttacttcatttttctcttactttgcttctttttaagacttagttttcaccagcttagttttaaaaaagtttcaacttttatcggtttcgtgtattagaatcgtattctatcttgtattctacttttcttttaatatagtggaaatgttttttgtcggcaacagctatataaatctacttttgcttttaaggtcgactgtattagcaataaattaacgaaaaaagaatattgaaaacatttttggtacaatattatttaaagtattttaagaacattttatttaatattaacttaatgtctataacaacaatttaaatgttaaagataagttttaaagtaacagattacttgcatgaaaaaataatctatgtgaccaattagatgtaaaaaatgacacatattaaataatttttcataaagtttgaaaaatattataacatgtttcaacctaatttggtatgacaaaattcatctactattttatagtttcataaagttttttaaaatacacccattttacttttgtaaataatgtttttcttaatctactatttacatttaaaaaaatatttctcattcattataatcgtttttttttttttttgaagatgtatcatctttgacatgatattgttttatatgtagctacatgaaggcatcaatatgttgtagtatggtatctctaaccaatggttgtggacttgtggtgcaactgcctttcacaatttcaacaacagaagttaaaatgatttttttttgaaagaaaaagttaaaatgatcttctacttttcattttacctggtggataatttaacactaaagattgaaaaaataaaaatctatttaaattttcggtgatggatttatcgatagatttctaaataacaatgattaacgagatttagttcaataattatcaacaaggtggaagaaaaatagtgtttaaggagggtgagaatgagattgagactagtacatccaaaatatgaaaataaatatctctataactatatccatacctccaatgatccaaacatggccagaagcccagaatcagaataataaaagccatacaatggacctaaataaacatagcccaataacggcccactaaaatctgatattttacatcaacttgagtggtagaaataaataaagatagggcagaagcagagaagcaaaatcgtggaaggttacaaagcctttcaaaaacctcactctctcaactctcaaaccttatctccttccttctcttctcctctcctctccgtcgagcttactatctccacaaa

SEQ ID NO: 6050 - DNA, 3000 bp, Unknown; identical to SEQ ID NO: 6048
  misc_feature (1)..( 3000): cDNA_ID_3079329_gDNA_ID_1620839_Annot_ID_170026 3000 nt of promoter + ATG

SEQ ID NO: 6051 - DNA, 3000 bp, Unknown
  misc_feature (1)..( 3000): cDNA_ID_2105085_gDNA_ID_1620839_Annot_ID_170024 3000 nt of promoter + ATG
gaatgtaaatggatcagcattgtcgtatcaataaaaaaaaaacttaatataatgctacatcaatattgttttagttaaaattttctacttgtctagttttcatatctactttttatttattttaaaatcaatgacttctaataaattaattttctacgacaattttacaatccattaaaatccaataatccatagaaacttagaagatgatagataacaacttaagtaaggcagtatgaaaagttgaaatgcaatataatttttatttttgagttctaacctaaacaagttttcaataactttgaataaaaacaaatttaggttagaactcaaaaacttgttttcaataacaacaatggaaatatgcacaccactaataaactttcttgtatgaaatggctaaagaacgagtagatcgttgttgaccattccaaaatacaactttctacttggcctctaatcgatttgaaattgaaaatgatctagattttttagactattcatatcgagatcagtatcctgatcttgaaaaagcctcttaattatgtttcattcaatcgccaaaaagtaaggtcggtttggttttacagagtttgtctttttcctgcaaggttcatctttccgggaaaaaaaaagtaagttttatatttttcttaacttcttgttagactaagaaaaccaaattttaaactaacgagttaatttacatatacattttttgagccattttagctaataaatcctaaacttgaacttatttacaataatgccattagcattaaatcttttttccaaactaattaattttactttacattcttaatttaaattgtcaatcacattatcaatcaaatttaatccaaacaaacttcacatcaatcccttaaaattagcataaatatatttgttaacaatattttaaaacaaagttttttgtttaaataaatattattcttactaaacgtttttgtttaaataaataaatcatgtatttgaacttatttacaatgtcatgcttaattatttaggaatgaaaatatttaattaaagatctaaatcttctaaatccttgcttttagatttattatgtcattacctaaaaggtaaaaaatattaactttttaaatataattatttctatatttaaacttaataaaacgttatcaatatttaaacttttaaaaagtttaatatatcacaattttttaacatcattatataatatatagagtttaaaaaaaattcaaatttttttccgtcatatcttgtgattcgaaattttaaaaatgaacatattttaaccaattggcgaaaaatgtgtgggttcaacgtcccgcatcgactaaaatatttagacaaatgattcgtaaacatatcataaataagatcagcattaataaaataaatggtgtttttatatatactaactttaaaaataaattgtccccgcggtacacagcgggttaaaatctagtaatagtatataataagatgacttgagacaaagaaaacaagaaaatattcttttcactttatcatgcaacttaaaaaaaaaatacatgaattatcctgatgctgatgtcagtttcactttcaaccatccttttaagcagttttagttccaatttgttttcgggatttaggcggcgccatgactgcgactgcgatttttgcattgtccaaccagaacaaacaaacaacagtgtaattgtaaaatcatgatgtggataataatacatatgttatgtggtttgcagaatgatatcgttgtttgctatgacaacatagatatacattatccacgcatctatggtttctcttgaaattacaaattatttttgtgcgattcacaaatacaaactaaaacatgatgggattaacatctactcttagcgttgagagaattggcgggaaattattgtgatcgatgaatgcaaaaatgttgtacatgatatagaagatacaattgcaactaatcgaaaaatctttgagaaccattcttcaacttttatggaagccattagaattcaacaaagtgactatcaatggtcttgagcttctccaatacctctccatagcaatttaattatcaacgtacaacatatatatgtatatctcatcataatattccccaatcatactcataccgttttctaccgtcggagacgtgaggatatcttctaagttctttctcttatgttctagaccaataatgattcttttaaaagctaggtgtattgaatattgattctgattcacatagcatagttgttatcgttagttttcattgagttgtgttttcttttctttacctttgtaggagatggtcgaactcataataagttcaatgtattagattaagatttgtcttctgtttgtagtaaatttggatgattttttaagattgtaattcaagtcggacattggtgtatttgaagaagtttatgcactcaaactagcctaggactgaatgtagcagattatagatgatagtctgttgtgacttttgtttataagagcagctataatttttattattttattattttatctcagattagtcgttgacaatatgagaaagagattatttatgtaattgctggagattaagcgtgactaataaagcatcaattaaggaacagaaagaaagaaaaaaaaaaagcaagaagagagatagcatgataaaggagatgataactttacagaacataaagactttacaaaacagaatgtgatgatttgtgacaaccacctcgttttttttaaataatatgtgctataatgagaagcaacacatttaaagattgaagcttgtctgtaaagtaacaaacttttttggtcactttgagagaatcaagaggtatcattataaagctgtaaagggttggtgaaagccatcacattttctgccaagcttttaaaagaaactgatgtgacaagtagaaagaattttgaagaagcaagaaaggttatatgaggagtttggtgtataggaagatg

SEQ ID NO: 6052 - DNA, 3000 bp, Unknown
  misc_feature (1)..( 3000): cDNA_ID_2135381_gDNA_ID_1620839_Annot_ID_170020 3000 nt of promoter + ATG
aatctcacattaacagagtttgattatctaatcaccaagaagaaggtaagaatcggttgatgcatctctacatttgattattgttttctctctcaaaatcactgatttgtttgtttttgctgcaacacagctggaagatgatgatgaagttgctgattttgtgaatcctaacacaaagaaggaaacattggcacttggtgattcgaatatgaggaatctgaaatgtggagatgtgattcagcttgagaggaaaggctatttcagatgtgatgtgccttttgtcaaatcttcaaagcccattgtcttattctccattccagatggaagagccgctaagtgatcaatgaactatttttgagtttcccattttatgaacattgtgttgagaaatttgctctttaggttttaaaacaatgaaaacaaagctttttatcagttctttagtttcatctcataatagttttaaagttgcaaactttatattgattcattcttctttgcttagtgtttacaatataaacaaaaacaaactcatttcttgggtgcgtatctcagtttgatcttcttaacctgtttgtgtttgagctggaatgacttggccagaatgtcatcgggaagagctccaaagagagaggcgacaagtgattgtgttccgggcaattggctatcgaaggctgcgagtacagatgctggactgttggcaatgttcttctggaaatggatgagtcccttggggaaggtgaaaacgtctcccttgttaaggttcttggcgatgagttttccagcggttgttacaaagccaacatagagctgaccttcaaggacgaaaatgatctcggaggcacgtgggtggacatggggtgggtttaggccgtttggggcgtagtcgatgcgggacatggagaggccgagagtgttgagtcccggtagcttttctacgttggctccggtcacgactgagccggtagaggtgtttgtggcggcaatgttggctaagcctttgaagtagaagtcttctggtgttatttgtgttgagtccttgcaagtgtatccgttgaccttgaccgcttcatttgtgatcaaaagagagcaaaacacagttagataaattttgacaagaagaaacaaaagacaaactaacttcaaaactctattattatttggtatgatactattgaaaaagaatgttgtccacctactttatattttaacattttgataaatactatatcatttataaatcctgccaaagttcgaggaaactcttgaataatataatacaaaatcgagaaataaagtatagtataaatgagaagatttcgtttcataatatctcaattggtggcaaatttcttaacatgatataattttataactagaagaggacaaaaaaccataatatcatgtggaaattgggatctataagaaaaaacaataaaatgtttttaccaacgatgaacaaaaaaaaagaggtgaaaacatgtcacgggtaaggtaaaattgattgaaacaaaatgtgttagtgaggtaaataccattagacaaatcagcaacacaaacatcttgaagcatctccgcggaggccatggctacaaacaacattgtaacaacaacaacaagatgggttgcaaaagacgccattattgttgttgttgttattttttttctgaaaagagtttgtttttgatgaatttataaattactaataaattcacaataaaaatgccttgaatttggtattcttataaacaccgaggatgctttacaatgtttattattaggccaattgtgagaggtggagtttaattcttaatttagccaaaattaggtttttaaattttaattgttggtgattaacaagagttgtttattggtgaattgagacatctcatctaatctatttggctttagtaccgtacgaggaaactctcctaaattaaacgtggccacaaaaaaatcgttgtatggattaataaaatagaaactagatgttggcttgtaatttcgttataactcagctagctttgttttgtttttggccaaacgactcaaatctaatacaaactctcattttacttgaggcttggataaataaccgaactgagaaaaccaaacaagaccgaaccgagatttcgtgttttggatcggtttcggttctttcggctgaaccgatcgacaggactttaattttggttagggtcaggtcgaacctatctatttctcagatacttaagaaaatggattataccaaaattaaaccggttttcacaaaatttagaccgttttcagcaatagccgaaccaaaccaaactgaatttaacccaaaacccagaatttagtcaaaacataactgaattaacaaattaaccggaaaccggatcgaaccgaatttattttaggttaatatcgacatctgtataattttgttggcgataaccgaactaaccgacccggagaaccgaagtcgcattcctattgaattttacatttgtaaccaaaccggggagatttggtgacttgagatttggtttctgggtcgacagagattgtccgctaaaatgtcactgtcattaacaagtacacaacatataatatgttaaatagatgaacaagtgaacaaatggtttaagacttatgactaacaaataccctcatggataaactcacaaaagtcccaagttcagcttgaatcgatatttagatatatattatcaactatgtaaaaacccaaatataatatgtaactatattaatataagtgtagacaaaatgtatagactacataaaatataactagagtaagctcgttgacgcaacagtttgggagaaagacttaaacgaagtcaagtcgcttttatttaatgaagatgttgagaaatgaagacaataagaaacaactcaagtgcttctttcatcaaatctctcctatttatatgtttctaatttcttctcctctattcatatctaaatcccataatccttgttaatctctccatcatg

SEQ ID NO: 6053 - DNA, 3000 bp, Unknown; identical to SEQ ID NO: 6046
  misc_feature (1)..( 3000): cDNA_ID_3079341_gDNA_ID_1620839_Annot_ID_170019 3000 nt of promoter + ATG

SEQ ID NO: 6054 - DNA, 3000 bp, Unknown
  misc_feature (1)..( 3000): cDNA_ID_3079362_gDNA_ID_1620839_Annot_ID_170009 3000 nt of promoter + ATG
tgccaaaagtagttatcaaatttttttttttctagcgaataagttcttaggtttacatgagctcaattagttcattgatcattgttattcaaacttaatgaagtgtttagtttccaccaaaaaaaataaaatgaagtgttaagtttgactaccgttatgtttaggttagtgacaaaagttatgttattaaaattgattagtgtcaaaagttaaaccatgttaatcttttatttgataaattagacgtacagatagaaaaagtacgcatctcataacagttgaaaaacaataaaatcattgaaaaaagtttatgttcctatttaaataatttttagtttaatttttacaaaatttgttacgttttcttttaaagtgaaaagctttacataaaacacaaggataaaaattaattacaattttaagaagacatagtttttatagatatttttttgaacatgctataattattcgtttgaactttttttttaacgtgctcgaatcaataaccagccaaatcgtaatgtaatttctcgatctatgctattgaccatccattcgaaacacatcacattttataaaccaagaaacataatcatctaagaatagtgctatcccatatttcatgatttggtctaaagattcttcaatagggtttatttatgcttagacctacaagaaataaaagacaagctagagtaaaagtaggctataataattgtatacaaattgttctgaagtaacagattcatgatttaaaaatcaaatcaagcccatcaatttggctttgaaacgctttgtgtcaaaatggacaagacatgacttccttcgtgtctttcgtattagaaccaaccatctaaaagctctcttcctttttctctaccaacttttgtcttctatttaatttaccaaatcatgggaattaaataattagatgaataaaggatcggaataacaagttctatcgtacactgtaagagcaaaaagaagaccgaaatcttggttgaaattgttgtcgaaagatctcattcacgagatcacttattaacttacgtcaaaaaattatatcgaatcgaaagatctttgtgatattgagtaacgtgaggattttattttggttaaagactaacatatgttgatctttgataatcaaacctagtaaaacaaaacatactaaagggaaagagagacgatacatgcaattaatgatttcaatcctccgtttaagaaactctgattttggttagaaactattagctattcattttggatatcgaaaattcgtttagatctcaatgcaactaagaataaatgtgtgtaaaacagaaaacgatgaaatctcaagtgaagtgatatatcaaggttttaatttttaaccgagtttttggtgttttatcattgtgtttttattcgagtttttagtgttttaattagtatattagaatgttttcaggtaaacatatgaaaatgatgcaaaacttgagtcaaatggtaaaaaggattaattttcttgaacaagacattataccggtccatgattaatcaggctaagactgatccactcttcaaaacttcagaccggtctaagcagaccaattccaaaagcatttatgaacagtctatcctttagcaagccttccattcaagccataaggccggtcccaaagattgcttcgtctaataagaacacgtacgggtaaagacacacctttgaagaccggactaagacaccgaaaccagctccgttgcaccagacccgtccagtcctcatgaagtctaatccaaacagtccgaatccaatagacctgtcccaactccttcacgcgggactagttcagtccgagaaagaaagagaaggtattcctaatctgtttgggacttcgccaaactaccgactctaagaagatctaggcctattagacggatttcaaaagagatgatttcatactcttaaatttagagaagagttccataacactcctttttaatattttcgatttatttatgcattattctttatatttattttcatttttttaccaattatgagtatatagtttcattattggattttagggattcaaaaaggattcatgaatcattagtttagaatcattagattaagtaagcatcttaagagttatatgtctactgttattcgtaatgccgtaactagtttgatcacccaactacttatcttatgtgaattaacgcagtaaaagtggtggaattgttggaaaatatcctagccaacaaaagcattgtttacgaagttttgtgaacctatcaaacttaaacgtttataaataaatattttcatgaaatccaaacgaaactttaggcttttaattggttagatatcttgactgaactgtcaaggaaacgctctctgacccgataatcgatatcttgattggttagatggagctcgactgttctctcatctcttcaacctctgttaacgattctcctgctgttttggcaccccgaagagccaatccttaccaattatcccttatccttcgaagctgcaacgtatgggtttgctcttcgcagatctataaagtttggtacgctctcgactccctctgatgcccatccccaacggaaactaccggagcaaaacggcggcggcggcggcggcggttctaacctaatccttctccaagtcccccgcttgggccatttgtcttgccatttgggcttaggcccaaaccgtttatttctacggcccaacttcaaaaggtgctcttcaatttcatttttacaaaagcccaggtattgcgtgaagcgtctgttgtcctctcttagctttaagttgtgtcgattcatggagtcaatggtttgtggacgccacttgatctcatatcatacctctttgctctgtttgctcaacatttatctgaaaacctgccctttagaatcacctagaagttctatcaaagtttcccaaagcttgaagaagactctctcggatagcttacattatcacggccgtttgca

SEQ ID NO: 6055 - DNA, 3000 bp, Unknown
  misc_feature (1)..( 3000): cDNA_ID_1829890_gDNA_ID_1620841_Annot_ID_50886 3000 nt of promoter + ATG
attgaaggaattgagaaagttgcaccgttcttgaaagtcattatcgaaaagtgagttctcttgttctctaaaattgttccattcttcatgacattaaatatgaggaacattttgactaacagtggacctttttgttcacagagatttcataaaatcgctgatacaaggtttgctagccggtattgcgttgaagcttttcctcatctttctgccagccatactgatgaccatgtccaaatttgaaggctttacttcagtttcattcttagaaagacgatccgcgtctagatattacatctttaacttagtgaacgtctttcttggaagtgttatcgctggagctgcgtttgagcagcttaactctttcctcaatcaatcgcctaatcagtacgtgactctctatctctgttaatctttcgttctttttgggttacaggcttttctaaggactcttctttttaaaaatctgtgcagaatccctaagactattggcatggcgataccgatgaaagcaaccttctttatcacatatataatggttgatggttgggcaggagttgcaggagagattcttatgttgaaacctctcattatataccacctcaaaaacgcattcttggtgaaaacagagaaagacagagaggaagcaatgaacccgggaagcatcggtttcaacactggagagcctcagatacagctttacttccttcttggtcttgtctatgctcctgtgacaccaatgcttcttccttttatcttagtctttttcgctcttgcttatgtcgtataccgccatcaggtaaatgtagtttctttctctcctaaatttgatgaaactggctagtttgataacttgaaccttctgtttatttgttttcttattctcagatcataaatgtgtataatcaagagtatgagagcgctgctgcgttttggccggatgttcatggacgggttataacggcattgatcatatctcagttgcttctgatgggtttgttaggtacaaaacatgccgcttcagctgctccgtttctcattgctcttcctgtgattactatcggtttccaccgcttctgtaaaggccgtttcgaacctgcctttgtccgttaccccttacaggtcagtttcttctacgttatctagatttattatttctgtttagttcgatttttgtcactgtttggatcggttttacgagccccagaaatggcaaaatgttgattattttacaggaagctatgatgaaagatacattggaaagagcaagagagccaaatctgaacctgaaaggttacttgcaagacgcttatattcatccggtttttaaaggcggtgataatgatgacgacggtgacatgatcggaaaattggagaatgaagtcatcatagtgccaacaaaacgccaatcgcggaggaacactcctgcaccgagcagaatcagcggtgaatcgtctccatctttggccgttattaacggtaaagaagtctagtttaacggtttcaattcagtaaaagcatctgcatacgatttaagtatgaatatagttcgtgtatgtatgtacttttatgtgtacatagagaggtttgtgtttttgcttagacgttgttgatgggttttaattgttgaagtattgaagtttcagggtatttttagaataatatcattttaattgggtgtttttcaaacaatgaatttgtggcaatcttgccaaacaaaaatatacgaaatggtcgaatagttgaggcggttagggcggacaaattcatttgcgatttaaaccatttttgtgtacctttcataaactatataagccatgctagtgtaggttgaaaaagatagaacaagttgaactacagaccggttttacttaaagttagtccgtggtggtttattgtccgattcaaaaatagagtggtttagtcgattaacggattagtctgttttctcatgtcatccattgaaagccgaagagtttgtagaagtaaacaaaaagatataaacaataataaaacaagaattgcataattttgtattcaacagaaattataaaaaaacttatagaaagccacattacagtacaagaaatcattcttatatctaataataggagaagtacatgatttttcatcccaaaaaaaaaaaagaggtacatgatttacacctcgtcgatatcctaacgattaaaaaactgtaactactgattttactacagtatatatgtatcgacaacataacaatgtcgtgacttatatactgttgagctcctaagaaaaaaataacgctattattgatttcacaatagtagcaatctcaactccatagcgaatgacgtagagaaatgtaaccaagacattttttcagaaactatgatcgatatatttcaagaaaggtagacaaaaagtgagaggctattatgtgaatgaagtaaaaaagtagaactattgaggctaatttatagagaatgaattgtaaataagcaatgcgatgggctgcaaactcttctcgtaaatctgcaaatttattaagacagtgcacctaaatattaatgaagagagttaatgaatcaataaatttgaacatcgtgacttgttaagtttggtgagaggggaataaggaacgttctatatgtaaagcaatgataattaagagttaaggagttcatagttcatgtttttctctagtttggacttgagtccaaaatccaaattaatccaaaacaatgttgagcctaaactgtcccaagactcccaacaactcaggaagctcttgctgttttccttttaatcattgtgatattacattcttgatcgtcccacagggaaaatattttagccgttagaccaaatgataaaaaactgtaactgttgatgggaacggcgtcgtttcgctaaccttcgttttaactgatctcaattctcaaggttcaaaagagtacacacacacttatctcaattatccactgaaacattcgtctccggcgaaacaaaaccagaatg

SEQ ID NO: 6056 - DNA, 3000 bp, Unknown
  misc_feature (1)..( 3000): cDNA_ID_2138640_gDNA_ID_1620841_Annot_ID_170039 3000 nt of promoter + ATG
ttaaaaattagggatttcgcttaagtttggaatgggttttgggtcgttgggcatggatcttaattggatcggatactttgttgggtcgtctgggtttttggtcttttgccaattatttgaattttctctcatttatttttaattcgataaaaaatgggaattagaagagtggcattcctggttactttttcgcagatagtggcattcctgccatttattcgttcaattccgtgattacaccatttctctctaccaacaggtttcaattctacaaatcttcaaacccaattcattcaaacgtctttctttagctaatatagatcagcgatactagatttactcagattcatgattaaagtgaagaaagtgtgaatctttatgtgtgaaattgttgtggttcttacaagttatgatttctagggatttgaattgtgtaaaggtttgaacttcagattcatgtgtttgttttagtctgttagatcattgttacaagttatcatttttagggatttgaattgtgtaaaggtttgaactttagattcatgtgtttgttttagtcgtttagatcattagtttggtttttgtttttgtgaaggggtttttggatgatcagtttactgaattgaagaagcttcaagatgatggaagtcctgattttgtagctgaggttctgtctcttttctttgaagattgtgttaagcttatcagtaacatggctcgagctttgtaatttcgatctttctcttatctcactcataatttttgttagatcatcattgctttgtgttgtcttaaaacttcttaaaactgtgattgtgtctcaatcacaaagtctggctagaatcatcattgcttgtgtatataactcagggataagtcgacgggaactgtagattttggtcaggtaggtgcgagtgtgcattaattgaagggtagtagctcaaggtatgttttgtgtctcgcttatatcctaataacaatcaagaagtatactctgtagtagcagaagttctgtgttgttgatagatgaagctcttctcttgtactcttgtttttgatagatgaagctcttctcttgtactcttgttttcgatacagtgttggtgcgaagagggtcaaagctttgtgtgttagcttcaaggaatattgcgaagctcagaattacgaagggtaagcttgttcaacaccgcttaaggactcatcggttgagatgtttgcagcaagtggatattgagtataagaccttgacgacaaagcttcaagatatgttcaatgtgagtagtgatgacatagaatccaatttttggttcattttatgaatcattttgttgactaatgaacaaatttattgccattgttgttgttattgcagcttgagaaacaaatcattcaagctggtggtagagttcctcaagtggatattaactaaagagagactaatccataagaaacaagatgatgacttcaaatttggattgttcagtttctccttttttaaatttattttggattttggtgttttgcttaaaaactcaatagaatgtgtggaaaaaaagagacaagtgattgttgttgataaattagtagtgtgtattggttctttgatcttattcgagaaaatttaacatctttggaccaaattaatgtgattgatgatatattggttttgcttctggttttagtttgagtaagatatagcaattaccaagtgagtcttttttggctagtggtgcttctaggactctccaaaggttgtggtttttaagatccttagttcgattctctcttggaataggtaggtatgtccatttttttggatcgcaaatccgtcctgactcgtatccgtcccgaatttttcatcccattcaaatgattatttgtttgggacaattaaatatgttctagcggatacatgaacggattagataagagacaaggtatccgaattatctttaaaattttcaaaatatttgtaacaattttaaaattattcaaaagtttcccaaatttgtccatgatttatcatagttttccgaaattatccatttgaaccttactcaaattagtgaaagtttatgtgaagaaaacttaaaagtaacggttgcttgaaaaagaaacaagcacaaagaaatttgatcaccgagttcacgacttagccgctatgttccggggaagatttcttgctccccactttcactatgagaatgaggttactgacaccacttaaagtgtgatgttgtcttttggtttcagatacaagcgatagaagaaccaagatcaaagacacaaagatgataaagaacaacttgctcaagaagctcgcgtttctctcactcttgttctatatacctaaatttctcgaacctatattgttatctgaatttttcgtcccgtattttatgaagaatattttggaaaaatatgattgattatccaaattagctgctctaattacatgttacttcctatctcgatatccaaaatagacaccctagaaaaaatggtgattcattcacgataaatcacaaacctgattctaatcaatgtagattagaagtccaaaggatactctccaaaaaaaaattaaaaaaaaaatagtgattagagggagcacaaagataaatgtaaacgcgagtgtagaagataactatctctttacaaatagtctttataccttccgcaacaagtaattgttctcatcagtctctctatgagtaaaaagctaagcgaaagcgagactccacactctcagcgattcaggcgataatacctaaactcaagtaagggtttttactctggtaagctaatcaacgctctcatctttaacaaattgcgacctttatatttctctcttcttatgattcgtcctctatgttctcaaaatagcttagaactttttacaaatttcagactttcttgtaatgattcttatgggtttaaacgtatttgatgatgaataggatttgctaaggatttggggatctttgttcggtttcaatg

SEQ ID NO: 6057 - DNA, 3000 bp, Unknown
  misc_feature (1)..( 3000): cDNA_ID_3079406_gDNA_ID_1620841_Annot_ID_170055 3000 nt of promoter + ATG
taaagctgtttaagatcaaatgtgggagtgggagtcaccaattttagtaaattacgcttttaagtaaaagtaaaacttggatttggatggatatgaaatttagtggatcagcgatagtttttgagagtggaaacacatttaagatgttgaaaaatcatttttgaaagaaattaagtattttttgggggtttgaattgaatatttacaagaaactagattttaatccgctgaatatcgcgggactattttggttttttacaaataaaaatttaatttgttaagcctgttaacggctgttaacttatatgtccgattcgaccaataattaaaatacagtgttttatttggcaacaatttattaagtgatgtatttttatttcaatccaaaagtattgagtattaaacttccaaattaaaatttgtttgggattttttaagcatttttgcctttaatgttttgtattttctgaatgtataactcttactatgtttgatttttactgtttaaaaatataggaacaataatgtacagttcattaagttaaaatctagattattattaaataatttaaattttaattatgtttattttattaataatatttattttgttaagtttttaagataatataattatattttgattgttatatctaggatttcacccatggtataacgtctcgtattactatcaactcaaactcgtcctaccatgtaatctcgttcactgaaactaaacatatctaatagatttcactcttggtatatcatctcgtattacaatcgacccaaatctgtcctaccatctaaactcgttcactgaaattaaacattttgtttttgttattttattttaataatactttaatttaaaagatatataattcaaattaatttaaaaatcttctttcaaatggttatttaattgttgtaaaagtcatacattataatattctacatccgtctctccatctaatctagttcggtaaattaaacattatttttttttttttgttctaataatatttttattaaaagatttataattcaattcaatttaaagttttcttttgaaatggttatttaatttaatacatttcatatattatatatattctaaacatttttcggtaaatatcctaaatattttataaattttaaataactatattatttatctttaataaattataatgttaataaaatcctaacatttttcctttttaaaagtaattagaattgatggatatatattagataagtaaatgctaataattaagaatattaattatttgataataataaatgtcaataacatttcttgtaaataagttccaacttgaagatttatttgttaaaatggcagcgaaaatgtatatgtagaagatggagatcatatgttggtggttgctattagatgtaaaacataacgttgtactgtgaactatatgccatgtatttctcctccacaaaatctattctctggaaattaacctaaatttttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttct

SEQ ID NO: 6058 - DNA, 3000 bp, Unknown
  misc_feature (1)..( 3000): cDNA_ID_1829886_gDNA_ID_1620841_Annot_ID_170053 3000 nt of promoter + ATG
tacaagaaatgttattgacatttattattatcaaataattaatattcttaattattagcatttacttatctaatatatatccatcaattctaattacttttaaaaaggaaaaatgttaggattttattaacattataatttattaaagataaataatatagttatttaaaatttataaaatatttaggatatttaccgaaaaatgtttagaatatatataatatatgaaatgtattaaattaaataaccatttcaaaagaaaactttaaattgaattgaattataaatcttttaataaaaatattattagaacaaaaaaaaaaaaataatgtttaatttaccgaactagattagatggagagacggatgtagaatattataatgtatgacttttacaacaattaaataaccatttgaaagaagatttttaaattaatttgaattatatatcttttaaattaaagtattattaaaataaaataacaaaaacaaaatgtttaatttcagtgaacgagtttagatggtaggacagatttgggtcgattgtaatacgagatgatataccaagagtgaaatctattagatatgtttagtttcagtgaacgagattacatggtaggacgagtttgagttgatagtaatacgagacgttataccatgggtgaaatcctagatataacaatcaaaatataattatattatcttaaaaacttaacaaaataaatattattaataaaataaacataattaaaatttaaattatttaataataatctagattttaacttaatgaactgtacattattgttcctatatttttaaacagtaaaaatcaaacatagtaagagttatacattcagaaaatacaaaacattaaaggcaaaaatgcttaaaaaatcccaaacaaattttaatttggaagtttaatactcaatacttttggattgaaataaaaatacatcacttaataaattgttgccaaataaaacactgtattttaattattggtcgaatcggacatataagttaacagccgttaacaggcttaacaaattaaatttttatttgtaaaaaaccaaaatagtcccgcgatattcagcggattaaaatctagtttcttgtaaatattcaattcaaacccccaaaaaatacttaatttctttcaaaaatgatttttcaacatcttaaatgtgtttccactctcaaaaactatcgctgatccactaaatttcatatccatccaaatccaagttttacttttacttaaaagcgtaatttactaaaattggtgactcccactcccacatttgatcttaaacagctttatattctcaactttcccctttccataatttaaaaatagatcttcttttacattgagaatcagcatgattggagatggctagtgggcataaaatgttaggaatagaccacataaataaagcataaatcatataattataacaataccttttattggtaattggcatacactttcaagtttatatttggattatttcattagcttttttaaaattaaaatgtagaaaaccacttcctacaattagaagaattttattttaaaatctacgacaaaagaaaatatgttccttttcaatcattctacttaaatctttaggaccaggtttaaacaaacttcatgtcggtatgtctctcattgtcaagatctgaagatttgttttttttttttttgaaagaaagaaagaaagagacaaaacttcaataatttacattttttattctagatgaataaggagtgaaaattcgggtaagcgggtcgggttcagataaaatttgatcggatacggattcttcggttaaaaatgtttaggacccaataggataaatctaaaatattggttcgattttggttcaggtccaattggatttgggttggttcgatatagattttcaggtctttttttaaaccgatactcgaattttcgggtaaataccagaactttcggataaaatttcggatttttgattaaatttaaattttcgaataaaaattcgggtatatttggattcggatcggattcgaattcgattttttggataaagaaatttagaagtcaataaaataaaccttccggttgatttaagttcagataattagattttttggataaagaaatttagaagtcaataaaataaaccttccggttgatttaggttcagataatcagttccggttttttttggccaggcctactgatgaactgttattttggtaacttctaaatatcaaaacggtcctgaatcaggactgataaaacgttaaaaaagaaaaaaaaaagatctactcgtcttctttgtttgttcgttacagtttttacaaaaaccgacagacactttatctcaagagactgggtcaggcctctgttcaatctctatcaaaatccctttcgacatcattcataaacactgacgaatcagtgaaacaatatctcaaacccagaaaccaacaataattcatagattactactatacaaaattctatataactataatctgttctcttgtgtgtttctcgcgtggcttgcgtgttacttcattcatcactgctttagcttctcctcatatgaatctcgaggcaatccagtcactgacttttctcactccccatctctagggtttctctctttcccttattttataatttatttcattgaatctctgaatttcattctcttttgtggagtacatttgtgtaaagcttagatttttatttgggtttcaagcaaaccgagaaaagaaacgattagatctcctttttctgggtttgttctcaaagatttgttctgtttcagttcttccaatttggggggattttatgttggatccagtctctaaaggttcgattttgatgtgtttccttgatatgtaatcagatttgaatcttaaagtttctatctttatgactcctttcaggttaaaactgtgagcatttggagtagcaaaagtaacaaagcatg

SEQ ID NO: 6059 - DNA, 3000 bp, Unknown
  misc_feature (1)..( 3000): cDNA_ID_2138720_gDNA_ID_1620841_Annot_ID_170064 3000 nt of promoter + ATG
ttgataaaaagatagatgagttctcataagagattacaaggagtttataaagaaagaagtcttggaacacactcacaagactaccttggaaaatacagactagtttgaaagtttaaaaataacccttccacttcttggctccaaaatgactcttgatatgctattttcgtcacttctcttgaccagcaaattatccacttggtttggggtcttcttgagcttgtgatggtcataaaattggttggacttcatatatattacattgggccaacttctgaatgttataccattgtttggattatcaaatgggtgatttgaatgtgaatcatttgcctcattaaaaaccttgtcaagaaaaaccattgggacaaaacttgacaagggaaaaatagtacaaatgagacatatgcccatttgatgatcatgtatcaaaaccaatgaggttaagataacatctttcccatactctttctccgttataagttcattttctgtttcaaaatgctcctcaggttcaagctgctcctctgcttcaagctcttccgcggctacaagctcttgatcaaattccatgtcctttgtgctttccatgatcacatcacataactccaacgaatccactataatacgaccaacatcttcggtctacatgaagtctttcacgaattcgataaagttcttgtcttgtcagagttttaatataaatttaatagagatggaaattaattgatttcaataatttttgatttgactaaattaattgatttgattaagttttgaaaaaaaattcatataatcatattaccatctaatataaatatactaaactataatttaaaaaaactatagtaattttgtatatcttcaaaagtttcctttctcgttttaataaatgtatataaattttgattagtaaatactatcacaaccatttatttttcactaggttaggcccgcctaaataggcgggtttaaaaaaccaattataaatttttactgatgatatttgaattctaaatagtaaatgatacttcctatttttaaatatttaatttagtaaatttgcttaaaatcaaattttaatcttacaattttgattttgctgtacacttaatgactttaacggtattttattgatgaaaattaaattttaaatagtagtcaacacatatttttctgtattttgtttagtaattttctaaaacccaaaattttaatcttacacattctattttgctatcaatttaactatctatttcatcataatattcccgattttgattatgcacatattattttaatgaataagtgttaaattttatatcaaaataatatgtatatcatatcaaatcaatataattacttcatatgaaaataattaataaataacaaaacataatgaaccaaaaaaaagaaaaccacaaaatattttggaaaagaaaaattgtttaagatatagttttgctatattttataatctcataaattagttttacctaatgtcaaactcatattagatgacttcaaatttatgaataaaacattgaaattttatattaacattttcacaaataataaaatatcaatccctctaaaccctattttcctaatttttggtggtttctctaatgactacatgcattaaaattcttatattaaaaaataaatataactatacaaaaattcccagtgggtattcaaataaaatactatattaattgaaaatacaattttatcgaactaaattaatgttaaataaattattttgttattttatacttcagtgggttcttaattagttattatcattactaatggttttgtttaaattaataaatgctagattaatttaattgaccaatatcgcatgtaaaatcaaagtttttaattttatttttgattaataaaaattattatgtatatatatagagataaaaattagtgtatgtaaatttgtttactttttttaggtttctattttcttagagaataaaattttttaaatctttgatgacacatgtaaacatcttatcgttaaactttccatctatcatgatctcgtgagttagtaatttttgaaaccgtactttatataataagatttgtaaaattttctatgatttgattaaaatttaatactgatgttatgaatataaaaattaaaatttccaaatctccactccctcatcaaatctccctcagccttatcaaatctccactccctcatcttcactcccccatatattcacttccattgacattttaagaaaaaggattgtcaaaaggaaatggtatacattgttatattaccaaaatttgataacaaaatatagtactaaaaaaagaatttgttgtctgccttgttaaattttgtttttttgtatatctagtctatatatacatttttacagcacttttttgaagataatgttgaagatttgaggaataattcaacaattaattcaaatgggtgggttttaaccggtttaactctgtttggatcctagattgcataattttaaggaataatgttatcctgatcttggattgcagaagtttaaggaatatgtttcaatgaatattacctacaagatttcgtaaacataattaatattctcgagtgcaaatatattctcttatataatctttcaaaattcttgcaatctctacaattatgcaaataacaacctttgattcctaatatctcgatacaatatatatctcaatgacatcaatatattctcaaaatcttctgtgtaaactaaccaaggtttaaatccgtagcaaacttttcttttccctcccaaatcatcaaacgatctaatatctaatactcctattacaatattttcaatagatcttctcacacttgcagttacggaaaatctcaacaattattctcattaacataactagatcatgaaaattctgaatttaaaacgcaataagatcattttaatttaaaacttactgaattaaaaacattcagagtggatacaa

SEQ ID NO: 6060 - DNA, 3000 bp, Unknown
  misc_feature (1)..( 3000): cDNA_ID_3079398_gDNA_ID_1620841_Annot_ID_170058 3000 nt of promoter + ATG
agtggctcacctgagagtaacgacatagaatgatcaaagaatgtggtcaacttacaatcaaagagacatgagtccagagaaagtaactaaccaggaacagatggatgaaaatatccaaagcatcgacggcctattcccaatcttcttttaagatccaagaggttgctgattggatgcaccgccttataaataatgcgttattagacaaaacttttaacattctgaaatagctgagattactataatggagactagtactgcatacctcatatgcaacaattttctcaagcaatgaagcaggatcatcccaagtaatttgatgaagctctaaagtggcaggactaagccacataccgagtttctccttcagaaaagaatctaatgttcgcaaagacggcgtgttctcttttctatacattagaaacaaccatcagtgtcagatacaaccggaaatgttttaccaactgattcgaaactatcttcaaatatttgagtttccagtcacataacaagaggacaagaaacattacgagagtatcgacagaagatcagctcggaggatggacaaaaatctcaaccctccaggatgtgtattcaacctctcaaataaaacttcatatgttggcctaagagcatgcctcagattcctctcaatgcgatagaaaacagaagataaagcccccttatcatcatcacctaaagaaaagtactcgcccatcaatggagaatgtaacgaagaatcacacaagaaaaaacaagaatggcacaagaatgactctcactagctggagtttcaagtccaagatattgcttaacaagttctcggacttgctctcggttaacatcatactccttggctaaaacaagcagtaacttctcgcggtcttcaagcgaaaggctaaagtaaccctataagcatttttaaccatatatgtaatcagattgaaaaggttaaacacatcaaagatcagaatcaagaaacaacaatgtgaagatagttttacctcttgaaaatcattaagagtaatgtctaatacaccagttttactagctgagatagctgagtgcattgtctctcgaacaacatcataaaccctaaaacaaaaaccaaactcactactgcaaagatcaatggtgctaaatcaatatctacaatgagaaattaccttccagtggtaccaaaatcattagaattttgcacaatgtgatctctagaatgattctcttgaggattagattgaatttccttctgacaacaaagtcaacaaaccattattatagagtcaaattagccttattatattcttatcttcttaaaaacattcaagctccgattaaagccatagccaatttctcactctctctctctctttttcatcaaaagatgtaaacttttcattgcccatgattacaaattgtgtgaatttggacagaatcgcaaaattatccaaaaaattcaaacagagaaaaagaaaagcttacaggaaattgagagagggaaaatttggagggattgttggatctcattctagcacgcaacagaatcgctagatttttcttgctcatatctgtttcattatgatcatcatcatcacggttaaaatttcatcggagaaaaaaaggaactcaggaagaagaaaaaagcgatttcgcaatcagacatgacaggaaccttaaaatctggccgttcaagtatcggaaaaaaaaatcgagactttgtattcccttttcaacggatagcgtaaaggcactggcttttaaaacggcgtcggttttactttacctgtcgcttcacttgccacaaaaatttgaataaatggcaggaatgtcactttctccaaaataataatcacgaatgccacttattctttataattttatttttttttataattaaaactgatgtaaatatccaaataactttttaaaaaattaaaatatacagatccaactaaaataatccgacccaagtacaataaaataattaacttggcccaaataatactatatttttaatatgtaaagtaacagttttatccaaatttaaaagcattattcttaataaataaaaacaggattcatatttagaagaaaaaaattaaaattaaataaattttgaaatataagtaatagatttttttttaaaaatctctattgataaattcgaaatgtatgtattattcgaaatatgttttagttgttgataacatttttaattatttttgaaataaatatagtttatttatctatttatattaaaatttaacaatttaatatctaaatatattttaaagtttatcacttaataaatatagtttatatatattattttaaagtttatcacttaatacatatagtttgaaataaatatagttttgaaataaatatagtttatatatattattttggacaaaattttgtttaaaatatttaagataagaattatcttttaaattatagttaaatcaaatattaacttatggattttttctgtttaaagttttaattatattaaattataatgaggttattttattaattttatatataaagtaggatatagtatttttcaaataaaaactcataaaaaaggcattttccaaatttactcatatcatacgcccgaaaaatcgattggaacttattcaattgaacaatttgaactatataagttgaactcgttcgattgaaccagatgaactagatcagttgaactatttgaactagatcagttgaaccatttgaactagatcaattgaaccaatttcagttataccattttattatgcaacaatggattggtttggggagcaacgcgattcagttactacattgtactgactaccattgcaaatatctaaacagccatttttgtttcgttcattcactttcttcaatcgagatctatagacagagtagaacaaacaaagcgcttgtaaagaaaagaagacgttgcgacggaagaaaaagcgaccgatgaaatatatgagtcgaccggag

SEQ ID NO: 6061 - DNA, 3000 bp, Unknown
  misc_feature (1)..( 3000): cDNA_ID_3079402_gDNA_ID_1620841_Annot_ID_170057 3000 nt of promoter + ATG
gaggagacgctgcaaaattgctaataagggtttctagtttgcttagtgggggtatatatatatatataggatttgtgaatcatggctcgcaaatttcggagatcgccgctgagtagtggagaaatcgaagaaaggaaagtgaattagggttctaagtctcagaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagatatg

SEQ ID NO: 6062 - DNA, 3000 bp, Unknown
  misc_feature (1)..( 3000): cDNA_ID_1841673_gDNA_ID_1620841_Annot_ID_170056 3000 nt of promoter + ATG
tttttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctatggagtcatcttcttcactccttcatcactcttacctctcttaccttaatccaaaatttggaaaaagacctttggtttcttatccattaatgcagagttcgcgaaaatgcaaacaaactcgcatttgttctaacaagatgtatgttcccggtatgtaacaatatgacatattcatcacaaaatgtggtttttattcatacagaattgttctatatagattaatgcctatttttctaatgttttttttgttatataattgaattaggctttggagaagcttcaccggaggctaaggcagcgaagcatcttcatgacttctttacttacgttgcagtgaggatagtgtctgctcagcttgaggttgatttgacgatttatttgattttttaatttaggtgttttgattaataataagtatgatctatatattaattaatgacagagttataatcctgaggcttatatggagttgagagaatttttagatacaaactctgtaagtgacggtgataaattctgcgccactctcatgcgtcgctcttcacgtcacatgaacttaggtaccaaaaataacacctttatatcaataatttggttataaaattctagtatgcgttttctttttgtgaaacttgttagttggaattttaattctaggttcttaaagttatacattatacttttttaacaaatttggttttcttctagtaatttagacgaaatctctttactttttccaaacattcttttcgtacattggaagttgaaacttctcactaaaataactagttatgggagttcggtttatatattcggtttcagttatatccattcgcttatcgtttttttttttgttttaaagtttagtatcccttcggttaatttgaaagttcggttcggtttcgattatttcggttttaaaatttagtatccatccggttattttgctttaaatatttttggatatttcggttattttcggatatttttggatattttcggatattttgagatattttttttattatttttgaatatttttactattttatatatattctcaagtatttttaattatctagtctagaaataactaatacttttgtaaatatatatttatattttagatatttttggttactcaaaatatttcggttggtatccattcggtttcagttatttcgattataaaattttgtatccattcaattagtttctggttatcggttctgtttacttcggttttggtttggtacatctggttcgggtaatttgctcaggcacaaaactaacagtataacacaactaatctgtgcaattcttgtaaagaaaaactacttcaaaaattgcgtgacgaaatacaattccaccaatttgcggattactaacgaaatcactttgtagatccataagtttcgtatatcttttaggtatacatatacttgatatgagataagtaaactaaaaactttgctttttttttttggtatcatggcca

SEQ ID NO: 6063 - DNA, 3000 bp, Unknown; identical to SEQ ID NO: 6058
  misc_feature (1)..( 3000): cDNA_ID_1829886_gDNA_ID_1620841_Annot_ID_50887 3000 nt of promoter + ATG

SEQ ID NO: 6064 - DNA, 3000 bp, Unknown; identical to SEQ ID NO: 6062
  misc_feature (1)..( 3000): cDNA_ID_1841673_gDNA_ID_1620841_Annot_ID_50888 3000 nt of promoter + ATG

SEQ ID NO: 6065 - DNA, 3000 bp, Unknown
  misc_feature (1)..( 3000): cDNA_ID_1829882_gDNA_ID_1620841_Annot_ID_50889 3000 nt of promoter + ATG
agaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagatatgagcaagaaaaatctagcgattctgttgcgtgctagaatgagatccaacaatccctccaaattttccctctctcaatttcctgtaagcttttctttttctctgtttgaattttttggataattttgcgattctgtccaaattcacacaatttgtaatcatg

SEQ ID NO: 6066 - DNA, 3000 bp, Unknown
  misc_feature (1)..( 3000): cDNA_ID_1829979_gDNA_ID_1620842_Annot_ID_50892 3000 nt of promoter + ATG
ggtatatttgcaagaccattataactacttaactgacagtgtttgaaattggaaataacttttttttttcttttaaaaaacaaaattggaaataacaaaattggagaaggaaatattaaaccatataatatttgctatgtacaaatattatttataaaatattttatgtttttattatctcaatgatggtgaacatatgtcagatttttacattctgtcatatataattgtttttacaaaaccataggttaaaaaaaaccaatttttttcaacttcatgcttcttaggttaggctattaggttcttccttcaaaaatatttgcgggaagttgctctcaaatataggattgaagcatttttcatattcatgagtggatgaatccaaaaggtttcgagcctctagaggttttctgcatgttttcgttgggttgtcccatccgatgttcccattggtttattatactgtttttcttaaagttttgttaaattttattatgttctctccttgatttcttatattattagtgtaagtatcttccatatttagtatcgaggaatatattatctattttttttttggaaaaatttaaactgttttgtagatgaatatatcaaactatgttaaattttatgtattttccatatatgctaaaaaaaaattctcgtgcaaactgaattttatttaagaatttaagtctttacaaaaaaaggttttttagccacattagctgattttctgaatttgcttgaaactacgtgaacattgaagaagctacgtgatgtgctacactattacaattacggtttgtgaatataaagataattgattcaaattttgaaacccaaaaatctatatttagaagtaaactggcaatgttcgaacagaatagtcatgccgttgaccgctataaaaaaattttaaacagaatataattacatgtatattaagaagttcaaaaagaagctatttgattcatcttttttttaatatatttttaaaccaaaatattgatagaacaatagggaaaagctcgagtttaaatatgacctcgtgaatttgttttttgttgtgtttttgaattattgttaaattatattcaaaaaaagaaaaaaatgttttacagcttaatgaatacgatttcaaaaacaaattctaacaacacaattggaacttaagctcgtcttgtagcaaaccaaacttgaagatcctcttcatacttatggattcccctataccccgaattgtacttaaacgatttctcacatttttgtcgatcatcttgatctggtggttatggttgttcaccgtgtcttcttgcattcctctctctccaaattgagtgtaccgtattttgaaagatatataggagaatgtaaacttttgttttctcatgtacattatgttaaacttaaatatatattccatttatttttagtataaagtttttcaacaaaatcttgatgtaacaacatgagtactttagaatagatgaaaataaaactagcttataaaatacaaaatgtaaaaataatctaaaaatgatgtaaaacacaaaatataaaatacaaaacgtaaaaatgagacatcaatatattgttctgtgaactttatatatagattagttacaaataatctattgtaaatattttaagatagacaataaattaatactttttagtaaaacatacaactagttaataatctaacgaccaatataaatcaactgccaaaacaaaatatatgaaattatattttctcaaaagttaattggttgtcttaaaatgaagatgttgactctgagtctatgatattagtcaaaatgcattttaacttttatgtacattccttgtatactaaaatgtctaaaaacacggtattgaatttcatttattccgtattataaaaaattacaaaaaagcccttcaaaatatatggaaacaaaattgtaaaataactgtaaaaagtaaaattatggttttgagataccaatatatttttgtatgaaattttatccaaacaataaataaatattgtatttatttgttttaaaattatatatgatggaaaatgaatcaatatttgttgaaagttggcaaatggtagaaacctaacggctaagagaatacgacgacgcaaatgaactgttttgactaattttaggaaaaagataaaacggttctctttaacaaatttgtcgcgtttgaatacgacatcgttaaaaactatgttaaacattatatatatatactaaaaagttcaaaaaactataaaattttagttttctcatcctttttatctttaaattatcaatgatttgttgttgatagaccaataatagctcacactaaagtaatttaaattttgaacacacttaacctattatctgcacctaaactattttattctataagtagaatgctcgttccaacacctcatattgttcaaaatgctcgttcatttttagatcgtaattgtctaattattaatttataaaaattgacagctttccttttaaaaacaaaacaatacaggtttgactacaaatacacattttcgaacagatagatagagagagaaaaagaaacacaataaaacgcgcgtaaaaaggaaggctaatttagtctttttcgtcgtaactcccataacgagacaaaacaatcttaagtgttccctctcatcgtaaaagcttttctccttccttctatgtacagctgtaatggcaatatcgtaaataactcgtaacagaaagggcaattattgtcaacatttataatttaatttctcccaacttctcaaattccaccatttttcttcatcctctcctccataattgattttccttttttttgtttttccttcttgcaactaaaataaataaatttttagaaaccaaaaaaaaaattgtagagagagaaaaaaaaaactcagaggagagaaagagaagacgacgaagacgaccattttttttttttttgtcaagagagaagacggagacaaca

SEQ ID NO: 6067 - DNA, 3000 bp, Unknown
  misc_feature (1)..( 3000): cDNA_ID_1829975_gDNA_ID_1620842_Annot_ID_50894 3000 nt of promoter + ATG
agcctacacaacaaaagcaagatatcaaattcagtctcctctcaacaaatttctcaacaaaattgattaccaattcccattaccttaagaccttgttgagaatagagtctctcctgcataagtaatagaatcgttgggacactgtttcctttctcatcataagaacattgcatcgattccgccgatacaccaaacacactcacactgcattaatcaaagagaatccaccattaaataagaagctacaatttcagatccagtttcagattctaaagcagtagtgaaattttgagagattaccttgcactagggactcgacatgggatctcaacttgaagctcgtgagggagaccaagaaagccatggaatcgatcgaatgttacatgagtgatgtgtcgaacatttgttggccaaccgatctccatgtgatgaacggcggacgaaatccctccgcctactccgccgtcgtcttgtctgttgtctacacggcaagaaaccacagatttacgcagcgccgttaagagaaactcaacaagagacagttgttgctgattctgctcttcttcttcttcctcctccgccgttgattttctccttcctccttttcctccgccgccgcaacctccgcctttagtcatcatcactagccccgtcattgagaactatgaaagattttcgcagcttctctctctctttctctctggactttgtgcttcttcttctctctctatggaagtgaatttgatttttgaaattctcgaaaaggtttctctttcttttttattcttttatgtgatttaatataatatatgtttggttttgaaatttttgtctttttggttggatttcaaagcaacggtccactcatttcaaaattttctccctctagggatattatttatctaatgtagcttttattggaatcacgttttaccccaaagaacttctctaaatctacgataatgccactcaatttaattggttgttggttgttgacgtggcgtttcatttatggatctacttgattttttgatttttttctttgtcaaattgacattttattttggatatataaatattttcactattaatattgaatccatgttttctctctcttttccctctttaaaatcttcgagagagagagaaagctgaaaatcactatgccgtccggaattcttttcggcttctgcctcttccgataaggattatcgtctagcaactactagttctttccggtgttggccaagttttgtccgacatcatttggctttcatagtgatgatgctcggctatgccgtcagcgctcttttgctgctttttgttttttcataaattagttttgttttcaataattctcatttgagatgtgttggtgataatgatagagcgattttcgcttctgttacttattatccaacctgtttttctttttgagtttagaagtgcaggaatcaaatcagagatttgagttgaagaacaaaagtgatttccgtcgcatattaacattgccttgagctgttgtttctctaattggagctttgattgttttaaccggtgaaaacccataagttttcatgtttgatttgttaatcgacgtcgaatcttcaccagaatcgatgtttgacggcaaaggatgaagtcgggaaaactttggattctcatccaatacgtgtattggtttctctacaatagaagacacgtggctttggatagagacaaaagataatacatttcttcttccatgttggtttctctgatgggctttagttgggcctaatatatttctgtagcttttgtgttatagggcattctatagcccaatgtaatatttatcttgctcaataaaattatccctcttgtgaaaaaaataaaaaaaattcactttttagattatttgtgatctatcattaaagttagtatacagatattttcatttcattttaaaaaatattttcagtttttattttgttaaacatatttgaaatttttattcacaactaaaactaagaaagttttttttttttgttgatactaattctttttattattatactaataaacttatttttctttttcatataaaataataataataaaccaaaatatttgttttttgtaatgtattattgggacaaaatttcatttgcaatgtaaagaccaattagatcacagtacgtgtgtatatttgtttttccttttttaccctttatgagcatagttaaccaaattttgttattaacaaaccggtttagcatacataaaaaaaagtttaagtcctccgccgctagggttcttgtgcgatgaagccgtctccgagaaatttgttacatgtgcgtcaatttcttttcagtttagattgaactaaacctattttactttattagatctagggatacgaaagatatggttttgatttttaacgattttatcattttcttccatgttcggtttctctgatgggctttagttgggcataatatatttctgtagcttttgtgttatggggcattccatagcccaatgtaatatttatcttgctcaattaaattatccctcttgtgaaaagaaaaaaaaaattcactttttaaattatttgtgatctatcattaaggttagtatacagatattttcatttcattttaaaaaatattttcagtttttattttgttaaacatatttgaaatttttattcacaacaaaaactaagaaagttttttttttttgttgatactaattctttttattattataataataaaattatttttctttttcatataaaataataacaataaaccaaaattttattttttttgtaatgtattgttgggataaatttcatttgcaatgtaaagaccaattagattacgatacgtgtgtatatttgttttttccttttttacctttaatgagcatagttaaccaaattttgttattaacaaaccggtttagcatacataaaaaggtgaagtcctccgccgctagggttcttgtgcg

SEQ ID NO: 6068 - DNA, 3000 bp, Unknown
  misc_feature (1)..( 3000): cDNA_ID_1829971_gDNA_ID_1620842_Annot_ID_50895 3000 nt of promoter + ATG
tatcccgagacacatatattatttcttatatacacatgttttgctgatttggttttaatggatatttgtatatgtaggttctctgttgcgccatgcagaatccttgatccctagttccctcaacgaggaagattttctgcttttgaggtaacataaagcctcttcagtcattctacttttcacctatgactacattaaagttttgtagttctcgagctgtactattttatgtagccgttgatattatttttttccggtatattgtcttctgcagggtgttttgtgaccagttacagccgttaatccattccgagtttgaggaaagtcaagtacaggtgaaggtgaaaaagctttttgctctcttatacattggttttacaattctctggcttatctgtttagttacactgatacaagtaggtgtaacaaggttttactcatgtccatcgtatgttaaatttctacgtaagacagatcttttgctaaccttcaaatgttatgttgtactaggatattgaaggtaggggcgggaatttatctggtaagctaaaagagcttctgaatcttaacaatgaggaagcttcagaggattgtgatgtccgagttgaaggtgtgatgacaaagcaaggcgtgaacgaggagatagacacagttgaaaggttgaaagagagcgatgcagatgctagcaatcttgaaaccagtggttcagatacaagctctaacagagggaagggtctggttgaagagggagagttggttcagaatatgagcaagcgatttaaaggcagtgcatcaggagaggtgaaggaggatgagaaatctgaaaccttccttgtctttgagaagcagaagaagaaacggaagcgtagtattatgaatgctgatcaaatggggatgattgagaaggcgcttgctgaagaacctgatttgcagcggaattcagcttcgagacagttatgggctgataaaataagtcaaaaggtgagttcaagaattctactctttttaatttccaaccacgtattacgaacgatgcgctcgttgattacatgattttgcagggttcggaggttattacatcttcgcagctgaaaaactggtacttgcttttatttgttcctcttcgtcagctgcaaagagaatctcgtaatcactattcattatctgacattgaaagtttattatcaggctgaataaccgaaaagcgaaactagctcgagcaaacaagcaaacggggccagctcatgataataacagctcaggggatctaccggagagtcctggagatgaaaacacttggcagcagaaaccatcaacaccaattaaagatcaaactgtaacagaaaccccgaaaacaggagagaatctgatgagaacatcgtcatcatcagaagaagggataaagcaagggcaacaagtgaggcttatggatgagagaggagacgagatcgggaagggaacagtgttgagaacagacggtgaatggaacggtttaagcttggagacaagacagatatgtgtagttgatgtaatggagcttagtgagtcatatgatgggagcaaaaagatgatcccttatggatcagatgatgttgggaggactttcacagaggcgaattcaaggtttggagttatgagagtggcttgggatgtgaataagcttcagtattagactcagttgcattgaatttgaccagtaggtttttgatttttgtttatttttaactgtttagagattctcctctgttttgtgagctttgtctctctctctctgtggttatttacaggcaaaggttgagactttgagaggaaggtaataacagaaggaatagtttgacttttttaatctcagttagttgactttacagctatttaaagaaacaaattttaattgtttcgtgatttaaggagattaactatagtaaatttaagaagaaatcaattccataaagtagctaatgattatatttgaatatttaggtggtgttattcaattatggagttaaagtcaattctttaaactttagatttgttttctatattgtttttaaaaatatgtttgtatgaatttcaaaatctctgcaatatgtcatggatttcgattctaatgatttactcatgaaactccaaagaggtttcatttcaaatgaattaatatacaaggattttacaagatttttagttttgaataacactggattttaatgaaatatttaaaatcttaattgaataacactaaactttaaaatctattaagcatgatttacaaagatgagttccaataacactagattttaaaactggatttagaatcattagttgaataacagtggattagtgttggatttcaattctattaaaatccattaactaataacacccccttagataaattaccaataaggctacagcttatgcattattattaaatttgttgaaaatgtgtatagaattagaatgttcctctaaacgaaaattcaaatttcaaagtttcgataataaagtgttgaaatagaaatgcttttcttagaattgtctacacacagtatttaccagatataaaaaaaaataacaaagggtaatctagacaattcacatacatataaagccgttgactaaagaagaagactaaaagtccagctcagcgaaaacgccttttctatccgaagaaaactgtgtcctccaaaactcggcgaagcaaagatttttattttattttttcttctcttttaattcaaaaacaaaaaatagtctctgaaaaaaaaagaaaggtttttactttgtggagaagacagagtccgtccgtcgtaactcgccaccgttctccgccgtgaattcttcttactccttcgatctgaactttctacctagttctttcgtccagtgccgtagtctttccttctttgattcgctttctaggtttcgtcttctcatttctctgcttctggttcagtattttggctgttgcgggatcgatttatacccgtaaagtggtttcca

SEQ ID NO: 6069 - DNA, 3000 bp, Unknown
  misc_feature (1)..( 3000): cDNA_ID_1829952_gDNA_ID_1620842_Annot_ID_50900 3000 nt of promoter + ATG
tctatgtgtaagctttcatttcctttttactttggcacaaatatattaaccattattcgttcttcgaggttcatgctaatctagtccggtcatgtcatatggcaaacggactcgaaaagtcgagctatgggtatttggcctttataaataacatatgtggatctataacttaattttgattaatagaggcataatataactcaaatattaaataaataatatagacaatccaactcaaatattaaataaataatatagacaatccaatttctctagcaatcactttgtaatgctttttatgattttatttgctcgcatcactttcaatataataatggctttttttattcttctttaaaaaaaaaaaaaatgttggtacactactgtttttattattctctttcagaatcttcttgttgaaaataaagagtaatcaatcatttacttggtgatattgcagacacttaggaaacggtagaactcgtgctccgtatcgccgagtaagagtagcaggaaaaagatgataagatacacagcagcaatatgagataatctggttttggacacgtgaaaattaacttttcacagcagcaatatgatatgattttcacgtatccaaaaccggactatatcatagaggcaccaaagaacttgtggacgagaagcatccacgtctcttcagacgacccgtagattaccgcgacttgtttaccttctatcactcagaagctggtcgtaaagttcaatctactcttcaagcttacatgtgtgcgcttgattccaagttttaacagagttaggtgattttaagtttgtcaaaaaccatgtagtaagaaaaaagggtttttgattagttgagtcatgtctgtttctgtgtgattcgtctttatatggatttttttggaggtctaagtctttgtgttgtatgaaaatcaatagagtatgtgtgcatgcatgcacatgcacatgtacaataatgtaataaattattgtatttgtatttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacata

SEQ ID NO: 6070 - DNA, 3000 bp, Unknown
  misc_feature (1)..( 3000): cDNA_ID_4257535_gDNA_ID_1620842_Annot_ID_170091 3000 nt of promoter + ATG
ttttcgtaaatggcaaagaataatttatctcgagaatgaggaatataaacaatgactttataatataagtattatactatattatgtataatttaatattgtgtaaactatatataaagtccttttacagcatttaaatatagatatttattgacacactagtgcaacaatggaaatatcttgaattgattaaaaaaagttgttatctatacaatatgaaactctttgtatatcttaggtgcaaaactatttgataatataccgatacatagtataacgatattattggataatcctccaaaactcagctttttgtctcgaaacttaagttataacaaagttaattgaaaataatgagacagtactagagatgtatgataaaccaattaaagttgaaaaagttatattcttatttagctttgccgtcaaaaggtacgataaatggaaaatatgctcttgtcttctgagcctcaaaaccttaagaagattcttacatatcttacatgtcaaagtaaagagatagttggtaacacattcccatgtggtccggaaaacaaaagcttcctttattgttttggaatattaatcagcaactgtgtagtagtattctatgttgcatacgtaaaacatataaataacattataatcatattagtttgaataatagattctaataaaagatgatgtatctttagcctagtgatacgtctaatgatcttaattaaacttgtttaatgtaatgagttaacactcaatattaacaaacaaaaacttcatattctggactacgtatgttatacatatttcaaatatacatcaattgtctattctcaacttattatttatagtctctttgttttcttgacaaattattggtcatatttttctttcacatggttccgaaggttacgttttcatgtatatatacatttgtaaaaaaagtatatatataacatttgtacaaaaagcataaaaaaattaaaatgtttatcccgattgctttttgtttgtcacatcaatatttagtgctctaaatattttggttgagtcacgaaactgtaaattaaaatcgttgaagttgctcaattatatatacgtcaccgaagttgttgtatattaacattgcatgctaaaatatatttcagatgtttaggacacataatgcattttccgtaaaataaagcttaaaaataaattaaaatatggttttataagacactattttatcttcttttttttttttttttttttttttttttttttttgccaaacccctattttatctttttatcttttgaaattttttatgatgtatctatgaaaatgatttgtgactaatgcaccgaggcttcatatgatttcattaatcacatcccatataaaatcacgggttatgttcataatttgtttattcaatattagactactatgtgaacttttagtgaattcacttttttttttatccaatcaaacctctggtttcagaatttagtttccagttttaaacttttttcttgagacgtaaaagctctcatgctttgttgatgatgtagtggtggagaatcgtgatcttcaacactttcatgtaaaaaggcttcatcatcgttaatggcatcttgggtttactcttggctgaatataaaaaagaaataataggattgatatagactctatatattaagaaataaagtaagacagtccacggcaacgcatgtgattataggaaccactatcatgcaacgacgtggatcagtgggaaccgttgctttcgaaagcataagagagacatcaattaattacaaagaaattgtgtaaacacatttatatatatcagtgacatttgagattggttttgacaaagatatacaacttctctcccgacataaatgtctacaagaatacgcaagttaatcatatttggagctctttcatctatagttgtagacaatttgtacactctattagggagttctagacttttgatgaatagaaacattttcagaatttgctttatttttttaatataggaatgtgaatattattttaaatgattcgtttcaaactttggatatatagtcatgtattcttataactagaaacttcgggtatttgggtaaaattttcgattatttggatacaaattcgggtattgggtaaaatttcgggtatttggatataaaccgatctgaaaccgattggatccgaaccgaatccgaaccgagattttctatttaccctattgggtcctagaatagcatatccgacatatccgtattcgaccgattattacccaaacccgaccagcatacctgaataccaagccgtaatttagatatgcaatttataaaggctaaaaaatcgtgaaaaaccattgtgatatattataaattattttttgggagccctaaaaacattacatattttggaagctcgagacaaaagcctttcttttttttaaccctttaggcacggttatatgaatcatatgacatgtaatatagcagtttgtaatagtaccgtcatattgtttaaccttcaaattcaaatatgcatgatttatgttcttgacaaaaatatgtatatttatgcaaaattaaatattcatctataacgatcatattatctatactgttaattttaaaaggatcatatcatctatactgttaatttttaagtgatttttttttataatttggatcccattttatttgctcttaaaaactttggatatacttgatagctttttaacaaacaaaaataaaataaaaagtacttcgagcccacgtaaaatcgaataaacaaaaatttaatttgttgaacaagttggtgttttgaactaaggcccaataatagtaagaatactaaaatgggcttaagccgggtcgtcggatcgggtttaagaaaaaacagggtcgaggtttcaagagaaacccttgttactcaggcgactaaaaccccaaatctcatttgtgtgttcgcctttctctcgtacaagtcaaa

SEQ ID NO: 6071 - DNA, 3000 bp, Unknown
  misc_feature (1)..( 3000): cDNA_ID_2999710_gDNA_ID_1620842_Annot_ID_170085 3000 nt of promoter + ATG
attccagaaactaattaaattcccagaacaaatcaacacaattccacacacgatttctcaaacatagcagctcaatcagaatgcaatcgaatcaggataaaaaaccaaatcgtttgatcattcaaccaaataacaaaacacggtgccgcaaactgaccggaaacgcaagaaaccgcgggaagaaaaaaagacgatcggaagagaattcgatgagagatagggattgatgaatatatatatatatatattaagagtgttgttgcagagagcgagagggcactgtgataaagagaacaagtgcgtggctacaagacgaagaaggagcccaacaaaattgatcgtgagcttttattttctttctttgggtaacacaaaagagggttggtgcttaggaaaaaaaaaatcataattactgatttgcccctgagggtattttagtcattacaatttctggtccatattgttctgatttcaacaacatgatgaacaaaagaatcgatgacaaggatggataagagagaatgctaatctgatcaacaaagaatctgttcgaaaattcaaagtaaatcattcattctcctctcatgatgatgatacatcaagacatgaagcttgttcttcgattcattgtctgtatttggaccttttctttgttgaactccgggtttatgcaaactcctcgtcgtcatcatcttcttcttcctcgtactcggaatcagattcctcctctctttcaggttgcatcaatgtattcatgtcaaaagaagatggatcagtttctacctcttctatatctattgtgtcgtagctcattctctgttcgaacttctcatctgaacagtttagcatccaagccaatgaacatttgattcccttcttgattatcttcttgtgtctcggctttaccgtggactcaagcccatacgtaaagaatgcggggaaatccacaaggtcttgaagaggtcttttcatttccttttggaagtactcaaagctgagtttcattattccgaggttcaaagccagaacctgaggacacccgattaccatttcccttgtttggtctatcgaaaatccacacttggtaaggaaatcaatgtgctttaacataggagactcgctgagactaacaaactgcggcattctctcgatcaaagagccaagatcctctggatttagatgaatggctgaacaaagtagcttcctctgtgtgtcgagcttaggtttaaggtcgattccgatgatttcaggatactgcgcaattatagaaggaagagatgtttctctgacattgaaatcttgcaggatttgcacgtttggtttcaccgtatcatccaattcaaacccgagtatgtgaggccgcttctctatcaacctagctgcagccagtctcggaataccaagaacctcgagatactccacgagaggcttaattatccgagctacccgcattcccaaaatctcagggtaccgtgttaaaatacccccaatctccctcctagctacacctataccaaccaaataagcgactgatgtgctcatagtcccttccagcttaaaccccaaaacttctggatacctctcaagcacccgaggtacatcactcggtttaatatccagtccttgaagatacttaaccaccggtgcaagatctataacaacgctagagtgaagaacctgcgggtatcttctaagaaactcagtgaaagtcgatttcctgacgcctagtttcccgagataatcaagaaccggaaccatgttcttcttcacgctacaaccaagaacaagagggtaattgttgatatcttcaatggtaagccctaacttgtgaagaaactcgacacgctctttcatcacatcagctgttacagggagttcaaggccatcaagctcatcaggaacaatcccaatcccacgcaagaactcataaaccttagcacgattagcagctttctccttattcatatctaacaaactaggacgactatacaaagacttagaatctcttcccttatccttatctctatccctatcccttcccgaagaagaagaagaacgagaagacctttctcttctcggtgaatccaaagaacgtgaagaaaatctccgatttgcaatagcgcattgaacagttagaccaattccagtcccaggtctcttcttgtggttgcataagttgccataagtggaatcagagagtgaacgagatctaacggcaaaaaaagatggtggctcaaagtgaactagcaaaaacccaggctttgtgaagccattacagaacctaatcttcattctttacctgcacaaaaacggaacaacactaaaatcgacgattatcaacgagaaaatcataccaattcggactaacccagacaattttacagtacaattagctcagaaaactccgaaaaaataccatcattcatgttcatgttaacatcaacgaaccaaaaaaccataacctaactagaagcaaaccacagaaactatggaataaggagaattggaccagcgtgtgattgaaatctcaccggagctgaggaaagatatcggagaagacgagggttttagaggagcgggtaaggttttttcctcatcacacaacaaagtcactctctttctccattgaaatgatttatccgaattattgacgttctcccccttatttcttatatttcccattattgccctatactatctgaaattatcacattaaaccaatacgtatatgattactttggatgtgatataaattaataaaaaaactatatatcatcaaaactttctcttaatatttctaaaattaattaattccctccttttatcttcaacattggattatcgaaaatgaaaaatagtattttctgactcttttttatagtatcgggtttaattcagaaatatataaagctttggggtctgtttcgaagtatctttactcttttaacagttctgagacttctaaagagaggaaaattagttcgtcgaagcatcgagaaa

SEQ ID NO: 6072 - DNA, 3000 bp, Unknown
  misc_feature (1)..( 3000): cDNA_ID_1829948_gDNA_ID_1620842_Annot_ID_170081 3000 nt of promoter + ATG
taaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatgcctctgcctatattcccgtcgcggttacagtgttcgtcttcatcgtcttcgtcgtcgtcgcgatcttcgttttttaggcctaagcttcgaatcgatccaagcttgaccttaattccaggcttatccaacgacgtcgggagactgattctctccttcgtcccttaccctcacatctctcgtatcaaatcaacctgtaaatcatggtacgctttcctctcttccaaaaccctaatttcactccgccatagcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtagtaggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagcaatgacttggagtgatgaccagagttacttactcattgtagaaagtcaaacgtggcaacacagctttgcacgcttcattgacatacacgtcgacgaaaaaaccatatccgctcatcgagaaagtcggaatttttccgagaaaattcaaaagggcgaaaaaaagagcttttgcgtacagttttcgaattggtctccttcgtacgggtaaaatcagctcaaaaacctgacctttatttttctggttcttcacatttcccgatctgattttagagtcatagcttttctaaagttctcaatttgaactcatactgtttctgggttcttctttcgatgtctctggtgattttaacttttgtgctatttttaattcgatgctgaactgattagggttgatactgtttctggtcattattcactacgcagataaagacgacggctttgattttttttgtttggatttagggttttgtgatttctaatctctccttgtttattaaatctctcagtagattgattgtcaaattgaagattgatgaaactctgatatgatcgtaatcgtcgactgttttctttgattttagctcttcataattgggtttaaatggcaagagggttttaatagttttgacttacattgattgttaaacttaaattgatgattgatgaaactgaggtttggtcgtaatcgtcgattgttttctttgattttagctcttcatagtttggtttaagtgacaataaaggttttagcttcagagtgtggaatgtgttattgatgaaagttggaacatttttactggcttttacaggcaagctatggttcaagagaactatgaatgaaactgtggtgtaagagaatatcaatggttgttatctgctataatgttttttggaccaagtgagtttgatgctgatgaa

SEQ ID NO: 6073 - DNA, 3000 bp, Unknown
  misc_feature (1)..( 3000): cDNA_ID_3079472_gDNA_ID_1620842_Annot_ID_170079 3000 nt of promoter + ATG
ttatatggatttttttggaggtctaagtctttgtgttgtatgaaaatcaatagagtatgtgtgcatgcatgcacatgcacatgtacaataatgtaataaattattgtatttgtatttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatggaaaaccgtaagtacagaaacttagaaccgaaagtacaggttgaaaaactgatattaatggtcggaaaacctgaaaatacagaacggaaaaccagaaagtaagagataaagagataggcagcaattctctcttaaattctctgagtggtgacttaggttctggatcccccttcttagtagtatctcttcctattggcaaggagctgatctagggttctcttagtctctcttgcgatttctcctttttgcccttctgaatttatcgggctgggccgagccgtgatgggcagagctgtgatgggccgagtagtcattctgatgggccgttgttctgatgggccgttcttctttgttatgagctttcttgacttggtctatttgtgtttaggccgaattgggcatggagggcaaagcccgtatcccacaccgaatctaaataagaggaaacaaagaaaaaggagaaaaagaagaagaagatatgcagccaaatgggcttaaaccattaacataatgggaaagcctaacttaagcccaatacttcagctgtcaaataagaagagaaagcccaatactccaaattcggatcatatcacattatacatctaaatctgtttcacaattcaaaacatacatttggattttgactagtcgaagcctagtaattagtaattaaccatatccatgtctcagccaatcataaactaccacgtgggtgattaaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatc

SEQ ID NO: 6074 - DNA, 3000 bp, Unknown; identical to SEQ ID NO: 6066
  misc_feature (1)..( 3000): cDNA_ID_2025218_gDNA_ID_1620842_Annot_ID_170070 3000 nt of promoter + ATG

SEQ ID NO: 6075 - DNA, 3000 bp, Unknown
  misc_feature (1)..( 3000): cDNA_ID_1829948_gDNA_ID_1620842_Annot_ID_50901 3000 nt of promoter + ATG
atttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatggaaaaccgtaagtacagaaacttagaaccgaaagtacaggttgaaaaactgatattaatggtcggaaaacctgaaaatacagaacggaaaaccagaaagtaagagataaagagataggcagcaattctctcttaaattctctgagtggtgacttaggttctggatcccccttcttagtagtatctcttcctattggcaaggagctgatctagggttctcttagtctctcttgcgatttctcctttttgcccttctgaatttatcgggctgggccgagccgtgatgggcagagctgtgatgggccgagtagtcattctgatgggccgttgttctgatgggccgttcttctttgttatgagctttcttgacttggtctatttgtgtttaggccgaattgggcatggagggcaaagcccgtatcccacaccgaatctaaataagaggaaacaaagaaaaaggagaaaaagaagaagaagatatgcagccaaatgggcttaaaccattaacataatgggaaagcctaacttaagcccaatacttcagctgtcaaataagaagagaaagcccaatactccaaattcggatcatatcacattatacatctaaatctgtttcacaattcaaaacatacatttggattttgactagtcgaagcctagtaattagtaattaaccatatccatgtctcagccaatcataaactaccacgtgggtgattaaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatgcctctgcctatattcccgtcgcggttacagtgttcgtcttcatcgtcttcgtcgtcgtcgcgatcttcgttttttaggcctaagcttcgaatcgatccaagcttgaccttaattccaggcttatccaacgacgtcgggagactgattctctccttcgtcccttaccctcacatctctcgtatcaaatcaacctgtaaatcatggtacgctttcctctcttccaaaaccctaatttcactccgccatagcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtagtaggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagca

SEQ ID NO: 6076 - DNA, 3000 bp, Unknown; identical to SEQ ID NO: 6071
  misc_feature (1)..( 3000): cDNA_ID_2999710_gDNA_ID_1620842_Annot_ID_50905 3000 nt of promoter + ATG

SEQ ID NO: 6077 - DNA, 3000 bp, Unknown
  misc_feature (1)..( 3000): cDNA_ID_1829921_gDNA_ID_1620842_Annot_ID_50909 3000 nt of promoter + ATG
tggagtagcatgctagtttagacaaatataaaatggtggaagagtaaatattcaattttgagagggtaataatgtaatcaataacatgctagtttagacaaatactcccaaaagaatgtctcaaactcaaagagttggttagaatttaaagtgtccaaatacacaaataccccaaattttatactatttatgtggctagtggctacatacaaatttatccagtgaacttgtgtgataatttactgtcttaaaagtttatctgtatctagaaatagaagatccgatcaacaaaatacgagtgagcatttcttcatggatcatgatcagaaactttcttatgaaaaacaatgagcaccacttttatgggtcactaagggttcgtgagttaaccccatacctcttttgtgtgtgtgccataggtagtggaaaagggaatctactgatgttagagggtggtgctgtttcggcgacccacaaatctggacgatgtaggcccaaattttacctcaccccaccattttcgtagacttttcattccggtcccataattttacatttcgttggtctaacccatcattcattgattctttacctttttgccaagaggctacttaacctttttgctctttatggattggtgataataatttagtctcaccataaaattcaatgtttttctagtcaacaccatctaaattctaattcaacatttttttcaacgctaattaaaacgaaattcacatatttttagatttatgactactagataaacaagttttatcgaaacttttttcaacaaaaatttcatgcgaaacaacaaaccacggatcaatacttactaatcacggatcggaatcttctatttttttttttttctattttgtaactatcatatttaatgttttcaactaatcacgtagaagggagctttttcaactattagtgaattgacttgtaaacaaaaggagaagtcaaataagaacaacgataatagtagaagaagctcttagactaattaattaatatcttagaggtacaaaaacaatttgattattattactttatgcgtcatctcttagatcatcttccacgggcctcatggacatggacattgacatcatgactcatgagtttggttggtgtaaagttcaaaaatattaacacataacaccaaacgatcaatgtcttatacatatttctatgtttaaaattcactaaaatatgttgcaaacagaataaaaaatattagctgcttataccaattgtagaagaataatatatagcaacaaaaataatatagaatgagtacaaaatggaaaataatctggtgtgtatataagttgattttcataaaattctgatagtaatatttgacacaaatcattcataaattaaaattttctatttaatagcattttgaaaaaaaattatttaaattataaattaacattttctatttaatagcattttgaaaaaattatattattcataaatgatgcattgaaatgttagatttatggtaaacatcaatctttatacattattaaaactcgttgaaaagtttaagtatcaactaaatttataggcgtttattgttttaaaagtttagaaccataaagttcaaatcattccaccacaattttgatcaaagttaaccacaacaaatgacaaggattagatgttacttggaatcgtttgattatagataaagaaaacgatattagtacttttatagttcagaataaatacataattggaagtcattttatgtgatacggcaagataactcttttgttcagcgccgttcttttgttgtcccaaggaactattgtgcgtaaacatcaaccccaaaaatgcataccatgtcacaactttttgaaagaacttaaattaacttaccaattttacaagaagtgaatacaactaatacagctttttaacctaggcttaattgcacgctaatgcttacaacatattccatcagattctgtcttttctttataaaaagttttagagatttctttctatttcaaattatttggtgttttacatctaaagtgtaagaaaccaattttcttttttttcaaaacgcaactaaaaaaaatcctttacatattatacattttattcttatttcattaataataaaatataatttattttataattttctctatcatgtattcttcaataatataacatcatattttgaccccacaaaaaaacttatataaagagtacaagaaaaacaaaactaatgtttgatagcttttacatttttaaaatctgagaaaattgaagttttaactccatcaaataacattgcaaaatcacataaaaattatgatttgtgatttcacgtttaaattttgttttgttagaaatctatttgataaagtagacgtttatataccaacataatcgtctaggtaattaaattagacatccacataacaaaatagcatgttatatatatttttaaaaatcacatattcgataataattaaataaaagttattaaaaaattaaaaatcaatatactatttaatggcgatcaaaaacatcattatttgtttttaaatttcatcgtcaaatcttgccatctacctaatttaaccacacaaaaacatcatcaaattattcctgtataataccaaattaaactcttttgtccaaaacaatttcaaaaaagaaaactctgtggaataagaaacgggcaaagaggggccagaagtttagccacgtcagctacaagagagtgccacatcatcaccataagcctctcccacctgtacggatccctcccaatataaattggaaccaaactctctcctcagaaaaaaccttctcattacacttgcatgtgcaacgacccgaccctatacccgacccggcccacattttaaacccattttagccttttctgtttccgccgccgactgatcggaataatcgatcaaagagagaacaactgaatcttcgccggatactacgccgatg

SEQ ID NO: 6078 - DNA, 3000 bp, Unknown; identical to SEQ ID NO: 6070
  misc_feature (1)..( 3000): cDNA_ID_4257535_gDNA_ID_1620842_Annot_ID_50910 3000 nt of promoter + ATG

SEQ ID NO: 6079 - DNA, 3000 bp, Unknown
  misc_feature (1)..( 3000): cDNA_ID_3076928_gDNA_ID_1620843_Annot_ID_170107 3000 nt of promoter + ATG
cggctgcatttctcgagactatctcaccggactgcattgtcaggtactaacttagttttgggtggaatcatattgaaagtgactttatggatggaattattcggaccgttgtagaattagggctaaatacctctatgacggattcaagggataataaatgttaaggaaagtgatttgcactacatgattttccaaacctatgagattcatatgagatgagagatgcgagaaataatggagagatgtgttgagtcatatattttatttcatctgttaagaaaaattgaaaaaagttttaaaaaaaactaaaactttatgttctatttctaaaatcaaaaaaattgaaccgttatccggcatcacgggtcaaagaaaagtttttatggacgtgaaaacactgactaacacaaaacaatcgtaggttgtgttggggtacaatgggttttaccactagtagctaattactacccatgttggttctcttgattcgaaatgttttttcctgttgtggatctgttgggctctttgcggctttgcctattagatttagacgtttcggctttgtaaaattttctttcttatgcaaccaatagcaaatcttttaagaaaaaaaaaaaaaaaaaaacccgtaattaatatcgtaagtttgactttatttgcttatatgccagcgtcaaatccgattgagcacgtataacaatatccaaacaaaaactaataccattatttatacatacatgttgcatcacgatgaaataaacaccttaatggcagtttaaaagtttgtgtgtatcaccagatctgttaccaacacgtaaatctattacgagatctattacgacttacaagagagaaacaaattgtttaataattcaagttggattgctttcaagtagttaaagtgagttgtggaaataaaagaggattgtttaatggttcctcggtaggaggcaacacataaatatatatcacgagtgagagaaactggatttttttatgttcaaagaaagaaatggaaatgataatcatctctctctgcctagcaacaatcctagcccttcttctcctaaaacaatttctgaatcgaacgtacactgccaaagtcaacctaccaccgtctccgtggcgagttccggtaatcggaaacctccatcagctaagcctccaccctcaccgctcccttcgttcccttagccaccgctacggtccactcatgctccttcattttggccgtgtcccggtcctcgtagtctcttcctctgacgtagctcatgacctcatgaaaacacacgaccttaaggttgcgaaccgcccgcaattaaaagtggtggagaaaattttcaacggtgggcgagaaatggttttctccccttacggagaatattggaggcagattaaggtattattttttttgttttgaaaagtcatttattttttatacaataatactttcctatatatatatatattttttttttcgaaatttaggaagggttattggtttatagatttatctatatatacattttttcagccattttagcaaataaatcctaaaatttgacttatttacaactcaatgctattagcattaaatctttttctaaaataattatattttttaaaattcttaatttaaattgtcaatcacattatcaatcaaatttaatccaaacaaacttcacatcaatcccttaaaattagcataaacgtattttgttaacaatattttaaaacaaagttttttgtttaaataaatattgttcttactaaatgttttttgtttaaataaataaatcatgtatttgaacttatttacaaagtcatgctactgaaattaattatttaggaatgaaaatatttaattaaagatttaaatcgtctaaattctttgcttttagagttattatgtcattacctaaaaaataaaaaatattataatttttaaatgttataatttatatatttcaactttataaaactttattaatatttaaacttataaaaagtttaatatatcaaaaaaatttaacatcattatataatatatagagttgtttttttacgtcatattttacggttcgaaattttaaaaatgaacatatattaaccacttggcgaaaaatatgtgggttcaacgtcccgcatcgattaaaatatttagacaatgattcataaacatatcataaataagattaacattaataaaataaatagttttttttgtggacgggtttggcgggacgggtttgacaagacgttacttaataacaattgtaaactataaagtaaaaatattttatagataaatacaatttgcaagtttttatatatactaactttaaaaaatgaattgtccctgcggtgtaccgcgggttaaaatctagtaaggaattgaaaatccaaacaaaaatcatttgttatttaatcattgattttaaaattctaattaaaaccatgtgttattgattcgatgatttataaatactagttaaaatcctttgttattcgtgtagtcatttgtttttggatttgggaatccaaattatgttttaaatggaattgaatggatttgaaagagaaaaatagaaggattcaaatccatgagtaaacacatgttatttcaaaatcaatatatcttgatttcataattaatagagattttcaaattctatatagatttacaaatcaataaaccaataacaccttagtttctgtttagctctcttgatttgctatatgtgcctacaacataaatatgaaagttcagatttgatttagtttacatgagcttgatagttacttggtgaagaaaaagaaaaatatctatttaatatttgagtcatgtgatctatataaattgaaactagaatatgattaattaactgatgaaaatatcaactctgtcttgtgaggaagagtgtatgcatcgtcaatctactcaataaaaaaaaggtacaatcctttgaaaaggtaagagaagaggagataagtgaaatg

SEQ ID NO: 6080 - DNA, 3000 bp, Unknown
  misc_feature (1)..( 3000): cDNA_ID_3079516_gDNA_ID_1620843_Annot_ID_170109 3000 nt of promoter + ATG
tctaaatatagatttctttataaatagagaagatctttgctccaataattgttgttttgttcctctaaacaaaatgttccaaataaattttattttaatttctaacataatcctcctttatttttaaagtttataaattctatccacttaggttatttttaaacaaaacaaaataaattttcattataacacataaatagacaatcgaatgattaagacattatttttaagcatcatcattagtactatttttatattttaaaatttcaattaatttagtaaatatatctaatacaaatttatatttttaggtattaaatgataacttattaaaattggaagagttttttgtaaataaaaaaattatgctttaaaaatagagaaatgattagtattgctccaaatttggagcaatactatctttatttttggcgcaagatattgagtaccattgatgatgattttatatcaaatatagagcttgtagcaagaagaagggtgacttacattatccttgtggtaaggtttgtagtacgaaactatttttaaccattatccttcaaacaaacaatgttaataattctatgtcaagtttctagatcttaatctccgataacaaactaataattaacaattgttagaacatccaacaataaagcataaagagtgaaaaaaaaaaaaaaatccaattaaaacctgcaatttttctcgttctcaaataaaacttctaactaattaattttcttaaaaaatcttcaagtcgtcaaaattcaaacttttcctatttaaaacttatcttgaaaacctccaaattgaaatattttcccaattaaaacctcaaactttttttcgtttctaaataaaatttctaacataactaattaatttttcctaaagaaacgtttaagtcatcaaattttgagtctgatcaatgatttactaacgataaacggcttttaacaacatattttccatttatttagtttttgaaattcacatgttttagttacagtagaaaatataaaatcaaaattgaggattgaataaatttatacttgaatgattgttaaaatttatactttaatgattatggttaaaattttaaatcaatcgaagtaaataacccaattggtaagtaactaagtattaaaagattccaaaataggaaatatacaataatgttttgcttgtgcatcggtggtcattaagtaaagggcaccattcaattcttagagtggtaggaagcgagaaaccaagccaatatggtatcccatatggctaagcttatgagagagttagagacaagtgtcgcattaggtgtcgtatgaaagatgcatacgatgtatatacagtttttttaacaacgtgtctatttgtaattatcactcattgtcttacttgatagcttttgtttgcttcttcttaataggatgcattttattgcatgtgtatgcatttctccaaatgaaatcttgtgaaacacttgtctctaagagtctaactctcacacaagctaaaaacacgtcagcttgaggtccacttagcttattgatgagtagttttaaagtttgtgtgtttccaactaatcagtaactagtaatcacccaacacataaataaatatattacgagtgagagaattgtttcaaagttagaaatggaaatcataatcatctctctctgcctagcaacaatcctagcctttcttctcctaaaaccacttctgaatcgaaccgttgccaaagacaacctaccaccgtctccgtggcgagttccggtaatcggaaacctccaccagctaagcctccaccctcaccgctcccttcgttccctcagccaccgctacgggccactcatgctccttcattttggccgtgtcccgatcctcgtagtctcttcctctgacgtagctcatgacctcatgaaaacacacgaccttaaggttgcgaaccgcccgcgattaaaagtgattgaaacaatcctcaacggtgggagagaagtggttttttccccttacggagactattggaggcagattaaggtgtttttgctaagtcattaatttatatatacagttaacaattagttgtggttagctctctggatttgctatctgtggcctattatataatttccaaagtctatatttgattaagttttaccagttagattgatagttacatgttgtagtgaatacatgcaccgtgcgtttgattaattttgatcccccttccgttttattttaatttgagtatcgtcttgtaaacaaaaaatgtcgtttaaaaaaaaattcaattttattttatagttttaatttcttgaccaataaaaaatttacataacatattaataaaaggtaaaaatagtattgtttcgttaatttgtgagtaaaaaactaaaagacatataatacgaaatgaattgtatactatttacttcttgaagtacgtttgttttaaaagtcagaaggtatttacttgttgaaatacatatacagttctataatgtttaatcttccaattgaaaaatacaatacatttaaataaaaccattaaatatttttatacaaactttcttattagatatttgattttcgtaagtttagttaataagaataacttgtatatgaaattaacattgtttggcaagaataatagcagaaataaataaataaataaaaaatgagaagaattgtggacttcatacataagaattagtgtttcttttctaatatatagaggatgtaataaaggcatgagttgagctttaaaagaaaaaaaaacatttgctttgtgcgtagagaaagaacagaacacatttttttgcaaaagataaacaacggaagtttgagagaaagtagtatttttgtttgttaaaaactttgatatattaatgctcttgatacttagatatattaattttctcattaagaaactgatgaaagtattacgtctgttttgtgaggaagactgtatgcgtcgtccatctactcaataagaaa

SEQ ID NO: 6081 - DNA, 3000 bp, Unknown
  misc_feature (1)..( 3000): cDNA_ID_2054365_gDNA_ID_1620843_Annot_ID_170115 3000 nt of promoter + ATG
ctgccttctagccgcactctcagtagggtcagcacaggtaacatactgcactgtaacttctcttagctctcccagaacttgatctctagaaggaatgaccactggtggggaagtagcctccagcgatccatgccgccagatgggtgggggtcccacacttggagggggaggggttactggatctggatcaaccacatctctctcaagaggaggtcgtctggttctagaggagtcagaaacagcctggtgttgctcagagggggtgggggccttttccctccaacggagactgtctcggagatcaatttttcgagaagtgttatggggatgggaatgtgacgtggtaagcggtctgtaatggttacggccttgatggtccgtgtatctactatgagagtttcttggtcccgcagcccctgaggatctctctgctgatctaaacccacgtctctcatggcgatggtcagaagatctcttatgtgggtttgaaacttcttcagagaaggtaggttttgtagaggatctttggtggctcactggtgccttgaaattatcccgaggagtgtagtagttcctagagtcccctttagagccaagagacagggccggaggagtagggattgcagacttcattttagaagtagtcaaaccaggacagagctttgtctcatgggagagtctgaggcagtggtgacaatggttcttgaggttcttataatccagatacacaagtgcttcactcccatcaggaaagtccacaatggtctctttgactaaaggttgtaagccattgatgagcagcttgaacttaactgtggccgaagttatttccatttccaagatctcccccaattcttctccaatggtttttagcatttctggttgccaatagtgcttaggtaggccctggatttctatccaaaagggaatgagggacgggaaggagtcagatataacaggctcccacttctgtagtatcaccatccattggtcatagtgatatgacctgttctccaggactttttgcatatcctcctcaaaatcaaacttaaactggaagcaacctttgcctagatctgaccctatggctttacctcgcaggttccacctattagagaggaaagggaatagagaccagaggcgttgcacagatgggttagtgagtcggcccatgagagttagagaattggcttctataagctccgaggtatccagatctggggctctaattctcttacggggagggggagagtaacctctctccaactctttcccttttaaatggaatgggattctcttatccatagaaacagcaagagcttttataaggttagggagtggttgaggttagttcttcgggtcgcaataaatgttcttgacaaggttaaaaggcttaaaaaggttttgaagaggtgtacaaaggttatagaagtatcgacagaagaagagactacctgaaggatgtcgaaacctcaaacaacctggtggagaggagtagagagcaggggaagagcggtggaagagtagaaccagtcgccggaaaatgcaattttgaaacaaagtttgccattgcaggtgtcggaccgctgaatattactccttttgggtgggaaatttgaaattagatctggttaaaagggtgcatcatactccttaaacacaatctcgacaaaagtgcttgggagcgttttttagaaaaaaaaaaacccctagtaattgttgtattaaacgcataagaccccaagtaaagtatcattggaccagcccttctgcgtcaaaatacttcagtaatacatacaaatcaaacaactcctgcgaaaacaaattgcaattacgatcacgttcgtcacccaagaagttgtcataaatttgagtttgtactttccgatatttacataaagttccaaatacgtgacgctggaccgtccctagttgctatcgtcgattagtgtaatctgtatctagtcgcatctcccacgttacatataatttacataattattcgaaagatcccaaataatatacttcaaatagcaattaaagaagcattattgtgtacataatgcatacacataattaaacgcatccttctttttttagttgaaatttaagtcttagtaaatcaaaatgaaaaatactataaaatgtgtctgtttgaatctgatatgcataatgctttttatggctatcataatcaaatacagaaattatacatgtaaaacgtaattgacaaaaaatgtgattatcttagtaaaatattataaaaataatgttgatgaagttaaatatatggttcttaattagtataatataattgtgattctcttagtaaactagtacaaaaagagtattgatgaagtattcaattaatagttaatacaaatcatgttcttcacttagacatagtcacaaattaaaacaaatacataaaattatttttctcgagatatccgaagtccgaacctataaattcgatcattatcccaaactcttatttcttttttcttttgcaagaaaacaattgtactcctccgcattgattacaagagacacacaataagagggaccgaaagatagaaaaagagtacattacacgagattccatatttttcatgtttttattacgtacgtaactgtatgtatatgtaccatatatagataacggaccattaattatttgaacatttacctcaaaaagcaaagtactctctctacttcattccaaccctatgcgtatgtatcttagtgtatggaccgatagacaaattaaatgtataggtagacacatgggctacagttatgaatgttacaattatttcatcaaaagcaaagtactctccatcgttacatgtacatatatacatttcttataattatttaaaacctgtttggtcaaaaggatagtgctcgactatacatatagccaaagaagagcagaaaaatcaaagtcgtgagttcagaagctataacaaaatttctaagaaaaagaaagataagaaa

SEQ ID NO: 6082 - DNA, 3000 bp, Unknown
  misc_feature (1)..( 3000): cDNA_ID_3079496_gDNA_ID_1620843_Annot_ID_170120 3000 nt of promoter + ATG
ctatcacgagcgtgaattaatttgttgttgaacttgttgtctagggatagcttctgtgaagttttgtcaaccgcctgaatagattaagaagaccacactgttcgattaccctatccttaggaatcatttatccatttgattgcctgttatcatttctgctttgtcattcacttgcctgctattgccatttctgcttttagtttcatttcatttctgttattgcatactaggactgttagaaccaaccaactttctacttggcttgacttagagctttctgatcatatctcatctgtttgcatcacattggattgacatcctaaaatactacaacgacaagatagtgttttaggattaattgagtaaaatcctactatcatatagataaaagcatttttatttggatcaagagcgatctagacgggaatgcgaaacttagattcaaccatgattttgattgctaaaaaaatgttagagatttaggtttgaattagtgttcttatactatatatgtaaatatttttaatgtattttttttgttattattgattctcttttgttagagatttaggtttgaactagcaatgatgatttacaaatatttaccaaattaataatttatgatttctgtgtactgagttgattaagactagaaaatgcaattatgctttcatataatagattaacaattttatccaaaaaaaagctagctagtttttttttttttttttttttggtcgtagctaactagattaactaaaaaaaactatagttcataactttgaaagagaaaaaaattctcttttatgattctaataaattttcaaaaaaaagaagttaaaaagtgcatttaaagtaacatatgaatatgactatataactcaaaagagttcgtgggaaacatctcttcacatgcagttgtattatattaattaattttgtaacaaaagagtggcatatgaccccatggaattgttcgtaacgtatctttacaaaatcaaactatattgtttgtagcgaaaccatgttttttctgtaaaccctaccaacattttatattttaaatttttatgattatgtgttgcttgcttgcatgcttctctctctcgatgttaggtactagactacgagagaacaagaagtataataatatgtatgcaagcaaatgcaacacatacagatagaaaaagacgtatgacgtagaaaagcagctttaggatgattccaaaacttgtttcttcaagttgacatttttgcagataagtgttaagttaaccctatcacgtctggtcgtgctggtgcgtggtcctcacgctccctcaatctcctgtgttttctgaaaatgtaggcccattttgctttgacttgggcccatttaaccctctcctcatctttcaatcttccaataaacaagtttttttaattaaggaagcaatgacttttgatgtctttaattagtattttattctgttttttgaagtttattattataattggtttcgtttctatcatggatgtggatcttctttgtttcttctcttcacgtcgtctttcctttaatagttacatattattttaagttatataagaaatatgaacccctttaaacatggagaccaaatagaaattatttgattattattacctcaacaaataattttgtcaatttttttggttgagaacgacgtttttataacaaaaagacaaaaaaaaaaaattgttcatattacactcttcttatcatctttattcttcgtattttccatacagttttattttattttattacatatatatttttaaaatgaaaaataatttatatgattttcttaaaaattgttttaatatgtgtattgtttgattatgtatgctaaaaaatggtacgtttctatatcatcttaggcgtattagttagtgtttagaagaattttcttacaagaatcgtgatcgtttaacgcttaacgagttcttgaaattactattactaattttgataatatgagtgctatttatcaattaatcttatgtttccttaaactccctttttaacttttttcacgtagttacaaaaagaaataaatatatattagtataaattaaaacatatcattccgcgataactagcaacggtgccgtttcaataacctctctcatgtcctttcgtaactcaacgaaacccaaaatcaacggctcagatcattccgacttctgtttcgcctttgctacgccacttcttcttcttcttctccggttttaaattaaaacctctcacaaaattattcggaatattatttcttcttcttcttcttcttcttcttcatcatcgcatctctctcacttcacgttttcttcggtgaagagatagccgccggaaaaagttatcatctccggaaatttcgctctttctttacggtaattacgagaaaaacaaaatccaaaaatcgtttttttctatttgatgattttgccttcgtattcaatattgtaaagttttgttttttccgttgtttaattacgtaaattcgataaaagtttcttcctttagattgaatttttctgtttctatggcttgagaactagtttcgtgtggttgtttcttctgattcttgaatttgattgagaaagtttatatctttggttaagagtttttttgtttgtgtacgttttaaaatccatggagaagcttgaatcacggagaagactagtcgtattaatggaaactccgtgtaaatcgaatgagcttcttcttttggatggttcttcttctctttagctttcctcttttctctctttttggtttctttaacaatctctgacttatagcttttgaagcctctgtttgtttatggttatatcctctctgttcttctcatttctaaagactgaattttgaatggtaaaagatcgtgtgtgtgtgtctgtatccttaggctttgatgcagttttctgaaaatttgaactttgtttatatgttgcagtgtttgagggtgtgttttatgt

SEQ ID NO: 6083 - DNA, 3000 bp, Unknown
  misc_feature (1)..( 3000): cDNA_ID_2054341_gDNA_ID_1620843_Annot_ID_170124 3000 nt of promoter + ATG
ctcattgacccactcgtaggttgttttcttagtgatcaactcatatgtaattttacgtaacaatcaaggaaaaatatgtaaaagctatgaagaaaagagaaaagaagccgaaatttctggaagtatgttgaaatgtgcgttgtcggttttgggaatctaaggtactgtgagccgacaaaagtagagatgtaataaagattttggtcaggcaatcataaatccaaatctttctgcattttataacaatgacgctcatcatcactttcctcttcaatatgtctcagcttttacttacgtgcgttatcatcatgttcctataacgtatcatctctaactttttatttaaacaatctgcggagcatatataaagaaccggataggacaagaacaaaacgtcaccgtttatatgagaaagcaaagcccactcactctcagttttgatatgtttttatgaatagtatcaccagccgcatctattcattcacactaataacgatatttataagctaattatggattttaaatttacgtacattgtgaatttctatgttaggtaacataagtataattcattataaggaacaatgcattttcacatactgcagtgcacattattaataaacaatagtgtctaacatattgcaatgcacgttacttgatccaactctctatcctattttgggttgagaggaagaacattttttgaattggccgtcatttggtacgtacaaatggttgaacatgattgcgactaattttattttttatatatcgttaaaaaaatttctgaatagaatcttcaagtaatttgagacgtctctagtatagtgcctaatatttcgtctctactaatgtctaatacgggttcaatcacaaggactcatccatgtagtgagtaagataccaaagtactcttcagtaattttagtcgacaatattttgtttttagcgtgtgaattaagtttccatatatgatacgtacccaatttttgacctttgtacttatgatacataaaatatttacgcgtcgaacgttatgtatatacgtatgatataatttatttttattttgtgtgggggaaaatgacagttgagcttcaagttgattgagagaccaggcctactatacaaagagaagcgattagcaccaaaaaacaatagtagtacggttgtatttgtcggatctatcatggtctccattaagtaaaatatattcatttaatattcatgaagtagtggtcgatataaaatccaaagattctgattaggaaagtgggaaattgaggaaatatatgagaacgtgaaggtggcggtcttacctaaaatggataaggccattaaaagattcgagcctacgaatacgaaggataaatatgaatatgtatagtgtattattttgatttagtataagaaaagctgtgattggttgattcttccctcgcgttacctttttgttttgcaagttgactacttgacacacactttataagacatatgtgaatatgtattgtaatacaccatagtaatataagtaggtcggtcatacatttgtatcaatatgaataattaatccacaaatcttttagccatagataacacagagatggctcttgattttatttcctgttttgggggttatgacatgagttcatttcacatgatgtcgttattttgaagcaaattatatttgaaatcgttgtgaaaatactcgaactattaactatgtttgatctttcaattgcagatgaaacttttaaacactagaccaccataaactacatatgagtggattgttgtaatcttgtaaaatcttgatcttaagggattgttctacgtctatttattttttggatattgtagaccttaactatgtaacgaaactttccccactactccccactatcaactgtatgaaattgataattaatcacctaaacttttgtttccactccgaaaacacctttaaaagaaaaaacacctaaaattgcatctcacatatataaattttataaaaacttccaacaagaaaaagtaattatttttatagtttggaaatttgttgtttaggtttttcttttttccccgtttttcgatttaaaagccttagggattgttattaatatcaatctggttttagattttctaattttttttttaaatgactttaataattaaaaaaaaaaacattataacctattgctagagagttttctataattattttgattagtttttcacaatctttaaaaatttctcaaacaatatctctattttaataatattttcatgattttattttgtaaagaaaagtataaaaagtcataaatcaataacataataatttaattcattaaaaatcatagattcttttgttttaattgaataacacaaaaaaattaatgacatttataaaaatatgaatccaaaacttcagatttataaagattctatattacttttatagtgtttaaaataataacaccaaattttaacaaacttattaaataataacagattctacgtaatgtattaatattttaagtgatgaaaactctatttaaatcataaaccaataacactgtttttaaagtgattatgaaactagtccaaaaataaagaaaaatcatgaaactaagccccgtattaaacctattaaggatagttaatgggccatagcccaaaacaagcaagaaccctaaattttcgtcatcttcatcacacgtgcccagaaccaagagcttacctcggcatctgatttagcaatctggatcaggtctgcaatttctgatgattcactctccattgttgtaaatctatgtttcagcttatgatcaaaaaccaatgcgtatgaatcgtctatgttcaccaaatcagtacacgtaaaagcgaatgtgatttctctaattctaccggagagcttattcaaacctgtaattcgcttcgtgttttgcgtatacgtctgctcaatcttcaagatcataactttttgattaacctatg

SEQ ID NO: 6084 - DNA, 617 bp, Unknown
  misc_feature (1)..( 617): cDNA_ID_2054329_gDNA_ID_1620843_Annot_ID_170127 3000 nt of promoter + ATG
acaggttatgtagtagagtaatttatgtaagtgtaaggttcttgacatgtgccaagaatacaaatgtacatgagtgacaatattattatctaaatattttcaaatatttaaaagcttatttcgaaatattttaggatccttttatgaatataagctgcttatatatatgcctataacattcattttcaaatcaaaagctccaacatattaatgagctgacaaacaacttaatgtttgaattcagatatgatttatattgaaagagtctccagctatcttagatagtctccctagttaagggattaaaggttatcattagcatataattggtaccataatattcaccaatactacagagcctaatatacatctctgtggctttgcttttctattctcttttgttattgttgtcattaaagaaaaaaaaagttggaaatgaggacgttgcattgacaatgcaaattcaattttgcttagccattaagaagctttttcacaactttagtaaagaagagagacttatataaagaagatgtctatcaccacttactcttcccctctcctctcttttccaaccaattctcttctttcttgtgtgttcacattcaaagaaaatg

SEQ ID NO: 6085 - DNA, 3000 bp, Unknown
  misc_feature (1)..( 3000): cDNA_ID_2054333_gDNA_ID_1620843_Annot_ID_170126 3000 nt of promoter + ATG
gtgacttagtgataattggcaaattgaccattataaatgttttaatggtaagaatacaacttctgatctcgggtaagacacaagtcgagatccatggttatattgtttacttgtccggtaaatatttctgaaaagtgtcaacttcgaatttttgaaaatttgctattttaatttgtgccagtttattaagttgcaatgctctacgtcgcaagttggaataacaaaataaacatgaacattatcatgtatgataatgtctacaaatatttataacaattatttggataataaaaagactaattaaaactcaaaaagtttactacataccatctacgaaatcggccaaacaatccctttgttgaaaggcaagcatcctctgtgaagtgtcatacccaactgcatgatcaacaaaagctgatgctccaagcacattaatcctttcctcatctttcatcgatgatctgaccaaagccgtgcagagagaagatgggctgtcttggagataaagtcctttgtttgagatagtgtaatctaatccttggaaatgaagagtgagtttaggcaatgaatctatctctaacccaacctcggttgtgaaacacattagttcgttcacttcgtatgcgaccgctggtccaatctgcgccgttagctcttccttcacctcctcgtagagtgatggctctagactcgtgtagtaagtcccaacgtctattgctattccactactctcattgcttctcattctaataaaaaaaaagatcatgagaaacaatataatggatatttacatttagagaaaaaagagcttgattgttttaaatactaacttgcacgtttgtggttttatcttttatgtgaaacgttagaaaaccattttcttaaaatacaaaatatttttcttgtttaaaagtattattcaaataattaataaaatggtgttcaatatgtaggttttatttggaaaaaaaaaaacaccttttaacgcaaactattaatcgaaatccaaatatcaaatgtttgagtctatgaaatttgttgttaaaacgtatattatatcaaatgtttacgtagctatgttagctagggtttaaagtttaaacaaattaaccccaacaaaatgttagagcatctacattgcataacctctcattgatgtctccaagatcaaccatggtaaaaatagactaatcaagattaaaattaaagacattttcctttttaagtgtctaaattgtcttaatgtcttagagaagatatttttgacatccaaaaaggaaaatgtctttaattataactatggttagtttttaagacactcatgagagattatgcaaaggggatagtcgtagctaggtttaatggagtaaattaaaaatataatcaaaacatcaaacgagtgatatgtttatacctctgttggccaagactgatcccgaagagagcaacgtgatacgagtaagcttccgtccccgtcatgtttaacatcggaaccaacaccatatcgccgccgtacgaagccgctgatccgagacggatgtagttacgcgacccggctgcggaaggccaaagacagtgtgaaaatcttgtgagacgtagctgagagaggagcgagaaacggtgagtcgttagactaagtctcccgtcgacgccaccaccgtcttcctccggcgtcgcacggtttctagccccgcagccaaagacaaaccctcgcactatagagagagagttttcttggtcggtgattgaggaagttaactgaagtgtgtcggagacaaggtagccggagctagagggagaggcctcgtagcggcagaaatcggaaggagtgcagagaagagagacagaagttgttgtgtttgttgttgttgcgttgaaatagttagtgtaattggtggagacatgaggacaaagagaagagttattgcaagagattgtagagaaagtgttggaagatttgtctgagagggagcattggtggtcatcatcattatcgaggcatgtgagatgtgtagaagagtctagcttgaggttaaaggttcgtgttggggttccaatggtgatctcaacgtaaagattagattcgaaaggtaagaaaaagccgttcggtatatcattcgggagatcatcttcaaggctagagttatgagttagtacagtgaagaggagcagaagaagaacaagaagaaagagtgagtttgatgaaaccatgtttctttggttttgtatagcttaatgctcccaaaacattcttaagttattagctactttttatatgaggtattgtatttaaattatccttgttttttacgatagtgttgcaccttggcttgcatgaaataatgttttacgctgtcagaaaaaataaaacaataataataacgttttaaatgtttattagtatgaaaattgcctaacatttttataagttataacatttttataagttataacgtatataatcgacactaatttttatatgtatgactaatactatatcttagaactaaatataaagtagtttgtacttacacgttacaactataatttttaaataatttagttacagtagtatatgtttttgttatttctacatgtggcatgtgtggtttatatatgcaggtgggttggttactaaacgcatctaccgtgacaactgacaagcatatattagatgacgtggcccattgacgatcacagtaacttgggcttattgggcccataacgcgtaaaataaaaagcccaacagaatcagaaaaagagatgtgtgggtcccataggaatctgcggtatagaatcaattgcttcgcgggggttttacttttcgtctcatcgcaaaaacgcatgacgcgttttttctccgtagatctttgtcttcgtcttcgtctttgtctttgtaattcttacgttaagctctctcacctacccgaaagctgcgaacttttcctagaaagctaattcaaacgtagaatattctaatcccaccacttaattttataa

SEQ ID NO: 6086 - DNA, 3000 bp, Unknown
  misc_feature (1)..( 3000): cDNA_ID_4270016_gDNA_ID_1620843_Annot_ID_170123 3000 nt of promoter + ATG
ctaagggataatttgtttatctcaaaaaatttcgtggagtaatgtgataagatttatgattaatttcgtggagtttagaattcgtggagtaaaaattaatttcgtggagtattcgataatatgatactacattatattattcgtttctgtctaggaaacttgcaagtttggttgtaacatttcacgcatgtggtaaacacattttgaatatttggagaaattaggagcagtaacaatatgtaaaacataaaataagtcttaaccacaaatttatacgatcacaatcttccataacactaccccaaaatttaatgacagaaaagcgatctcatataccattttcaccttctactccccccttcttcttttttcggtttcatttaaaaaattgatgtatttttgtataaatctcttcatataacttgatataatcttctgatcctacaaaacaaccactatattttttctcaaccaagtaaactatatttgtctaggtattacaatcgaacaattcattgttcaattaatgtataattccgtaatttcgtcatctcattatgcgtacaatttttttctttctatcttaaatctgactgttaaatttcctttagcatcctttccgattcgagcagttataagcacacttttttgtgattaaacattgtcatccttcacgctagcttaccttttaaacgacaaatcagcaataaataaaaaacatggacaatgactctaatggtggagctacatatatcgtgacgaatcacacatgtaagagaatcatgtgaacaatagtggtaggcgaatctctatctcttaatttgattcttcaaaataataattaatgattcgatattaagccactttatcaacatttacttccctaacatagatatatgattctagcacagccaatcgatcattgtattagtgcacgcacacaataatcttatgcgtcatcggtcggaatgcattttttatgttgcacaagattaattttcttcgatgcgtagaattttagtaacattgtttatatgtttaatttacaatattactttttttgtagattaaaaatacaatcacaagatttaatggaagtaataactaattgaaagtttagagatgcgggaacatttatacaaaggagcgcatatagatgctccaagttataaaattctttaatattttggattagatgaaagaataaaagaagcatgtaaaattgtgtctaggtacatttggtttagtagtaattagatttgggacaagatgtataatcgttttttaattagtttgatctttctaattaataaaatcggatgtccattgagaaatacggattgagaccatttgtattgccgatggtggtgttacatagtttttgcagaacaagctcatccatgtctctccaatccggtgccaagatctagttggaatccatgaaccaaatcttttttgttggactgattcactcttagaattaatcaaacaaattaaattggttataattttcgaaattctagtcctcggtaaatcccatttcgttgctaacctagaatttccaaagttattaagaagcatgtaatagtcggtttatatatataaaggatttgttttaaatataggtctaagccataaaaacaaacccaaaattctggaatcgaatcaacctaaaataaaagtctagtttggtattctaaaacatttgttttgcggttgggttggatacgaaatctgaaatccgatacccgaacaaatatccttaaattattatttattattgctactttttatcatgaaacaaatgaatttatgttactagaacaatgaacttttttgtgtaattcggtccaaaaacctaaccaaaataggtttcaattctatgtcggaatgaaattaaatttcgaaaaccgattcgaacctgacaaaacccaaatcgacctatatagatcataaatctccctatttgaattattccaaatccgaaaaaaccgatttgaaaacctgaatgcctaaacctactttaaagttaaagaagcaacagtagccataagaagacccacaatataaagattgaaagaacccaactcgaaccaacaatgttcctaaaaatagaagcccataacctagatagagcccaaacccctaattcttcttcatcgacaacatgcaataaactttgctcttgctcgttagatctctcgctccaagtccaaatttctccataaagatgaagactattagagcatcattattgatgatctcttaaaacaattcttatgttaagaaacatgtcttataactaacaaaaggctcttatataagagacattaagtcacttttgttagttataagacatatctcttaacataagagttatgttaagagaccatcaataactatggtcttagtgacatttgagaagaggagcagccaaagaaatttcagatcacatgttcgattaccaaactactaaaaatagagactgtagagtatagacttattcacaaacttggaaaaaagattaagtttgttttatattaaaggtgaaaacttttgccaaataaaagcaataataatgtgtctcaaaaaaaaaaatcctttttttttttttttgtgcacccaaaaaaaaaaaaaaaaagaataatccttaacattctctctcacataagctttttgaattagacaaaaaaaaaaaaaggcactagtcaagtttttttttttttgtataacaaaaacagagacagatccagacaaaaggctagacatccaccacgtcacgcttcccaaccaagtgacacgtgtcgcatccacaactcgtcaaaacacaaacaccaaaaagtagatgacgttacaaagcatcatccgtaaatggcggcttcctctctctcgctctcttctcctctctcaaacccacttcgcagattcactcttcaccatcttcacctctcaaagaaacccctttcttcctcttctctgttcctctgctccgccgcaaaa

SEQ ID NO: 6087 - DNA, 3000 bp, Unknown
  misc_feature (1)..( 3000): cDNA_ID_1011596_gDNA_ID_1620843_Annot_ID_170117 3000 nt of promoter + ATG
aaataacatttaaaggttaatatttatgtatgaaagatgccaagaaacttgtgtcttgatgatttgtttcgtatttgtcttgagattgtgggtggaagcattataattaacctttctataaagttttagccaaccaaaccaacattaccttttctttttctctctttaataatcaataacaacaataaaattgattactaaaatttaaagttttacatatataaaaatgaacaactaaattgaaaggagacgataataagagagggagaggtgtggacatctgaggatgattctctgccaccaagaagagcaaatgttatgattttaatttctaaattaagtaaatatgttgcacaaaaaaaaaaaaaagtatatataagaagacctcaacatcatcccattggccactttgctttgacctttataattctgacttttaactaatattaatcacgtttttttgttctaggtaaccttttacgtaattaatcatttgttaatcgtcctttctactcctctacctacctacaacttacaaattcgatgaatatttgcaaaataccatttcgtcacgatctttttttttgtaacaaaatagtttaatacaatctattaaattactttttctgactgtcttagaaacatttctatttcattattgggttttaaggaaaaataaaaagaacttatcgttgaagtttattattagtctttttggttaaaatgttgaaaaaattttttatataaaaaggagggtaaagaatgaatattcaaggatggcacgaaacttgtaatgcctcttattggcattataccataaatagatctaagacttgtgtagggtcagaagttaagtatagatttggtcatttataaaaagattctgtatcttttcatgtaagcgaggatatatattatctggactttcgagtaagaaaattgcaagttagatttataaatatccaaaatgaattatcaattggcaaattgtagcaaaagaaatgacattttaatcttgcataaagagaacggtatgaaaacaaaagattagttcaaaatatgatgtaatagctcccattgcccattggatttgatatgatatgtatataattaaattcaatatatttttttttttgctatctattaatatttaaatagaatattcctttcttttatcttaattgagttgtgtgacccactcacccactctatagatcgtcttctcaaataccgaagtatcgaaccaaaccgaattagctaaaccaaaatttatttataaacagtttgatttaattatataaacttgaaaccaaactaaaaccttttctataacctaacggaatatatgtaaatttaattaaatttattttaatttagaaaagactacgaatttaaccatatacatgcatatatttttatttattttaatttagaaaagactacgaatttaaccatatacatgcataaatttattttaatttagaaaagactacgaatttaaccatatacatgcataaatttttatttattcatatattgaggcttgagggtatcacctataagaggttttttaaaaaggagtaaatgtgctaaaggaaaatagaagaaaacagggcaaaaatccgaatttaatcgtttctactttttgtagtggggagttttcaacattttacttaattgaaaaccggacacattcttaagttatttaataactaaaaccggacaaaattcaaatagtatcaaataaacggaaaccaaactgagttaagaaaaaacgatctcgaattacaatttacaaacatgattttccatcacttgagtcttttgaataacagtcaataacaaattctaaatttttttttttaatattcattgttaacagtaacattagtaatgcaatcaaataagtacatgattggttgggcggtaagttatacctgacttacattcttaatttttcttaaaatcttaattacgtaccaatagtgttgtaactttacctttaaacttacagcctattttttttttctttttttttttaagcggttagaaaataaattctcaaacctatattttattagttatagaaattttaattcattaaataaatacaaaaaattaaaattattaacataaatatataaccaaaaaaaatatttactatattttatttttctatcatcataatatatttatttaaattagtaatacaaactattttatttactataaaaaattattacaactattatattttactaatccattttttataaattatttaaagtcgaaaacttacaacaataattctacaataataactatttttccttgacatctaatcaagtttgtacagcatatattaaaacatttgttaataaaatgaccaaaaaagaaaaactctcttagagataatcttatttacttacaaaaaatatatccctcatgcaaagaatatacgaatagatttttacacatctaccaatggtagtttttagtattgactttgtcaagtgtatcattaccacaaccctaaaagataccacttctttgcttttgggacaaatgtttctaaattctaatcctgtaaataaactttccaaattaaaaaaaaaaagaaaaatacagaaatgagaagcaaaggactagaacaagcattaatttaaagatattaattaccaaaatcacgcatacacatacacacacatatatatattaatctcccaaaagccaagagtatatattttatccaattatcgtccttatcatcttcttccttcaattttagttttatattaccaaaagaaaaaaaccttatcccttctctctctctttcttctttcctctattgtctgccatggcgatttctactattctctgagtctgtgatcttaaagatttgatgagacagaaacccagaaactgaaaaacaaaaacccaactcgtgatatttcgttccgaccaaatctgtctgatttgtgatctgaacaaagtacggta

SEQ ID NO: 6088 - DNA, 3000 bp, Unknown
  misc_feature (1)..( 3000): cDNA_ID_2054379_gDNA_ID_1620843_Annot_ID_170111 3000 nt of promoter + ATG
attttactttacatgatacctaccacacatgtaatctgaacgaaaaaacctatacgctaacatagccatacataagcgtttttactatcatgtcattttttgcaaaattaatcataattttaactcaggtcctgaatgttttatagtttttaattggtttttagttttcggtttttgaattttggtttttgatttttgaagtttttgatttttgttgtggattttagtttttgcaaaatcaagaatggaaatttttttatattttttttaactcgaatggaaatttatataatttttaatttttttacttaatcttaatgtttaaacatttttaaattgtgtattttatctttggatgaattgataaatggtaaaaatagcataattaaataataatagtaaattaaaaaaaaagggttacgtaaattgttttaaaaacccacaaaacttagtttttagattctatgaagaaatagctaaaaactcctaaaatctagttttcctattttttaaaaaatctactttttgtagaagaatgaatgagtaattatttagtttttgcaaaatcaaaataaaaaaactacttcaaaaattggaaccattcaaggcctcaatcatttgtccatttttaatctaaacgaaaaaacccactcctttcatttgtttctttaaatttctgcaatgtttaatttttattaaaacttatgttcgtttctttcaagtcatctagtttaagaatagtacaagagcacagtacgagtgtacgacacgatcaatttatgttttttcactttatagttttgctcgtaactcatatttattgatgatgactcgactcccatggtttttgccgccggcatgcttttatgggttgggaaaaaataagtaatttgagaaagatgatgtcataatatggacatgtgtccgttcacagattggcttcaaagagtttcaatatgtttgactttggaacagttgtatgaatttgctctatttgctgcaactacctgacgcggcgatgcgactctgcctacatcataactcataattaatgcaacgctcatttgaatcaaactttcacaaatcaatacggttacacatttttcatgatgtatgattctgacactttcaatattgtttttttttctttttctaattaagagttttgataatcactcctaatttttattttcattttaattatttaagtttcaattattatcatgcttatatatttctatttttttttaatttaataatgtcaaatcaaatttacttttgaagttttaaattttattagttggtcagacacaacacaacataaaatttattttgagaaaaccaagagtacaagatgtaatgtttaaaatcgtggtagaagtttgatttatggagaaaagaaaaagagttttcataagaaagtgaaatttttcattttatttcattatcaaagcctaaaataaatgacgattctcttcactttctcataaatactctttttttcttttttctttttgcagaaatcagtccaccgcgattttcaaaatcttcatcttgtactctcaattcttttattgcctgttgtgttctgtctagttctgatttatgcttaactaataaaatttccaaaaaaattgatttgacacaattaaatcagaataatagagaaatgagaagcatgataaatgaatcttagataattcaaaataaataaaaaaaaaataaataaataatctaaaatactaaaattacaacaaattattagtaaaaaaagaagcatatattggttttacatatatatatattttatacatgtcaaaatctgatcaatagatataatatgcgagttactaattttgaaataagtctttatttatattgtaataaggatagtaaaaatttataaggtcttatcctggagttatgtgtggaatagttacggtgcagttaaccatgaaattttgaagaggtatttttgatgactatctagagggcgttgatttctttgttgataaaaaaagaaataagtttatgtgaaaccagtgagtttgtgttgtgacttttagcaaattgagaaataaagttattgggctgaaataagcattttagtgaacaacaaaacacatacatgcagaatatatcagtaataactagaaaccaatggtccacataaggcccatattcagcccactagtgaccgacctacccaccggccatttactttatcctcgctagtcacagtatcgtttccatttaagtttgctcctcatggtggtggtcctaaaactcatctacccatacttcttcaccacttttttcattttattttgcaatagaaccactctctgtgtcagcttatggatttgaatggttacgacggttggggcgaacaaaaccgtcaatggatcagatcgttttttgttttatcattcatcaaaaatagtccgcagtggtccggaccaaaaaaaatagaagaaaaccgctgcggaccatctgcagaccgtttttacatacaaataaacttggtttacagcgatttatagtccgccccaaaaatgagatggagtaaaccgcagacaaattagaccgctttgtccgctgcctccattcataacctataaatcatataaaaaagttcgtagacaaatttgctacgcatcatttgctaaaataaaacacctgttgccaaatgtcgacgatccagaattatgattacaagtatcatcatcatacgattacaattatataaagaaataaagaacacacagaactataatgccaagtaatttcatcagaaataaaattacgttgtttggctaagattttaccacgtgtcaacttttcattcgatctagatggatacccatggaccccacatggatagactcattgacacgctcatgtgaagccaatagtaacaccaaccacaaaagaaagagagagagagagacactgaaacatagagagaagaaaaagaagaggtttagagagagaaaaatg

SEQ ID NO: 6089 - DNA, 3000 bp, Unknown
  misc_feature (1)..( 3000): cDNA_ID_1830037_gDNA_ID_1620844_Annot_ID_50914 3000 nt of promoter + ATG
attatcatggtatcagaaaaccaactattcttggtgtcagggagcatatcttcacgggatcagtctcgtcactggcgtggttcatgtctgctcaggagacaagttttgtcactcttggtcagcgtgttcttgcaaacccactgaaggtcagaatgcattatggccaccctgatgtatttgacagattctggttcttgagtcgaggcggcatcagtaaggcttccagagttataaatatcagtgaggacatctttgccgggtttaactgcacgttaagggggggaaacgtcacccaccacgagtacattcaggttgggaagggtccacaatttggattatttctaactaactatactgctacaacgtttttttaacgtttttaacgtttattaattatgcaatctacttttgttataattatgtaatttaacgttttttaatcttctaaattcaaaaaatttgagtaacctttgtctttatgcatttttcaggtcgggaagggacgggatgttggattgaatcagatatcaatgtttgaggctaaggtagccagtgggaacggagagcaggttctcagccgagatgtgtaccggctcgggcacaggcttgatttcttcagaatgttatcatttttctacacaactgtagggtttttcttcaacacaatgatggtcattcttactgtttacgctttcctctggggacgggtttatctggctctcagcggggttgagaagtccgctctagcagacagtacggacaccaacgccgcgcttggggtgatcctgaaccagcagttcatcattcagctcggtctgttcactgccctgccaatgattgttgaatggtctctcgaggagggtttccttctagcgatatggaatttcattcgaatgcagattcagctttcagctgtcttctacacattctcaatggggaccagagctcactatttcggtcgaactattctccatggtggggccaagtatagagccactggacgtggatttgttgtcgagcacaagggattcactgagaactaccgactgtatgcacgcagtcactttgtgaaggccatcgagcttgggctgatcctcatagtctacgcttcgcacagtccgattgccaaagactcgttgatttacatagccatgactatcaccagctggtttcttgtgatttcatggataatggccccatttgtgtttaacccatcaggattcgactggcttaagacagtctatgactttgaagacttcatgaactggatctggtaccaaggcagaatctcaacgaaatctgaacaaagctgggaaaaatggtggtacgaggaacaggaccacctgagaaacaccgggaaggcaggattatttgtggagatcatcttggtcctccggtttttcttcttccagtatgggattgtataccagcttaaaattgcaaacggatccaccagcctttttgtctacttgttctcatggatatacatctttgctatatttgtgctcttcctagtcatccaatacgcccgtgacaagtactcggcaaaagctcacatacggtacaggcttgtccaattcctcctgatcgtgcttgctatactggtgattgttgctttgctcgagttcacgcatttcagcttcatcgatatcttcacaagccttcttgcattcatcccaactggctggggaattctgctgatcgcacagactcaaaggaagtggctgaagaattacactattttctggaatgctgttgtctctgttgctcgcatgtatgacatattgtttgggatactcataatggttccagtagcgttcttgtcatggatgcctggattccagtcaatgcaaacgaggatattattcaatgaagcttttagcagaggacttcgcatcatgcagattgtcactgggaagaaatcaaaaggcgatgtctaagtttaaaaaacggtaaagctccttgttctcaacaccttatgttatgatcgtttaaatcctggatttcacaccaatgcgggctttaaatttgtgtaggtcttaagaagtaaatggtagttcaaatcctattggtatgtggcgaaggaatcagttggaggttagttttcccgaaacaaccgaattcgaagttttgtttcgtctaaagaaaaactcagatgctgatgatttatctttgtattttaaacaggtttttggagagtttggttggatgaggaatcgggaagttggtttgattcggttagatgggtttagggagatatttgattgtcagtgtgtgtggagggaactctgattcttgtatggtttttgttctaaaggtacagcaatttgtgtagtgaggctttgtgtatttgttctccttctctcattatagagctttagagcatttttagtttatattcagattgttatctaatgtcatctcgcagagcttttgttcacatttcacatcttttcttctccttcttagtagagatcagtttcagattagatacttgtccatattccactactctcgtctattatcggtttctgcttgtcaatttctgggtccaaaattgaaataaatttatataattggaccacaacaccactttgtcggttttgacttttctacttggatgctcctgaacttcttgctcccttttctattacaaattgggaaacaatcagtgtgaattggggaataaaaaaaaacagaattgagcaattaaagccacgtggcaagaaatcgacgagggaccaacgtgtttgtctgcaagatctaatccttttattaacaaaacggcgactgatctaacgggaaacttttaaaatcgagaaattgttaataataaattcaactacttctgggccatcatcatcaatcttgttcgtcttccttttgatcttatcaaactacagtcaaatcactcagagaaagctactaggtctctcctcgacatttgctttcaattcgatccagtaattttcttctcatcggagagagaaaaaaaaaatg

SEQ ID NO: 6090 - DNA, 3000 bp, Unknown
  misc_feature (1)..( 3000): cDNA_ID_1830033_gDNA_ID_1620844_Annot_ID_50915 3000 nt of promoter + ATG
actgatcctaaatattatttaaaaagattttttgtttttcatcgcatattaacaacattatttattggcaacaaaaatgcaatgaaattagtattttgtagcaacattttcacaactattttgcagcatgtagattgtgattttctcgttatactaagttttaagtggtgtaatataagaattgaaaattatgatgttactaatttgtgttattcttataatgatcattagctcaatttgtgttaaatatccacctgactttttattcgagtgtactgttttttttttttttctgttacaatttgagtgtagtgacgattttatatatatttttgttaaagactatctctctagattaattaaaaacttatctatactcgaagttgatatattggttctaaaacgaaaacgctcgatgtattttaagaaagtgttatgaaaaaatgatagcaacttgaacacaaaacgactgcatacatagtagatgattgattgtctaaattaatttatttccattcgaatataatttgatggtgatttgtgtgtaagaaggataggtgaatcgttgggtggaaagttaaaacgtttgaatgcatatctaattactaactagtattcgtgtcttaatacaaagatttcttatcgtttcgtttgttaggtgaagattagctaaaataattaatatgtttaatttgaattggtgtatcatttttttgtcattaaccgtgatgaaggtgatgacaatgctgcttacgtcaagcttatcggcggctctagcggtggcacaagtgggaaagaagggaaacgcaaacgcaggttggcttccgatttgcgggcaagttccaaagttttgcgatcagatcactggagctttaattgccggtttcgttgcactcgtcctctatgtactcttactcttatattctctccacgccgtcgtcgacccttttctccttcaaaaatcttgaatctacctttttttttttgagtatcgatctaattttatgtctctcatacatatatagatagtagacacataaacataaatttgctcgatgtcgatttgagacgtagttcgtgtgttgtgcttgtataatttccactgaaaagaacgttttctaaaagttcatgaccataacacgtaaagaggcgaatgaaggtaatattaatgtgggacatagtgttttgcgtgatccaaattattttagtatcgcaaaccggcctgtcttaaatggacatttgtagtaacaaaaccgaccatcagcaaattaacgttaacgttgctctaatcgtgtgtatttttctaatgcttggtgaagcacatgcgaccatttgttgtgtcagaacaaaaggaagattccacatttagaatttagattataatcccacatgcctattatttaaacatatgtatactgtaataaattagtcccagaagagcatttcatcatactgtataattaatcaaatttaaaaaacatttgtgttgaagagaagatgactagattcacttgattttttttaatactgattggtcgtttgaccagtcaggatccagactgaaatattctcaaaaggtatgaactattttaatgaaatatttgagctgagaatttgcttatgggacattctatccttctaaagaaatcattagaaaatggagaaaaagttactagaaaaagagagggaaatggggcgagagtatgaagaaagggtcccatgtgaatctaataattgaaaagcaaatatgagatttattttagggttcttgttttagcgtccaaagcggtcgcagttgccgttcagcgacttttctctgtttatgaaataaaaacgctccacttgttcttttcttctttcaacccactttgttataactattaacaaatattgcttggtccaaattttattatactgaattattttagtttttttgtatcatcatcctcaatgttagttttgaaatcctaggtcagtaagtcaataacgaaaatgacaagtttaattttgtaattggaacttacatgtcacggtctttgtttacgatcattgccacgaattgtttagatacgggctttttttttctttccgtgttgatgattatcgtttcttcttacatatcttgatcaatcactaacatttacataacctacaattttgtaatataattgcaatactcgagatcttcaaatggtgatactgttaataaaattacgaacttttaatcatcatcaaaatctatagaaaaagatacataggaccaaaacaagcctaaaacaaagagttataatttacaaataaatgcatgtattttgttacttttgttaaggattttcatatcaatgcatgcataatgcattctctttttattttatttataatgcattcttttataatattcggatccaaaattatgaattaattccagattgccataaatgtctttctttgtttatgctgacttttttcttttcttaacttatatagtaagtaaaccagaaaggtggaagatacaaagcaatttcattgcattaataaacttcaaatgtattatccaataatcaaaatttatctagtaattcacaaaaaaaaaaaaatctgtctatcattcaaaatttcaccaatttggataaatatctagaaaattttaaaatacaattcaataacactattaacatatcaatcaatatataacattgcaaaagtttacttgatcattagtatattcattttaaggttaaaagatctttaagaaaaggaaattcaaattatattgttggaaaaaaatacaaatcaaagacagcaaaaaaagtaacaaaaaaaaaaggtagaagaaactgaaacgcggaaaggaggcaaaatcttctcgtcgtcgttgtcgccgtcttcagagctacaaacgaaaaaactcgcttccgtttcgatttctccattgttattgtttcttcagtgaagcttttttcttcgagaaatttctaagatctaccacatgctactatg

SEQ ID NO: 6091 - DNA, 3000 bp, Unknown
  misc_feature (1)..( 3000): cDNA_ID_2991244_gDNA_ID_1620844_Annot_ID_50918 3000 nt of promoter + ATG
gataaccatgtttcttgtaacaagtgtcttcaacatgaccagggcgactacagtaagtacaaactggcctctcctttttctgataggtgtctccattaagaacagattgtgaagactgattggagactgcaaacactgatgaagtcattcctggagtagtagaaatccttgcagaacgttgaatttcatcctgatcaatcatgttgaatacctcagacaaagaaggcaaagttttcttcatgagaatctgacttctaacagcatcataacaatcattgagtcccataagaaaatcaatgactctattagtctctctttcaatcagaagatcttctacagtccgtggaatagcctgaagactcgtcaattcttcccaaagagtttgtttacgagtatgatacgatgacaaatccagattgccttgacgaagagagtgaatctgttgacgcagcttgtaaagtcgagggaggctagatttgtgaaatcgagtatagagatctttccagattgcagcggctgtgggaaaatacaagatgcttgtatagatctccttcgatacactattcagaagccaagacttaaccatactgttacaacgacgccagattttgcaataaggatcatcatcatcaggttttggaatagatccatccacaaatccaagcttattcttagcttcaatgctagtagtcatggctataatccaggtaccatagctgtttccatctaacagttctggagctaagactaaaccaggatgatcggagctaacaagatgataaggactgtgactattatcaggagaatccgatacctcaaagtgacgcgatgagctgtattgagctggttgatgaatcgcagcatgaatcgaggatcctggagctcttgctgatgaaccagaagactgctcatgaatcttcgatgaagcaatgacaagtagatccggtgaactactccgacgaacactctttccatttcgtttacccatggagaatcgaaacagctaacaaatgagactggatcgcaaaggaaacgaagagaaaacgtgtagaagttcaagagaagaaaaaaaatgagaagatgaacaaactccggtgagattccagtgaaatcaaatcggaaaagtttgttacgagactgagatcgagatattttgctctgataccatattagtaaaacaatctcattctcattaattagcaaaagagtacaattgggggtttatatacaaactgatattggcctaaaccataagcctctaaaccaaaattaagattggtttatagaataccaacctgtacagactctatatgaaatctatactaaccaaactaagcttatatacaacaatctaagctatatacattaatagacgaaatttttaaacaaaacccaggattcgaacatcaaataacccatccccaacgcaacaaatattatcaaccaacttttcatttcatcaatgacactgtgaatcatataaaagagatatgatgtcggtgttgaagataacttctttattgtaagattattttgatcgaataagctgcctcaaatcttctaatttcgacaactctttatctgtgaggacactatgaacacgtttgtaaaaatccatcacttggtctctagctaccaccattttctttcttcgcatagggctggggaataatgagttcttacagtgaaaacataagtggtgaccggacgcattgaacctaacatcgtagaaaacattgaggaaatttttgtaacataataaaaagagacatgtggaaagagaaaacaaaaataaaacaaaatattgagaagaaaccaagaaaggaggaatttctttagtagagagatctaccgagattataaagaaattgaggagtagaagagatgtcagcgagctaaagtgacatcagaggaaagactttgaagtggttcctcaatactagaggtatataagaaaaagaaaaagaggcagatccaaaatgttggttttgaaagttttatagatttttaagattttgtttttgttttcatttttcaagagctaattgtcataccattaccaatcaagttttaaaatgttggttttccaagaaaatacttttgctataatctttttttttgtcatcagatattatttaggattcaacgaaccaattttgaagaaaattgttaacaaaagcgaatttttcatgccaaatagttttttattcaaaattttagacttttagttatcttataagcaagcgttataatttatttatttttttaaagaaaattttgagaaaaacaattgcgaaaaaatgtcaggagatcttcaaatgttcaaaaatacaaaaaaaaaaaaaaaaaaaaaaaaattagtgtggggtaaaataatacgtttaaattttattgacttttcatttcaatagtcaacttttagtgacttcttatttcagtcgctaactttttgttgatgttgccaaaatagtcattaaattgacccgagatcacaaattgcgggtaacggaactttgttaaaatttctgttaaatccacaagtgactggattaaaaaaaaaaagtgcaactggcctaatatgagcccaataaaaaatatctcaaaagttttatgggcttattacagatgggcttagtcagagcactatcttacccaaacaattaaaaaaacaatttacaatatgttttcgttttctacttttttcggttattttgggcaaatgatatctacagctcaacaaatcaaaaaaattcaaaaatatttcaatttattatttctcgatttttttcacaactgtattttaattgtatttttagtagaaatacttatttttccaaaaatatttgtttgtgttgatgtatatataaaaaatctgcatcagtgttttgtctacattttctcttccattagtttcgttatctttttattttctctatctatctggatattattttttcacttggggatttggagaaacctctcctctctctatctatagcc

SEQ ID NO: 6092 - DNA, 3000 bp, Unknown
  misc_feature (1)..( 3000): cDNA_ID_2137741_gDNA_ID_1620844_Annot_ID_170158 3000 nt of promoter + ATG
atggttcttgtgattgggaggtgtgacacccaaattagatttatcaaactcaatttatatatgtatgtaataattttacaataatccggataatatatcagaatttaaatctatataacaatcaccaaaataaattaaattacactgacaatatgaataaattcaaaaaagtacatactattgtactacaatctattgtcggcagtacataataaatcttaacgttagttctatgggattttgtgttttgtaaaagccaaaagaaccttacaagacttttgcaaataataatatggatacatttgaatctcaatcgttaaacaatttgtaagctttaattcaaaaaacaacagaaaagagtttaacaaaacaaaacatatgaaaggaaaaagagaaatggatttggatgtgaagaaaaaagtggaagaaacatattggctttgtactttaacaaaaagaaaaaaacatattggttttgcttccaaatagtgactgcgttttgcggtacgggaaaagtgcggtgcagttcaaatagtaacgaaaatacatagatatatatatatgtagagattttgatattgttacaacactgttgcgatgcgattttgggtatggtttcggttaccattcatagcctttgtagtagtggctatacaaatctaatcttgatcgttgtgttgctttaattaggaaatacaagggagggaagatataaaaatatatctaaaaggttatttgattgatatcgacatatgaaatttcgaagtatgaacacatgaaagagtgtttacacatttacatatgtatttttcaacacaactagaaaagtttacaagataagatgaatccaagtggatgaaattatctgtcacttgcatatacatacactcaaaatctgaaaagtcagaacttgtgaaatgattaaataaaataaagttcgacacaaaaaagggatgaatcatgtaggtgacgagagacaggtattactgttagtgatgcaatataatcaaagcttagattcaggcccatcctcatcatcatagcctgcggcaacaatcaagaaaacatgttttagattcaaatgcaattttttatttttattttattttcatttccgatgaacaaaaaaatacttaaaagcaactaacttagttacatgctaattttatattgtaaacattttttttatataattaatatgggattaaagaaaattttaaaatagacaaatctagtactcttgtctttgtgcgcaagatattaaggttttgaatggatattgtggttagtgctgactgatccgtcagcggttcaattcatattatttttggggcggacaataaaccgctacaaacttagtttaaagatggtctgcagttagtacacagcgcttttcttttattttcttgaattcgcactattacagagtatagttttgtgagtatagtttgtgaacgataaataaaaagcggtccgatatataaacggttttgtgcgcttggacatgtgtcaccattcaaagcctaagatcattaagtccatgacatgtagacatgtttttttctgcaatatacggcaaacatatttgcttgcgacattctaaacctttgttaagttttgcaccattagatacgataaactcaattctcttggaattaaaccatatatacatggtataaaaacctttagaagagacttctactatacattaagtttttttgtttttattattatagaaagtaatcatttgtgatggagagtgtatggacttgattagtttgggaaaattattcaaaatttcatttcatacaaaatgtggtttagaatttagaaaggtaatttgcaaagcactaaagcagctttaatatatctctttcatgaatttttaaaaaataaaaagatacgattttttttggggaaactaaaatctttgtttttctctcttatctctctttgtgtgtttcaattagtgagaaattagtaactctctttctcactctctctctctctctgtttcaactgtctgtgaatcaactgttcttgatctccagaaacctctacacaaacaaaaggtgcgttcttttgcgttgaaatggctcatatctcaaatcgtttgtttctctttgtgggtttcttgttgttaccatgtttaaggcaaactgtctgatctgctcagacatttagttgtttttcctcttcatcactctgcgctagttttgtttccgaattcttttgagacaatattggtttagtttcttcttactcgattcacactttacgacattggattcctataaagtgatttacttttctctaaaaacggcaactttgttgcttaagaatctctctgttcttcaggatttgcattaacgtctctcgtttcctgaaaggaattgatgatttacgccagtagaatttgaatattgtctatgtggcagatgtaaagaacaagttacaaagagatattcacaagaatccgtctggattcatgtgtgaatagaaatatgagcaaactctgttcttgatctttgtgctttcttttcataaggattcatgttttgtgattcttgtaggtcctactttgattaatttaatcacagggattagtaaacaagtctcagaacatagattaataagatccccaatggtgataaacaatctcaagacagtctttttggtaatacatacctttattctattgctaagatcacatgctagaatttggtctttactacttcttgaggtttatttatctctgtgatcttattgaaactgctgttaaactatctacttaatcatttgtctctattgcttttaggtcatagtccatcgttgaccaagatttgaatccaaggctttcccggagagtatatactagttaacaaaacactcataaaaagctctggcttgaccaaattttctacttaagcataacggtggagatctgtttttttgtgtgtggctatataacaaccttattgtctaggctgggattaaaca

SEQ ID NO: 6093 - DNA, 3000 bp, Unknown
  misc_feature (1)..( 3000): cDNA_ID_3079534_gDNA_ID_1620844_Annot_ID_170155 3000 nt of promoter + ATG
tcttaatatacaatacttctttttcatgcattaagccccttacaatgtcgagtaaacaaagcatgtgtccgctaatattgtcttcgagcttggtatttttgtattctgatacggtatttggggacgacatcttttgttgactcgatataagaagggggtttgtggaagaaattgtagtattatatatcaagaatggctctccaaaccatgttgctggccacttagctattatcgaagcgtttgttgcaacatcaatatcatatcttcagctattctgttttagagaggttgagactgaatctatatgatctgaaggacggagatactgctatgcatttggccttgacaggtcgccatgtggagatagctgcatgtctggtaaatgtgaaccaatgtgcttcatttcttgcgagtaaagttggaatatctcccttgtatttggcagtggaagctggcaatgtcccactcgtggtatcaaagttgagaactacaagcaatgaaggaagaaagacgaactttgattttgtacacgtggctttgaaggccaagagtagaagtttgttttgcttcttaccaattagtagctctgtttagtttgtttgactagtttgggacagaagactaaatatttgcatgtgggctaatttatacagatccaagtcttggggatgagtgatgtgaagaagggataaattctctttcaattggagcatccatagggttttataaaggagtatgtaacctgttagtacgattaacgaagagtgtttacgtgtgaaacaatgatggaccctttccactcatttggcagcaacgaatggccatatcagaattgtcaaagagactctaaaacattgtccagattcaaaacacctgcttaacaagcttggttagaacgttctttgcattgcaacaaatagtgggaaatgtaagtgtttgattccgttgttgttatatatgcaattctgtttcattttatttccgcactttgggttgaattgtcctgtttctctatttaaagaaaaaagtgcttcattttgatgctttgtcgatcaaactgaggtttgattcccaagagacacatacagattgtatcataattagctaggtccagtttgatcactgtgattgtagttgacagatagtcaaaatgacctcttgttgttttgctggtgatcattatttcagtacctaagttttttttacccaaccctcacttcaacacatcttttgctgccaccatttcctttcgctttcggccgctggtcacaactcacaacagcaacaatgactaaaagaatctgcactaagtcaatttccagcttcttgttttattaaggaaaatctcgtgccatgtaaattgtcagacttttggtttgtttccagctcatacctggttttgaggtagtctatgttcttggcttgccatttctttttaatcttgagctatgttcttagaggcggctaagcagttcaggacttggttgttggttaacttattgtagcaatacttgttcttatttgggctttgctgggtgatccagaactcggccacaaagcctttcagtttgcctttccatttctgtctttggctctaaactccatgtaggtcgcattctattttggcgtgctcgctacaacaagtgatatactagttattttttttcgttcttcactaaatactagattttaacccgcggtacaccgcggaaacaatttattttttaaagttagtatacataaaagtttgcaaattgtatctatctataaatatttttattttatagtttacaattgttattaagtaacgtcctgccaaacccgtcccgccaacccgtcccataaaaaaaacatttattttattaatgttaatcttatttatgatatgtttatgaattattgtctaaatattttgtaattttgtaataattaaatgctatcaaatatctctgcgatttgacgattataattaaattgttatagtcatggagaaaaacaatatcaaaaatgataattttgtagtaaataaatgatattaaatattttgaaagttttattttagtaactaatcgtgtagttaatgtggagagatttagggaagattgttaaatgtcaaatatttaatttgaagattttttttctaattatcaaaaacaaacattaaaatccagtggcagctattgtaaataagtcccaactataagatttatttcacaaaattgctgcaaaaatgtatatatagatattcagcgcgtattttattttgtgctctattttcttcttgcctattacactgtcccatatattcctggctttggtcgttgtcactgggcaacggatatcctctccgaatgctattatggtttgttgatgaagaagatgctgaaacatatcacacctctggctctggtccgtgtgattgaaacaaaaaagacgaaaggatgtcttcttatctatttgattcagttgttgttttcataactagtaatttattacgttggtttggaaagagtcagtaagcggggatagctcagttgggagagcgtcagactgaagatctcgatccacgctcaccgcattacgttgtcttttcgtttttattttctttctatatatcttttactcattgattgtgttacatgaagcggggatagctcagttgggagagcgtcagactgaagatctgaaggtcgcgtgttcgatccacgctcaccgcaatatttagtcatttaatttttttcccaaagccatgcaaacgacgtcgtttaaaaccaaaacacacagagatagtcatatacggtgtcgctttatgaaaagctcgaattatactaacggtggttttacaatatgaagttcaaaaagcccattaaaaagcccactacatatcccaccgcctttacctctgaaccgactattttttttccaccctttatattcgttgtaacagcagagatttttatagtttggtttctttgaccggagaatctcgattaggttacg

SEQ ID NO: 6094 - DNA, 3000 bp, Unknown
  misc_feature (1)..( 3000): cDNA_ID_1830001_gDNA_ID_1620844_Annot_ID_170151 3000 nt of promoter + ATG
accaatacatgtttctcacggatatgtggaaaaactttgttgaaagactctaacttggtgtggcacttggttagtatacgacatgttgttcattcaatggttgtttgacataattcgctttcctttttgttcatgcctcagtctctgtgttgactttttttctataatcatttgggtttagagccagactttccaattctttatgtaaaaggtggcattcacactcatagctacttctccgggtgctgccacattgcttgaaagtttggaacactaaagggattatagtaataaacgaagatctatatgatcgaaaggaaagagatggatatactgctatgcatttgaccttcacaggtcgccatgtggagctagctgatgtcttgtcaatatgaaccaatgtcttcattttttgcgaataaagatggaaaatctcccttgtatttggcagtagaagcttgtaacgtttcacttatgacagaaatgttgagaactagaggcaatgatggacttggagggagaaagtctaactttaattcagttggaagggtagaaaatttcttctatacatggatttttaggcgaagaatacaggtttgtttttgatgcttcttacccattagtagctatgtttagtttgttcaaatttctatattcagctagtattgagacggaagactaaatctttgcatgtgggctaatttatacagatgaccttaatgcttttcttaaagaagatccaagtcttggaaatgaacgagatgaagaaggaataacttgtctttcatctagagcatccatagcgtttcataaaggagtaatgcaacctgttagatcgatcaacaaaggttgtttacgtgtaaacgatgataaatgttttccaacccatatcgcagcaaagagtggccacgtcaaggttgtcaaaagagattctaaaacgttttccagactcaaaacacctgattaacatgcatggtcagaacgttgttcacattgcagcaaatactgggaaattacatctatatcatttcacaaactgtgataaaaccaaatatttacctctactggtggtatgtcttgtaggcttgtagttgtagccacagtaactttttctgtaggttttacaatggcaggaggctttgacaactcttctccaaacttgggaatggcaacattagccaatgcccccaacctcttctattttcttatcttgtatttgacacccttgcaatgcaaatctctgttatgacaatacttaactcggatttatgtgcagttgagggatcctacactcgctcacagatccttttaagtggcgtcaccattactgttttttgctatattctgcatgccctgcgttctatttttgggtggttattacagtaggaaattgtagaggacttgtcatagtcttttccattacatctataatcttcttgggttatattaatttatatacccagaaaacataaaaattaagaatatacctataatttttgtataattagttctctttcctcaacttatataagttggacaaaaatacccttccgctcatcttaaattatttaacaacataagaaaattattacagacgtcttttatctgattcaaatgatattgtttatcaaatatataaataaaagtatattatgaattaactgataactattatgttaacatgataacaaaatatagatcaataagtttataaatatattatgttaaattatattatatcgcgataagattataaatataccgtattaaatcatattatatcgcgataaatttataatttatgtgatatattatgttaacagtgatattttgttaactatactttttatgtatttgaattttagtttttatgttttctaggtatataaattaactattttgttatcttgttaacatagttattagtttattgtaaaaaataaaagaaattgtaaaaggtaaaatcgtctaaaataagttaacagtaacatttgtacagttaacaactagtcaaactaattataaggtcttccatgtgtacagagtgatattacccgatcttcttctctcttgccatgtctttttttttttttgctaagagagtaaatatcaatatatgaaaatgtagttgtcacaaacttacaatagtagaagacctaaagagtttgatccatgccaaaaaaagagagcttaaaaacagggatcaatttacaatatgcatctatccttagtggagccacaagctcatgaggtttctcaatttcttcatcttccttctcctggctgtgatagaaatttataaactgatcacggtcatgttcttttgtaatcgctgcgtcagcaatcagcgacacaaagttataacttacttgcatgtaaagtatgtggagagtattttaccacgacatgatccacgacatactaagttataacttacttgcatgtaaagtatgtggagagtattaaatagcacgaatattctctaaataaagattgaaacttggaagatgtctgtacaagacaaattttattctaaataattctaccgaatatttttctcttaaattttagttttaagtatatttgattttttttgtatttgttttgattttccaggaaatgagtaaatttcgtcgagtccctctaatattgaatctagtgttttttataattattttagtaatgcatttatgatgttttatttttgtggctacgagaagaaaggccttgaaatcttcgatagaattttgtcttgttcagacatcttccaggtttctattttgttttttgtaaggaatcttccaagtcttcatgcgggcggacaaagctactatcggtctaagtctccgcctatgagtctcctgctatcttcctttttaatcttcttggtgatagttacgttgagatatgcggttgcctttttaagcttaaaacttaagcttctttaattttataattccaacgacagctttacacgaaacaaacaaggcacagagatta

SEQ ID NO: 6095 - DNA, 3000 bp, Unknown; identical to SEQ ID NO: 6091
  misc_feature (1)..( 3000): cDNA_ID_2991244_gDNA_ID_1620844_Annot_ID_170140 3000 nt of promoter + ATG

SEQ ID NO: 6096 - DNA, 3000 bp, Unknown; identical to SEQ ID NO: 6090
  misc_feature (1)..( 3000): cDNA_ID_3076251_gDNA_ID_1620844_Annot_ID_170136 3000 nt of promoter + ATG

SEQ ID NO: 6097 - DNA, 3000 bp, Unknown; identical to SEQ ID NO: 6089
  misc_feature (1)..( 3000): cDNA_ID_3079550_gDNA_ID_1620844_Annot_ID_170135 3000 nt of promoter + ATG

SEQ ID NO: 6098 - DNA, 3000 bp, Unknown
  misc_feature (1)..( 3000): cDNA_ID_1830013_gDNA_ID_1620844_Annot_ID_50922 3000 nt of promoter + ATG
ccactcagcctgcagtgctaggtgcacctcagctctcaaggtgatcttaaaacaccacccagacacaatagaaatgcttaactcacagggtcaaaacgttcttcatgtcgctgctaaaagcgggaatgcacgagctgttggctatctgctcagaaaatctgacgtcaaaaggttaatcaatgaacaagacatagaaggaaacacaccgttacatttagccagcagtaattctcatcccaaggttgtaagtctcttcatacatgatagaagagttgacttaaaaatactgaattacaaagggttcaccgctttagatgcagctgaggatcatatggcgacgattccttcactccaagaggtttggcctgcttttgtacggcattggatatatttgtactcatttatatgaagctgttgacatcactgaacatattctatgttatacccatttacagtggttgatatggatggcattggtggctgctggtaccactagagctccacgagttcatctgagagcagacatccctggtctgacaacagatgaggacttaatcctaaaaattcacaaggatagagtaaacactctccttgtggtggcaacactagtggctacaatggcttttgctgcaggcttgagtgtgccactaggttacaacagcacagagttcaagtcaaatgtcaaacattcttacgaagaatctgcatttcatgcttttgtcatctgcaatagcattgccgtatatactgctgttatatcgacagttgctcttatagggacacaattggctgacctaaaatgcatgctgaccaccttcaagtttattgtgccactcctggggttttctattatcgccatgtctttggcttttgttgcaggcttatacctggtcttgggacatcattattggcttgccatatttgtcttggcctcaggcggtttctatctcatggctctacttctgctcatcatcccttacgcttcgccttatacttttagtccgctattttttcgctactttttgcggtttcccttttcaatgttggtttcctttgcatactggagggatggcactgatggggaatgctcgtcacgagtttttcgttggtcatttcttggttaagaagatcaagacttgaaaattcctgaattcccttgtctcatgatgttttagcttgagtttgaattatgcggtgctggtagtagttaaattggtttcgggaagtttgccttaaaaaccacattgtatcttgcttcctaacatgtctcccatgagttgcaaagtgtattcttatgttgactaataaatactttcaactttttgttacagtggtgttattctcttactttctattgtggtaatcaatgaagctatgtagagaactcaattttcctttaacggcgaagaaagatatttaattagccattatggtctgaagcctctatgactagctctgatgtgtcttcattcatctgttgctgcattgacataattgttgctctttgcagcactatcaagaagcctgaattctttagtacagaatatgtcgaaggaagatgttgattccgtaaatcaactagttcctgcaccaacagaagagttgggtatgacttatatggagacgaatagggaacaaggagcagcatcaaaaccaacaggaagatgtcaccattaaccacgcaaagggaggtcgcttactgcaagatacattgccataaacgctattgacattgatgtaagcgaaaagaactggaagtgcgatgttgaaggcttttgagttgagagaaagatactattgtcatgatagaggaatacatcgccaatatgtcacatacaagaaagaattggaaagctgttttctgagccaaagtggccattcccaagttgggaacagagcctttgtgaccacctggtaatgtgaatcctgcagtaaaagtcatggtggttacaagagttgcaaccaataaacggaagaattgacatgatctttgtactttccaccttctggcttgaatgatctaagactttctgaaactggactggaacttcttggtgcaccagcattgatcaaagccatccaagtcaatcgctgtatacaaggtaatattggggtaacatctttgtcatattacctgttgaaacacgtagctccaatcaatgttctactacatctaaagctgtggaaccattatagtttggttttttcaggtcacctctatgatggtcccaagaaaacatactcacaactttagggtgccagttttggtggctagacagcaaaataatagcggcttgacagctctggatatcgccgaactaaatcccaaccccactacatcttttgagaggtatttctaatttcccactacaacattaccttttctcgatcagtttgtcggtttgacctttgaatcttggttgatagaaaccgactaagagtttggctctgtgtcttctcttgttttgggatttcttatcgccagcttggtgctactgttcagtttttcatatgtgagaaaacataaacaaagaaacatacattttgtgttagaaacaaatcggagttgcttaacgttcatgagtttgtatatagattcggtagatggtggcttgatttttgaggttttgttgttctgttttgtttcttgactttcagagttcagacattggttttaatacaaataaaattagacggcaaaacaaaaagatggtggcttgatttacataagtcaatgcaatttcaataaatttttatttttttcataatataataaacaaattaccttcactctgtttctacactgactttggttttataaaatggacgaaaagagtatactaactcagatcctaagtatgaatctgaatcgactcttttgctgggagggaaggatttcaatggtaataccatgctgatcgaatgtgaaccctaaaccaccatcttgcaacaaatagtctaccaacgatgccactcgctcctatcttttcttccaaagga

SEQ ID NO: 6099 - DNA, 3000 bp, Unknown; identical to SEQ ID NO: 6094
  misc_feature (1)..( 3000): cDNA_ID_1830001_gDNA_ID_1620844_Annot_ID_50925 3000 nt of promoter + ATG

SEQ ID NO: 6100 - DNA, 3000 bp, Unknown
  misc_feature (1)..( 3000): cDNA_ID_1829990_gDNA_ID_1620844_Annot_ID_50928 3000 nt of promoter + ATG
atttatacataaatatataaaaatttatatgaaaatttataatttttcattctgactactttcatttgatttagatacaagataaaaaaccatttttagacccaaaaaaaaaaataggttaaaatataaaataaaaatggtggagtaagatattgtaattttattaaacaaaactgttgtaatgttaaaaattatgtaggtgttgaataatgatgtggtagaaagaaaagatgatgtggagtgttaaaagtgaaaaagtgggtgttgtaaatgagtaaccattgtagataaatagtctaatgattaattttgccaacaatgattatctcaacttcagggataaaccggcctaaattttagatttgagtttgatcacttatgtgtgttatgtctgcatgcctaataagaagtattatgaccaacaaatattcaatgtcagtgtaatccaaatttagcaaagcaatgtaaatgagctgcatattatatgttaaatattgtgtgtactcgtgttcttgtttttacatcatcagttactaattctaaatccgaaattccatctacatacgtagatcaatcaaagttgtcctaagaggaggccttgtgagtctcattgggttttacagaaatcgtcggacctatttgggctcaaacatataaaagatccaagatactggatttaggcccaaactcttttctcaatacgataggatccaaatctttttgtagctgtggaatgtggtggataacaaataacgtcacttggtaaaaatccaacattttagattcagccatcggtcgtacaacgtcactctcatcaacttctttttcagttccccaaatcacgatgatcgcttagtcatcacacccatctagcatcccgccgtcagataaaccggtcatttacccttaccaacataccggttttctcaatttacaaattcggtttgataaatatcaatagattaggtaaatagaaattaagttaattcggcacgtgtcacgaaaactaccacatggcgcaaaggccaaaaccacaaaattcagaaaagttggtatgcttccacgtaattgacatttttcacgtgatttgcttgtgactactgatgttacaattagtagacgtaccgttcaataacgtgatatttattagagattattgatttgcataattagttacaaaatcacacgtcacaaccatttttccccaatattacgtccaaaactgttgattcgtttgatttttattgtccgtccaatgactatttcgatttattataacttcttgtgttagtaaatagtaattcaagtctatatatactcttatatcataaattaggaaaagtaagtactgtatacgatcattgtatctaataaaatatgaaatatgcgagcaataacggccaaatagagcgtaacttcagttttttttgtgatacctagttttaaataccctaaacatcaagttacctcaaattggcaaaacctaattttgctgaaattgaaagaaaaataatatatttttatttctatatttgacttcatttaaatattattttcgaaataaatatttacctacgattgattttatcaaccagttgaacgaataatcttcttttttgtatgttaaggtgcacttataatatatatttctatatatatcacatgaaagaaaaataaaataatttaaataataacaactttcagaactaagtttttttcatattaattataaaaaatttgtatagtatactatagactcaataatagtaagtactaagcagtaaccatcaataacaatattttctaggactaacattttatttctcttcctacgaacgtaccacattgtatcatgatagccaatcaaaatacacagtactgaaactagtaatgataataagttaggcagcctaattatatacaacttttcaaatacgtcatatgaacaaataacattttccgtaatatgtactgaaaatttccacgataaaaaacaataaaaatgctcgattaatgttcttatacactggcattaacaattctcacagcaaaactaccacactaatcacaatcttatgctcatgtagtatttttagacaacattgtacatgtagaaagttctttaactcttaagtattatcgactagttttttttctagaatgaatttttctaatcgaatactttaaaaatagagtcgacgaaagagattaaatataacaaaaccaaaccacgtgaggatcataagctatggacgaggaaaatcgtcaaactttgagataaatttttgattgattaggtgtttgttgtactttttcttattaatatccagaattcagaaccttctcttcctcaaatctgtctttatcctttttaattcaattttaatctcaacttttctatattttatcgtctaaatttaaagaaaagaaaaaacccaaaaacagaggattttgatcaagtaaaagaaagaatattttctagagaaagcaaatcgattctctcacctttatatatataacctctccacctctgtttcgtctctcaatatatatccactggtctttcctttttccggcaaaattgtaacagaaccaaaaattactctgtttttttttattttcttgacaagtctgcatttttctcctctgttttggaattttctcgtttctggttttccgatcataaaaaacaaacaaaactaccgtaaaataggctctctccacagaaaaaaaagaagacttttctttcattcttctgcaagtaactgagcagatttcggttttttcttcttcaaattgatatttttaaagttataaaaatttcttgtccataatttccgttttccttaaattcagctgtcctaacgtcaaatctcagacactcgcttgcgtgtctccctctcttaaactctctctttctctttctcttttggtttctgggttatttcaaagaaaagaatcaagaaacccctctttctctcttacaagaatcccatcatg

SEQ ID NO: 6101 - DNA, 3000 bp, Unknown
  misc_feature (1)..( 3000): cDNA_ID_2992383_gDNA_ID_1620844_Annot_ID_50930 3000 nt of promoter + ATG
tacaacatatcttgacagagcaaagattgatttttacctcacagaattggtagtaatagtgagacagtgaaccatggagtgtgaatccaacaagacctgatctaagaacacgagttcgatcaaactcaaacagcggttttccttcgtaacactgcataaagttacagccaaaatggtcagagagaactcaaattaagaagctttttagagtatttttagtttcttacttgtgcaatccaatctcctaaagaatacacaattccactaatcgccattttcgccaaaacagggtttgttttgagaatttgttcatacgcaaaccaattatgttcaggtgcatacctaagtatctcgtagagagtccaaccctaagaagaacaacaacaatcgtgatatcaatttcagtataatcccataaaggagcaagctttgcagagatagaagaaccaatcaatcacaagagagataaagaaaaccctaagcttacttgccaatagtcatgatcaatggttaaaagcttagtaaccgcaacggtaccggcggcgagaactatagctgcgttgatacctcgactcatcagccgatctgtatcttctactttatcttctgatagttcttcctctgccttgaaattgtcatttttaacatcgattgcttctctgtcttcaatgatcgatttaacgatcaagtttcttctctctgtaatcaatcgtttctgattcttaaaagggttgattcggggtaatgggcctgcggttttaatccgtgaagaaaccttcccggagacgatgatggtggtgggacaacaacagagagctgccatggacttgcacttctcaaaggaagatactttttctcttctcgttggctctctcacagccaaaggagaggtttttagacttagagaacaaaaaagaagcagcagactttggtgaccaaacggtaggaactgagccgaaccgagtttcggttaaattaaaaccaataaccggtgggttttaatttggttaaaaaccggtttgcacaatctcaaaaccgaagccgaaaacaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatggttggaatggtagaggagggtttaggcgtaaggtaagagaaaatgggattgaacccaatttgcatacttcaaattctctggtgagcttgatgtttcattgatttgacaaagcatgtatttgagattgtgggcagttgcaggatcagactacatgttacttacaacaggcatgatcaaggagtattgtaaggtagggtagagaaatgatatgacaatgatgcaggttttgagtattgcctagctttgtatcaagatttggatgagaagtgactttcaggcttgtagtttagtgattggagattctgcaagaagggaaaattacatgaaggttatgtggtttttctgcaatatgattcgttaaggaggccaagccaaatgtagtcaaatacaccacgttaatgattcatccgtatggggacagcttagatttttctgtgtgttgcatccaaagatgtactgtgtacccaaattccgagttcaccaaccagggatgaatgatactgtgtacctaaattccaaagatgtactgtgtaccctaacagttttcgtctggttaggagataatcacttcttgaaagcagtttgaatgtttctcaaagaatggtcatgtactacccacgttttttgtttggttatcttggaggtaagatgagctggtgacaattctgtttttggcttatactaagattaacgtggagctagtcctttgctttacggagctttgataagatgttttaggatttaattacccatcaagaagataatgagggagaaaaaggctaaagagattcattcgacttgcaaaaccatggttggaattttgtgcacatagtgattgaggagagagatagaaagtgaagggactttaaatgttagacccgttgaaactagtggtgggcctgtgaaggttgaggttgagggaagagccagcctgcccaaaagaaaaaatatcttgtgcaacttgtgatgcttggtagctttggtcctacatgcttatccagatatttgcagagaaagaaacatcaaaaggttagccacattataggaagaactaaaattttctaatgctattttgctcaaataggtgtttgagagctctgttcatttaataatgtccatatttgtggctatgttcactgaattattaacagggaaagcagttgaaagatagctaacatgatgtaggggttttggtttttaggaggcaaagaggctttcatgggaccacactggatgatagttgcaaaatacattgtggttaaggtttgtctcttgagcacatgttgagactgggatactcttctgtgagaacgcattaatagctgtattaagtgttgatagaatttgtggacggtaattcccgtgacatttatggaggtatctgtgatgtttttcctattaaaaagacaaataaggagacccaaaaaaggtgagaacaactatacacacaaagaaatttcttttgtctgaagacaaagggagtggtcaatgaccagtactcccctatatgttgggttaggacttctactcattttgcatcgttgagatactatactgccttgaaagacttggtattgg

SEQ ID NO: 6102 - DNA, 3000 bp, Unknown
  misc_feature (1)..( 3000): cDNA_ID_2138868_gDNA_ID_1620845_Annot_ID_170167 3000 nt of promoter + ATG
tattgatacgcggtgtctttgaaaaaaaaactcttctgttagatcttgaactgattgtaatctgtaacctaataaatcgtgaaccacgggtctagaattatgacgcgttcgttgtggtatgggcagggatctcgctggagcctccgggcgaggactttcatatacgcagcaatatgctgtacaaaaataaaaccaacccagacaaaaaaaacaacaacattaactcaccattatctactttaactcaggcagaacaataccataacttagacataaccaactacaactcagtctgcacaccagaataaaccagctataatttatttaactcagcctaaacaacacgataactcagccataaaatagacaacctcagacagaatataacaataacttacttcatcacccaaccatccataatttgaatctggccataactttctttcggtcatgaaaactccgtagaaatcaacctcgtctattccattttccaacgattttttgctaacaaataataaaagaaagttaatatacacaaatagtgtaagcatgtcgtacttaacaacttattaaggtataaagggtcatacatgtcgagacttgacaaataatccttaagtttctgcatgcaatttggactcagaatcaactggatgaaaaaacagtctatgtgtatccacgcatgaatgatttttccactggccagctcatataccgaccagaatgattcttcttccctttcagcaactaacggctctgcaaaagggaacatatatagtgatatataactgatctgtcgcaagaacatgatgaccatttcttcctagtgagtattttgagtgaggggggagtttttagccttgctcttatgatttagggattttcttattcatgacaatattggacccctaggtagtactaataacaagagagggtttttgttttcaaatgttggtttactggttaggcttttattctccaccatggtatggttcctataaagctacataagaattcattttgaagtttgtttggtgtgtgaccgaagaaccaaaaaaaaaaaaaacagttgctcattctttgtctacttatctcactattcggcaatgcatatacgtcctaatctttgttttgcttatcttagttattctatctctctcccttacctaaaaagctggcttcaaaggacttgacggatcgtttataaaacagactagtcataaacatagatttatattcgagatggcttcaaatacgaatcttaaactgtttatagtatatatagtatctaatagctgcgggtgttgtgaaagggaacttagtgttgaccatggtcatggagtttaaccaagaagtttgttgaaccaaggattcacacaatagatttgtttagagagggaaaacaaatctagtaatttctcttcattaggtattctatccaagactcgattacaagaggggttctaatctcttatgaaatacattagggttttgctcaagaacagaaaaagaattagagttttaaaaaggtatagctgcatccatgatggattgcctacgtaccctgtgaagggatcaagccattcgtagttttcaataggtataaagttctatgtttcttgtgaatatcccaagatctccccctttttgtgaagtccctaaggcactttatataggatccttaaaccgcctccctagcgatattcttcggaagattcttatttatccttaggtcggttctagaggataatcgtcctaaggatattctccttattcttcggaggttttggggagatttcctgatttcgacattatcttcaaagattctcctttatcatttctgaaagtcccataaaagatcccattttaccggaaatgatccttggagaatgaatggtttttacaagtctttgcctcgcgtgttcttcacggctcggtggtcgtttgagaggtggcttcggggcaaacggtatgtaccggctcggggcgcgcttgatgactgtccattaagctcagttggctgtctcccgagccgatatagatgtttcccgcagcgttctcacgattggttcgggctgtgttcatatgattaacacccgagccattttacaaactctcttcgggacggtcgatcgaataaggtcccgaggtgctttgttctaggctaggggccaatcatatgtttaaccatgaggtgattgttattcttagactgtttggctcggtcttgcttgtgggggaatccgaccccaacaaagttgtaccttgacggaagagagcacgaatgggatcggtgcgggtgtctggaaagtgcctgaagaaggttcatgtgatgatcaaactctggaatgctactgggagtactgactgtaccaaaacctcctccaacagtgccacagggaacaagcaagccccatatcaatgtgtgatgaagttgaaggagcagggtcgtaaggtggacttccacagttagaaggaggcttgtgtgatggaggagctccatatccttcgtcatagtactgatttccggatctgaataaagaagcatggcatcatttggaagtaagagatcacatgagaataccatccctagaaccgagagagaaaagtttatgttaataaatttttattgtataattgatattgaaaaacattaataaacattaataaacagtgttcacataaggtgtaaattcaccccaaaagcactctaaaaagtaaaaaccaaaagagaaaaaaacatagaaatggttacttaataatataccgagtttcatctatttacttaataatatacggttatttgatttaccggttaactaaaaaatatctggtttaatcgtatttattgttggcaaacacaacattgggcgcgaagtggtttttgatgcccttcaacaacatttgggggtttcatttcaatcgcatttctagggtttctttctctacgattcaatagattcggacgaattgggggattctgaccagagagaagctatg

SEQ ID NO: 6103 - DNA, 3000 bp, Unknown
  misc_feature (1)..( 3000): cDNA_ID_2138868_gDNA_ID_1620845_Annot_ID_170173 3000 nt of promoter + ATG
aaagtactatgcatacttaaagaacgaaacaagattggaattcttacattgggagctcaagaatcatggagaatattatctaaaggtttccttagtcattacaaagtgacaggttatgcaaaatgcattgatggagtcatctactatgaaggttcttttggtgatggtttaagacaagagcttgccataatgagttttgatttaagatctgaaaagttcagtttgattaaacatccgaagaaaagtagcatagctacatgttggtcatcttatgagggaagattagctttggtaagttccattgcttctggagttagcttatggattttggaggatgctgataatcacaaacaatggatatataaacattttccttcacatcgagaattcatcaaagagagatggaagttgaagggtgttactcgtactggtgaatttatttacacatcttacagagcttatgtacttaatgttgaaggaagggttttatatcaatggttccgtattttgtatgttgatcccaagagaaacagtatgagggtagttatgcatggaggaattgcagttgacgatattaggcgacttgatgaagttggatatgatcttatgaaagacttgactgtcataccaaatcacattcagatttgaagctgatcttaccatgtcgttgtaagagttttcttcatttttcttttcttaagttctgcaaattttgtgatgatttttgaatcattgaatcccattgaggggtttttgtcttgatttaagaaattccttataaaatcgtggtagtgaagtaacacctgactctaacgcaagaacatcactgaaatgtgtagcttagtcttctatattggttacatatatagtcatctaatgttcttgaataaaaatacctcatgagcagaactccaggtcatatttttcttaatcaagagaaatacattttgttatgatttgataagttccttaatcccaacatgtttttattgtgtttggaagacagtttgattacctaagtttgtaggaggtctaggcctgaaatatcactttcatgtaataaactagaacaaactattttatcaagatggaactaatatgcactttaatattaatacataatacttttaaaaatggtgaaaaataatgagcttatctaccaaaaaacagaaccagttgtttatgatggccaaaagtgtcataattacagtccctagttgctctcatgtgtctttcagatttccagctcttgaaactttgtcaatgtaccaagtgagatgatgatgatgttatgttttgtgaattgtcaacaggtcctgaattggagcgcttgttgaaggagctgatttggactcagaatcaactggatgaaaaaacagtctatgtgtatccacgcatgaatgatttttccactggccagctcatataccgaccagaatgattcttcttccctttcagcaactaacggctctgcaaaagggaacatatatagtgatatataactgatctgtcgcaagaacatgatgaccatttcttcctagtgagtattttgagtgaggggggagtttttagccttgctcttatgatttagggattttcttattcatgacaatattggacccctaggtagtactaataacaagagagggtttttgttttcaaatgttggtttactggttaggcttttattctccaccatggtatggttcctataaagctacataagaattcattttgaagtttgtttggtgtgtgaccgaagaaccaaaaaaaaaaaaacagttgctcattctttgtctacttatctcactattcggcaatgcatatacgtcctaatctttgttttgcttatcttagttattctatctctctcccttacctaaaaagctggcttcaaaggacttgacggatcgtttataaaacagactagtcataaacatagatttatattcgagatggcttcaaatacgaatcttaaactgtttatagtatatatagtatctaatagctgcgggtgttgtgaaagggaacttagtgttgaccatggtcatggagtttaaccaagaagtttgttgaaccaaggattcacacaatagatttgtttagagagggaaaacaaatctagtaatttctcttcattaggtattctatccaagactcgattataagaggggttctaatctcttatgaaatacattagggttttgctcaagaacagaaaaagaattagagttttaaaaaggtatagctgcatccatgatggattgcctacgtaccctgtgaagggatcaagccattcgtagttttcaataggtataaagttctatgtttcttgtgaatatcccaagatctccccctttttgtgaagtccctaaggcactttatataggatccttaaaccgcctccctagcgatattcttcggaagattcttatttatccttaggtcggttctagaggataatcgtcctaaggatattctccttattcttcggaggttttggggagatttcctgatttcgacattatcttcaaagattctcctttatcatttctgaaagtcccataaaagatcccattttaccggaaatgatccttggagaatgaatggtttttacaagtctttgcctcgcgtgttcttcacggctcggtggtcgtttgagaggtggcttcggggcaaacggtatgtaccggctcggggcgcgcttgatgactgtccattaagctcagttggctgtctcccgagccgatatagatgtttcccgcagcgttctcacgattggttcgggctgtgttcatatgattaacacccgagccattttacaaactctcttcgggacggtcgatcgaataaggtcccgaggtgctttgttctaggctaggggccaatcatatgtttaaccatgaggtgattgttattcttagactgtttggctcggtcttgcttgtgggggaatccgaccccaacaaagttgtaccttgacggaagagagcacgaatg

SEQ ID NO: 6104 - DNA, 3000 bp, Unknown
  misc_feature (1)..( 3000): cDNA_ID_2138885_gDNA_ID_1620845_Annot_ID_170179 3000 nt of promoter + ATG
tcttacgtattagttataaggatagctcctcaaacatctttcaaattacttgttttcttatcataaatttcgaaaaacttagatatatttaatctgcatattcatttagtttatttcataataaacgtctaatttttaggtaaggaatatgtgtagcatgtttggattttatgatcactttagccactaagtggatctcaaaattaaaaagaatatattgaattaaaaagatatagaaagaatgatggttcaagttctgactaattatactctcatattttagttgttatgttgaattaattactaattatgtattagttattttatgaagtctaggtggcaagctctcatgtgctgatgtgtcaagttgtgggagagagttaaccttctttcatatatatgattaaaacatcaaccactagatttttatatgattgtgatgccccttaaaactttgatatatttagcgccttggatttatagatcacatgtaactggattctgaaagctaaagtcgtgagtttttgtgtagaatttttataaaaaacaactttaagaactttaccccacacacaagctttagaaatcattacaacgcttgattagtgttgttgtagtcaacatatgtcattatatgattaagtataagaactagatatgcaacgagattcagaaagttaagtcgtatatgtatttgtgtagaagctccaaaaaaacttctataacatcacccccatccacaaagctaagtaatcatacaacaattcaatcattaagcatcaattcaatccatatcatatatatttatgcataagtctacacttagctaatatctcatctagaagctaacatttaggcaaccaaatcaatcaaaaactctagatctacaaacgaaagaaaataaacaacaatcaatcttgtttagatgagttccatgaactacatgtaaccacatgaaacacataaccctaattcacattggtctggatgaacgagaaatcgctacccttgaccaacccgatctcgatctgcctaagctttctctgactcgtactaatgatggatataagcttcagaccaaaaaaaaattagaaaaatattctaaaaatattctaaaaataataaaagactaagggcgggtaacacataccgattatccgactaacttgactcttagctatccgactaatgataccgaccaccacagtttctctgacgaagcttaacgacctaattagtttgcttatacgtttaagttataataaaatgatgcatgaaaaacagtattgtttgtataaaaatcaaataatataaaaaatcatataaaagacaaaaaaaaaaatagactaagaatatcaaaaacttacaccttattacaaactgtacacaatcaatcataattttataactaaaaaacaacaaaaagtattatatacaacaaattcatcggtttatacaaaaagaacaaattattaatcttgcagtatatattgaattatacgtcttttaaataaaagtattataaaaaagaaaaataacaaaatgatatttagttttacaggatgggttatatggtaggacagattttgggtcgaaattagtttgagactgtataccatgggtaaattcttaaaattaacaatcaaaatacaatttatacaatcttaaacactagacaaaacaactataatttaaaattttgattataaaagatcgacccccagtgtatccacaatcaaacataagtttataccaattaaattaaaatacaacaatatcataagtttataacaaaaaagatatatatatatcatccggtgtacctttggtcaaatcctgttattatgtaagtaagctaaacttttgatattattaatttgtcttaaacgtcatactcaaacacgacgattacacttaaatcccccattaatctttgatattaatatatatatatatatatatatatatatatatatatataattacatattgttatttacgttattatttgttttacgattatatttattttgggtttttatgcaaataaaagggtactacccatatttaagttccaaaattgaaaaatattatcaattaattgaaatttgccactattttgcaaatcacaattatacaatatgtcaagctctattaataattttttttttttcagtcgaatacggataaagaatttagaaaatattttaatatattaacaaaaataatcaatagaattaagattaatagtttaatatattgaaatttccgttataggaaaaggaattctcaccttttttatataattttttttaacttatgcatatatttttttctgatagagttatacagcttttcttatatttatctttaaatatattaataaatttagatttgagacatgatgatatcgtgatcacatgagttagcaacttgtaaaattcaacttataataagatggtcacattaaataaaaacacatgtatgattagaaatttccattttacaacctaaattatatgtctcttttataacaataataataatgcgtctgttaaaaaaaaaagcgtcttttacattttataacccttggtcttctctaacttgctaaattgagtgctaaaacaatattcgagaagcattcttgtactcaccaaaatcttcacatttcttttgtttacaaataaacgtactaacaattcaacctggaaatgttctgaaagaccattagctaaacccaaaaatatatgcacgaacatagatcattactttggtagttacaacttacaacttagtagcataataatttaataaagtactactggttacaactttaaaaaggaaaaggacatcttttactttattaggacagctttttgagttgtaaatttagagcccaacattggattcctcttctttgaccattcctctctacctgaataacccgttaatctctctctgtccctttcttcttcttttttcaagaacaataaaaaaatg

SEQ ID NO: 6105 - DNA, 3000 bp, Unknown
  misc_feature (1)..( 3000): cDNA_ID_3076533_gDNA_ID_1620845_Annot_ID_170185 3000 nt of promoter + ATG
aacaaacagaacatcttgaagatctaaagaagagcctaactgaacactgccttgttttgtagcggttgtaaaacgtccatcaggaagtttaatcaaaacaggaggcatatcacaaacattacggagaaatgcaagagaaccagtcatatgatttgtggctccagaatcaattatccaagattcaagaaaatacttaccagactgatgatcatttaaggtagatttccgttcctcaagaatcgtttgtaaaattttccattgtgaatcattcagcccactaagtcctatgcgatcatctgatgtcaatggagaagtgagcgatgaattcgtaacaacattggcagccattccagaagaagcgacatgattaatagaagatccacgaccatgactctgttttcctttgaacgaacttaaaccaccacgtgaagaagatgcagtgtttttaagacgcaatttttcttcgagccaaggaggatacccgattaatttgaaacattgttcggcgagatgaccaacacggccacaattactacagactctgttttctgaagaatctcgaggtcgtgaagtagtttggaccgcgaagctaacaccgtcaaccctctcgttatgtaagcgactcaaggatttggattcttcgtcttgtgtcaaagcattgtaagcttcctcgagagaaggtagtggcactcgagagagaagagccgacttgacagctccgtacacagattcatcaagtcccataagaaactgatgcaatttgtcttcttcacgttcttttctgacgtcgtccatggttttagcttgttggtaatccgccaagctacaccacagttgagagagacagccgtagtaagtttcaatggccactcctttttgacgacaggttgctaactctgttttgagtcgctgaacatgttgtccattcttgacaccaaagcgtttctgaatgtgtgtccagagctcatgagaatcgtcgagatgagacatagatgtggaaacagtttcatcgatggtgagcttcatccatgaaaccacaagagcattgttggcagtccaatcttcgaaatcgggatctgtctcaactggttgtggaatagatccatcagcaaacccaaatttctttctagcttttaacgccaaacgaagatttgtggcccattcgtcgtagttgggtccacgaagcaacggtttggagatgagagttccgggattatcaccggatgtgagatcatatggcgagattgtacgccttgtttcagtcctagctggtgtggtggagctagcgagagccaattcagtactcatgatgaacggagagtttgatgcaagtattaagtagagaagttagaaggaataagaaagcgatctcttatagcggaaggagagatcacagaatcgatcacaaaaaccttttagtagttaggtattgtgctctgataccatgtcaagaatcaatcgaggttgtgaaaagaagattcttattgattacggcaagaggcaatgcctttatatacacgataagtttagacctagttaatctatacaatataaatgggctaaggccacacagcccaacatatattgctcataaacaaacttttcaattgaggcaagtctcaacatgttttgatcaaatcgacgcttttctaaaccactttgttttctctttttgcatcgtgaaccttccttgatttggaccaaacttggaatataagagataacatattgtttacagtttccgtctacaagattcagtttttctaagtatccatcctctccgacgatgctaataaatgttttgagacaattagagtcggggtcaaggtttctaccgaaacccatgaagactttcttctcttcgtctacgaagaaactatgtgatatctttatcttaggtctcgtatcaattctaaataacttgctccacgacaccgtttcggcatcaatcttagtcgtaatccatatctccaactcagataacgctgaaataaagctgcaagcttctcttctttaacacaagataaagtcacatctacagcgctgcacggtagagggagaagcggcccgaatctctctcttgtaaaatcaaaacagataatgtgatctttgtgaccctgtgacctcctttctttagcacaccagtaagtgtttcccttaatagaaacgccactggaagaacaatgtacaccccagtgtggagtgacatcaagagttgtctataaacccgagtcaaaatcatagatttcataccaaaaagattgtgtttcgggtgtattgtagaaataatctagaaacctcaggaacttaaaggtacgacaagattccttatcttcgtatccaagagcataactaaacctatcaaatccattcggaggttgagaatatcggaggttgatccaccttgtatgcccccaatacggattccaaaccaaaaccctagtaacgtcgtctttcaagatgcataacaacaaaccctcaaagtggaaaatattagatatactcacttgattgtgaatgaaaagttgacctttaacctctatagatggatcaaagtcgacgacaccgctcattaaacaaagtttgtgaggcatcatcatgatcatcatagtctctccatctcttgttggtgttgtcactttaccaatgtgcatcttcgtaaaaccctcacttttggataaattgttccaagttttgcaagttaatctcaccgctttcatagatttcaaaggaaccctagaaatgatctcctcgatcaaatcccttggaagattgtagatcatcgtcgtcattgtttcaactttcacaacgaatgatttcttgcagcttagggaaaggaaaaaggtatacacgacgacaaattataaccctaaataaatttgggccactagtgggctttcagaatctaattgggcttaagcagacccaatttgtatctggcgcgaggttttagtttctgcggaggaggagatgatcgacgattcgtctcttacggcggag

SEQ ID NO: 6106 - DNA, 3000 bp, Unknown
  misc_feature (1)..( 3000): cDNA_ID_2138932_gDNA_ID_1620845_Annot_ID_170191 3000 nt of promoter + ATG
cttttgcgttgaaggctttaagtgatcccacttgctcagcaaggcttggcacgattggtcgtggatgtttgcctccaagaagagacgccccattatagtttcatctttgcttatgagtgatcccaaaactgaatcaagcaaatcttcttctaacggtgtagtacagttttcaacctttagagagaaatgaaaatacagacttctgtcagaacacaaagatactatgtttccagctgaaatgatgaaaagtagcaactaatagatacatcttctgactaatgttgacactaacagatctttctaatcttcatttgtttgataaaatatgctacatctcaaggatacagaaagataaatcatggatggaacaagcaatctctcaagcatcatagacaatcaaacacttatcaacagcctttatccacctcaagctatcaaaaacgcctaacaatactgtatatatgaataatatgaaaaacccatttgatatatcagaagaatccaaagttttattaccctcagaaagcaaaacgatatggactgacaattataaaaaccagaaacataatgtggactaccattagagtctctctattaagtgcatctactggataatatcaacaattgtaagactttctgcaaaggaacacaacatggatacttatgaaatgataatacagagttctgtcagaccacaaagaaactatattgaaatgattataagtagcagctaatagatacattttcttactaatgttgactctaacagatctttctaatttctatttgtttgataaatatgcacctcgtattagtaccattaaacattggatggaacaagcaatctctgaagcacatagacaaccaaaaacttatcaactacctttatccacctcaggctattgaaaacaactaacaatagaggatatatgacaaacccatttgatatccacctcaagttatcaccttcagcgagaaaagcgatatggaaggacattttatatttcatagtactaagagaaacttaatgtggactagcatagtctctctctcaagtgcatcatatctaccattctatgacttttctgcaaagagactcaatgagaagtcaaacttcatgagaacttagataaatcaagttgtcaacttaacaaagaaaaccaaatgatggtaccccatgtgctaattaaagagtagagagaagacaatagcacttgagtaaccatttcatcaagaacaagctaaccaaactataaaccagcaagtgcaaaaagcaaactaatttactcgagggcaatgcaattctaaacccaacttaacccaattaaagaaaatttagggttaatatgaagaaactcttacttcaccatctccgatttgacgcttaaatctctgcatttcctcagacattcttccaatttcatcctccaattcacgaaccctagcttctgcttctctagctctctcatcagattcattcccaaactccatcaacgcatcacgatcttgatgataaagcaaacactctttctccaatttcttacactgactcaacaaattcccacactcactagccaatttctgattctcttcaacaaacttcttcaacgcttgcgcattcatactcgcttcagacttataaaaaaaaaaaaaaaaaaaaagattcagattcaaatcaatcaaatcccagaaaacgaaagatacccagaaagaaattactaaccctaacacgatcgattacatgatctttctcctttaatcgcgaaatcagaccctgatactgttcgcgaagacggcgttgagattcttcagccgtataaagcttcttctgaagagattccatggagatcggaagacctaaagaatgatcaattgtatctttgatatattcttcgacttcttgcgagagatttgttctcgattttgtttctgcttcatctgaatcaattctctcgctccgcatggtttactcttgaaacaagatttggatttcaagaagagaatttagggtttcaataggaagaagaagaaaggggaattagtaaaagagacggaagagaagaatttcaaaaatgaaatcagaagtttgtagccgttacaaaagttattgcatcgatcgattcgtgcctacgtggcatgttttaagtggcggaaatatttggctcctaatgcaattttttggttatggtttttgggatccggtttggtttattttgtcggttttacttgtggaaaacttttttttttctctgttcggtttgacacaattcggtttttgttcgagttggttttttatttcggttttgtttttgtttaaaaacgtattttaaatatcaacaaaaagtgattacctaaaattacaatttaatgtcattatatcaaacaaataattatcaactaagtaattatttttcctctattttcagctcaattttttttattggtttatttttattttttcatcttgactagtattaagcaaaagcgtatcattcaattatataattgtatcaatttccaatttatttctatataaatttttcattttttgagtgtactaggataaaaaaaaattatatcattgggtggaatgaaaccttaatgtttcatgactatgcataaaaaatgaacgaaagatgagaagaaacatgaatcaaacctttatttttatttagatgattagatgagatatatacattaggaattttgattcgttcagttaattttgttcagtttcataaaatttaaatttgatttaaggttcagttccaataattctatttataagattttaaactattagtattattcgaatttggataagttcggttagattcattcatgttttcaccactcatttcctaagaaaacctttttaaaaacaaggtcattttaagaaacacataattttacacgaagtcgttttaaatgaggtagtttaaacgaggtcgttttatcttagtaaaacaaacaaactcctatgcttttctctatataatg

SEQ ID NO: 6107 - DNA, 3000 bp, Unknown
  misc_feature (1)..( 3000): cDNA_ID_2106758_gDNA_ID_1620845_Annot_ID_170192 3000 nt of promoter + ATG
aacgaccttttcgacatagcttcttgccatatctccaagaactcctccatcaatttttttgccattcccattgatgatataggaagatactccacctaaatagtacacacacataattataggtttcaaatgaaagtagtgcataatagcataatggcataagttgatagcactaaaaattcgtataatgaaaacttgttgcatggaaaaccgtagattatgcaaattttcttaattgacaaattttctgcctaatcacattagaaaccgtcattatgtgtgttaccaatcatagctaataacctttagttactgagttacattacaaactccaaattatgaattaactagagtgttagataatcattaacattgattattaatatatctcaacgtactcaaaagatataaaatttgttacctccatgactacgcctctaatggtctcagcatgagtaggaacaactttaccaactctcaaacgaaaatccccaagttgatactcaagcccttcaaagtaaaacgagagtttgcatttgtaagactgaaggctctccatgatcatttgaattgaagaatctgcttccacgacgatcctttgcgacctgatgacgaaatagtacttatctggctcctccggaagcgaaattcctacaaattcacgcgggaactcagcttgattcgcctgatcttgcaacatgggtttgtaatagttgagagtggctttccatgttccctctttgacgccattgagactctctatgctttgtgttacttcgtttaggatttggctgctaaatgttgatccctgatttggttgccaatgcaaaagcctggaaaagtattcccccaaagaaatttgaaaaaaggttaacgtattataaaagaaattacaataatggttatttagtttatgtaatcatcaaacctaccatttgacgggcatggctaatggaggtacaacaaatttcacttgacaacaaaattaaaaaaaaatgatctctattaatttacaataatacacaaacaataatatcttatataatatagttgtattcagatatataatttaccaaaaaacaaaatgataaaactttacaataaagcaaaaaattatttaatcaaaaaatactttttgatagaatttcaatcagtgttcataaggaaaatacatttaaatgctcaaatggagttcatttttttaatcatttctttcatttgaaatagaacgtggtctatatggaaaggaaaatttatttttaaaagtaatttacagaccaaaaataatacatatgcatcaactttggaatcataatacaaatttcattttttaataaataattataacatagagaataattagatattttagtgcatgtgcacaattacataagtgtactcacccttatcaagataaaagggaagaaaatataaattcttataagaaaaaaataaagtaacttttgactttaaataaaaaggaaacaaatctaagaaattaatgttataattaaattatttaccaaaattaattgaaaaataagaaacatttttttacaaaaactaaagaaattcattagatctgctatgagtatccgtttgggatcacacgttctgtgatagtagtagatcgacaacagattaactaaacgaatcaaatatgaaatatatcacttcttgaatacaatctaaatataaaattcatacatctcggataaacaactcaattctgcttctaagtatatttagtttataaaacgatgctttttatctttatcttatctaaatcattttaaaaagatgagttgaaggcatagtaaagacttttaggcttaataatcatcgagccataaaaacaaaatacaagattagattgcgagaaacacttaccgatgaaagagatttctggtgatgatcttcttgggaatacgtagtataacgaaaaattaagactcgtacactgcattatatagagaaaagcataggagtttgtttgttttactaagataaaacgacctcgtttaaactacctcatttaaaacgacttcgtgtaaaattatgtgtttcttaaaatgaccttgtttttaaaaaggttttcttaggaaatgagtggtgaaaacatgaatgaatctaaccgaacttatccaaattcgaataatactaatagtttaaaatcttataaatagaattattggaactgaaccttaaatcaaatttaaattttatgaaactgaacaaaattaactgaacgaatcaaaattcctaatgtatatatctcatctaatcatctaaataaaaataaaggtttgattcatgtttcttctcatctttcgttcattttttatgcatagtcatgaaacattaaggtttcattccacccaatgatataatttttttttatcctagtacactcaaaaaatgaaaaatttatatagaaataaattggaaattgatacaattatataattgaatgatacgcttttgcttaatactagtcaagatgaaaaaataaaaataaaccaataaaaaaaattgagctgaaaatagaggaaaaataattacttagttgataattatttgtttgatataatgacattaaattgtaattttaggtaatcactttttgttgatatttaaaatacgtttttaaacaaaaacaaaaccgaaataaaaaaccaactcgaacaaaaaccgaattgtgtcaaaccgaacagagaaaaaaaaaagttttccacaagtaaaaccgacaaaataaaccaaaccggatcccaaaaaccataaccaaaaaattgcattaggagccaaatatttccgccacttaaaacatgccacgtaggcacgaatcgatcgatgcaataacttttgtaacggctacaaacttctgatttcatttttgaaattcttctcttccgtctcttttactaattcccctttcttcttcttcctattgaaaccctaaattctcttcttgaaatccaaatcttgtttcaagagtaaacc

SEQ ID NO: 6108 - DNA, 3000 bp, Unknown
  misc_feature (1)..( 3000): cDNA_ID_2138913_gDNA_ID_1620845_Annot_ID_170186 3000 nt of promoter + ATG
aaaaagaaattcacgaaagattttataaaattcatgaaggatttaagaaattcatgaagggtttcaagaaattcagaattaaacttttttttttttgtaacccttccttaatttcatgataatttttcatgaattttgtaaaatcttttctgaattttgtggaaactttcaaggaaatttaggaagacttctacaaaactaaggaagggtttcacgaaagatttttttttgtgaaatccttcttgaattttgtaaaatctttcttgaatttcgtgaaattttttccagttttcgtagaatccttcctaaattttcttatgtggaaaaaatttgacggaatgttttgacaaaaattgtttttggcgggaaagtttttacggaattttttttggcgggaaaatttgacaaaaaaaaattcacggaaaaatttgaaagatttttttttcacggaaaactttgactgataatttttttaattaggtgctattttaggaagaaaatgttttgagtgctatttgtagatattttcaaatgaggtgctatttttggaagaaaatgttttgagtgctatttgtagatattttcaaatgaggtgctatttttggaagaaattttgtgtgctaattgtgtcaatctttttttttttgttaaccgatattaattagagctcaacaaagtcaattcacgtaaaatgttgtttacatatgtgatatattgtggttcaatataattttttttgtgcaaaattatccgtatttatatttgcactatgaaatattaaaggtaaataaaaacttatgaattcttctttattaattccttcaaatatactgagaataataattcttgtaaactagagaaattttaacattaacctatttttctattttctttgggagtttcctattaaggtaactttaagaatagaaactagttatgtatttaaaacgatacaaactaggatatctaaattgtattaaaaagattgtacattcaaaatttgtatacgagatcttcaaattttgtatataaacatcgaattatataaaatatttttaataactaaaaaaaaatatttgtatctttggcggtcaactaaacctttttttatagcatatatatatgatatataaagtttctttatgatataattatctatctaacatttaagattgtattaaagtttcgaattttatgtctacgtaattttgtttcctttcattttatacacaatgttgtattgtttgtacatgaattcttttcaaaataattttttagatatcattcatataaaatagagctaatgagataataaattaccttgaaggcttgaacattgtcgagacaaaagttgaaaacagaaggacaaaagatcactgtcaaataattattaatacatcagaaaaataattaaaaacgataatattgttttcagtattcacctacacataatatgaatatcatgtttacatatttcgaccttttttgatcggttctaataatctatatctcaaaactaaccaatctcatctagattccgtcaaattaagtttagtctataattacgaaactaaaaaatattagcaaatgggaaagtgctagagtcattgcactagtttattatgtgaaacacgaagaaacacggtggcgcgtagaaatcacctagaaactacgaagaagacgtgaaccccacgtctctctttcttcttcttctttctctatctcttcccattacaaaactcaagaagatgttaaagtacgaaacatgtcatacttcaaaagaaacgaaggaacaattgtgtttgcgtttgcgagcatcgggttcatagcgttttatatcattaattactacattcggcgatgcagaaaccgtgccgcagcagccggggacattgaggaagctcgaatgagtccgaggaggccaccgcgaggacttgacgctgaagccatcaagtcgtttccttcattcgtttacacggaagctagaggaattgagccaggaataggcgagctagaatgtgttgtgtgtttgaatgaattcaaagacgatgaaacgctgcgtttggtaccaccttgtgtacatgtgtttcatgctgactgtgtagacatctggctttctcatagctccacatgtcctatctgtcgtgctaaagtagttccttaatacgagtctcttaattagccttttactatgcattttgcgttacatagttctccctttgtaaataaattatctttatagtgttgatattttaccaaccgtaatgatgatactactccatggaaggaaataatctacaaaggaattgaggcatattgaattattcaatgtcatgatgatgatgatgaattagactagaaaatgacaaaaacatagtttatctctttggttacttgttcatgtattacacactaaacacatctatttggctttggagagggaccacctatcatgctgtgtacaacaaatatgtatatatgtaagttacaagttaatgaaacgttcggatatatagttatataccatactttgaaggctttaattagttactcatatgatgtaaacatttgttatggtgcgaataatctagcaccaaatacataaaccttattggtccgtcacattccattgagaggacgtgaacatcagagggatgtgactgaccaataaggattaggtcaaaactgttggaaaagtcttgttgcgtagatcaacaagttaatagagagggcatgagtaatgtagtacttgttctacgtctatagtgacgtaaagacttcttcaaaagtcaaaacgttagaggaagaagccaaatcaatcattccgaccaaaactaatctaactaaacatagtagtaatacaatatgtattgtcgtgacgagtacaaaccaaaatgtgtttagtattataaaaacggcttgttcgtattctcttctctcgctcaacacatgaagctcaagtgatccaccgtggttagcaaaaggacggttcacatcatg

SEQ ID NO: 6109 - DNA, 3000 bp, Unknown
  misc_feature (1)..( 3000): cDNA_ID_2138897_gDNA_ID_1620845_Annot_ID_170182 3000 nt of promoter + ATG
gtaaatgggtgtttcgtctaaaatacaaatctgacggcacacttgaacgacacaaagcacgtttggttgttcttggtaacaatcaaaccgaaggtcttgattacacagaaacttttgctccggttgcgaaaatggtcacagtccgcgcttttcttcagcaagttgtttcacttgactgggaggttcatcaaatggatgttcacaacgcgtttctccatggtgatcttgacgaagaggtatacatgcaatttcctccgagatttcgtactggtgacaagacaaaagtatgtcgtttacgcaaatctttgtatggtctcaaacaagctcctcgttgttggttcgcaaagctcacatcggcattgaagaactacggttttattcaagatatttcagattactctttgtttatctttcacaaaaacggagttcgacttcatgttttagtatacgtggacgatttgatcatcacgggtactactattgctgtgattacagagtttaaacattacttaagctcttgtttctatatgaaggatcttggaattttgcggtacttcttgggaattgaggttgctcggagtcctgaaggtatctacttatgccaacgaaagtacgcacttgacattatcacagaaacgggtctccttggtgttaaaccggcttcttttccattggaacaaaatcataagcttgcttttgccactggtgaaacaatagacgacccacttcgataccgtcgtctagttgggcgcattatttatcttgcgactacgaggcctgaattatcatatgttattcatattctctcacagttcatgcataatcctaaaccggctcattgggaagctgctcttcgcgtcgtcagatatctaaagtctagtcctggtcaaggtattctcctacgtgctaatacacctttggttctctctgcctggtgcgattcagactttggagcatgtcctcattcagatcgatctctcaccggttggtttattcagttgggtggctctcctttatcttggaagacacagaaacaaaatgttatttcccgctcttctgccaaagctgaatacagggctatggcagaaacagtgagtgaaatcatatggatccgtgaattacttcccgctctcggtattccgtgtactgctcctaccacactccattcagatagtttatcagccataagtcttgctgctaatcctgtctatcatgctcgcactaaacatgtgcgtcgagacgtccatttcattcgcgatgagctcgtcaatggcactatcgctactaagcacgtctcaaccacttctcagctagcggacattctcactaaagccttaggacgaaaagagtttgcagactttcttgccaagcttggtatctgcaatctccatataccagcttgaggaggggtgttgggctgtgtggccttagcccatttatattgtataaattaactaggtctaaacttatcgtgtatataaaggcattgcctcttgccgtaatcaataagaatcttcttttcacaacctcgattgattcttgacaatatatataactaggaggaggcgtaaaaggagaaaacaggtaattttttgctcttgtacctttgatatttttactgaaagtgaagcttatggtgattacacttgtggtctacaggagcagaacattgagagtgggtcgagtattggaaacgcttcaagatgttcttggaaccatatgggacttcttgcattgtgatgcctaataaagaaccatatgatgatgttgttcgtattgttgggtttctcttttactttctgttgtctcttttgtagaataaataatgttttgggtaatgaatgatttaacttgcttgtgaccaaaaaaataaaataaaaatgttgttttgttacgagtcatttcgattgcagatacaatgtaacagtcttcacacattgaacaaaacaaaacctaagttaaacaaataactgtttctttaagtctttaaccatgaatctggcctttattagtaaatagtaatagtggttattgtaacatgagcaacatacgtcatactagccaaccaatgtctctcttcttaaactcatcgaactaaagagaggtcaaatcctcatacttactcggcctcgatgtgaattcacgttataataagaaacaaggaaaacacaaactaatcattttcttagtcctaggtgttcggttttaaaatttagtatcattcaagtattttgaaatcttcattttggtttggatccggttcttttgtttttaaaatttagtatcaatttggttatttttccttggatattttgattatttttgattattttcggatatttttttgttatttttgagtattttactttttctatttttattttaaaatttttgattttttgatcaataaataattaatattttgggtatttttggttaccaaaaatatttcagttcggtaccaattataatttttttttgttatataataatatagtatacatccaattatttttaaatttttgattttgttcgattctttttgcttcggttccaattcagtagcttcgattcagtttaattgcctagacctacattttctattagaactgacacaaaaacaaaattggcgtcgcttataaggtctacaatatatggttggcctctggcccaatagtaagcccatatattaaccgacgtcggtttatagccccgataaacacaaacaatatagataagatagtttcttctacttcaaaaaatggatgctttcagaaatttccagaaattacgggtccaattgagaaaaacgcgtatcgtcgtcttcttcatcaaaagcgaacaatttcgaaaacaaacctaacgaacaaaaatcaaatcttctctctgttaaaatctcaccgactagagaaaagctttgttttttccaattaaagttacattttttgtttgaacaaatcactttctgtgatctacatttgtgtggtcgtgaaatcaatg

SEQ ID NO: 6110 - DNA, 3000 bp, Unknown
  misc_feature (1)..( 3000): cDNA_ID_2138881_gDNA_ID_1620845_Annot_ID_170177 3000 nt of promoter + ATG
tcaatatgtatatgaattactatcttcacaattttttacaaaaagctaccactctctctatttttctgcaatcactcgttttatttgttttattttttcttacagtttctctttccatcctcttataattttgtctaaacaatatgtgccataccttctaaacttttcatatgctccatatttcttcttcgaaaatctcttacttttcttgttagtataagcattttttaagctcgtcaagatgtactctgttttgttttctgttattctaagaaaatgttttaccttctaaactggtacttaactctatcacttttctcttttgatgcagtttagatccttttcaccttcacgctttccagactgaaagacctcaatttatatcttcgagaatttgattcaaattgatacgattaaaaacaccactatcaaaccacgtcattgttacgtttctttaagttatattaaaaaatgttggattagttgtataaaattctagaaaaattctttctaatgcccttttcattatgcccctttttaactttaccctttttttagccattttcatttttaccctctttagccattatgaccattttacccctatttgaaaattgttttaggttaacaaaataaaatattaatatttttcgcctaaaatatccaaaataaatttcccgccaaaaaaattcgaaaaaaattaccgccaaaaagttttttgtcaaaactagttttctcgcaaaaaaaatattttttggcgggaaatagatttacaagggattttaaaagggtttaaaaagatttacaagaaattttaaaagagttttaaaagatttacaagggattttaaaagggttttaaaatatttacaaggattttaaaagagttttttaaaagatttacaagggattttaaagtgctttaaaagatttacaaagcttttttaaagatttttaaagggttaaaaattgttttaaaaaggttttaaaatatttacaagggattttaaaagagttttaaaagatttacaaggtattttaaaagggttttaaaatatttacaagggattttaaagggctttaaaagatttacaaaggttttttaaagatttttaaatggtttaaaagtgttttaaaagatttacaaggtattttaaaaggatttcaaaagatttacaagagatttttaaagatgtacaagtgtttttaaaagatatttaaagaatttacaagaagaccctttaaaaactcttgtaaatattttaaaatcttttaaaatctcttataaatctcttaaaatacttttaaaatctcttgtaaattttttaaaacccttttaaaatcccttgtaaatattttaaaacccttttaaaatctcttgaaaatatattttttcccaaaacaattttacaaggatttgcataatcatttttttggcgggatttttctttttggtgggaaaaaagtttgccagaaaatttttttggcgagaaaaataaatttttggtgcaaaaatttggtgggaaaatttcagtttctaattacatgttcctattagatgaggataatttggtcattctgttcaagggaaatggtatttttaaaaaaggacaacataaaaagatattgttgcaaaagggtagtaaaaaaagagtagttttgcaaatctcccaaaattctgtaagggtttaggtttaatattatttaattataattatattgcttccttttttataagtttaaatttaatatttgttattttcgttttttattttaaattttaaaatggaaagtaattattatttttaaaaatgttaattaattagatgttaaatatgttaattattgatgtgacagcttccgattagttgttttaaaaaatgttaaataattaaatgctaaatatgttaattattgatgtggcagctttcgattggtcgttctaaatcctatgtggacggctttagaagcaaatagcctcaacttttatatagtatagattttcagtttttggtgttcaatttttcgatcaccggttttgatgagattgaaaaactctgtgggaattttttatggccgggcaacccgaacaccacacgagttgtaaaagtgctttcaaattattttatttattttataaacatttaaatcttaaaaataatatatgagaattaaaattaataaataaaattttaaccataaattaaaaacgaaagtaacaaaaaaaatttaaaaaatgaagtaatttttttttaagattgtaatattttttttaataggatggttttttattctttactttttttcaccagcgaccattttattaagttaggagaactaatccggagtcgatgtacttacatgaaaaagaaaaaaaacttcgtgttcttatattttttgttaggcaatcaacacagacattgttacaacagagaataactctaatataaaataaagacaaaaaatttcaaaagcttttttaaaatattgtaattcttcaaaagcttttaaaatgttgtaattctacaaagcagctcaactaaataaaagttgcattttgcagacatacgaagtcgctaatttttcacatatcggaattggaccgagaaggtggaaactacgcgcctccatcgagagtggtgtaaaccataatctattacataaaaaaaaagataacaaaagagacgttaaagcaatgtttctctgttacgcgctgacgcatctctaacctttttaggttctgtactatctttatcttttagtcaagtgttagaaaagtatcttaatcagacggttagggttctttattattactagccgcaatttttttattgaaacaaataaataaaaaaataacccaagaacaacaacaatctggtctgctgatgtattaattaaagaaaaaaataaaacagagcaagaaacaaaaaaaaaaatgtaaagaaagagaaaaaaagctttcgtagtgtctattgaaaccagagaaaagccaaaggggatg

SEQ ID NO: 6111 - DNA, 3000 bp, Unknown
  misc_feature (1)..( 3000): cDNA_ID_1830057_gDNA_ID_1620846_Annot_ID_50933 3000 nt of promoter + ATG
tcgaaccttgccttgtttactccttcttcacttgctagtaaagcacttgtgttcgcctttatccatctcaatggaaaactcttctgcatcatcttcatatccagtatccttcttccttgaggatcgttgatgagacatctgttgtcttcaaataagactctgtatcccttggataccatttgagaaacagtcaacagatttcttgctaaacccggcactagaaacacctctttgatgatcttctctcattggcttgtcatcacttggatatttccttttcctgccgtcattacatgttgaccattccccactttgatcggtacctttacactttgatcaagagtgatgaagtatttaacttccttggtcatatggttagtgcatccgctgtcaactagccatgtctcatcattcacgtttgatgatgtttcttcttcgactgcactgaacagcatgtgatcctcatcatcatttgtttcttctagacttagatccactcgctcggtccttctaagtctgcagttctttgctagatgtcccggtttgttacacacgaaacatcttctctcattgttccccacttgttgcgaaagaacacctttgttcttcttcatccagcaatcactctcattgtgatttttacgttcgcaaacgtcacaccatttcccagcctgcgtttgacgcttgtcttcacgtttgttttctccatagaacgctccttccgttgatcattcgtctcgcatctctacccgcttctcgtgtgctttcaatgtgcctatcaactatgttacggacaacgaagtcagatccttcgtttgcttcatcatagccactatgatgtcaaatcttttcggaagagaaattaggattttttgcactatttgatagtctgatttctcttctccatgaactctcagttgatttcccatctcaatcaacttggtcatgaaagtgttgatattgtcactttctttcatcttcaaattctcatactcccttctaagagattgaagctttatcatcctgacttgtggtgatccttgaaattccaataccaaggctttccaagtgcgcttgatgcaggggcgattctcggaaatatggaatctgagacggcagtttgaagaatttgcaaagcggttagatcctttaaggatgctgcttcacatcgtgtcttttgttgcactgcttcagggctatgatctccttctgcgggtggttttggaactccttcgtcaacaatttcccacagtttctttgtctggaaaattgttttcatcttgatgcgccaaaaaccataattctctttgttgaagattggagtcacaatgtgtgacaccatctccataactctctcgtgtttattaaactctttacttgaaatgtttggcccttgaatcagtagggctctgataccatgttggaaattgaagcctcttgttacaaagaaaaaacaagtgtttacttgttgttctgtttcttatgagatacacaaagcaaaagagaaactgacttttattgaatggagaacttgttcgtttcatcacgatacaaaaagtttaaatagaaaacaaatagacacaataagtaaagagttgtgtctctttctctctaagataaacgacacaacctaatctaaaagtcacgactctaacaaacaccttttaatacaacataattataacttatagaccaaactcaattataaactaacagatttgatgcagcttcctaatttccaacagctccatgatgtttatcagctcgttgttgtcagaatctgcatcttcataaatttataataaatataaatatataatgtataactgtatgtagaaccgtatattgtggatccgtgaattggtggaagagttgctattgcggaatcgtccaagaagctattcataaaatcaatcacgaaagaaaaagaatttgttttgctattatctctatattgtgggtagccatttttggaatctttgaaaaatcaaccaatacgcattttctctcagtttggaagttaacaaagacgcgttttttcaaggttttgtggggactggggaccaaaagttcttaatatgggttaacgtctcacaggtaataccaaacatttcatttatttgtgtttttctatcactatcttttccacattttagtattttactattacatataatttttgactaagaagttgattgtgaatgagtctgtacatcttcctagaaatgattataagtatattatttaatttgttactccctctattgtcatttatttgtagtttaagtttcaaggttttggcacaaatgaaattatttcgttttttattattatcttttaatatagttaattatctatttaaaaacaattcaacaaattgaaaaaaaagttttgtagaatttctaagagtcaaaaataataaaatttccattaaaaattgaaaacaacaaataaaatgaaactatttgtttttgcttaaacaacacttcttaaaaaacagaggaaccattgtaaaatagatttttcccaacacaaatcgaaaacgtaacttatataatctctatatttttagtaattcagcgacttatcatttcattgttaactatttttcactgacatgtttctcgttatataaaagtctctgtttatgtcaatggtcgtatgtgaatggttcatgtattatgcaaaactgtttatgataatattgccggggaaaaaaaactgccatgtttcatttttttactagttattacatttgattattatcaaccaacttaccattgaaagataacttgtgattattatttacagtaacgaagaaaattaggccatattttgttttctttttggaacctttcaaatgtcaaagctggtaggctatataaatataaacaaagctcaaaaatttattactatacttaacagtaacgaagtagactacttcaagtagtacatcaaaaaaaaaaaaaccaaagaagttgttatctttaacaaacaaaa

SEQ ID NO: 6112 - DNA, 3000 bp, Unknown
  misc_feature (1)..( 3000): cDNA_ID_1830049_gDNA_ID_1620846_Annot_ID_50935 3000 nt of promoter + ATG
aacaaagaacaatccaaaactaatttatggcataaagccttaatgcttattattatcattttgaaccaaatgatataaataacttaaaaacatcccaaacaaatatgaattatatatgtcattatattaatataaattagttgtagacgatagaaataatatattcttattagattaaaaaattctgaaatttagtttttataaatgattatgctatataagtagttttcatttattttttttctgatttctcaagtaattactcgatacaagttagtataaacgcagtcgatccagaaggaccaaagatactctaaggatttccaagactcatttttagctagcgcgaaaaggttgtttgtttggattttcagattgtaaataaaaattgcaaataatttaaagatcaacttatgaattaaagacattgtgctatagggtatttcagatatcaatgaataatgaaaacattagacaaggaattcaaccatgaagcatcgggcttgaacatgaacacaaatttagactaagtctctcttaagacattaatcattatatttaactatgcaactactaaactcttgtttttaattttctagtcaaatccgtattagaattaggttcattcggttcacaatgcattctaacataaactctcattggttagaaatacattgctcaatttacatttgttcagacagtctatcaaacatttttgatgcatagaaaaatctagaatctaaaacagagtgttcgatctttttctagcattaagaacaagtgaatcaaagaacttaaggattaaaaactcaagaaaacaatcaaaccatcaattcattgaatctcctacttagaaccctaaaacccaactaaaggactatttactcatagcaaaaggaataacacaaagagatgaagaagacataatagattactaaacaataaaagaaaagggattagaaatattttccaaagtatcaaagaggatgaatctctagaatcccaataggggaataaaaaattaggtctcaaaaaccctgctctataaaatgaaaaataaaactgcttaaggaagaccgaaactgggcatcaggtagttgcctgatgagatttgcgtgatgtcattccccaaaagatttttaggcaagaaaacgaaactgggcacaagtagttgcatgataaaatttgcatgatgtcattttccaacagagttgtcttgaatcaccaatttttcatttcttctccgaactcttggttttgatacaaaaacgcctccaactccatcattgcttcctaaaacctgtaaagactcaatcaaggactggaagactctaaaaacatactttgactctataaaataatgatttaagaaagaaaacaaagactcaaaaccgataaaaataaaacatatcattttcatcgaaattataagtagttttcatatacagggaaatctttaaaaattaatacttcaatttatagtgattattgatttaaaaaataatacttcaattaatttatagagacggaggttattttaattacttcataaattaataatcactatacaataatacttcataatttataggattttcaaaaatattattatcttatcttctcattgaattatgttaaacattgcaatcttttgctaacatttatgcatcccatgaagggtggcatacattttagcaaaagattgcaatgtgaaggtagttggcatacattttagcaagagattgtaatgtgaaggtagtttgagctcaagtatatatatgtcatgtcattcatgtcttcactagattggactttaatggactcgtttcttaacagaaaaagtagacatacgatgtgtctgcgttacaaacatgtccatgaagacagttttctgatgatgtagacccacaagagcaacattccttataagcccgtgatcgggcatgaaaactgaccccaacttcaaacctaatatctctaacaggtttgattattggttgctcaagaggctgctcatcttcaaccataaaaaggtatcaacatactcaccataaacctcttctagagtagggtaatacttcttatcattaggaagaacaatttggttctcaatctcaacataacatcattgattgtaataatccaaccatccatgtttgccatgtttattatcttcttcatcctctctctctctctctctctctctctctctctctctctctctctctctctctctctctctctctctctctctctctctctctctctctctctctctctctctctctctctctcaagtccgatatagttaccaaacaagctatagtcctctttatgtaaaccatgccgttgaatagctttatctgaaacatcactacaagaatattgggttttaatagcactataatatagcgtttatgtcagtaatgctattgttatgtaaccactttattttaaatagcgtttatgtataatgaaacgctatgatataataaactataagtcacgtgtttattaatcaggttttcaatagcagattttaataaaaacgctatgttaaagttaggcggtaacctaaaaaattagatcccgtacttagaaaaatttcattctctttggcatcgaaaaatccccaaaatttgcagacctaattttcttccctctctatcaatttctctcgatttgtttccctctctatcaattttgctcgatttctctcgatttcttccctctcagtattctcttccaaccaaatctagctcgctcagtcacattaatctcatctccggtttgatttaggaagacgagaagacaatatctagctctctcagtctcatctccggttcaatctcagtcttgttcttcacgttcttcatctccggctcgatttaggtatttcactcttatcctctgttgttatcagatctcctactctattcttgtacatgtttaactggaattctctttgataattgtatacaccgtcggagtgtttgtacc

SEQ ID NO: 6113 - DNA, 3000 bp, Unknown
  misc_feature (1)..( 3000): cDNA_ID_2997065_gDNA_ID_1620846_Annot_ID_50937 3000 nt of promoter + ATG
atcatccaaaagtcgcgtcggaaaaaagtgccgtgtctatgtttgtttttcttttgttatttgttggtttttttttggtgtggtttctatagacttttcttttaaaaaagattacagtccaataagaaattgaaatagtaattgggctaacgtgggttagccagagttacagaaagagagaattttcggtgaagctaatcggagtataaaaggaaaaactgtcaagcttttatgcaattttctttcatcgacctattgagttgccggtgattgcaataacaacgaaatttcagagttgtgcttaggactgcctagtcctgaaattttggaaaccaaagttacaaaaaacgtttttgaggttatttcctaagatttagaaaacatgggttctttatattataaaattaaataatttgggcctattttatactgtaaaattttaaaaacaaatcagaggcccaaagtcaatgtttcacgaggctctgtttaggaccggccatgtccgttttgttgatggatactaaattactaatgacctaacgggtttatttagaccgaaatagttttattagctaaaaccagttttcaaatggtttgtgaattgcagcatgcaatgtgtgagcatgatttcccaattgttctatcagtgtcaaagtgatatgggccaatccgaacgttttatccaaatggatcaaaagttttgattttataagattgatgagttaaattagaaattttgaatcataatggactaattatcaagaaaatgacactggtaatacatttcttaacacataatttttcctatttttataaacggaatctgaccataagtataaagattgatagaagttttttataaactattgtgtatatcacatttgtttaggaaatatgttagtaagaccttggtccaattggttcacctgatagtcaaaaatgtgtggtggtccttcaggaagaagtccaatctgaaacattttgggccgtttctagaagaactgattggatcagctgatagaattttattaaacaaaaaaagactatttgtatattgatttcatttttagttcccgagaagagtagaacaaatgctaaaatgtatcatgcggcccaataaccaacaaaactagttgaaagatggatcaatggtttttacatgaagaaagcccaaaccatacactaataatctaatattctattaaaaggacttgctgttattcggcccaatagccaacaaaactaattgaaagatggatcaggggctatggaatacctcagaataaaaagtgttattcattgcagaggaccccttaagcggacatggttgggtccttgttcgacaagacttagtcctccatcttggcctcaagagtgctcgacgaagtttatcaccgcttcatgcggaattttattccttgctatgggcaatagaatgcatgatctctattagcgatacttctggcgcttttgcttccgactgttcagacctgatttctatcattaacaatcaagaagattggccgacattcgcagcggaattgacatcctatcgctccttagtttatttttctccttcttttcgtattagatttcttcctcgtagttctaatactcgagcagattgtttagctaagaaaactcgggctcgtaatagccttttctcccatgtaagcacatcggttcctgaatgattctttctagcggagagtctctttccgataacttaatataaatggtgtttgatgaaaaaaacaaattatcgtaatgatcctaaaaaggagttagaaaatattaatatcttatctacatctagatgataattgtttttatgatccttattagatagtgtttaaatttaattatccactaatttaagcataaactatatattctatcaccgtttaaccaatccatataaatctcttttaaagcttctagaaatgagtctcacacatcagaaattagctattttcttattttattacaagaagagaaaaaaacaaacaaacaaacatgtgttactctcattttgccacatgcattataacgtataggtaggtgaatcacctaacttgtttcagcttatgtaattaactttaccaatatattaatttattgttgataagtatattttaaattaagatatgggaccagaaaaataacaaaagtttctattaaaaaatgcttgcatttaaaagagaagaatgtataaaatctttatcaaaaaaaagagtatatcatagattcataataataaaaaaaatttgataaatgactttttatttaaaaacttaagatattacaagctattactctctttgtttatttttaattgattttctaacaaaacacacatattaagaaaacatattaaaactgattataaatgtatcgatttttgtgatttatatttttctataattctaaatcaatgatatttaattatttgtgttgaactttaaaatttatcattaataactaataattagtgcatagaaaatctaaaaatcaatctttttgaaacaattttttttctaaaaaatcaattaaaaagaacagagagaatattgttttaataataaatgttttattggtaatccaatattaaaataattatatggattaaatttaattataaattttaaaaaatttgaacaaaaaattatttagtgaattgattccaacatgtggaaaaaaggaaacagataattaaaaaaattgattggttctgccaaaattgactaccttcaaatcagagatgattttaaaaataaattcatccaattaaacttgccacatcatcaacttggaccagaatattcgcagtcaccaaaaacaaaccaatgtgtccaggttcaatgaatctggaatcacctggttcttcgtatttttgttatataatgccacgcttctcacaaatcatcttgaattgaaaataaaaaacgaagaatcaaaacaaatcttagagaaaacaaaaatccaatttttgctgtgaag

SEQ ID NO: 6114 - DNA, 3000 bp, Unknown
  misc_feature (1)..( 3000): cDNA_ID_1381119_gDNA_ID_1620846_Annot_ID_50938 3000 nt of promoter + ATG
ttttgtttcggtttcagttcggtacattcggttcggtttatttacccagacttgtatatgacttttctatttcttttatcttattttgtgtatatatatatatatatattctcacttaactcaaaaacaacaacatcaacaacaaaactctttaaaaagcaagaaaactttcactagtagttgaagaatttctctcttcctctacttattattattatcaactggtgatttgatttctctctctctctctcacaatggattcattaggatcaagaagaaggacacataatagccgtagggttccttcaatgggaatagaaggggacgaagagtttcaagaagaagatgtgtggtcagttttacgagaaggagaaacttcaagtcctgaaatgaaaatacccaaaagtcatttctcttcctcatcatcttcttcctcttcaccatggaacattcgtagaagcaaggaggtctcaggagtgaaacaatcatcagcacctatgaatgtccctgattggtccaaggtttatggtgactcaaagagcaacagaaggagtagccatttgcattctcatgctgctgacgatgatgatgaagatgatgatggttgcatggttcctccacatgaatgggttgcaagaaagctagcaagaacacagatctcttctttctctatgtgtgaaggagttggaagaacacttaaaggaagagatctaagcaaagtgagaaatgctgtcttgtcaaaaactggtttcttggagtaagtaggataaaatatctcatcatcatcatcaccataattatcatccatgtgcatggaatatgaatcccataactcttgtttaacattatcatcatgaaaaactcaactttatggtatccacatcatcatcattatcaatgtcattgtcgtcatcatcatgtggggatcactataccaagagtctttttgttaagttttttttttctttattgttgttattatttttcaatgtgttatttagagtagataagtatcatagtgatgatgatgacttgtcagccccatgcatgggtcccgttttatgttcttctgttgtttttggtttctctttgaaggtttttttatgatcttaaattagagcctagagaggggcatctcctttagaacctttaattggagttgagttctttaccatgttttggtgaaagattttgtcgtttgctatcgacaatgttatatataaattagatatctttctttctttgttaatattagctatgtccatctttggctaattatgtatttggcaaatctgctactaaatatcattaatttagccgatttcatgcaaaaataaataagccctaaaatgctgagtttccaattctgaagacattttcaaccatatcaatcgatcaatgtcatatattcacatatcgaaggtgtacatataaaggattgaatccatgattttcctttgaactcttttatgaatagttttgaatgtttttttgtttgattatagttataagatatttaatagcggtgagtgaacgagaccaaaaaaaaggtgattaaatgtaataaactttaaaactatgggatatcgagaagaaaataatgtaacgagaaaacatcacattagacttcaataatgcttttaaatatagaaaaaggattgatagtagaagcaaagatttttatattggtatgattagtagtaaaacaacacggtaaaaaaaaaacagtaggcgaaccaaatagttagattttgattggtaatctcgtatggttgcagtattttaccgttctaaacttctaattattactagtgacgaaaacgttgaaaaacgagatttttaaaaaaaagttgtaactattttttttaacaaaaaaaagttgtaactattttggtattgtttattgttttttttatatacctaaaacctctaaccttgttttttaccagtcttacttttgacataaataaaaatagtggttagaaatagttttcagttctgctgctttcttaccctttttatgtctttatgattggtaatttggtatcaatcggaacaaactaaaattgttaattgtagtccttagtcctaatagttcggttatccattcggtttcagtttgtatctattcggtttcaactttttcggttctaaagtttagtattcatttggttattttgaaagtttgattcgtatcggttttttcagttttaaaatttaatatccattctattattttgctttgaatatttttggatatttcggttattttggatattttcgatcatttttgaatattttcggttattttttcgagtatttttactattttatatatcttttcaattatttttaattatgtagtctaaaaataaataatatttagtatccatttagttttggttctttcggttctttcatttatagaatttagtatccattcgaatattttccaatttttggtttgctttgatttaattagttttgctttgattttgattcggtatattcgagttggtttatttgtccacgcctagtagtcctgatcatgtaaatgacagaaaagcccaaacgagatccaaacctataaaggcccaataaatagttcacaaactcatgaccactacaatccaacgacgtcgtatcatctcgctgacgtaagataagcatcgtaactaattaaaatccaagtaataagtttgggtgccgtgcaggtaacaatcactaaaccctaaatccatcctctctgtttcctttatatatattctctccttttttcatttttttgatcctcttcttcttctacaatcaaaattcatttttttttcctctgatcatcatcgaaccctagtttcgtcttttgggtacgtttgatttcgcctctccactttgtcaatttcgagtttttgtggtttgggtttttttcccgatttagcctaacagataaagtttcgagttttgtttctcttaatcatcgtagatactaaccgaatcatcatg

SEQ ID NO: 6115 - DNA, 3000 bp, Unknown; identical to SEQ ID NO: 6114
  misc_feature (1)..( 3000): cDNA_ID_1381119_gDNA_ID_1620846_Annot_ID_170222 3000 nt of promoter + ATG

SEQ ID NO: 6116 - DNA, 3000 bp, Unknown; identical to SEQ ID NO: 6113
  misc_feature (1)..( 3000): cDNA_ID_2997065_gDNA_ID_1620846_Annot_ID_170220 3000 nt of promoter + ATG

SEQ ID NO: 6117 - DNA, 3000 bp, Unknown
  misc_feature (1)..( 3000): cDNA_ID_3079590_gDNA_ID_1620846_Annot_ID_170215 3000 nt of promoter + ATG
attaaaccattacattttttgaaaagctatattaaaaataaccataacaatataaaaatgttgttaatagtctaattataacaatatgattacgctattaaataatatttaaaccgacgaaatcgctattgtatattgtaatataatagcagacattataaacgctatctaaagtgtctgacctacgatgacgagcacagaaatagcgcttaacgaaacgctattaaatagttagatagcgttattcggatgctaccaaaagccaatattcttgtagtgcatgttggcccctaaagctatttgacaagtttaaagaaggagataattgtttagggtttcttatcttgtggttttactatttgtcttttatatttataaataaacttggagggcttcaaccatctaagctgctccttaactccattttgtggtcagtaaactatctattatatgtttttcttttgacgaatttctttgcaaaaccaaatcttggattaaaacatgagcaattttgagaaaatatgggcataaactttctcaaatattaaaagaggagacaatgaatcgcattggaagtaagaacttggccccttgaagaaacgacatacattaacaacacaacagccagaagatcaaaacctggaacaaaatcatgaacaaaaagtccaagatggaatttttgcgtagtaatcatcaaagtgtctaagagaacaccatgcaaagctagaatcgaccgaaaacttaagctaattttgactagatcaaaatcctaggctagaaccatccagaaaccctaggttatcatacaaagatgataatatagattggtttgttgtgtgttcaagtgtatcatacaaagatgccaaccatgagctttgtaatagtttggcttggcaatgagacaaccaccaatctttttctcctgctttcattaggagtctgagaatggtacctaacatacaaattggctatgagttcagttagatgataagtttttttttttgtgcactcagttagctaattcaaatgttatttttaaggtataattgttgtatgtgtcatctaaaataaacttcaaatgttgcacaaagtaatatgatttaaattttaaaataaccaaaatttcttataaaccaagataaagaggataagaaatcttttctgcccaatcagattcttgattttgatttaggttacttgattcctatcttactctgacataaatataaggaagttttttttcttttttgttaaaaagtgtaaagtaagaaattttctaagcattttcacattaattcccaaaaagaaatatatctgtgtaccttatatagttcttttgttgatacctaatatagttcttcctaatttgttttttatatttcttctaaatatatacctaagcaaccaaatatttttaaatttgatttcaattttggcataccaaacaaagtgtgttctactacatataaaaacctctttaggagatgtatttttcctgatctcatttatttgattcttatatatcttactctaaacagaaatataaacaagtatgttttctttttgttaaaaaaatactataaatgtataaggagattttctgagtattttcacattaattaccaaagagaaatatatcacataactaatatagttcttcctaatatatttcttcttaatatatacctaaataaccgaatattttcaaagttgacttcaattcttttcatccaaacaaagcatgttctactaaatctaaataccattttaggtgacttattttgtgcttcaaaagaagcttgttttttattgtttgttccattttgctaccagtatatacttttaatagaattgccaatacccacaaaactttacttacaccattcaaaagctatgttgtttttgagactttctattcataaaaatattgagaacttaaaaacttatttaaatggtatttatcttatggaatataaatattttataaaagtaatctttcacccatatatataatggatggaaaatcacatagtaacatcttataaacgcactaccataatatattgttaggtttttattttttattagcccatcatatatatgggataagcaatacataaaatagagagcaagctaaaaaattagaaaccaagtcctcttcgtaattgtgaccaagagtgagttcaagggataattcttcttcaccagttgtaccaccaccaacaacaacgacatcatgtctctattttcatttagtcccacttgccataaaatatacatctatttcgttcacgttaatgatcacatagtaacatcttataaacatttactagcataatcataatgtaagagatgcaaaggaaaataatacccttgacgattgatagagagacatgcaaagatactttcataggtttgttacttgattccaaaattggggttactttcttagtaatattgttcaggttcttaattttgattcaactttaagtgaccggtttaggtgctgtggttaagtggaattgagtaccggttagatggagccaattgaaacggattggagaaacaaatggaaaccttcttttcacgagagagggtcttctgttatgtttgggacttagtataaaagccctgtaatctcttcttcttcattatccgttttcatacttgtaaaaaaaaaaaaaaaactttgagctctgagactccattgttgagctctgctcttgctctgtaattctcgttctgatttagtgaattgccgaactgatttggccccagacgtagacttgatcatatcgatcttgttgaactgggtaaacaaactcttgtgttgttttctttcgttctctgtttcgatctctttcttgagctgatttgagtttcgattgttgagtgattgagagtttgtgaggatctttgtattgtgaatcgagcataaaacgtaacagattggtatcagagcccaggcttttgggtggttcattcacatcgcatcgatcg

SEQ ID NO: 6118 - DNA, 3000 bp, Unknown
  misc_feature (1)..( 3000): cDNA_ID_2139551_gDNA_ID_1620846_Annot_ID_170213 3000 nt of promoter + ATG
tcatctcccgcatcatttttatttctgtcaaaggattggaggtgcataattatgaataaacggatataaacttcactatgcattatgttgaaaatctaaatattccttatgcaaagttacacgacaaacatatttattaaaatttaatttaaaatgtaagatagttattttacctttactagattcttctttctttttgttcctatacatctattgaaagtaaaaaaataaaaaataattcagtacttgccatcttagatagtatatgttttgtagataagttttatacactatataattataaagacctggagatgacttttgacatgtgatattgtgaggtctctcacacccataagactcaaaattctcttaggagttgcacctgcaaatttaaggagaacaataatatcgactatagtgaattaatctaaaaaaggatataaagagaacattaatcatggaaaggtcttaaaaggaaaaaaaagattgttgatttcaatgacaatttttttttctttgaatttatttcagaagaatcgtcttgttatagttttgcgatatggaaagaaaaccgcttactctcttcgccaccgagtttttcaataacttgaataaaacggatatcaagatcgtcggtccagtgcattcgcggattgtctgacctaatgtaagatctaaccatcggatcttgcattttttttatctctcgtaaaatttttagtttgataatattgagagtgtgcaccaattatttatagaaaaattatatggaaaagaatattaatatttatttcccaaaaataacctaagaaacaaatatttagagctagtaaatgttattgttgtcacgtgtaatttatcatttaaatatttctgtaaaaaggatatataaaatcgcattttaagaaatatttattttcttgacagctccatgtgttcttttctctaataataatatttataataaattttaaaataaaaagttaatactactagatttgtttcaattttattctaagaataattctatctatgcttgatatttatataaataaacaaagaacaatccaaaactaatttatggcataaagccttaatgcttattattatcattttgaaccaaatgatataaataacttaaaaacatcccaaacaaatatgaattatatatgtcattatattaatataaattagttgtagacgatagaaataatatattcttattagattaaaaaattctgaaatttagtttttataaatgattatgctatataagtagttttcatttattttttttctgatttctcaagtaattactcgatacaagttagtataaacgcagtcgatccagaaggaccaaagatactctaaggatttccaagactcatttttagctagcgcgaaaaggttgtttgtttggattttcagattgtaaataaaaattgcaaataatttaaagatcaacttatgaattaaagacattgtgctatagggtatttcagatatcaatgaataatgaaaacattagacaaggaattcaaccatgaagcatcgggcttgaacatgaacacaaatttagactaagtctctcttaagacattaatcattatatttaactatgcaactactaaactcttgtttttaattttctagtcaaatccgtattagaattaggttcattcggttcacaatgcattctaacataaactctcattggttagaaatacattgctcaatttacatttgttcagacagtctatcaaacatttttgatgcatagaaaaatctagaatctaaaacagagtgttcgatctttttctagcattaagaacaagtgaatcaaagaacttaaggattaaaaactcaagaaaacaatcaaaccatcaattcattgaatctcctacttagaaccctaaaacccaactaaaggactatttactcatagcaaaaggaataacacaaagagatgaagaagacataatagattactaaacaataaaagaaaagggattagaaatattttccaaagtatcaaagaggatgaatctctagaatcccaataggggaataaaaaattaggtctcaaaaaccctgctctataaaatgaaaaataaaactgcttaaggaagaccgaaactgggcatcaggtagttgcctgatgagatttgcgtgatgtcattccccaaaagatttttaggcaagaaaacgaaactgggcacaagtagttgcatgataaaatttgcatgatgtcattttccaacagagttgtcttgaatcaccaatttttcatttcttctccgaactcttggttttgatacaaaaacgcctccaactccatcattgcttcctaaaacctgtaaagactcaatcaaggactggaagactctaaaaacatactttgactctataaaataatgatttaagaaagaaaacaaagactcaaaaccgataaaaataaaacatatcattttcatcgaaattataagtagttttcatatacagggaaatctttaaaaattaatacttcaatttatagtgattattgatttaaaaaataatacttcaattaatttatagagacggaggttattttaattacttcataaattaataatcactatacaataatacttcataatttataggattttcaaaaatattattatcttatcttctcattgaattatgttaaacattgcaatcttttgctaacatttatgcatcccatgaagggtggcatacattttagcaaaagattgcaatgtgaaggtagttggcatacattttagcaagagattgtaatgtgaaggtagtttgagctcaagtatatatatgtcatgtcattcatgtcttcactagattggactttaatggactcgtttcttaacagaaaaagtagacatacgatgtgtctgcgttacaaacatgtccatgaagacagttttctgatgatgtagacccacaagagcaacattccttataagcccgtgatcgggc

SEQ ID NO: 6119 - DNA, 3000 bp, Unknown; identical to SEQ ID NO: 6111
  misc_feature (1)..( 3000): cDNA_ID_1830057_gDNA_ID_1620846_Annot_ID_170211 3000 nt of promoter + ATG

SEQ ID NO: 6120 - DNA, 3000 bp, Unknown
  misc_feature (1)..( 3000): cDNA_ID_3079603_gDNA_ID_1620846_Annot_ID_170201 3000 nt of promoter + ATG
tttatagaacgaaagataggaaatgatgactatttctttttttcgacccaaaaatcggacctgaaaccaaagccaaaaatttagatttatcctattgggtcctaaactcctcgacccaaacaaccaaacaagaacccgacacgaacccaaatatacccggatatttgattagaatatccaaatttaccgaaaacccaaaatcttacctaaaacacgagtatttaatataaaatttgggtattggtctttaaaattggccctctctaaccaaaagatccttacttgattgggttttagccgaacccgatccgcgtacccggatgtctacacctagttttaaagttttggtgcaaaatacataagaccttgaatataaggttttggcgggaaaaatgtatgcataaaatgtctttcaaaattatgatttcacggattttgtagaacggtaaacagtattctactatttttggtgagaatatggtattgtactattttttcatctatcaaaatagagagagagagagagagagagagagagagagagagagagagagagagagagagagagagagagagagagagagagagagagagagagagagagaatctaaatttgtgttcatgtttgagaacagttcttaatttctgaattacctgttacatctattcttctagattgattattaaaatattctatagctcaatgtctttaattcataagtttaattgtcaatttatttgcatttttatttacaactctgaaaacaaaacaaacaacttttttttttgttttagctaagaacaagtcctaaaactctttagaatattaaccatgtatatttaccttgcgcttgtatcgaggaattactcgagcaatcaaactacatagttataccatcaaatgtagtttaatagtttagtgattttgatgggaaatagataatttgttgtttcactgttttggtgaaagaatattattttaaaatatgataatatatataaagtaaaactatcttggttatcgttgtgatttctagatggaaattgtgttgtatataaactctcctttaagttaaaaatttaaaactcatccaagattttttgttcttaagttacattttccaaatgcatcaagttattaagtccaactcatataattaaatgttatttaacgaataatgtcttgtatatgcatctagatgcacaaacgaaccacttctaattttctttgatgctcttacatttttttcaaatgaatttttctcaaacctcagcatctttcttttgttaaaaataaaattttaatatatgagtcaaactatatgtgtcaatttgatctaatctaattcatcaaccctaataattttactatttggatcataatgagttgatgggtcagtgagttagtggatcgtttggagtaagttgtaatggtttatggttcaccatattaaaccataaattatcatacttaacatcatcattagctttattaatatcatcatgatcaccatataatcatcatcacctttatcatcaatttcttcaatataatcacaatatcataattttccaaccaaaaaatgagattctgtaattcttttgctaaagacactatttcacaatttctcagatagtaaaattgaacaattttctgccaaaaatagatggttttcacaagttttccaccgcaatacgatatcacactttttccgctaaaatattaatctatattttcagtcattgatggtgaataagggattcatacctcatggatcaacctaacttatcacattaatgattttattattttgttctaaatgagttgattggtcaaagaaattataagtagatgagttgatcagtaatcaggatcgcccctgatctaaagcaagtaaagctagggctttaggtgctaataatatatcatcatttataggacatcaaatacgggaaaattatatgtagcacagtgacaaagttaagttttaaggttaacatgaagtcttgagtttgagccaatattttgtggtttttgaatatttttatatttaagtgttatgggttttaaaaaaaaaactcatgctttaggtagctatgcactttgggcctgccttgtcaataatatgtaatggtttatagttagacaaaaactttcataagattataatttttcacatcataattatcttcatactatcatatcatcatattattaacgccaccgtcatcatcatcatcatcataccatattttccccacaaaaacaaccttcataaattttacgaaaaacaaggttccacaatctttagccttacctttaccaataatatgattaactatttggacacatctacttgcagtactctatacaaatatgatgaacattttccacaaacaacgattctacaatgtaactccatttctataagaaaaatgatttcatctcccatttatattttatatcacctacaactcatttgtattcatagctttttttaagaaaatctaattttaattcaaaataaatataattcaaagttctttttggatgattataaatttatttataacctttggttaaaaataataataattaataacaaggctattattagagaaaatatgtttgtttttttgagttttactttatttttacaaatattcagcatatatagatttaattttagaataaaaataaaataaatctggtaagtattcattttagattttaaaatttattatgcatattattattagagaaaagaaaatttggagttgtcagaagataattatttcttaaaatgcagttttatatttatttttagagaatagtaaaatcaaaaattacacgtgacaacaaaaacatgtactagcactaaatattttttttaaggttatttttggggaaaatatataaatatatttttatataaattatcagtatgtagtctaaagttttatcaaactaagagttttacaagagacagaagaacaatg

SEQ ID NO: 6121 - DNA, 3000 bp, Unknown
  misc_feature (1)..( 3000): cDNA_ID_1830072_gDNA_ID_1620846_Annot_ID_170199 3000 nt of promoter + ATG
aaggaaagggaaagtatgagagagatagacgaaagagagagagttaactgttgttgtttttccgcacggtttacaatgaaaaagagataaaaggtattgtaaaaagacgcagttgttgagcgcgaaaactgctcagtaaaccgtgggaacaaaatggacatttcacaaccaaatgtggtatgagttgtaatgcccgaagaaatatggcagattacataacgattgggaaaaatatggcagattttataattttcctacatttaattcatatcaaacaacatttgaacatttaaaaccatatacatttgaacatttaaaaccattcaacgagaaatcataataaagccatcatctgaacagtgccaccgaattagtgtttctactttatccccatcaactcaatccaatcattcactatgacaaattttggattccgattcttaaaagaagaaaaaaaatctaggttaagtttcgacgtgccgcgcgttaatgaacagacaagaaacaatttaacatgtcaatcttcactaaaatttactttcggattcgagacaaacctgagagaagcgaaacagatcaaagcttgctcgggaggaatggacgagaggttgaagaagcggtagcggcagcgcaaataaacgaagaattacaacaatcaacgtagaacaaacaaggactttcagaaaaggctcataaataaactttttaatggaccatattgtgtggtaagaagataaatatatcttatcaaataaaatataaatttactaaaacattataacacaactatacttatttattttatagaaaagaaattaaaagtaaagaaaataattataaaaaaaatgtatatatcttattaaataaaaataggaataaaggtagagaaatttggatctataaccaaaaaaatttaataattaagaaactaacctaaaaaaaaaagctgttgtgatattttttgtattttgtatattaagaccactttacccttctcacctctcacctctcacctctcacctcttatctctggcatctcatctctttttttctatatcgccttcattaaaacagaacaaaactatagttttctattttactttcaattttgttacattctatttgctagaactaaggaaaacaaatacgaagactcaccagatctaattgaatattttctggtttgatcaatatctccttaacacaaatttaaacccaaaatcgaatcgatttcaattcgatttaagaaaggagaaaagagattaagagtatataaacatgattttttcagacttctaaaaactgaaacttgagatgatttcatttagtttaattatttttgtttgggttcatataaagtatcatccttagggtttaatttttttaaatcaatagatgtttgtaattagaatggattgagataaaaaaaagttaatttttctggaaattttttattgaattggggagaagagaagaagcaacgaagaagatgatgaaggaaaaaggtctgttaaataagaataaagtggatatttcccagttctcatatgttagtttcttaatttctagaattatagtgctattttcttaatttagtgttgaaaactagttagttttccaattcacccataaaagtattttcagaaaaaaaatatagaaaaaaagaaaaaaagtattagtgtacttggaacctaatattattcattatcaatcatggaatttttactttacaccgaagtcgaaactctactctggacgataaagtgtatgattggtgccgacaaccaagatgtagccttttttatatactgttcagacctggtgaagatagttttttcctcaaccgaatagtcggcgttttcagcatatttggaggattttcagagcgacaaggaagaattcacaagcttctctttatctttaattttttgtaatgcaaatgttaaaacggacaatttggcacgaaaatttgtactaaatcgttttatgtcacttatgtaaacaatattccgcaagattgattcttttgagctcaaaacaaaaccgatgacaaaaaaaaaaaaaatcatggaatttctaagaaccgtagacacttacttggtcaccgttgccaactacgacgaaatatttataacatttctaatatgctacttgacaaaacaaaaaaggctacttgaaaatcgctaatttttgtttttcttcctcactagtcaatatcacttatgaaaagttatttgtaaatttgcaattactttccaaagtaaggttttgtgagtaaaatgtatgttttgataggaataaacattctcaatttactaagcagttatgtatactatagttgttttaaacgcacaaatgaaaacttgtcaaatgggattgataacaaacatatcatactactttctttctatcttttgtcaatatcgtattactttatgttaaatatatagtaaaacttctcgataaattaataactatataaattaataaattcttccgttccgagttgagatcaatgtaaaaattgatacaaatcaatatattaataagataataatttttttgaaaatcttatataaatatatggtctcatttaccttttagattaaatttttgtaaaaagttacaaaatttgtaaaatctctctataatttaaatttattaattaatcgataaattaatacctttttaaattaataaattttctcggtttcagtattattaatttatagaggttttaccgtatttcaattatatcctaactatacaacgaaaacacataaaataataaaatttgaacatgaacatctctgtatacatatatggacatgagaacctacgcgtatgtccgagtactttcctagtagtaacaaaatctgaccaatacaccattttgtcaagtcaagtagtgtgtactcgttgtctcaagtcaccttataatatacaaaagctctatagtaattgattatcctcgtaacaataacgtatgatcaaaaagat

SEQ ID NO: 6122 - DNA, 2463 bp, Unknown
  misc_feature (1)..( 2463): cDNA_ID_2139509_gDNA_ID_1620846_Annot_ID_170196 3000 nt of promoter + ATG
aattcgttttcagggaatattaccaagcgggcaagagatagcggtaaagagattaagaaaaggttcaggacaaggaggtatggagttcaagaacgaggtcttactcttgacaagactccaacataggaatctggttaagcttcttgggttttgtaatgaaaaagatgaagagattcttgtctacgagtttgtccccaattcaagccttgaccacttcatattcggtgagccttcgcgagacgagactttgcatctttgcatgttacactacttttagaaaacaagaaaaaaaaactgtttctttgagatgtgcagatgaagaaaaacgccgagttctgacatgggatgtgaggtatacaatcatagaaggagttgcaagagggcttctttatctccatgaagattctcagttgaggattatacacagagatttgaaggcaagcaatatccttttagacgcggagatgaaccctaaggttgcagattttgggatggcaaggctgttcgatatggacgagactcgaggacagacaagcagagtagttggaacatagtaagtaagctctgtttttatttttaaagattctttgatcagcatcactattaatatgatttggttaatgcagtggatatatggctccagaatacgcgacatacggacaattctcgacaaaatctgatgtttatagctttggtgtcatgcttctagagatgataagtggtaaaagcaacaaaaagttggaaaaagaagaagaggaagaagaagaagagcttccagcttttgtaagcttatcacttatgtcgatcatctttactcttcttcttcatcttcttatcgaaattttaaaaattatttgcaggtgtggaagaggtggattgaaggaagatttgcagagatcattgatcctttggctgctccgagtaacaatatctcaataaacgaagtaatgaagctcattcacataggtttgttgtgtgttcaagaggatatttccaaaagacctagcattaattcaatcctcttttggcttgagagacacgctactatcacaatgcctgtgcccacgcctgttgcttatcttacgcgaccatcgttatcacttggtcattaatgaaccgtcaatcatgtatgttttatacctatttgtctctctctgtacaatgaatgacaaatgttgagaaaagagatgccgtgtaatgtaagcaaacttatgtttgatttgtgctaaacttatttatattaaatgaatatttgatatagccagcgttttggataatgttggaaattggactgaaacggaggaacgcatagatgaaattaaagtccaatttctatgaaagttcacacgagcagaaacaaaaactttgatctaatgtaagaggaaatgcgtgcggtaggggttgcgtagtcataaagaaaggacattgaacaaaggcacatttttaaacttatatgtaagagcatcatgggctcttaaccatatttagaatttaaatattgcacaatcaaaatacccctcatgagtttttatttttgacaactccaatggtagaagttctaatgaggctcttaaaatttaaatttttgaaatttatatgtgtttgtgtaacaccccgatttcaggaatatggtggtgcatacggtgaaatttaaaataattgatttgaccatttatattaccaaaatgcatttatcttttcgatcaaagatgttgaaaatgctcaagtaaataacatttgacattatattttacttttttcatgtttacaataaagcttcgttttgtatgatctgaaatataaaattttctctatatttataaccaatttactatagactaaatatttttaaattacaaataccgaatgactaatccataaaactgtgatggacaccatatataaagctatattggacgattgtgggtgttgttcattaaattgatgatttccactatgtcaaacctttcctccaaatttaagaatgacaaactatccaaaattattttcaaagatttttgaaagactcactacgagtttctcagaaattaacaattgttacaattttcacttcttttttcttcctgaattgtcacattctttatacagtatatgagtatgactcgtagaccaagcaaaggaagacttttttggtcatgcatgcgaccaaaaacaagtacttacataaccatattgaaaggacaatattttcaatacttctagagaagaaaaaaacccttagttcatacgaagtgattaagaaatgtttaccctttctctacggctatttgaatttgaatggccatctttgaagtcaaccattactcaaattttttcatgtgtactcaaccaaaacccattctctctcatgtcacctaattatacacatatataaacatttattacctcattaacaaaaaaaaaaacaatgaacaaaaccctaaactccattgcttaacaatg

SEQ ID NO: 6123 - DNA, 3000 bp, Unknown
  misc_feature (1)..( 3000): cDNA_ID_1830120_gDNA_ID_1620847_Annot_ID_50940 3000 nt of promoter + ATG
acaccaactgataagatgttactattagaagttacttttattcgcttatgaattttaaattcattcttaaactcatgaaaagccttttttagtctggatgacacaagtgtttttaggagaaacaaacgttttgtaaaacttcaaacgtggaaaatgaaagaaatgtggaaaatcatctcattttcagattaaatgacaaaagctttcatgtatgtgaagtcaagtaatcaagttgtgaatgtaaattaatgttaaagatcactacatatataaaacataaagctctaaagtggaaaactctagtatgaacttgttaaatattggataaaatggggataaccaattttgtcaaaatatgtgtggaagttgtgtaacaaaggtcatattaattaattgttgctatacaagatgaaaggtctctttgttttaaaatttgtgtatctattggaagtaatactgtttggtgaaatttcttatgatgacgaagacatagagaagcaggtgaaacactttctaaagacaaagtcgaatcttgaacaaaggatattgtgctatgatgcaccaactgataagatgttaccattagaagttacttttattcgcctatgaattttaaattcattcttaaactcatgaaaagccttttttagtctggatgacacaagtgtttttaggagaaacaaacgttttgtaaaacttcaaacgtggaaaatgaaacaaatgtggaaaatcatctcattttcagattaaatgacaaaagctttcatgtctgtgaagtcaagtaatcaagttgtgaatgtaaattagtgttacagatcactacatttataaaacataaagctctaaagtggaaaactctagtatgaacttgttaaatattgggtaaaatggggataaccaattttgtcaaaatgtgtgtggaagtggtgtaacaaaggtcatattaattaatttttgctatacaagatgaaaggtctctttgtgttaaaatttgtgtatctattggaagtaattttacaaagtcaatttatatttttctatttagaaatgacaatagattaagtgggagactgaaaggccacttaatgaaagaagtggaaaagtttgaaagtggtgaaacttagtttagtaaaataaatacaaaagtggaagagttacttaaaagaagtgcaaacccatattctaaaataacaaatatgaataaactactttgttatatgtttttttctaagcgtggctgaaactctcttaaacaaggttcgaaacttgctatccacgacacacaatctttttcaaatgacactaaattacatcaatgactatattttcaacactatatttgattttcgtgttgctattttttggtaatgctatatttattactcaacaaagataatatctacaaaagctctttgaactgaaaacacaaagacaaagtaagagcgaagaataaaccttgagtgtgctcgaaccaaaactgaagaatatcttgcagccagactcatcttggaatgaaacaaggtaaactcatgtttgtcgctctgaatggaaattgaatttaaagaaagaagcaagcttcacgtttttttttgggatcatgaaaagctttaggcgagatcttgtaattacgagagagggaagttgacaaagagcttgtggtgaaaaacgacttctgcctgaactgtttgataatccggctctgagatcagaggatgagagtaacgattgtatttattgccaccatgaactagaaaacctttgttgcatattggtgtttgtttttgtgagagaaactgttggatgacacatcactatactaagaaagtcttgttaaattcatcgaagatgtgaagagatgagcgtcattggtctcatgttgaagctgtttgatgggttgatctgaaacttgggttccatcgtcgaaaatgcagtagcattaactggagttacctctggttctattgttggggaggaatggccatgagagttctgctgcgattgacctgaagcaattttcagcttgttatatgtcacttgcttgatttgatgctgcgattagaggactgatgtcatgtttgggaggaagtttgatgcaactctgaatctagtagctcaggggaagaaggtttcaggtttcaaaaacagttttatgttttgatgttgattcttccttcttcgttttgtttggctacagaactctgattttgcttctaaaagatgttctggaaacttgaaagcaagatcattccaatgacatagagatcatcttctggttccttatggtatgataggaattcgtcctcaaaattggctgctcgcaggttatgttattctggatctgtcatgggaaattagccataagtttcaaaccataaacccaaatcgtgatccgtcttctcctgtagcttcgtatatctgatgttgggcttgcaagcaatatttcagaattatcttggttggtttgtattagtcaagtaacacacatggatcatgggcttagagttaacaagaagaagagaagttgatgagcccattaaccccttctagaagtgcgattagagccgttagaagggagaagagaggagagtcacgggtaggctaaggtttcatcttagccatggtcaagtcactatcactctagagaaaagtcgtctactctctcttcatgtctctttcattttgttttgtttgttgtaaagggaaccctagtgtctccctatataaaagtcttgttccctacattgtaaccaatctaatctaagtaatatcttcacttcctattcttggctcttctctcctctataaacttcatacttctccatacttctcatactcttttccgcatattctaacatggtatcagagcatgttcttcgattcttaacatgctaaatctcttctacttactctaatctacttactctctacattcttcttaaatctacactttcctcttcaagaaacactctattacccaacggttaaaagagtgtacacatc

SEQ ID NO: 6124 - DNA, 3000 bp, Unknown
  misc_feature (1)..( 3000): cDNA_ID_1830108_gDNA_ID_1620847_Annot_ID_50943 3000 nt of promoter + ATG
ggagcaaccggcaaagatcacaaacactcacaaggacacaacagaaaaaccatgagaaaccaagttcaaaagaattcagacacaaagtataatgaataagctgccaagattacgagaactttatatcaaacactagagacacaacacaaacatttcagacaagtacacaacacaaacacttcagacaagtacactaaagaattcagacaagtacacaagtacacaacataacagaattcagctgccaagtacacaacataattcagacaagtacacaacagaattcagacaagtacacaacacaacaagctgccaagtacacaacataattcagacaagtacacaacagaattcagacaagtacacaacacaacaagctgccaagaaaaagcacagaagatttacctcagtaaaaatcttgttcttggaatgaacagacaatccacctgatccagtgctctccggattgtccattgagcacatatgagactcttcctcttctatcctagatgtcacttgcttgtaaatctcctttgacttcccatcgatgaaagttccatccgcttttctgtgtgtctcatctagcagctcaaggaaatcaggagttgtttctccagtcttttcacactgaaacacaaagagataaacaagttagattcataaaattgtagtttaagtaatggtaaggagagaagaatacttatcttacccgttttcttgcacgagctttgtatgaggtctggcctgaacgatgtttatagatgtctttgccatccagatcatgatatctagcatttctgctgttgttactctttttctctgactttggatcttgccaaaactgtactagacctttccacacatcaggatcaatccattttggcttggcttcatcacccttctccttccaatttcccttccaccttgacacttgattagacatcctagactttagctttgcttcaaactcaacccttactcttttgttaattgaacggtcccagttatatacttgctacaaaacagacaaagcaaacatcagactatgaaaccaaacaacaaaacaagcataaacatcaaaagagcacagaacttactgcaaacgtttcataccatcgatcgattgtagcctttgatgtctatgaccaattggcatgaggttctttgaaatctctttcaaatatgctgcggattgttgctgcaactatagagtcatcgtcaaacctacaacaacagcaacaaaacacataaggatctctatgtctttatacttctaagaaactacaatgctaagtacaaccaacctaaatccagagacttctaaggcaggaccaaacttctaaggcagaaccaacctaaatccataaacttctaaggcagaactaaccaacttacaagacctaattccagagactataagcttaaccttaccagagagttcccggaggatgctttgggtctagccttgtcaagccagcacaaccaggactatcgaggagctcttccagtgtcagattgttgagacggtcaacttgaacatcataatgattgacagaaggctgagtcgttggcgttggaggcgatggtggaacggttgaacctgaacgtgaacctgaaccttgaacccctgagatattcccaccactaacaggagaattgacatgcaacgggtcacgctgctgttgtctaacccgtacaaaagtattatccgacggcatcttgcacaaaaaacaaatcaagagttagatctgggaaaaagaagtaagatcggagaagaagaatgagttagatttgagagaagaacttagatcggagaaacagaggttacctttgaggcaaaacagatcgagtcggagaagaagaaacgcggcggtgtttgaatacagatcgaagaagaagagaggcggcgaagagagtctgcgtcgtaatcagatcggagaagaagagaggcggcgatgagtataacagattagagaagaagaagaagagaggcggcgacggaatcggatcggagaagaagagatccggcgccgaagagatcagagaagaagaagagaatcgaagaaaatttttagggttagggtttgatgcggctggtttgagctccgctcaaactaggtcttcgagtatatataggaatttatttcctcgcaaaaccctcgcatagtttgctttgaaattgcgaggaagatttttaaaccaattaaaacgcaccacatattgcgagggaattgcgagaacacctagcaagtccctcgcaacttatgatttttaataattttgggtttagggtaaaatttacgacggaagtgcgagtgcgtctagcaattccctcgcaatccttcaaccaattaactccaccattttgatttagtgtttgaatcagatctgatttagattcacctatttcgaataagactcccagcaaattaaaatatgactaaatattttaaataatttaaggtttatggtaaatatttgcgagggaactgctacgacagacttgcaaatctctcgcaaaaacctcgcattgttgaatcaatttgaaaaaacaagaaaacactacttaaaattattcggattagttattctgaatcattaggaagttaaatatctacattagaatctaatttcatctcaaaaacttcaaatgtgcatttttcccaaatacatcaatgatgaacttatgtgttttcaataatatgaatcataagtgtttaacatcttcaatatgaaatgtcatattgaaacatatacaatatgtttttgtgcatcaccatataatcaacttgtatgattatacagtcatttagatttacatttataaatgaaaatcaaagatcccaaatcacttctatgtattttagggtttagggtaaagatttgcgagatttttgcgggtggtttgcgagggttgatattgttcattgcaaagtactcgtactttcctcgcaaatttgcgaggaagcagtctctcgcaatatttgcgagggattagca

SEQ ID NO: 6125 - DNA, 3000 bp, Unknown
  misc_feature (1)..( 3000): cDNA_ID_1830100_gDNA_ID_1620847_Annot_ID_50945 3000 nt of promoter + ATG
gtaacggagatggacatattctgctataagaaataacggttttactctctatcatcttcttctttccttcttttttgtttttgatgagtgaaatcgaaaagatagtatagggattccaaatggatcccaattaaatttgtattgatgagtaaaatcttaaccctaatgagagtatagggaactcaaatgcttcaatcatagacacatatcgaatcaattatgaattttaattaaaaatctaaattatttgagaactttggatagggagttacttggataaacttgatccatggagttctttgaatcccttatagatgacaacatcttatcaatagagacggccttttcattctcacacagactcttatctctcgtaacaaataatttgggattattttaaaaattacacttaaaagctgatcctaatttcataagaaccataattgcaaaatcaaattagaatctaaatacaaaccaccgacgaattaccttattgatttctttgagggaaaatgaagatcatgacttgctatagagacaaaggagagaaaaaatggtaaaatggtcactcaaatgagagagaagtacctaattctataagaatattgaaaaatgatatgagagacaatgacacaaagttttgaaaaatgatatgagagacaatgacacaaagttttttgtgctttatctataattgatccaaattaagcgtgaactaattcgactttagtatggtctgcatcttactacacaacattcaaaggctatacatgttttcaatcaaatcaatatacattcaaagcctatatgttttttaatcagataaacagccagtagtcacatcttttacgtgctttcactagtacttatacactctaaactatatgcatgccttgaatggggaatagtatttagacactaatttaggggttagaatgaaagaaagaaaacttgaaggggttagatgagcaaatatgaaaagttaaaacttcaaggaaacgtatgcttatgggtcccacacagcgtcaacaacgtgaaggcgtttgcttgtgccacaaatcaaagcaaccttatattttccatttgcagcaaacaccaatcaaccaaagtaacaaaccatctattattaattattgtgcaaaaaaaaaaaaaatccttcgcacgttttaacattttattgtgaacatttcagacatttagtgtttttctatgtgagtggagataaaatttttttttttttttttgaagaaatggtataattggggtggcaaagttaatttaaagacgttactgtaacactgtttaagaaaggggttcaatcatattgctctttgctaagctggacctaagcatgggttcaacgtgaagcgtacctaatgctaaacaaacccatatctacggatattttgctaagtataattctcatccattaaaaacagttagacaaataaaatatattgtcttaataaataaataaatgaatgagacaattcttctggattttaaaacaattctttttttgaatcagacaaatatttaaaaattaagatgatagatttaaaaatttcgttgtttatatatatcttggttttaaacctatattgcttaagatcctacttttacactttcagttattatatacctttttaaaaatatttttttattaaacttactatgatttcacttatcttgtagatttttatttagtactaagaaaagttatttatattatataaaatgaataaaaatttagttgagtaaaagaaattaatacataaggttctcttttgaaaatagacatataaggctcttccttgcacacttcaaatagaatgaatttgatgtggaaaacagactaaaccaagatatcatcctagaagatatcttaactatgtacttaatagaaaattgaaaagaaaactttatacttatgcaaaaaaattattaacttttacttaagagaacaattgggatcaatatgaaaataagatataacccaagggtcgataaattaaagtgaattaatatgaaaatgaactttatccttaataaacacaaaacgaattttgctgatctgtctaggtccacgcatagcaagcaaggtttcataaacgtgacgcttgcttatgaaactaactcacacttataactttaatttaattccttcatattcttcaaaagtttccatttacaagcaacaactaaactaattgacatttgacaataaaaagctgaactttattatgtatctctaggttttttccttgagagtttctctctttgaagtcatttacgtatatatatataaacccttgcaccattcttcttcgtcttgttaagcttttaagaatctctactcacattttctctgtgagtgttcttttatacttctttgttatttccaatttttctttctttcctctaaaaattttaggaactattgaatcatttaatttctgtttgttgataaaatttcgatcaactgttctcggcttaccgatgcattttttgtaaaaccgtctttttttggtgaataaaattttaaattcatacaaaaaaaaaacatatttgatactattttagctccattgtatctgaatcttcatttgttaatttttttgtttcctctgttctcacttgaattttggaatattttctctaggttttaccttatattcttcactttaagaactatatgaagatttgattggaagtaataatattcggtgatagaatctgagtttgtttgattctggtgtggggcttatatctaacttttttctttgtaccaatacattttcaattttacatttttgattagcttaaaatgtgaaggataccttgtaaataactattacactattgcttgtcttagtctaatagtcttcactaatattttgtgcagtagaagtaaatattataaagagttgttgtttgattatagagagttgttgtctattctttaacttgatgtgatgttgtttttgatgacaggtaaaa

SEQ ID NO: 6126 - DNA, 3000 bp, Unknown
  misc_feature (1)..( 3000): cDNA_ID_1009437_gDNA_ID_1620847_Annot_ID_50946 3000 nt of promoter + ATG
aacgagaatccaagaaacgagatcataaagttgattcagattggtttgttgtgtgttcaagagaatgcagcaaagagaccaaccatgaactctgtaataacttggcttgcaagagacggtacttttacaatacctaaacctacagaagctgctttcgtcactctgcctctctcggtgaaacctgaaaataggtccatgagtgagcgtaaagacaaagatccgttttcagtggatgaggtctcgattacagtcttgtatcctcggtgaatattccattattttctgacctcatctgcattggtgctagagaaactagagtacgatacaagaaacatgtaacttggggtgggtattcggataattcggtttattttggttactttatggacacattgtcaccgaattatacccgaatttagttgagtaaataattattttaaattctttaaatttcatctttagtataaattctttttgagaatacatattaaaaggaaaagcctaaaaaccgcggtttattttttatttggccgtttaatacctgtaattttaaaattggaataaaaatagctaaattattttttgttgtcttttaaatccatggtcttttaaattttggtaatttcgaatttgcgacttaacatctgttattgggcgttacggaaatcgttaacggcgttaacaaaattaagtgaaattagaaaagcaaaaaaaagtggtctaaaaaaccacgatttatattttaccgttaaccggtaacgacttccgtagaacccaataacagatgttaagtcgcaggttcgaaattaccaaaatttaaaagattatggatagagtaagatacaaaaaatatgtaatttggggtggatattcggataattaggtttattttggttactttggtatggaaacattgtcaccgaattatacccgaatttagttgagtaaataattattttaaattctttaatttcatctttagtaaactttctttagtgaaatataaactctttttgaggatatgttatattaaaaaatatttggtttaataaattaaattaaaaattcgattgagtccgtttttttagtgaactttctttaccctaatcggtttaattttagattgggtcaaattcgttgaataatttcatttctgttttgaatcggtcgtatcatttcggttcattaaaatgctcaagatcaggacaaagattcatgtttcattcaaactctagtttaaaatttcgatcaaaagacaaatttctttgtaaaagtaaatcaaatttgctaatataatatgtcggtaacaaagaatgaatgaacaaattcatctatacaaaaaaaagaaaagaatgaagaatgttctctctaagaaaaactagaaaagcttgctagcgaattctttggccttaacctgagagagattcgatcttttcgcgagatctctcagttctgataagcttctccctagcttcaccgcaactcttgtctcaaacacttgtccgttctctctcttctccgtcgatttcatagtttcttctaatagagagaagaatccagctgagtttctatacatctcaaacaccattcccacttgaccaccatgctctaaagtgttgacaaccgcagccaaagaagcacaagtcatcgccacgattccagctaaaccggaatcttgaccgataaagacagagcttacagcagaaactccggttaaaactggtccagagatagccaagaaccggtttagcttcaacgccacgtgacctaatttctcatactcttctgcgtctctgctcttcaccacatgagcaacttctctcatctccgcctcaagctcttgactccatccattcgcaagactagttttagggtttttctccttgttttcaggccaccaagtcgccggtttaaactcttccggaaacttctcgagcattgttccgatcagaggaagaggataagctttatctagagacaacactctctttatcacttccttaacatcttcttcttcgatctcctcgttttctctcagaaacatttcgatttcgactctcagcttcttgaacagcctcgtcgcgttcctctgttcttcagctagctgcgaaggttgaatcttgctcatcaaggcagcaaaacccgtcgcagatgttaacaacaccgttgaagctatcttcacagcggttacagaatctacaccgtgaccgttaaccgaggctattccggccatcaaagcggcagtgagagtaatcatgttgacagaattgagcagtaaagagttccaattgttacgttgatctccgatgttcttgtgcatctcaatcctatccataacttcttcaagaaccgcattgagacgagttctttggatagaatcagaacctctcttttgtttcaacgaaagaggaagactttctacaaactcaaagctcggttctttaaccgataaagtcggtattttcggaaccgagacgtgaaatttcggtagcttcgggattgaaactgctgctttaggtcttgtactagaagaagatgacgaaagaactaatcttgatacctgcaatgaagccattattgataggttttttggttatgttggtttcttaatatctctcaggagatttgtgattgtgtttgatgaatgaagagagaaatgttatgtgtggtgttatatataggtttaagatgataggcataaaacaaaacaagaaaatttaaggaattgaattgaccaaagagagaattattgaccaaagaccaattaggctttgatagattctcctgtgacggtttttggtctaaccgtaaagctagcctcccaattttacccgccatcctcgtagaacgagtcttaattacatctaaaccggctcggtttatattggtttgattaaaccggttcggttttgttttgtaggtaggaatttggtcaaattgcttaagacacaaatgacaaaacactagagagagtatcgaagagaagaatccaaaaaaatg

SEQ ID NO: 6127 - DNA, 3000 bp, Unknown
  misc_feature (1)..( 3000): cDNA_ID_1830092_gDNA_ID_1620847_Annot_ID_50948 3000 nt of promoter + ATG
tgtacggttaagttagacgatttagttaggtacactattccggtttggttaaagatattttggagaaacattgatttgtgcggttgtacagttaaaaggggggcttactaacattgaaaaacaatttgccatcaatatttaatgcccaaaaagtttagacgtgactcttgtcacaattaatgcaaaatcattattactttggattaatatttgagataataattgttgaattaaagatgaacccagaaacaaaatttattttacgaaggaatgtgatgctgaagaagggttgatcttgtttatttacgaagtttggagccaagacaagcattatcgtgtaactaatgaaggttttaagaagttttttgttataacacactatgatcttcattgtattcgaaatcaactttgttttttatagaaaaacccagaaatcttttatttcctattttgttggttgaaaatgctaaatgagtagatatttatgtttataagtgtgtatatcgaaattctatttgtttttgtagatataatcatgttttcagttgcatttaatgggtttctcctgaatttatgatgcagttgggtaatggatattcccgtatttactatggtcggtgagtggagatgcaaagaagaagaatggaaatttgaaccagaggaagacatgtttggtcgatgtgtacgtgttaaggaaaatatgacgtacactaagcgaggctttcagtttgaagtccgcagagatcaatcccataattagttactggatgccgggagagatgtcagtgatgatagatactaaacgccctcctgtctacattgacagtcaagtggggttagatacgttctttttgattcgtggtgggtatctttttcttaacttgtttgtctctttcattacaaccgtcaagacactcggaaataatgtctctaggactcatggtgacgatgctgaaagtgaccatgtgtgtgatagtgtttcaaatgttgatgaaaataatgaggcgctagatgagcaagacgacgttgaagacggtaaaacagatgaagatgaataggagggggacaacgaaaatggtgatgggtatgatgattatcagggtgactatggatctatgggagaagtaccctcgatcctactatcgatggtagtgaaagtagtggcgaagattatgattacaacaagtggaacgatgtaattgtagaagaatatggaatagggaatgttgaggaggacttcattttcactcaactgactgttcaacgtccaggggaattcagtcggctgttggcagcgtgtacgtacacaagtcagcgtgtacctaacaaagataacatttctcactcgggtgaccgtacaccagctgtgactccaagaagtacgtgtcaacatggtttgtaccaatgtacgtacactatagattgaggagtatttttaagaacagaaaagtcatacaacaaacaatgtcttatctcgcaatcaaacaatgtttttgctataagcaacctaggtcatgtcctacaagattggagatagtatgcgttgatgatacctgtccatgacatttgactgctcaagtcgtcaggaattcagaatgtttcaaaatcacatcgtatgaaagtcttagaatatatctcagtcattgtcaatatcggtttattattgaatcaataaatttttcttaataatttaattcacaaacaaagatgtacgtatattactacacatgtacatacattaatttaccaacaaaaatgtacgtacattattgcacatatacgtacataatttttcaatatgaggaacaaatattatttcaccatatatttttatttaattattatgtatgtatggagattattgagatataagaatatgtaataaaatagcttaagttattagaaatcgtaccatatacgttccactaaataagttcgtgtacgtacattgtaaattgaatatacgtacacaaaagaaattcgatgaaggttataactgtaatttttcagtcatcttcaacctctgtatccttttttgcaaacctaattttgcggccgtctttaccagttttttcaaaatctcattttttttttcattttgaatactttttacaaataaatcttgtaaacctagagtatttttagttttaaaagctaaagtgtttgaatttttggttttttttgtattttgttcatctctgaaaacatgaaatttgtttctcaattttaaagttcaataggatgcctcaaatcaattacccaacaatttgaacggtaatgtcgaaaaatgaaggagtggatgaatgaatttcgaaattatttctacttttctctcggatctctccgtctctttctcgttttcttcgtttcagttttttttttttttttcgcaaaaccaaactgcaaaaaaaactaaaccaaaaccaactgcaactgtgcgattggttgattctattaagggtatttcagtcacaaaatgtttcaaaagggaaaacgtgaaaaccaactctcatttatccaaacgatgagagcaaaaaaaatttcatccacttttgtgaaaatttcttaatttttaataagtcatgaaagttgaaaccatttttggtcacctaatttgactttcacttgtcctttgatccttgacagtatatgaaacccgtactaggccttgactcgtttcatattcattcccttgtagtttccaaactatttggaagcggaaacgacgtcgctctttccagtgttactatcgaagacatttacatgccacttaaggcataatgacaacgaagtgttcgacgtatcgtttacgtaagcgcaatttagggaagaaaagtctttttgccttgctccttacgtcaccctaaaagtcaagtgttcgtgatagaaaagtctcttcgtatttgatccacaattctccaagagaataaatacaaatcaaaatctgtttatttaaagccaaacaataggttttaataaggaaacgttaatagataaatg

SEQ ID NO: 6128 - DNA, 3000 bp, Unknown
  misc_feature (1)..( 3000): cDNA_ID_1830084_gDNA_ID_1620847_Annot_ID_50950 3000 nt of promoter + ATG
gttagtcggcctagctgttatttccggtgggatctttatccgtactacagagcttttgacaatgttgtaagagttcctgctcctcctcctcaagcttcttctactattatcgattacgggagagacgagaaaagttttcaaggaagcaacatagcaattattgtggtcccttcagtcatcaatctcatcatatttgtggttctaatattctcttggaagagaaagcagtcacacaccataatcaatggtaaagtcttttaaaataagcaacatatatattccttatcttactaagagtttggttttaaacttgacatgttttatttgatgacgtgcagatgtttttgattcaaataatggtcaatctatgttacgttttgatcttcgaatgattgtaactgcaaccaataacttctctcttgaaaataagcttggccaaggtggatttggatctgtctacaaggtaaagaaactagtaagaagagtcctaacaaaatcttaagatgggtcagtgatctttaattatagcatgagaattcgttttcagggaatattaccaagcgggcaagagatagcggtaaagagattaagaaaaggttcaggacaaggaggtatggagttcaagaacgaggtcttactcttgacaagactccaacataggaatctggttaagcttcttgggttttgtaatgaaaaagatgaagagattcttgtctacgagtttgtccccaattcaagccttgaccacttcatattcggtgagccttcgcgagacgagactttgcatctttgcatgttacactacttttagaaaacaagaaaaaaaaactgtttctttgagatgtgcagatgaagaaaaacgccgagttctgacatgggatgtgaggtatacaatcatagaaggagttgcaagagggcttctttatctccatgaagattctcagttgaggattatacacagagatttgaaggcaagcaatatccttttagacgcggagatgaaccctaaggttgcagattttgggatggcaaggctgttcgatatggacgagactcgaggacagacaagcagagtagttggaacatagtaagtaagctctgtttttatttttaaagattctttgatcagcatcactattaatatgatttggttaatgcagtggatatatggctccagaatacgcgacatacggacaattctcgacaaaatctgatgtttatagctttggtgtcatgcttctagagatgataagtggtaaaagcaacaaaaagttggaaaaagaagaagaggaagaagaagaagagcttccagcttttgtaagcttatcacttatgtcgatcatctttactcttcttcttcatcttcttatcgaaattttaaaaattatttgcaggtgtggaagaggtggattgaaggaagatttgcagagatcattgatcctttggctgctccgagtaacaatatctcaataaacgaagtaatgaagctcattcacataggtttgttgtgtgttcaagaggatatttccaaaagacctagcattaattcaatcctcttttggcttgagagacacgctactatcacaatgcctgtgcccacgcctgttgcttatcttacgcgaccatcgttatcacttggtcattaatgaaccgtcaatcatgtatgttttatacctatttgtctctctctgtacaatgaatgacaaatgttgagaaaagagatgccgtgtaatgtaagcaaacttatgtttgatttgtgctaaacttatttatattaaatgaatatttgatatagccagcgttttggataatgttggaaattggactgaaacggaggaacgcatagatgaaattaaagtccaatttctatgaaagttcacacgagcagaaacaaaaactttgatctaatgtaagaggaaatgcgtgcggtaggggttgcgtagtcataaagaaaggacattgaacaaaggcacatttttaaacttatatgtaagagcatcatgggctcttaaccatatttagaatttaaatattgcacaatcaaaatacccctcatgagtttttatttttgacaactccaatggtagaagttctaatgaggctcttaaaatttaaatttttgaaatttatatgtgtttgtgtaacaccccgatttcaggaatatggtggtgcatacggtgaaatttaaaataattgatttgaccatttatattaccaaaatgcatttatcttttcgatcaaagatgttgaaaatgctcaagtaaataacatttgacattatattttacttttttcatgtttacaataaagcttcgttttgtatgatctgaaatataaaattttctctatatttataaccaatttactatagactaaatatttttaaattacaaataccgaatgactaatccataaaactgtgatggacaccatatataaagctatattggacgattgtgggtgttgttcattaaattgatgatttccactatgtcaaacctttcctccaaatttaagaatgacaaactatccaaaattattttcaaagatttttgaaagactcactacgagtttctcagaaattaacaattgttacaattttcacttcttttttcttcctgaattgtcacattctttatacagtatatgagtatgactcgtagaccaagcaaaggaagacttttttggtcatgcatgcgaccaaaaacaagtacttacataaccatattgaaaggacaatattttcaatacttctagagaagaaaaaaacccttagttcatacgaagtgattaagaaatgtttaccctttctctacggctatttgaatttgaatggccatctttgaagtcaaccattactcaaattttttcatgtgtactcaaccaaaacccattctctctcatgtcacctaattatacacatatataaacatttattacctcattaacaaaaaaaaaaacaatgaacaaaaccctaaactccattgcttaacaatgata

SEQ ID NO: 6129 - DNA, 3000 bp, Unknown
  misc_feature (1)..( 3000): cDNA_ID_1830080_gDNA_ID_1620847_Annot_ID_50951 3000 nt of promoter + ATG
ttgtcagggtttgcaataaatatttgtgatgcatcattgctcatagtttttttttttttttggtatgtgcagaggcgcaatatgattatggtggtcagtctaagctacggttcgattttcgcatgatcctaacggcaaccgatgatttttcctttgaaaataagattggccaaggtggatttggatctgtctacaaggtaaataaacttgagaaaaattactatcaaattctttagatgtgtaagcaatcttatagcacgataatcgggtttgcaggggaaattaccgggaggggaagagatagcggtaaaaagattaacaagaggctcaggacaaggagagatagagtttagaaacgaggtcttactcttgacaagactccaacataggaatctagttaagcttcttggattttgtaatgaaggcgatgaagagattcttgtttacgagtttgtccccaattcaagcctcgaccacttcatatttggtgagccttttttcactttgatgtttgtgtaaaaatttttgaatgttctagtcgctggttcgagtgacacttgggagatgaccatataaaaatattcagtggtttagtatattgatgcttctttggtaatatgcagatgaagagaagcgtttgcttctaacgtgggacatgagagccagaattatagaaggcgttgcgcgaggtcttgtttatttacacgaagattctcagctgaggataattcaccgagacttgaaagcaagcaatatccttttagatgcatatatgaaccctaaagttgcagactttgggatggcgaggttgttcaacatggaccagactcgagcagtgacaagaaaagtagttggaaccttgtaagtatcctctgtttttactgattcttttagacaaaacaagatactctgtttttttttaccctaaattttcgagattcttggaatcagaaactaatttgaatttgttttagtggctatatggctcccgagtacgttaggaacagaacattttcagtcaagacagacgtttacagcttcggagtcgtgcttctcgagatgataaccggtcgaagtaacaagaactatttcgaagccctcgggctccctgcatatgtaagcaaaatccagtcttgtttactactttagacacaaatgaatctcaaaagataatttgagtataaacttatggtgataatatataggcatggaagtgttgggttgcgggcgaggcagcgagtatcatcgatcatgtcctcagtaggagccgaagcaacgaaatcatgagattcatccacattggtttgttgtgtgttcaagagaatgtttcaaaaagaccaaccatgagtttggttattcaatggcttggaagtgagactatcgccattcctttacctacagttgctggttttacgaatgcatcgtatcaagctgaacatgaagctggtacattatcactaaatgagctttcaatcaccgagttaagtcctcgttgaaaccaagatctctctgtcaactcttatatccaagttttattcacctaaatttcacgatataaacatatgcacaataaattaagttgttattcacctaaatttcaatttctgaccaaggagatggaagatatgagaagcatatgacagtttggtttgcaacaagataaggagggtagttactactaaatatttttcagtgtatgtatttttaaaaacgttaaactttccgatgcacttgatgtaaacacgttttttcgaataaattttacattctattcaaaaaaaaaatttcaatttctgatcatgggctgaccattggacaagttttcagaccatgtccattaaggaccaacaattaaaacccatgaaaaataatggtccaagtggacatgaccgttgggttttagacagtccaattgacacttctacatatatgtatgtatctaaatggggttccaactcgaaactcattatcaataagtggattggtttatgtctcttatatactgttcaagtctcttcttttcttcccagcattccaatgtgagatatttctccacatctactaaaatggatacataacataacaataattcaaaatattccttctatacttgagagtaaagaatcttggtcttccatgatacttccacgcttcttctttattttgttagggttttaaatttatatgctaaaacaagtgttcaaaaaaatgctaggcgctaatcgggcagtgatccaatgcctagcgtctagaacgcttaattgaagcctatatgattttaggcggttaaagcgtttatagcctaaaacattatatatatatatattattatagataaaaataatttaaaatatgcattaataaaataaaaatattaaatttataaacaaaaattagataaaacgtacatttaagagaatcttgcaaaacctgccatattcccctcaaaatcttacaatccctatcatattcacagtcagcttacagaatctaccacatttagctacacgtggaaattcgtggacgaaattacccttaaggtgggtcagtgctctgacttagatggcgacagcttcgtccagcgaaaagaggcagcccctgttccgtaataaatgtttccgtttccgattggatgttatgtggatttattttttaaaaatggtaatataggggttagtcactttaattgtttattaatgttgcagaggaaagatgttgtgttgaacagaacaaagtggtaaactggggaatttgggaggtgttgttgaagacacaaccatttattgcggacgaggtaaaatttattatctggaatttctgtccttcgattcgctttagtttggtagttctatttgtttgtttggttgtgataaatgcaactacctcatattccaaaatggtatatttgttctgtttgaagaacagaaaaggatggacgaaggagttatggtattggtcggtggctgggaatgcaaagacaatggggagtggcgtttcaag

SEQ ID NO: 6130 - DNA, 3000 bp, Unknown
  misc_feature (1)..( 3000): cDNA_ID_3079603_gDNA_ID_1620847_Annot_ID_170252 3000 nt of promoter + ATG
ttttatagaacgaaagataggaaatgatgactatttctttttttcgacccaaaaatcggacctgaaaccaaagccaaaaatttagatttatcctattgggtcctaaactcctcgacccaaacaaccaaacaagaacccgacacgaacccaaatatacccggatatttgattagaatatccaaatttaccgaaaacccaaaatcttacctaaaacacgagtatttaatataaaatttgggtattggtctttaaaattggccctctctaaccaaaagatccttacttgattgggttttagccgaacccgatccgcgtacccggatgtctacacctagttttaaagttttggtgcaaaatacataagaccttgaatataaggttttggcgggaaaatgtatgcataaaatgtctttcaaaattatgatttcacggattttgtagaacggtaaacagtattctactatttttggtgagaatatggtattgtactattttttcatctatcaaaatagagagagagagagagagagagagagagagagagagagagagagagagagagagagagagagagagagagagagagagagagagagagagagagaatctaaatttgtgttcatgtttgagaacagttcttaatttctgaattacctgttacatctattcttctagattgattattaaaatattctatagctcaatgtctttaattcataagtttaattgtcaatttatttgcatttttatttacaactctgaaaacaaaacaaacaacttttttttttgttttagctaagaacaagtcctaaaactctttagaatattaaccatgtatatttaccttgcgcttgtatcgaggaattactcgagcaatcaaactacatagttataccatcaaatgtagtttaatagtttagtgattttgatgggaaatagataatttgttgtttcactgttttggtgaaagaatattattttaaaatatgataatatatataaagtaaaactatcttggttatcgttgtgatttctagatggaaattgtgttgtatataaactctcctttaagttaaaaatttaaaactcatccaagattttttgttcttaagttacattttccaaatgcatcaagttattaagtccaactcatataattaaatgttatttaacgaataatgtcttgtatatgcatctagatgcacaaacgaaccacttctaattttctttgatgctcttacatttttttcaaatgaatttttctcaaacctcagcatctttcttttgttaaaaataaaattttaatatatgagtcaaactatatgtgtcaatttgatctaatctaattcatcaaccctaataattttactatttggatcataatgagttgatgggtcagtgagttagtggatcgtttggagtaagttgtaatggtttatggttcaccatattaaaccataaattatcatacttaacatcatcattagctttattaatatcatcatgatcaccatataatcatcatcacctttatcatcaatttcttcaatataatcacaatatcataattttccaaccaaaaaatgagattctgtaattcttttgctaaagacactatttcacaatttctcagatagtaaaattgaacaattttctgccaaaaatagatggttttcacaagttttccaccgcaatacgatatcacactttttccgctaaaatattaatctatattttcagtcattgatggtgaataagggattcatacctcatggatcaacctaacttatcacattaatgattttattattttgttctaaatgagttgattggtcaaagaaattataagtagatgagttgatcagtaatcaggatcgcccctgatctaaagcaagtaaagctagggctttaggtgctaataatatatcatcatttataggacatcaaatacgggaaaattatatgtagcacagtgacaaagttaagttttaaggttaacatgaagtcttgagtttgagccaatattttgtggtttttgaatatttttatatttaagtgttatgggttttaaaaaaaaaactcatgctttaggtagctatgcactttgggcctgccttgtcaataatatgtaatggtttatagttagacaaaaactttcataagattataatttttcacatcataattatcttcatactatcatatcatcatattattaacgccaccgtcatcatcatcatcatcataccatattttccccacaaaaacaaccttcataaattttacgaaaaacaaggttccacaatctttagccttacctttaccaataatatgattaactatttggacacatctacttgcagtactctatacaaatatgatgaacattttccacaaacaacgattctacaatgtaactccatttctataagaaaaatgatttcatctcccatttatattttatatcacctacaactcatttgtattcatagctttttttaagaaaatctaattttaattcaaaataaatataattcaaagttctttttggatgattataaatttatttataacctttggttaaaaataataataattaataacaaggctattattagagaaaatatgtttgtttttttgagttttactttatttttacaaatattcagcatatatagatttaattttagaataaaaataaaataaatctggtaagtattcattttagattttaaaatttattatgcatattattattagagaaaagaaaatttggagttgtcagaagataattatttcttaaaatgcagttttatatttatttttagagaatagtaaaatcaaaaattacacgtgacaacaaaaacatgtactagcactaaatattttttttaaggttatttttggggaaaatatataaatatatttttatataaattatcagtatgtagtctaaagttttatcaaactaagagttttacaagagacagaagaacaatg

SEQ ID NO: 6131 - DNA, 3000 bp, Unknown; identical to SEQ ID NO: 6121
  misc_feature (1)..( 3000): cDNA_ID_1830072_gDNA_ID_1620847_Annot_ID_170250 3000 nt of promoter + ATG

SEQ ID NO: 6132 - DNA, 3000 bp, Unknown
  misc_feature (1)..( 3000): cDNA_ID_2139509_gDNA_ID_1620847_Annot_ID_170247 3000 nt of promoter + ATG
ggtggggttagtcggcctagctgttatttccggtgggatctttatccgtactacagagcttttgacaatgttgtaagagttcctgctcctcctcctcaagcttcttctactattatcgattacgggagagacgagaaaagttttcaaggaagcaacatagcaattattgtggtcccttcagtcatcaatctcatcatatttgtggttctaatattctcttggaagagaaagcagtcacacaccataatcaatggtaaagtcttttaaaataagcaacatatatattccttatcttactaagagtttggttttaaacttgacatgttttatttgatgacgtgcagatgtttttgattcaaataatggtcaatctatgttacgttttgatcttcgaatgattgtaactgcaaccaataacttctctcttgaaaataagcttggccaaggtggatttggatctgtctacaaggtaaagaaactagtaagaagagtcctaacaaaatcttaagatgggtcagtgatctttaattatagcatgagaattcgttttcagggaatattaccaagcgggcaagagatagcggtaaagagattaagaaaaggttcaggacaaggaggtatggagttcaagaacgaggtcttactcttgacaagactccaacataggaatctggttaagcttcttgggttttgtaatgaaaaagatgaagagattcttgtctacgagtttgtccccaattcaagccttgaccacttcatattcggtgagccttcgcgagacgagactttgcatctttgcatgttacactacttttagaaaacaagaaaaaaaaactgtttctttgagatgtgcagatgaagaaaaacgccgagttctgacatgggatgtgaggtatacaatcatagaaggagttgcaagagggcttctttatctccatgaagattctcagttgaggattatacacagagatttgaaggcaagcaatatccttttagacgcggagatgaaccctaaggttgcagattttgggatggcaaggctgttcgatatggacgagactcgaggacagacaagcagagtagttggaacatagtaagtaagctctgtttttatttttaaagattctttgatcagcatcactattaatatgatttggttaatgcagtggatatatggctccagaatacgcgacatacggacaattctcgacaaaatctgatgtttatagctttggtgtcatgcttctagagatgataagtggtaaaagcaacaaaaagttggaaaaagaagaagaggaagaagaagaagagcttccagcttttgtaagcttatcacttatgtcgatcatctttactcttcttcttcatcttcttatcgaaattttaaaaattatttgcaggtgtggaagaggtggattgaaggaagatttgcagagatcattgatcctttggctgctccgagtaacaatatctcaataaacgaagtaatgaagctcattcacataggtttgttgtgtgttcaagaggatatttccaaaagacctagcattaattcaatcctcttttggcttgagagacacgctactatcacaatgcctgtgcccacgcctgttgcttatcttacgcgaccatcgttatcacttggtcattaatgaaccgtcaatcatgtatgttttatacctatttgtctctctctgtacaatgaatgacaaatgttgagaaaagagatgccgtgtaatgtaagcaaacttatgtttgatttgtgctaaacttatttatattaaatgaatatttgatatagccagcgttttggataatgttggaaattggactgaaacggaggaacgcatagatgaaattaaagtccaatttctatgaaagttcacacgagcagaaacaaaaactttgatctaatgtaagaggaaatgcgtgcggtaggggttgcgtagtcataaagaaaggacattgaacaaaggcacatttttaaacttatatgtaagagcatcatgggctcttaaccatatttagaatttaaatattgcacaatcaaaatacccctcatgagtttttatttttgacaactccaatggtagaagttctaatgaggctcttaaaatttaaatttttgaaatttatatgtgtttgtgtaacaccccgatttcaggaatatggtggtgcatacggtgaaatttaaaataattgatttgaccatttatattaccaaaatgcatttatcttttcgatcaaagatgttgaaaatgctcaagtaaataacatttgacattatattttacttttttcatgtttacaataaagcttcgttttgtatgatctgaaatataaaattttctctatatttataaccaatttactatagactaaatatttttaaattacaaataccgaatgactaatccataaaactgtgatggacaccatatataaagctatattggacgattgtgggtgttgttcattaaattgatgatttccactatgtcaaacctttcctccaaatttaagaatgacaaactatccaaaattattttcaaagatttttgaaagactcactacgagtttctcagaaattaacaattgttacaattttcacttcttttttcttcctgaattgtcacattctttatacagtatatgagtatgactcgtagaccaagcaaaggaagacttttttggtcatgcatgcgaccaaaaacaagtacttacataaccatattgaaaggacaatattttcaatacttctagagaagaaaaaaacccttagttcatacgaagtgattaagaaatgtttaccctttctctacggctatttgaatttgaatggccatctttgaagtcaaccattactcaaattttttcatgtgtactcaaccaaaacccattctctctcatgtcacctaattatacacatatataaacatttattacctcattaacaaaaaaaaaaacaatgaacaaaaccctaaactccattgcttaaca

SEQ ID NO: 6133 - DNA, 3000 bp, Unknown; identical to SEQ ID NO: 6127
  misc_feature (1)..( 3000): cDNA_ID_1830092_gDNA_ID_1620847_Annot_ID_170242 3000 nt of promoter + ATG

SEQ ID NO: 6134 - DNA, 3000 bp, Unknown; identical to SEQ ID NO: 6126
  misc_feature (1)..( 3000): cDNA_ID_1009437_gDNA_ID_1620847_Annot_ID_170240 3000 nt of promoter + ATG

SEQ ID NO: 6135 - DNA, 3000 bp, Unknown; identical to SEQ ID NO: 6125
  misc_feature (1)..( 3000): cDNA_ID_1830100_gDNA_ID_1620847_Annot_ID_170239 3000 nt of promoter + ATG

SEQ ID NO: 6136 - DNA, 3000 bp, Unknown
  misc_feature (1)..( 3000): cDNA_ID_1830076_gDNA_ID_1620847_Annot_ID_50952 3000 nt of promoter + ATG
acgaggataatcaattactatagagcttttgtatattataaggtgacttgagacaacgagtacacactacttgacttgacaaaatggtgtattggtcagattttgttactactaggaaagtactcggacatacgcgtaggttctcatgtccatatatgtatacagagatgttcatgttcaaattttattattttatgtgttttcgttgtatagttaggatataattgaaatacggtaaaacctctataaattaataatactgaaaccgagaaaatttattaatttaaaaaggtattaatttatcgattaattaataaatttaaattatagagagattttacaaattttgtaactttttacaaaaatttaatctaaaaggtaaatgagaccatatatttatataagattttcaaaaaaattattatcttattaatatattgatttgtatcaatttttacattgatctcaactcggaacggaagaatttattaatttatatagttattaatttatcgagaagttttactatatatttaacataaagtaatacgatattgacaaaagatagaaagaaagtagtatgatatgtttgttatcaatcccatttgacaagttttcatttgtgcgtttaaaacaactatagtatacataactgcttagtaaattgagaatgtttattcctatcaaaacatacattttactcacaaaaccttactttggaaagtaattgcaaatttacaaataacttttcataagtgatattgactagtgaggaagaaaaacaaaaattagcgattttcaagtagccttttttgttttgtcaagtagcatattagaaatgttataaatatttcgtcgtagttggcaacggtgaccaagtaagtgtctacggttcttagaaattccatgattttttttttttttgtcatcggttttgttttgagctcaaaagaatcaatcttgcggaatattgtttacataagtgacataaaacgatttagtacaaattttcgtgccaaattgtccgttttaacatttgcattacaaaaaattaaagataaagagaagcttgtgaattcttccttgtcgctctgaaaatcctccaaatatgctgaaaacgccgactattcggttgaggaaaaaactatcttcaccaggtctgaacagtatataaaaaaggctacatcttggttgtcggcaccaatcatacactttatcgtccagagtagagtttcgacttcggtgtaaagtaaaaattccatgattgataatgaataatattaggttccaagtacactaatactttttttctttttttctatattttttttctgaaaatacttttatgggtgaattggaaaactaactagttttcaacactaaattaagaaaatagcactataattctagaaattaagaaactaacatatgagaactgggaaatatccactttattcttatttaacagacctttttccttcatcatcttcttcgttgcttcttctcttctccccaattcaataaaaaatttccagaaaaattaacttttttttatctcaatccattctaattacaaacatctattgatttaaaaaaattaaaccctaaggatgatactttatatgaacccaaacaaaaataattaaactaaatgaaatcatctcaagtttcagtttttagaagtctgaaaaaatcatgtttatatactcttaatctcttttctcctttcttaaatcgaattgaaatcgattcgattttgggtttaaatttgtgttaaggagatattgatcaaaccagaaaatattcaattagatctggtgagtcttcgtatttgttttccttagttctagcaaatagaatgtaacaaaattgaaagtaaaatagaaaactatagttttgttctgttttaatgaaggcgatatagaaaaaaagagatgagatgccagagataagaggtgagaggtgagaggtgagaggtgagaagggtaaagtggtcttaatatacaaaatacaaaaaatatcacaacagcttttttttttaggttagtttcttaattattaaatttttttggttatagatccaaatttctctacctttattcctatttttatttaataagatatatacattttttttataattattttctttacttttaatttcttttctataaaataaataagtatagttgtgttataatgttttagtaaatttatattttatttgataagatatatttatcttcttaccacacaatatggtccattaaaaagtttatttatgagccttttctgaaagtccttgtttgttctacgttgattgttgtaattcttcgtttatttgcgctgccgctaccgcttcttcaacctctcgtccattcctcccgagcaagctttgatctgtttcgcttctctcaggtttgtctcgaatccgaaagtaaattttagtgaagattgacatgttaaattgtttcttgtctgttcattaacgcgcggcacgtcgaaacttaacctagattttttttcttcttttaagaatcggaatccaaaatttgtcatagtgaatgattggattgagttgatggggataaagtagaaacactaattcggtggcactgttcagatgatggctttattatgatttctcgttgaatggttttaaatgttcaaatgtatatggttttaaatgttcaaatgttgtttgatatgaattaaatgtaggaaaattataaaatctgccatatttttcccaatcgttatgtaatctgccatatttcttcgggcattacaactcataccacatttggttgtgaaatgtccattttgttcccacggtttactgagcagttttcgcgctcaacaactgcgtctttttacaataccttttatctctttttcattgtaaaccgtgcggaaaaacaacaacagttaactctctctctttcgtctatctctctcatactttccctttccttcaccgataactttcatcggattatg

SEQ ID NO: 6137 - DNA, 3000 bp, Unknown; identical to SEQ ID NO: 6121
  misc_feature (1)..( 3000): cDNA_ID_1830072_gDNA_ID_1620847_Annot_ID_50953 3000 nt of promoter + ATG

SEQ ID NO: 6138 - DNA, 3000 bp, Unknown
  misc_feature (1)..( 3000): cDNA_ID_1830199_gDNA_ID_1620849_Annot_ID_50964 3000 nt of promoter + ATG
gaattattttttacttttagataacaatgtatactctatggtaacattgcatcaattatgaatggattggccaagtataaaatttaattatgattatacctcaaattcacactacttaaccatctattttcaggctattccattaattagtttttattaacacagtaatttatttgagaacagatttgaaaatattttgctaaactacttaaccttagactaactggaaaacaatatttaactaagtgtctgctaattaagaaaattaaagtatcgttcaccttctagacacactatgtcgattactgttttgagtgcaactagtgtattcgaaataatacttgggtgaattaagtttaagctttgagtaactaaaaattatatataaggatccataagttttgttgaaatagaataatcggaacttttacattcaaaaactttttcatatatatacagaaattcaacccccaataaacaaatgactaatgagtgatagtctgataggtgttaatgactgtcttaatatgagatacataagaaattttgaatggaattatttaataaatgtgaattatgtgggtgacttgactattcagtgttcactgaacacaaaaaggtaccaaaaaaattattccaatcagtgagagatcttcaaaggaaagattctcattcgcgccaatatttttgctgggaaaaggtaaaactttttagattattctataaattattttgctgatgttcccttacgaaaaaaacagtattcagtaccaaaatgtctggcacatataatcgtatagacgataagtagttgtcgaaattttatagggcaatggctcaagcaagtgaaacattgacacctagcccattcacatctatgtcactatatatgtgggttcacaaaggtgacgttttccttatgtgaatcatgtaaatgctataaagttttgtagtacatgagcgattatatattattacgaaactcctgaaatatatgatatataatcagatgggttgaggtagtgacaatagtttgtaagtgcaccaaaatacgttttgagctattaagtccgaagtttaggtccttttaagttatcgaaggtatgcttaaaaaaatttactaccttttagtttttttttgcatgatcgttattcgagaaacatgctgacgcacagattgatcagacgctgtggtaatccaagtgatagcaacaacacaaaatcatgtggagaatgatgatgatgatgcacatatggatttgcataaattttgtaatctccgaaatattgtggagaatgaaggaggagaaacataacattttaaaaatggataaagaaaaagaaagtgatggaaaaataagtatgtggtagaaaaatagggttccttcttctcatttgtctctttcaagctttatgatgcaaagcgacccttctttttcttccctttattttcttttattgttatcgttagtgtcactttctttttattaatttcataaagtcgtatgatcgtatccattgtttttattttgctccgacaggaccgacactgatctttctatatctttcggtaattaatgttataggattcctttttcagatcacatcatttgtattttatgttattttcgtttaacataatacactaataaaatgacttcataaaagatatggtttaggttggggaataaaagatatggtcgagccatacttctaatccttaatttaggttgatagaacatctaccgtcactaacaagtaatgaagtcagattaaaacttgatcgtgacaaaaattgtcccatatattttaaatgaacatgataacatattaattgaaaaatgttttagtgacttagttgtattgaatagcaaaggcaagtaagtagttatatacaatgactttcctatactcgagaagaccgtatccaagtaaatcaagaagatcgatatatatctagccggatctttggattgtcaagtgtcaacaatcttaattagatcaaaacagtctgttttaaaacatatgccaagttgtcaaacagaaaccaagcttttcatcactcaaaggagaatcacaaattctgcatggcgtgggggatagatatatatcatcgggagccactgagtccaagaaattgaatctattgacttcctattgctaatctatttcaaaataaccacgtcagagagatacgagtacatgtaatatcaatgagatattttcttaggagtaatttgaagatatttaatttgcggttgtaataatcccttttgaaaataatttgacttgtacacacggcaacaaaagaatgatctaaaggcaagtaacaagaatctgagtatccaccacctcttcctgttcctgttcttgttcctgttcgattccaaactctcactttctctgcccccctcgtgtctggctcccaccttttgtgtccactcaaccaacaacaacagtgtatctcttctcctccgttaaataactttatatttccccgttacatttccttattgtaacaaccaaaaaataattcacctgagactcacattctttaaggttttcgcatttaatatttcactttcttgaaatctcctatatttttgttatatatggtcgtcggcgatgccaacggcggtgaatgtagcgaaacaatgcttaacggcagaagcatcctacgcattagaagaagctgtgaacgttgcacgtcgaagaggacactcacaaacgacgtcgcttcacgctatctcagctttactctctctaccaacctcagtcttacgtgacgcatgtgctcgtgttcgtaactctgcttactctcctcgtcttcaattcaaagctttagatctttgcttaagcgtttctttagaccggatccagtcgggtcatcaacttggatctgatgattcaccacctgtttctaactctctaatggctgcaattaaacgatctcaagcgcatcaacgtcgtttacctgagaacttcaggatctatcaagaa

SEQ ID NO: 6139 - DNA, 3000 bp, Unknown
  misc_feature (1)..( 3000): cDNA_ID_1830191_gDNA_ID_1620849_Annot_ID_50966 3000 nt of promoter + ATG
tttgctcatctaaaaccctaacagaagtcgaattcatgaggcagaaatcagaagacggagcttccgccacgtgtctcctcgaattcgccgcctgtgatgatctttcatcgtttaagagagagatcgaagagaatccatcggtggagattgatgagtcagggttttggtattgcagacgggtcgggtctaagaagatgggttttgaagaaagaacaccacttatggttgctgctatgtatggaagcatggaagtgttgaattacataattgccacaggaagatccgatgtgaacagagtttgcagtgacgagaaagtcactgctcttcactgtgcagtttctggctgttctgtttctatcgttgagatcatcaagatcttgcttgatgcttctgcttcacctaattgtgttgacgctaatgggaacaaaccggttgatttgttggctaaagattctcggtttgttcctaaccagagtagaaaggcggttgaggttttactgaccgggattcatggttcggttatggaagaagaggaggaggaactgaagagtgttgtgactaagtatccagctgatgcatcacttcctgatattaacgaaggtgtttatggaactgatgattttaggatgtttagctttaaggttaagccatgttctagggcttattcacatgattggactgaatgtccttttgttcatcctggtgagaatgcaaggaggagagatcctaggaagtatccttacacttgtgtgccttgtcccgagtttcgtaaagggtcttgtcctaaaggagattcgtgtgagtacgcgcacggtgttttcgagtcttggcttcacccggcgcagtataggacacggctttgcaaagatgagactggttgtgctaggagagtttgtttctttgctcatagacgggatgagttaagaccggttaatgcttctactggttctgcaatggtttcaccaaggtcgtctaatcagtctcctgagatgtctgttatgtctcctttgacgctgggatcatcgccaatgaactctcctatggctaatggtgttcctttgtctccaagaaatggtggtttatggcagaacagagttaatagccttacaccaccaccgttgcagcttaatggtagcagattgaagtcgactttgagtgctagagatatggatatggagatggaacttaggtttcgcggtttggataaccggagacttggtgatctcaagccatccaacctcgaagagactttcggatcatatgactcagcttctgtgatgcaacttcaatcaccaagcaggcattctcagatgaaccactatccgtcttcacctgtgaggcagcctcctcctcatggattcgaatcttcagcagccatggcagctgcagtgatgaatgcaagatcctcagcgtttgcgaaacgcagcttgagtttcaaaccagctccagtagcttctaatgtctccgattggggatcaccaaatgggaagcttgagtggggaatgcaaagagatgagctgaacaagttgaggagaagtgcctccttcggcattcatggaaacaacaacaacagtgtgtcacgccctgctagagactacagtgacgagccagatgtgtcgtgggtgaactcactggtgaaagagaatgcaccagagagagtgaatgagagggttgggaatacggtgaatggtgcagcgagtagagacaagtttaagctgccgtcgtgggcagagcaaatgtatatagaccatgagcagcagattgtggcataagaagcagaaagaaagatgtgggatttatattgcttttgtcttctgggcctctctacacagaatctaacaaatctggcaataattctttgatttgtgtttgacccatagtttggttactagtatatgtttttttatgttctttttttctttgtcattctcttgtccttcgtgacactatgtaatgattaaaagcaaataattgatgcatgagttcaaatgttctttgaaggatccatcttattagctttgtaattgttgtgatatcttaatcttattggttacgtatttcaagtgctttagaaaaaatgggcctaagagattttggggagcttttttggcttgttattttcctcacatatacaacttgcagcttattatttattgaaaatcttttcttatctagattcaaaaagatttccacaaattttaattaacgacccctgattacaaagaaacctacccaaagtcaaattttgtccataatttctatcgtgtaggacactaaaaagtaaaaactcatacctaattggtttctagtagaaacggtcagtgcactatctttctttcaggttatcgaaggaaaaaagatcagtagagtagcatcgttaatagtagagttaagaaaagcatgtaacatgtggtctactttttatttcacagaaaaataccataccatgtgataatgtcgcataaaatctttacttttccggtgttatcgatgtgtgttaatgctaaatacccgaaacaatttcaagactcaattttgaactatcgaatagaattcttctaaaatggatgaggaaaaagtcgctggtttaagtcgtgcgaccctcaaaataaagttaggaatataatcacaagctgcatactttcattaatcaatttaaaaagaaacgactaactttattctttctttgccaaactccataattagttaagtctatgaatgaatgtgaagagagagttttacatttaaaattgtaaagggcaaattatagaaaattctgtgtccaccaattaggcttggctctttaactcactgttctcaatctttaataatccccatcttcttttctcctatatgattatctctctttccttcgtgcgtgttatctctctgagccacatgccgacacttacataactgttgaccaagtctctcttccttctttatcaaatcatgcaaccttcaagaacaagagtttcattttttgaaacaggagagacc

SEQ ID NO: 6140 - DNA, 3000 bp, Unknown
  misc_feature (1)..( 3000): cDNA_ID_1830180_gDNA_ID_1620849_Annot_ID_50969 3000 nt of promoter + ATG
aaattatagagaaaggtaatttgggcaccgacgtgaatttgactaaattacgagagagaaagaaagagagacttggtcacgaaggtgttaattagcatgaaagagagagaaataatcgtcgttgaccattgaccataacttagtcagtcatatatataaaaatccaaccgcccactattgttcccctattcacaaggtccttgctttctcagacgtaaacaacaagaaattatattaacacaacaacaacaacaaaaagaccaaccctatttattcatattttctcttatatgcaactctcaaagaatccgatcaaacaaacgagaaatcgagagaagaattacaccgacgatttcaccatgaagagatctgtaatcatggctcctgaatctccggtttttttcccacctccgcttgttttctctccgacgtcggtcaaaacgccgttgtcttctcctcgttcgtcgccaccgaagctgacgatggttgcttgtcctccaagaaagccaaaggagacgaagactacgggttctgattctgaaacggtgttgaaaaggaaacgaccaccgatgcttgacttaacggcggctccgacggttgcatcgtggtgcagtacgacgagagagacggcggagaaaggagcggaagttgttgaagcagaagaagatggatactactctgtttattgcaagagaggaagacgcggaccaatggaagataggtatttcgcggccgttgatcgtaacgacgacggaggttacaaaaatgctttctttggggtatttgatggtcacggcggatccaaggcggcggaattcgctgcgatgaatctagggaacaatatcgaggcggcaatggcatcggcgagatcaggagaagatggttgttcgatggagagtgcgataagagaaggttatatcaaaacggatgaggatttcttgaaagaaggttcgagaggtggcgcgtgttgtgtaaccgctttgatatcgaaaggcgagcttgcggtttcgaatgcaggcgactgccgggctgttatgagtcgtggtggaaccgcggaagctctcacttccgatcataatccttctcaagcaaatgagctcaaaaggattgaagcattggtgagttttatccttgtgcattggattttgattagtaacatcacataattgtggaattgcatttcaaaaaaaaaaaatcattgaattcgtggaaaaagcgactctagtaaaaatgcggttgataaaatttttgcaaattggagaatcattctaccattttgcgttcaaaataatgttttagtgcggtttggtttaatttgtgtttggtttacttatttttgaatgtgtgtagggtggttatgttgactgctgcaacggcgtttggagaattcaagggacattagcagtctcacgaggaattggagaccggtacctcaaggagtgggtgatagctgaaccggaaaccagaacattacggattaaaccggagttcgaattcttgatcttagcatctgatggcctgtgggacaaggtaagcataacaagaaatgcatgatttcaaaaatttgattttcatttttggtctttggatttaatgttgaagctggtttgtcctataggtaacgaaccaagaggccgtcgatgtcgttcgaccgtactgcgtaggcgtagagaatccaatgacactttctgcttgcaagaaactggctgagctatcggttaagagaggctctttggatgatataagtctaattataattcagctacaaaactttcttccatgatatattaacacatagtacattagctaaacttaattaatttcattaggtcgtagttattaataaattttgttcggtattttacatgtaaatacataaaggtttggaaaataattaatttattgttattgttcttagagataagctccaaaatatttttggtttacgatataaacactacataatacatgaaattgcactatctaaccatttatcatcctttttatcctcaacttttttattctcatgcattttgaaaaccacattctaatcatatttctgcttttatgtgtaaaaccaacaaagatgtacatggttgatatacacacgtagacataaccttgacaagcaacatcttcgtcgttactcattttacagatttctacccatctgccttcaataaaacaaacatcaaccatattagtaactgcatggtaaccaagcatacgtgagtttttgttgtaaggaccggtaaacactttgaacctataaacacctccgcctcttccaacaactcagaataatgaacaagatcacatgctaaggttttgtaatgcttcttacaaacaaaagtttatttaaaaagggaagggagagtttataaaatataaattagcattgacattggtgtgaggttcttcacataatcatatcattctgaccaaaatattagtcggaaaatggttagaaacacaccaatatgagttgttttcttgtagttctgagaaaacatagatgaaccaatatatcaacgtaagtaactaagataaattgtgaatcatgagaatgcaagaaatattttctcatgattacatgagatgaaatactaccttacaattcatcaaactttttgtagaaaaaggtattgaagaaatgaaaattggatgtagacaaaaaaataaaaaattcttgctgcaagatcctggacaaagacaataatcacattaagaacaatgtaaattttttaaaattagtaaaaactctctataaattaataattcacaccatttaaattttagaggaggtgatgaaaggacattatcatcaattttggtagttaacccccaattatttaactaatcaagatacaaggggtacaactgtaatatattcatagtttggtgtgttttctacaatattcagaaacacgatttaagacgattgaaactaaaaataaaaagtgtcggacttgtaaattttcgctcagcgatctgcttcca

SEQ ID NO: 6141 - DNA, 3000 bp, Unknown
  misc_feature (1)..( 3000): cDNA_ID_1830167_gDNA_ID_1620849_Annot_ID_50976 3000 nt of promoter + ATG
ctaattaacatcttctatagataatttgggaagagtagagtccaattggcctaattgggtgatggattttgttgtagagaagatcgttaataactaaaaaaatatcgatttagaaggacattttacttatgaaaaaaaaaaaaacagaaggaagaaaaactaaaatttagagttttaggtgatgtttgcagttttgctccaaaaaaaaataaaatgatgtgtgtagagattttgattaagaacaataataacgttttaaatttcagtcaaaaacattattccacagtcattgtttgattgaatacattttgtttgtgtcatcactgaattccccaaagtaaaaaataactaattttcaagcatcacatatgaaacgaaattcctaatttttaattcgacaagcaacctacattccacgaagttgccctggtccaaactttattcgtttttattataaaaaaattgcgagcacgacttttgtcctcatggtaatataataatgtcagaccaaaaaacgatataaaagtgactacgaataatataatatgcaattgtggtttcaatacctaaactattgggccatactgattgattacttagctgcagtgactatgcatgcaaccccatgcataatacgtacaaatctcattattattatattcctctcggttcacccctaatttattctttccgattaatatatttacgttcacatatggttgcacattatttgaagtacaattatataatatattacttgaattttcttcggtctagtgtacactgcgtatatagtttctacaatctcagatcttcagttcaaaccctatattataaaaaagttatagccttataggtaccgaaattttaaaagttgagagacataaaacacgaagactttggtccacgcttagaatttgattggttcatttcatatatgtgtcaaggaaaatgaattagcatagtgtcgtggtcaatttcaacggattatataacttagtaaatcaataccgtagttaatataccctttttttgtcaataccgtgattgatattaatacttagcatttggtatctgttgggtcgtataattgatcatgggttgtctgagcatggaagtaggattatagggtagatatgaagaacgtcattctaacgtaaattattattgctacacttttaaaaccaaaatatacgacagctttaattcttcctaccaattaataacgacgacgaaaatatacgattacggctggacattgggcttccaaaaacgattttgaaaaaaaaaaaaaaaacagaaagaaatgtcatatacctaatttatttgaccgatgactttcacattatctggtcaccattcacaaaatttgacacagtacttgcatgtcgcttacaagaaaaattagcctgctgatgttagaggaatacagatagatacaattctgccttgaccctctcctggaggcgcaaagttcatgacaataagtaaatcatatattatacattttaattttctcctttctaagttcttaaaaaagtatgacatcccctactttgcctacttccttaatttcacaaaaataaaagtatgacatacttaattagaacatatcttttgtttagtattttactagtaattttaatagtacgtacgctatatagaacgaactaatcacccctgaactgaattccaaactaaatcaattggttgcatgtgtgtacgtacagaaactcatataattctcaagttcaattctgtgataatcatgtgacttattagcttcagttgttatattctgtatcctaatttatttatttattttttaacatttatttgggttatatatagaaaaagagatgtactatttgcatgtatatagagagaggcgcatgtgtagataattatagataatatgaaatcgtaagagtagtggagatggagacaaacccgtgattgtcgttggtgacagaaacaagtagtaatattttcttctcgtgtctttcagtgaagacagcccagccaagcaccttttaacttctgtctgattcctctctctatgctctttctctgtctatctatctaattatgcttttgggtttcttctttttctggtttcacagctttggctttgaagtcacgagcccatccccctaaccatccccttttatgctttgcttttctagtcaatttaattcatgagttgtaacgatggaagaagtttcatttatctaattaatgtgtatgcctcattaatgttgccttcttcctatattgctaaaagctagttcgaatgaaacaaaaacacgtaccaaatccaatgaaaaacatagatcttcagttggttttgaaagaaagaacaaaaaaaattgttaatgtacatgtcatattgaaccctgatttatgtcataaaattggtatacgtacgggttgatatcatgaaaacgtttgatcttttaccatgaaaatgatcattatttagataaattcaatctactccttggaatttcttttcactccctatcacaacgagattcaaagattaattgtactaattgacttaatagttattaactcattttaaaatacatcttatgactgaagttactaatgtttaatgaaattaaaagtaccatttttgtcatgaggtgtaattctagatctatctttccctaagatgtatataactgtagaaaaaaccattggtgtaataaaaagctatatattaaatagaatttagaatatccgttgccatcatatacatatttcaacatatatgttgagttggagagagagggggagaaaaaggaatgatggatacaagcatccaaaaagtcatacacatagaccatcaaaagtcttcaccttaaattcctaacacatatgtatgagtgtgtgatctttgtttgatctttgtccagagaactccaagatagaccaaaaaggttcaacctcaaaacaaacaacacaaaaacagccaaatagctagagaccaagatg

SEQ ID NO: 6142 - DNA, 3000 bp, Unknown
  misc_feature (1)..( 3000): cDNA_ID_1830163_gDNA_ID_1620849_Annot_ID_50978 3000 nt of promoter + ATG
tttggactgccaaatgtggattcgagctctagtttagtttgctccggtttaaacgcaattcatgaataagcaaaggaaatcaatccaaacttacgttgtgaaagaagttgggccgaaaatgtctgaaacccgaataggcttttaacccctaaccccttgaaactatcttgtggcccaattaaaacctaattgtttaactgacacggtgccgtttaacttggcatctttgacgcaagtcgactcattttccgtttgtgttccttgctcatttcttatctctagaaacctgtctgatttgctccgtcgcctaaaaagtctaaaaccctaagtgtctccgcctcgtagctttacccgattcaacgaagagtgaattcgcgtgagctcaagcagtatcgaaatctaccaatcatggcgagtcaaacaccgaatctcgagtgtcggatgtacgaggcgaaatacccagaggtggatatggcggtgatgatccaggtgaagaacattgccgatatgggagcttatgtttctctcctcgagtacaacaacatcgaaggcatgatccttttctccgagctctctcgtcgtcggatccgaagtgttagcagtttgattaaggtcggaagaattgagcctgtcatggttctccgtgttgacaaagagaaaggttacattgatctgagcaaacgtagagtcagcgaggaagatattcagacttgtgaagagaggtataacaagagcaaacttgttcattctatcatgcgccatgttgctgagactctttcaattgatttggaggtaaaatatcgtagttcaaatctgggattatctactggatttggattttgcttgttagagatattatcaaatatcatagcttagtgatgtgatcgttgaatagaaattgatttgagctttcatgttgcaggacttgtatgtgaacattggttggcctttgtatcgacgacatggtcatgcttttgaggtaagaattttgtgaattggagattcattgtgtatctctatggttatttagttctcatatataattttcttttgttcaggctttcaagatcttagtgacggatcctgattcagtgttgggtcctctcacccgtgagatcaaagaagttgggcctgatgggcaagaggtatatactttgttctctggcattgttttagcggttagtactaactttatttggtgctaatcttacaagttttctgtttgtaggtgactaaggttgtacctgctgttacggaagaagtgaaagatgcacttgtgaagaacattaggaggagaatgacaccacaaccaatgaaaatccgggctgatatcgaattgaagtgttttcagtttgatggagttgttcacattaaggtcgtatctcttattagattatctttaacttgtgaaatgaatacattatgatttcatttgattttctcacccatgcttgtaatttcaggaggctatgaaaaatgctgaagccgctggaaatgaagactgtcctgttaagattaaattggttgctccacctctgtatgtccttactactcagacacttgacaaggttaggcaatcttctatcttgcactatgatttacttggtttggtaattggtatattatagaaatcctcccctacttatctttaagaggtttatgatctctgtttagattgtatatccactaaagctacttgccagaattttgaaaacactgtagttgcaaggaaagtaaatgcttaagaaaacactggacattgcaactttgtttgccaattatgtagctctgcggatttgtcttcacttaaaccataaatgtgtaaatgctatgttttgtcccattttatcttctcaatttctcaaatattaaacaggaacaagggattgaaattctaaacaaagccatagcagcatgcactgagacaattgagacacacaaaggcaagcttgtcgttaaggagggggctagagctgtgagtatcttaaattagttttttttaagtgatgaaccgtctcgagttgcatgtcacaagaacgagcttttcttttgtgttttgtttaatttggttcacaaccgcctattaatgtttataatctatgtcaaatataggtgagtgaacgtgatgaaaagatgctgacagaacacatggctaagctacgtcttgacaatgaagaaatgagcggcgatgaagatagcggagacgaagaagaggacactggtatgggcgaagtggatctcgatgcaggtgccggaatcatcgagtaagattgccggatttttctttctattaaatctacccaatctcaacagtcccagtattttggtttaagctttgacaaggcagtagaaaaacctccgagaggatttatgtgctttttgatgactctgaggcattttattttacccatagggggtggttacatatcaatcatacattcatggttttataaaagatttgattctttgcatatgttactactgctcaagaatatgttgctccaccacatgactcattattatcttaggaaaactttggctcaatatgatcatacttttgagtttaaacctcaggaaagtaggttgattggatctggcaatgataggtgtgtagatttaattcagatctgatgtctccgaagatgcagatattcatcaattactactgcgatcttctattgagaaaatttaccaaaaatgaaattcttaaaaatcctctgtctgatacataaatggttaacttgcaattgattcataattaaaatgatttattacaagatcaaacatcttgtcttatactactaatcagaaaagaaaaattctttcggacacaaatccttttttaatctgtcggcgcattaaaaattacttaagctctctctgcaaaatcgaaatgtgaaagttgcgacttttggagctcagctcagctcacactttcctcttcctcttacctgaaacgcgtctcgtaacactgatctctaatgatcttcgtctccaatg

SEQ ID NO: 6143 - DNA, 3000 bp, Unknown
  misc_feature (1)..( 3000): cDNA_ID_1830159_gDNA_ID_1620849_Annot_ID_50979 3000 nt of promoter + ATG
ttttagtggtaatgattttgattggttaataatatcttgttatgaagatttttgagtgtatatgttttttttttgttctctcctctaaaacagaatcttcaatttgaggaatgtgccaatcatatttaccaattacttgttgtttttgtttgttttaatttaaattgcataaaaccaaattgttttccttatgcactctttcttatttgttccaattttaagggatatttaattttagtattttagttgttctgttaacttttttattcactaatcacaaattacaagagattttctattaaataaatgattatttacttaattaagtaattagtgaaagagattttgaagctgcaatttcaattttcatcacataaaacaaaattatacagcttcaaaacaaataagtcacggataaacaaaattccagcaacgacaaaaagaaaaagaaaaaaaattccagcaacgcagttgaaccacaagcttgccacgcgccatgacccatcccacgatctcgtacgtacacgtgtctctcatccgcagcctcatcatcaacacatcacaatctcacttttacatatatctccctcgcctcacgaaaaatccattcgtcttctccaattttctcgcgaagaaaactttcctactttgtttcaatccaaacgagtcaaaatgcttctcaagactgtttcttcatcttcttcttcagctctctcgctggtgaatttccatggcgtgaagaaggatgtgtctcctttgttaccttccatttcatcgaatcttcgagtttcttctggaaaatctggaaacttaactttctcttttcgcgcatctaaaagctcaaccaccgacgcgctaagcggcgttgtcttcgagccgtttaaggaagtaaaaaaggagctcgatctcgtccctaccagctctcatctctcactcgctcgacaaaagtactcagacgagtgcgaagccgccattaacgagcagatcaagtaggttattctttctcaccccagtctcttagattcggtattataatctggttgattggctataagatttggtaacttggaacctcatgttgattctgcttattgtttatgaacctgtgaatttgaaattcttcaatggattttggttgcagtgtggaatacaatgtctcgtatgtgtatcacgctatgtatgcttactttgatcgggataacatcgcgctcaaaggtcttgccaagtgagtctccggttattcaagagtgttgatattttcggattttttttgtttatccatagttaattgttggtttcatggaatcaggttctttaaggaatcaagtttggaagaaagagagcatgctgagaagttaatggagtatcaggtcttatgaaagttatttccatttgtttaccttattggagctaatttggttctaacatgttttagtttttttccatgaattgcagaacaaacgtggtgggagggttaagttacagtccattgtaatgcctctttcagagtttgaacatgttgacaaaggagatgctctttatggtaagctcaaaaatgctaacactaataatcccaagtgaaaaaacttctttagtttcatatgtctgccacattctaagaaattagatattgacaccaatgattttgttaagcttttgaagagattgcatattttcactagcaaagactgaattttatctgagttcttaagtattatgaaaatgtatctctcatatggagattcaagtctcaatggatataggaattttaacatacaattctgtgatttgttgttgcaggcatggagcttgctctgtcactggagaaactagttaatgagaagctcttaaaccttcacagtgtaaagaccatctcttcttgagttcatactatatatgtcaaatccgtatttgagaagtaaatctaatcttcactcggcaagaactgttctcagtttggtaatgctttgcttcaacaggttgcttcgaagaacaatgatgtccacttggcagattttattgagagcgagtttctgacagagcaggtaatttatttggtgttctatgttagtggcaaagagctactgttgtatataagctatcaaagagaatctaataggaatttttgataaaataaaacatttctcaggtggaagcaatcaagttgatctcagaatatgtggctcaactgcgacgagttggcaaaggacacggtacataaataatctctcacattttgttctaatctataaatttataaaagaacaagaaaatccacttattcatcctacgtcgtgcctcaaacttggttttaatatatgtctttgaatgcttgtgggtaatttcaggaacatggcatttcaatcagatgcttctggaagggtaagcagcttcgagggactcttgtgtctactgtgtttctatatgtgtctactttatgtttagttctttagcttttacgattttgtgaggtagtagacttctttttctgtaagagacaaaagacatgatcacataactttatattctggtataaggttcatcaaacccacctggtgatcgattctacatcggttcggtcagaatgtttttggactgccaaatgtggattcgagctctagtttagtttgctccggtttaaacgcaattcatgaataagcaaaggaaatcaatccaaacttacgttgtgaaagaagttgggccgaaaatgtctgaaacccgaataggcttttaacccctaaccccttgaaactatcttgtggcccaattaaaacctaattgtttaactgacacggtgccgtttaacttggcatctttgacgcaagtcgactcattttccgtttgtgttccttgctcatttcttatctctagaaacctgtctgatttgctccgtcgcctaaaaagtctaaaaccctaagtgtctccgcctcgtagctttacccgattcaacgaagagtgaattcgcgtgagctcaagcagtatcgaaatctaccaatcatg

SEQ ID NO: 6144 - DNA, 3000 bp, Unknown
  misc_feature (1)..( 3000): cDNA_ID_3079655_gDNA_ID_1620849_Annot_ID_170296 3000 nt of promoter + ATG
tgtcagaaaatgtaagaggtattaaaatcacactctgacagcatgttatcttaatgtatattatgtagctcagtagagaatgataaggttgcagattgcacaatgcttttgtgctaatgaagagttaaaccatcttaaaaatctaatcatttgcagggtatgatgtatgcacttctctagggcatgcctcaagcacaaaagttgatattattggtaaggtttaagatatgtgaaaattgagactattttcaccctgtgttctaagttgtgaaaaagctaaattgttaatgctgttttctcccaacttcgtttgcaataataatgtaataaatgtgcctcaggatttttgttttgaatatggtagataaagaggatcctggcaaaggcgtcattgttcagatgtcaactggaaataggaaccaaaattgctcgctttcagtttctgttatttgccagaaaactaaagttgatgtaaggatttgtatatcagacatcctacttaagcgtatgaattgaagttgattttaggagtttttaagacgtaaaacctcgttcaccattttcttttctcagggaccactcactttggcgaaatctggtacctgtcagtatgtgagtgttcagtaactcatctatttgctcttttcctgtagctttcaaattaccaagtgtgattgtttcttttgtgaattttatgggttttaagtttgaaaactgagtttttatttgcatctcaatatcttgattcttaagaagtatggactctgggtagttatggtcttgtttcactgacaggctactcagctgcgacatcctgccggttgtgcagcagctatatccggccatagtagtggatggggctggtttagtaccttactaatcatgtgagcaaaccaatctttttaatgtgaggcctattggaatatgtttagatatcgtgggaatcaaaaatgaaatgttcttatctttctcagtatcttgtgcctgtttggagcttatctggtgggtggtgcagtatatcggtatttctcccttggaattcgtggcatagatgtatgtttcactaccttcctttatatatgcaagtttttctcatgtactgattctatcacaattgaaatgtaaacaccctgttttataggtaatcccgaatatggattactgggccactgtacctcacagtatacaggtattgttctgtgtttctatattctcttctggtagattggtgtctaagaattaaatttaatgagcttacgtttcctcttcatcttgcagagctgttttggctcactattttcaagattcggggggtctattcgtggtcagcaaacctcatattctcaggtcaacttctgagcagtctcagcatcttctctgatccatggtctggagacacatccccaaactttccttgactggttcaaccaattgcaaacgccgctagattgttataccctgagtactcttttggccattatatgactgcaagttataaggtgcctctccttttcagcttgttatgtcatggatccctgtagaaacaaaagaatcttgttcattggatagaaacaatgtcaagccattgcaatctgcagcctttcccatttcgtgtgtttgctctttggagattgtttcagtttcttgatgctgattttgagtaatggtaaccgatgtgttgatgttttagcacattttgcatccgcttggcgttggataagtggatatctcttttctttcagtgagttttctgataggcgagtgatcaatgtttaggatagagatgttgcaattgaccaaaaatccacgaaccagattgttcttttagtgatctcggttaaatttgagccgatttagaaactggtctagctgagccaaaccggtcaaactggccggtccagtcgtcataatatacagtagttgccaatgaagcttcttgaaagcatctctttgtacaattttgagtattgtagcatctaaagaaacattggcttagtgttttgttttgttggacgaagagtgtgtacaaagaggaaaagtgagagccaacaacttgagcttgaaagcccaacaatttctcaactaattccactattcatttcatcttgaactctctcctgatagttactatataaaaaaaaaaaattatagaccgataattaagattttgtttgatctcacattgttcagtattaattttaataaatgtcagttttgttctatattgttttctaagtaacatcaaaaatccattggacaaaggtaaagacaacgatgtctcatctttacaaattgatcaactgtacgaaaacacctcaaggacacttagcttagaagccaagtgaatttatattcctcacctccatcaatcatcatctcaaagtttccaatagcctaagaaactaataatttttgttcctttttgacagatattagaagagtattcatagtaaaaaggacaaaggaagccaatgatttaatcataaccatctaggttggatttaatcaaatacaaaacggactagatgtagtccacagtgaactcagtgattgtttttgtcttaaaatcaaggtaaatcacatgattacttaaaaacaaacagagatatacatttttgctgaaaacacgaatgtgtatataaatggattaaatcttacgaaaaagcattagttagtagacaaccactctgttgcgtcaacatttacctactcatcactcttaagtatacttcctttgctaattcacaaaaatttcatcacctaatataatcataaccatattataaatagtttaatcattgtacaattcacatctttagtatttcttgaagcaattccaaaataaagttcttttggcttcctcctcccacattcttatttggttgaggagaatgagatcatcaagaacacaaagtgttcatttcttaattttatctcctcttttcctaataatataaaatttgaaatcacatttgtaacactaattctcaaatcctaaac

SEQ ID NO: 6145 - DNA, 3000 bp, Unknown
  misc_feature (1)..( 3000): cDNA_ID_1812409_gDNA_ID_1620849_Annot_ID_170294 3000 nt of promoter + ATG
gcgtcaaagatgccaagttaaacggcaccgtgtcagttaaacaattaggttttaattgggccacaagatagtttcaaggggttaggggttaaaagcctattcgggtttcagacattttcggcccaacttctttcacaacgtaagtttggattgatttcctttgcttattcatgaattgcgtttaaaccggagcaaactaaactagagctcgaatccacatttggcagtccaaaaacattctgaccgaaccgatgtagaatcgatcaccaggtgggtttgatgaaccttataccagaatataaagttatgtgatcatgtcttttgtctcttacagaaaaagaagtctactacctcacaaaatcgtaaaagctaaagaactaaacataaagtagacacatatagaaacacagtagacacaagagtccctcgaagctgcttacccttccagaagcatctgattgaaatgccatgttcctgaaattacccacaagcattcaaagacatatattaaaaccaagtttgaggcacgacgtaggatgaataagtggattttcttgttcttttataaatttatagattagaacaaaatgtgagagattatttatgtaccgtgtcctttgccaactcgtcgcagttgagccacatattctgagatcaacttgattgcttccacctgagaaatgttttattttatcaaaaattcctattagattctctttgatagcttatatacaacagtagctctttgccactaacatagaacaccaaataaattacctgctctgtcagaaactcgctctcaataaaatctgccaagtggacatcattgttcttcgaagcaacctgttgaagcaaagcattaccaaactgagaacagttcttgccgagtgaagattagatttacttctcaaatacggatttgacatatatagtatgaactcaagaagagatggtctttacactgtgaaggtttaagagcttctcattaactagtttctccagtgacagagcaagctccatgcctgcaacaacaaatcacagaattgtatgttaaaattcctatatccattgagacttgaatctccatatgagagatacattttcataatacttaagaactcagataaaattcagtctttgctagtgaaaatatgcaatctcttcaaaagcttaacaaaatcattggtgtcaatatctaatttcttagaatgtggcagacatatgaaactaaagaagttttttcacttgggattattagtgttagcatttttgagcttaccataaagagcatctcctttgtcaacatgttcaaactctgaaagaggcattacaatggactgtaacttaaccctcccaccacgtttgttctgcaattcatggaaaaaaactaaaacatgttagaaccaaattagctccaataaggtaaacaaatggaaataactttcataagacctgatactccattaacttctcagcatgctctctttcttccaaacttgattccttaaagaacctgattccatgaaaccaacaattaactatggataaacaaaaaaaatccgaaaatatcaacactcttgaataaccggagactcacttggcaagacctttgagcgcgatgttatcccgatcaaagtaagcatacatagcgtgatacacatacgagacattgtattccacactgcaaccaaaatccattgaagaatttcaaattcacaggttcataaacaataagcagaatcaacatgaggttccaagttaccaaatcttatagccaatcaaccagattataataccgaatctaagagactggggtgagaaagaataacctacttgatctgctcgttaatggcggcttcgcactcgtctgagtacttttgtcgagcgagtgagagatgagagctggtagggacgagatcgagctccttttttacttccttaaacggctcgaagacaacgccgcttagcgcgtcggtggttgagcttttagatgcgcgaaaagagaaagttaagtttccagattttccagaagaaactcgaagattcgatgaaatggaaggtaacaaaggagacacatccttcttcacgccatggaaattcaccagcgagagagctgaagaagaagatgaagaaacagtcttgagaagcattttgactcgtttggattgaaacaaagtaggaaagttttcttcgcgagaaaattggagaagacgaatggatttttcgtgaggcgagggagatatatgtaaaagtgagattgtgatgtgttgatgatgaggctgcggatgagagacacgtgtacgtacgagatcgtgggatgggtcatggcgcgtggcaagcttgtggttcaactgcgttgctggaattttttttctttttctttttgtcgttgctggaattttgtttatccgtgacttatttgttttgaagctgtataattttgttttatgtgatgaaaattgaaattgcagcttcaaaatctctttcactaattacttaattaagtaaataatcatttatttaatagaaaatctcttgtaatttgtgattagtgaataaaaaagttaacagaacaactaaaatactaaaattaaatatcccttaaaattggaacaaataagaaagagtgcataaggaaaacaatttggttttatgcaatttaaattaaaacaaacaaaaacaacaagtaattggtaaatatgattggcacattcctcaaattgaagattctgttttagaggagagaacaaaaaaaaaacatatacactcaaaaatcttcataacaagatattattaaccaatcaaaatcattaccactaaaaaaaaaacacaattttagttgttaattagtaaccataatccagttcttctacctgttcattgagagatgctaactctatataagctgataatgtaggctaacacttctcatcatctcttagaacaagtattgataaacaacaattttttttttccatacaccttaaactcaataataag

SEQ ID NO: 6146 - DNA, 3000 bp, Unknown; identical to SEQ ID NO: 6143
  misc_feature (1)..( 3000): cDNA_ID_3079662_gDNA_ID_1620849_Annot_ID_170292 3000 nt of promoter + ATG

SEQ ID NO: 6147 - DNA, 3000 bp, Unknown; identical to SEQ ID NO: 6142
  misc_feature (1)..( 3000): cDNA_ID_1830163_gDNA_ID_1620849_Annot_ID_170291 3000 nt of promoter + ATG

SEQ ID NO: 6148 - DNA, 3000 bp, Unknown; identical to SEQ ID NO: 6141
  misc_feature (1)..( 3000): cDNA_ID_1830167_gDNA_ID_1620849_Annot_ID_170288 3000 nt of promoter + ATG

SEQ ID NO: 6149 - DNA, 3000 bp, Unknown
  misc_feature (1)..( 3000): cDNA_ID_3079672_gDNA_ID_1620849_Annot_ID_170281 3000 nt of promoter + ATG
aaccccttcgtctccttcctccgtctcttcctcttcctcctccgtctccgccgcttcttctccttccacctcctcttcctccactcaaaccctaagacctctcctccctcgccccgccgccgccaccgtaggaggaggagccaactttggtccgtacggtatcccttttaacaacaacatcttccttaatggtgggacctctatgttatgccctagttatggttttttccctcaacaacaacaacaacaaaatcagatggtccagatgggacaattccaacaccaacagtatcagaatcttcattctaatactaacaataacaagatttctgacatcgagctcactgatgttccggtaactaattcgacttcgtttcatcatgaggtggcgttagggcaggaacaaggaggaagtgggtgtaataataatagttcgatggaggatttgaactctctagctggttcggtgggttcgagtctatcaataactcatccaccgccgttggttgatccggtatgttctatgggtctggatccgggttatatggttggagatggatcttcgaccatttggccttttggaggagaagaagaatatagtcataattgggggagtatttgggattttattgatcccatcttgggggaattctattaatttgtttttgtggaagatcatattatatacgatgagcatccctaaggtcggtcaagagcattggagattcattgttgagaggaatcaaagagattgcattctatgaggagctctgcatgcaaaattttggaggatttttttactacctatagagataaataagagggtatttttattatttttttgaagatttttattttcaaggaattcgtaaaagagattacggttccaataaagtatgtatatgtggaagagaatcggaggagatggtggaaagttgtatgggaattttattggttcaacacttccttcacagtgtgcctaccttaatatataattattgataggatatgataatttctgtttggttgttcgagtttcagaggttatatatagttatattttgtttatctctgagaatatttacacatatctctattaagttttagtaatataggaatcatcaatgtagaaactatggagagaaacacgttttcaaaaagtgttcatcactggatgcataattgttgtcgttgagaagattatttacattattcgagctgggtattctcacaccaacacttcatattcaagtttacaattttttgtatcgatcatccttcaaagtgtttggacatgattttgtccgaatcctagctttctttgactaaaaagagttctccgtttctgtatttcccttgtcctgtgatttcttgtttactatggtgtttattggaagttgacaagaaaaaatcaattttattttttgtttatgattatatttcgaatcttttaacagtattatacaaaatttaaattaaaaataatcccatatctgactgggttatacatgaatatttcaatattaataattaatttaatttataataattatatatacaaaacacaacaaaatagattattatattttcatttgttatatgaaatcacaacacttttctatatcttggttacgtaataatttaagtgcacaaatatgggtatggtgattcatatactagatagagattgacataaacttttctagaaccgattattttggtaatcaaatcatacaatgttgtttatgaaagatcaccagacaatgtggaataaagcttagttttattgttttcctctatatcttggtattattgaaatctggcaaagtagtaccaaaccgaatccaaaaaaaacaaaatcgagaaacaaagagagttactacgtacacaaaagaaaacattcaaccacaacaacacaacgatgagagaaaaaagatcgctaaacaaagaaaaagaaaaagatacaagatgtccattagagttttaagaatatattattctcttatatttttcccttaaaagtattgttgtttcagttttttgtataaaacaattataaacaattctcagtttagagtctcaatgtaataacaagaaaacatctgaagtaaaaaaaacaatttataaataaagaattcaagagtcaacttttatgtatacatatggtaatacatatatatatatatttaattcatactatgtaaatatgaaaatgatacttacactgaagaaaatgtatagtcaacatttagtttccaaaataattatctaacactatgaattaatatgattcacaacaatgaaaataatgttagtcaatataatcattagcattaaataatgacagaacaattaattaaatcatcaatttggtatattgactaggacctaaatttggacagaaattcagttatttcaattttctgtaatagtacaattaaccacataaagattttaacatgttaatggtttgatttggattttagtttttgtttactagtattgtttttaaagaataatcaatgtaaaaccaaatccaatatagtttggtaaatttttaattagctttgaattcagttcttaaacttttacttttttagcaaaataagtttcatttttagtcaattttctatggtatttatgatatttgaaaataactttataaccaaaacataggaaaattctagtttttgagttgatattttcaacttggtttagatctaaaaggtttggtttaactaaaacattaccatagacattcaatattttttagtaagtagcaattaattttacatcttttgactagtatcattttccaaaatctcatcttttcaacactatttaaacggattcccgcgctaatcttcattcatatgctcaacaacatttaaaattttaaaagagagaaataaaaatcgaagagtgatcatgacaagaaagaaagtaaaacttgtatggatcgagaatgacaagtcaagagcaacaagtttgcaaaaaatg

SEQ ID NO: 6150 - DNA, 3000 bp, Unknown
  misc_feature (1)..( 3000): cDNA_ID_1840930_gDNA_ID_1620849_Annot_ID_50980 3000 nt of promoter + ATG
gcagtcgtcgctgttgttgatttcacatccgccgttggttcaatcgaaatttcaattgtacccttaatcttagtaattcttacgaataagccgcataaattatttttgtatatcatttgcaatttgaagcctgaatgttatcaactatgggccttctcaaatctcaaacggcccatttaaaaaccgaaccagagtatggttcaatttagtttcttcagatgaaccggatttattgaatttattcagagatttatgtagaaattctttcgtccaattgtttaatcatgtgtttctattcgattttcagaaaatacaatttcttgtagattatggatgttaattttttattttatctgaaagcttatatacatatttatgttttaatttggaatttcggttataaaaaaaaacattatcctatacatcaaataatttggtttattcataaatgaaagtatcatatacacaacacatcgttattattttgatggctcgtcaaatcaattcagacaatgttgaggaaccattttaccgctcatagaaccatcaacattttcgcaaactgcaatggaagaactattttcaagtccattactttttatgttaatgtcaattagctcaatattcttgcacggaaagcttttgctacattgaagattcattgccactttgttctttgacgttccatatatgttttttaacttaagatcttggatttgaacgtgagactctccctgaagaaaaataaacacaagttgtcttttatatttttgttcttattcttttgatgaaataagagaatgatgaagcttgttttttgaatagaatgttaaccttttgctcatgttcacaaggaggatgaggacaatacttctgatcgatgttgattggttttccaacgtcaatcatctgaatattctcgtacacaaagttcgaaacgaggatttttgaagctgaagattcccaagtcttgatccgaataccatcacttgtaccgttgaaaatgacgtctcttactgttaagtttttcacgtctttctcgtctttgttcttccctaaacttccaacactgatcccatgtccgggaccacatttaacattagagatatcgaggttagtggttccagagagaatggcaatacaatcgtctccggtaccgatgtttgtgttggagatgtgcatgttgctacatgaacccatcttgataccgtcggtgttaggactatcaccggaagctgttatagtgacgccggtaatattaaagtgatggacggagaagaagttgaaatgtcccattttgctgttgagtgatgttatgtctttgatatttgagttgttcacgaatgcaaatcccatagtctataaaaaaattcaagtttattataagacttgttaatttctcaaatgaaaaagaccaaaaattctaataaagttgtgtataaatatcacatgtacgttttgtaatacgctttaaatgtaaataagtgaaaaagtttaagatatgttaccatagctagtttaggacaattgagatttttgtggcagtcattgagtggccaagattgttttccttggccgtcaagtgtaccggaaccggagatagaaagattgttgatgtacctaaagttgatccatgtatcttgcttaatatcactaggatttgcaggagccaataaagttccatcaatgacgaattcaataggatttttgcatggacccacaaactctacaccaccgaggtaaaatattccttttggtacatagattttactacttccactttttcttttgcatgcacgactccatatacttgtgaatacctgattttgtatgtgttaagaatgatatatatatgttaaaatacaataaattaaaaatatatatttatctttttggtttgtatatttgtcatatatgtttatagttgtgctaatgtgcatagattttcatctcataactaattaatggtaaaaaaaaaattagaaaaattctcgtttacatacattggcattatcagtttttccgtccggcttagaaccatgacgttggacgttaaacgtttttggtcggatagtaggacgacttgcaacaaatatgaacaagaaagatacacataaaaccttaaacacaaaagcaatgcttgccatcttattattgagtttaaggtgtatggaaaaaaaaaattgttgtttatcaatacttgttctaagagatgatgagaagtgttagcctacattatcagcttatatagagttagcatctctcaatgaacaggtagaagaactggattatggttactaattaacaactaaaattgtgttttttttttagtggtaatgattttgattggttaataatatcttgttatgaagatttttgagtgtatatgttttttttttgttctctcctctaaaacagaatcttcaatttgaggaatgtgccaatcatatttaccaattacttgttgtttttgtttgttttaatttaaattgcataaaaccaaattgttttccttatgcactctttcttatttgttccaattttaagggatatttaattttagtattttagttgttctgttaacttttttattcactaatcacaaattacaagagattttctattaaataaatgattatttacttaattaagtaattagtgaaagagattttgaagctgcaatttcaattttcatcacataaaacaaaattatacagcttcaaaacaaataagtcacggataaacaaaattccagcaacgacaaaaagaaaaagaaaaaaaattccagcaacgcagttgaaccacaagcttgccacgcgccatgacccatcccacgatctcgtacgtacacgtgtctctcatccgcagcctcatcatcaacacatcacaatctcacttttacatatatctccctcgcctcacgaaaaatccattcgtcttctccaattttctcgcgaagaaaactttcctactttgtttcaatccaaacgagtcaaaatg

SEQ ID NO: 6151 - DNA, 3000 bp, Unknown; identical to SEQ ID NO: 6145
  misc_feature (1)..( 3000): cDNA_ID_1812409_gDNA_ID_1620849_Annot_ID_50981 3000 nt of promoter + ATG

SEQ ID NO: 6152 - DNA, 3000 bp, Unknown; identical to SEQ ID NO: 6144
  misc_feature (1)..( 3000): cDNA_ID_1830150_gDNA_ID_1620849_Annot_ID_50984 3000 nt of promoter + ATG

SEQ ID NO: 6153 - DNA, 3000 bp, Unknown
  misc_feature (1)..( 3000): cDNA_ID_2169314_gDNA_ID_1620850_Annot_ID_170314 3000 nt of promoter + ATG
acgctttcaaagaaatacagacgaacataaataataacataaagaatcaaatcacatgcgtacccaagatgacgtggacagaacagagaaatcacacttctatgtctcaatcaattctcaaaaatatctcaacattataccaaaaaaagaaattctcaaaaatatttcaacctttgactatatttaccaaaccccactttctggaacctcctaacttttaacttatgtattgtaatgatacacctttatacttttgcaagtagactaatctcatggcatctattgcttgctaatggtcggtctaagggaaatgatatatacagcattatacttctgatattagacaatattaggagttcagaaagaagttgttaccctcgtttacgaaaaaaatgtttatattcaattatgaaaccaactcttctgaaattctgtgatagttttattgttcctcaatggtccacttattccccaccttgatatttttgcaaatgaggcttttgtcttactcataaagaagatccattcgaagacatatttttgtttctttccgttttttcaaaaacaataaaaaagtttttgttcacattttagaagagaagcaattcaccaattaatttcgtaaggtaacatgaaccaaagaagcaaaacaaaacatcattataaatatatttatactgacaccactgaaaggtaacttgaaccaaagaagaaaacacaacataaatatgattctgtgacattatcaaaaggatttaagactatcccaaccaagaagtaaacaaagactaattatgataggataataaaatgattaaataacgaaggccagtgtaattccctactggctatttattttttccttactagtagtatagatttttcttatctatctctattcagtaataaaacatttttttggagatccaacgtagcaatggaaaaccttgaaatcgcagttcggagctgctatagtgtctaaaatcatcttcgccgtgcgctcttgactcaccctcgcgttattcttttccacaagcaccgcttctacgatcttattgaaccctttccctcggctacgagccacgaaatcaaccagagcagcttgtaccggtcccaaacttgggctatacgccactgattcaatgtaccatccacggtaccacttcccttcgtcatcctgcagcgccactcccgacggagactcagtgtacggagagaacgaattgtttgccgcggctagagccttgcacttcaaatgggaacaatctgatgagcatatctcttcggtagaacccgaaagggtgaggcagttatcgcgcttctcgagaaggagaggggaaccctttgggaggacgtcgtcaggggtgaatctgtacggaaggaggagcttaaggctcgagaatgatccttctgcttcatgctttgatttgagcaggattttgatgtcaagctcgttgctggtctccataagaaactggcggcagtttccgcacggcgcgccgaattcgatgcagtcactagagatggcgactgctaactgacggagacctttctcggagtttagtgcgaggttggtgacgaggaattgctcggggtggatggagtggtgaagaggaagacctgggaattcgacattgacgcctaaatagacccgacccgatgatgcgcgtccaacggctccgactttgtatttggagattggaccccgagccagagacatcgcctttctgatcagctttggaagtctgatgggttcggtgacaccttccgatgctgcttctttggcagtgaaaacgaacttgtacttatcttgtgccgccattgccctgttttgagattctacacgagattttggaaatgagttaacaagttaggacgttgggccatttaggatcgtgtttcgagtttttttttggttgagagatatgaaatgagatgagaagtggtattgagtctttgcctatttatataggtgtgtcgtgtctgtttgcatattgtgaaaggactttttaaaatcgtgtttaggtcattcgtatactcaaaacaatagttagtgtgtgaacttcaagattaaaaaaaggtgattgtgacgatcaacattcatgaactagcttttaaagcaaagtagtaattagggttaattttctagttagtataaagtaatgtactgtaatgaagagtatttattcgaggaagactaagtagttcttaattaacttttactgagtagtaacatttaatggtttgaatagtactaattaatataggtaaagaattacatggacaggcaagaatataaacgagattatgactgtatctccgtcatcaagactcatgctgactcatgaaccatttcttcaaaacaaaattgcttttaaaaagtaagtaaggttagtttttttttttttttttaaattctatactaaagaatgggttaaaaaaataaaattcaatagtccttgattagtcataaattcatgggtatgaaaattggggaatcttattcttaaaaagttataattaaattcattgagtttgtgtgagattgtgacaatataaaaatatcaaataatactctaagtccatgctatatatatattttctctttgtgtttaaaattgaatcttgttcagaaatgagcactttgggtagatcattttgaacttaaatgtatgatatatatttgttcgaaaaatatggattccagttaattttttgagtgaatatggattgaaacgttttaagaaggatgattgtgttactctaatttttgtaacaataaacgttattatatttttacagttactccccataactttgtaaaaagtaaagaaaagccccaaacagagagaaacgaccacgtaagagtggtttggatcactaaactcgaatcgtcatcttcattcgatatgcgccacatcatcttcatcgctatgttctgtcttgaaagttcaaacctttttacaaatcagacaaaacccaacaattaatgaaacaatg

SEQ ID NO: 6154 - DNA, 2012 bp, Unknown
  misc_feature (1)..( 2012): cDNA_ID_2992285_gDNA_ID_1620851_Annot_ID_170325 3000 nt of promoter + ATG
tcttcactttaaattagaacctcatgtttcccaaacaatatattccgttcatgaatctcgtctcgaattaaaactaaaatattacacattttagaatgtaagaaaaacacactcaaaattaagaatcttggaattgaaaacgagattttgaatgtgttcaaagatactctttagaaattataatggtagataatagcacttgcatgacaaattcgattctctcttctcatcatgcatttttgctttacattttgttcctttaaaccaagaatattttgactcacctaaaagataaaccaaacatatctgaaatctacaattgacaattaacttctctttttcttttctcttattcttactgaaataaaaatagtatgcaactggtctttataaatttcatttttatattttaaaaaaacatcttctataccaagtttaccaaattatggtagtccaatgattaaaaaataaatcattatggggttaggacttaggagatcgaattcgaatcatttcaaattttcaatgcgatttcaatcattgtttttcactgttaacactttgaaatatctaagtgtatctaaaaatttcaagccttagagattaatttggacttcgatccggaattctgcgacgactatcaaacaaattttgttttaaccgaaatatagattatttgcatctctgattatcaaaccattcattctttttattattattcagtttactataaagtatatgtccctccctttatgaaccgtatcaaatactatacatagtatgcatgttcgaagaaatttccaacatactaatttgaaatcaacgaacatatcaaattataatgcgttgatgcagaatatatgctttctatatatataacttaagtacaaaaacctaaattttccatatgccttcgtaatttagtatataaatattcattcattcttaatacagcctaggactcggtagcattttgaagtaggaacgaattttgttaattaagatacatgagtgattagatcgaatccaaaaggtatggaggcgtagaacaagaatttggttctctttcattttacgtatctttcactaaagaatagagagaaaacaataccatgcaaaaacctctcaaaaattatatattgaacgcttagacaaagagccaaatttattcgtttttgatgtttacatcagtatttgtttctagctagttcatattctttaaactccataatcatttgaaagacataaaatacagatgcttaagatctgtggatgtttatataggatcttcgaattcggataatgaaatcatttatacactattaagtattaactttgtagaggacttaagtattcgaaatcttgattcaggttgtcaatcaagaaccgtaatgtttgatctatagagccatgggattaatggatgctaaaagaataaaacactcgagaagaagagtacacgtaaaatcactcacacacaaagaatgagagatgggagaagaatactacaaagtgtttgttttttttaaatcggctcatatataaatttgggcgatactctactacccacattattcttttaaacaatgatataaatgtgtatggcctatgtagccgaactttttacatatctgacctgtatatatataataattatttatcaaagaaattagagaaagattcttccacttttgatggcttataaaagatgatgacccaaaacactcaaaatgcagcagcaactgctctctcaccacccatctcctcatttctcttttgcatttctttctttttttctgcattgcattcttttgaggggtttaattttctgcatagctttgtctaatctcttagagctcaataagagaaggtactataactgatctctccctctttcaagttttttttttgtttggtttatagaaaactataaccgccattatccgttagttttaaccgttttttgaaactagtgaatcctcataactttgatttctcactaaaaacagatg

SEQ ID NO: 6155 - DNA, 3000 bp, Unknown
  misc_feature (1)..( 3000): cDNA_ID_1830267_gDNA_ID_1620852_Annot_ID_50996 3000 nt of promoter + ATG
actagaaagaaagaaaaaaaaaacttttgggcaatttcaagaaatacaaagatttgtgtacctcctctgttccaagtagtgtttgcttcccatgttcaagtgatacaatcttaccatctttctcgtaatcaaacttgacataaacaacaccagagtcaccttgtccaacataaactttctttacattgtcataagcaccaccgtcgtcccaaacatctccaccacgaccaccttgagcttccaatttggtcagaccacctgataccggcggagtcagcggtgtagtcgacggaattatataaactccaacagaatggatcaaatcacttgaacttccatgaaatccaacgattttgccacctcctagctcagcttcttctccagaggttagtccaaaaggctgagaagttttccccttgaatgtcttaaagattagagccgttacgatctctatcggtgatccaaagagcttctcgtagtaaattttcactgatgttatgtaatcttctggatcaaccacaaactagcaaaaaaaaaaaaagacaaccaaaaatgatcagttaatgttgatgacaagagaactctcattgaaaacaaaatatttacctcctctgttccaagtagtgtctgcttcccatgttcgtgtgatacgatttttccatctttctcgtaatcaaacttgacgtaaacaacaccagaatcaccttgaccaacatacactttcttgacgttttcgtaagcaccaccatcgtcccattcttctcctccacgaccaccttgagcttccaactttttcgccatcttttcttcttaacctaaagttatagtacccatttcttagaaactgtaaacgcacaagagccatgaacagacactactcaagcactttcatgatgatgaaactaatctaatctgaggactataatacttccactaggacattactttaaacaatggtatcatattctcatagattcattatcatataaagaaattcaataattcaaataaaactagtaaaaatcaatataacgattttgtgaaagaaagaaaaaaggagtacattaaagggaaggaagaaacacctttgagtgtgagaaatggagatgaagatggaatatgaatgagttaatcttgggattttgtatatatactatatagtatatataaaacatttttgaatacgaacattaaattctcttttcatccaatactaaccactttttttttctgccaatactaaccactttttcttttctttttgagagactttatattcaaccaactcgtgcttcacgagggatggaagctttgattagttaggacttaggaacttgtattaatctaaatatctttttttttttaaaattgaatctaccttacaacataaaatttgtaaagagaattccaaaattccaaaaaaaatcacctaaaattttaaaatcgtgaaagcagcatcgtaaagatgttctcttctgttttttttttttttttttaactctcttttgaatattggattagagattttcacagtgtcgtagattcttcgtagagtctgttatgagttgacatttaccataggaattgcattatcgtgagaaggttaaatgataaattgacatttataaattctcaaaatgtaggttatgagttgtcaaagaaatgtaggctatgaaaaaaaaaacttacgtctaaaaaaatgcaaagttaagaaagaaatactcaaagttcgtggcatttgaccatctctcagctacacctcaaattatagctcatgagaatggcccatgaatatgattgtggctccgttaatcacgtggtattaaaactcacacacgaccatttctcatctgcctccaattatagcgaaaccgttacaactcgttgttcacgtgagcatcaaaatgtgcattactcctttcaagttcggcaaatcctaattatccattttaatggactgcagagactttaattagagcttatagaactttaaacattttggtttaaatcttaaaatagaaatttaaccaatctcaaatgatttttttttcttttcttttggcataagtttcataactcgatgatgaatgctacgataatatagacatacagtatgatgattagatgaaaacagataaagaagaaaaagtgtatcgtacgccccactcggtgataatgattaatgagactatatatgagagtacccaaatatgattttttccactcatgaatcgtattgcactatttctgcattattaagatagacccacatttaacattagaccaaaaaaaaaaaaagatagacccacaccacctgttatagtatttagtatttttacacatccactaaacgacgacaattgacaaaatcacacaaacctttctcctttattcatttttgtttaattcgggtcccttgctttttagcattcggctctcattcttatcttcccatggatggatagtcatagttatataatacagttcaattgaagttatgcagtatatatatgcaccacacacgagtcttctatatatgtggatactacgtttcaaaataattctattaacttagagaagataaactttcttagtacttttttcgtttcactttacacacacctcaaaaaaattcttgtttcatttgtgactgcatgtaaatgtcgttaccttacttgaatttttacacaatggtacgtgaaaaagaaaagaaaaaaaatataattgagagaaaatataataggatcacaccactacaatacatgggctttaaattcatcttttctatatgttataatttgggccaagactattatatcatatgggcctatcaatgtaattagaagcaattgcccgatccaataaccttaattaggaaaaaaaatcgttcccttctctcgtttcttttcagctctgactcggcctctatctctctcccgtcgtcagccacattcaccggtactcatctgaccaagctagggtttcgcagtcatcatcatg

SEQ ID NO: 6156 - DNA, 3000 bp, Unknown
  misc_feature (1)..( 3000): cDNA_ID_3100659_gDNA_ID_1620852_Annot_ID_50997 3000 nt of promoter + ATG
tacctccaatagcctctatttcccttacaaggcgaaaatggcttctgttcaatgtactcttgaatgccatcctttcaagcaagtgcgtcgctccacggaattgaggagtctcataaatagaaccacagtcaacgtataaaccaatggaagctgctggattctgaacaaaatttcactcaaaatcactttccagtagtttttaacaggaagttgatgttgggattactaaaagaagctctcaccggagacatctcagtggctatagtcagaccatttggaagagtagtggtcttaagtttgctaggctcaacatggtcagagagtggtggtggaagagagacaccagccaagggaatgttcatagaaggaagtgaactagagtagcctccacttagccagctggaggaagaagagctcgttgcaacagcactagaacttgcataacgagaagctcgaaaattgtggtttagaatgccctataaacacacacacacacacacacatcctaagcatcattaatctcttgattcaattaacattgtaaaaataagaactttcgaaacagagacatttcataaacctgcaaaaagcatgaataatggcaccagctactataaagcgataaaattgaatcaagatctataagaatctaagagaccctttaatccaaatccaaaaacaatgaatcatacaaattgttcaatactaagcattctcctaaaaaaaccagaatctcaatggaaacaagtgaagtaggacattgaccttaagggccttggctcgagaagctgccgtacggtacatgatgatgactgcgaaaccctagcttggtcagatgagtaccggtgaatgtggctgacgacgggagagagatagaggccgagtcagagctgaaaagaaacgagagaagggaacgattttttttcctaattaaggttattggatcgggcaattgcttctaattacattgataggcccatatgatataatagtcttggcccaaattataacatatagaaaagatgaatttaaagcccatgtattgtagtggtgtgatcctattatattttctctcaattatattttttttcttttctttttcacgtaccattgtgtaaaaattcaagtaaggtaacgacatttacatgcagtcacaaatgaaacaagaatttttttgaggtgtgtgtaaagtgaaacgaaaaaagtactaagaaagtttatcttctctaagttaatagaattattttgaaacgtagtatccacatatatagaagactcgtgtgtggtgcatatatatactgcataacttcaattgaactgtattatataactatgactatccatccatgggaagataagaatgagagccgaatgctaaaaagcaagggacccgaattaaacaaaaatgaataaaggagaaaggtttgtgtgattttgtcaattgtcgtcgtttagtggatgtgtaaaaatactaaatactataacaggtggtgtgggtctatctttttttttttttggtctaatgttaaatgtgggtctatcttaataatgcagaaatagtgcaatacgattcatgagtggaaaaaatcatatttgggtactctcatatatagtctcattaatcattatcaccgagtggggcgtacgatacactttttcttctttatctgttttcatctaatcatcatactgtatgtctatattatcgtagcattcatcatcgagttatgaaacttatgccaaaagaaaagaaaaaaaaatcatttgagattggttaaatttctattttaagatttaaaccaaaatgtttaaagttctataagctctaattaaagtctctgcagtccattaaaatggataattaggatttgccgaacttgaaaggagtaatgcacattttgatgctcacgtgaacaacgagttgtaacggtttcgctataattggaggcagatgagaaatggtcgtgtgtgagttttaataccacgtgattaacggagccacaatcatattcatgggccattctcatgagctataatttgaggtgtagctgagagatggtcaaatgccacgaactttgagtatttctttcttaactttgcatttttttagacgtaagttttttttttcatagcctacatttctttgacaactcataacctacattttgagaatttataaatgtcaatttatcatttaaccttctcacgataatgcaattcctatggtaaatgtcaactcataacagactctacgaagaatctacgacactgtgaaaatctctaatccaatattcaaaagagagttaaaaaaaaaaaaaaaaaacagaagagaacatctttacgatgctgctttcacgattttaaaattttaggtgattttttttggaattttggaattctctttacaaattttatgttgtaaggtagattcaattttaaaaaaaaaaagatatttagattaatacaagttcctaagtcctaactaatcaaagcttccatccctcgtgaagcacgagttggttgaatataaagtctctcaaaaagaaaagaaaaagtggttagtattggcagaaaaaaaaagtggttagtattggatgaaaagagaatttaatgttcgtattcaaaaatgttttatatatactatatagtatatatacaaaatcccaagattaactcattcatattccatcttcatctccatttctcacactcaaaggtgtttcttccttccctttaatgtactccttttttctttctttcacaaaatcgttatattgatttttactagttttatttgaattattgaatttctttatatgataatgaatctatgagaatatgataccattgtttaaagtaatgtcctagtggaagtattatagtcctcagattagattagtttcatcatcatgaaagtgcttgagtagtgtctgttcatggctcttgtgcgtttacagtttctaagaaatgggtactataactttaggttaagaagaaaag

SEQ ID NO: 6157 - DNA, 3000 bp, Unknown
  misc_feature (1)..( 3000): cDNA_ID_1830264_gDNA_ID_1620852_Annot_ID_50998 3000 nt of promoter + ATG
taagttactgcaagtgtgtttagcgtattcagattaacattttactgaattaattttgttttaggtaaagacccgcgaatatatgtttaatatgtttaaatgaagtccaattattacatggggactatagatcatataatcatagattaaagttcattattgtttaggtataaataaaagttttttgaaaatagtattaggttttgtaagtaaaaattggttaattgggtggtcatgatcatactgataaaaaaatgaaagtatatgaaaaaaggattgttggaatgtattaatttggctcggctttggcaaacctgggatagattgcgtcctaacttttagtgatttggcatttaggccttaccaatcaactgatccagcccatgtaatgctaatcttggaattttccctttttgaaattcagtttgcaatatattaatcttggatttttccatctttctaattgatttacaatatttttatattggatcagccgcgtaaggaggagatctgatctgatctgatccacacacgtctcacgagtgtagtaggctcgacgtgctcaaactcaaagtgtgataacgtattttttaagcttaaaagaagtcatcattattgttatctgtctcaatagaaataaacgccacgagatccacgagtcgcattttttttattttgccaaaagtcaaaaatatgtttccatatatatcttcggaaattaagaagaattagattttaatctgcggtataccgcggggacaatttatctttttaaagttagtataatttttttttgcaaattatatctatttataatatatttttattttatagtttacaattattattaagtaacgtactgccaaacccgtcccgccaaacccatcccgtaaaaaaaccatttatttatattactgttgatcttatttatgatatatttataaatcattgtctatatatttttgtcgatgcgggacgttgaacccacacattttttgccaattggttaatatatgttcatttttaaaattttgaatcataaaatatgatggaaaaaattaagatttttttaaactctatatattatataatgatgttaaaaattatgatatatcaaactttttataagtttaaatattaataatgttttataaattttaaatatataaataataatatttaaaaaattaatatgtttgtttataaagtaatgacataataactctaaaagcaaggatttagaagatttaaatctttaattaaatattttcattaataaataattaatgtcagtgacatgacattgtaaataagttcaaatacaaaatttatttatttaaacaaaaaacgtttagtaagaataatatttatttaacaaaaaactttgttttaaaatattgttaacaaatatgtttatgctaattttaagggattgatttgaagtttgttaggattaaatttgattgataatgtgattgacaatttaaataaaaagtttaaagtaaaattaattattttggaaaaaaaaattaatgctaatgacattagatcgtaaataagttcaggatttatttgctaaaatagctacaaaaatgtatatatagatttcaaaatatacttttttaatcactattttttcgtggagtagctgtctacgaatgttctatccaatacattcgaacacgtgattgttcgttaattttcttgattctgtaagagaaacaaaaaatatagatgtccaactttttttttcgggtgggaatatagacgtccagcttagctacgtactgaataattcaaagttccaaactagtatatattaatacaattgacgataaggtcataaggatcgatggattccaacgattcgatacaagtattaatgaaataagataacacgattgtgacagcaaactctatattgatatttctattttttaattagccatgcgttgcacgatcaatttacaaaataataaaagaaaatgatcgatcaaagagcattccattgaaatttaattccatcctgtaatcacataattttgggcccaatcctatttttcaaatgtaacatgctattacatagtcacatagaacatcctaaaatagggttaaaatgtacttttatctatttgcaattttgatattttcctttctgaaaaagattagtatatggcaaattatcttttagataaaagatcttttgttctgactatacattaatttattttaaaaaaaaaacttaacagatatatttgcaaatacaaaatgatgaaaaataaaagggataccataatctaaaatctgacaaagaaaatatacaaaaagtcaattacgatacttagaaaaagaactatatatttttgggtagggaagttcaaaaacaaattaccgatttgctgactatatgagcaattattacatacttttatttatttgtacaacaattattacacatacttgtgtggaccaacatgattaattttatattggccatatggtgcgtagtaaatgttataataacttgaaattaaataataactaagctcgactcgatatatagatccaaccagtagcctctcttattcacacctaatcttcatcttcatcttcgcattcatagtctctacgatcaggtaatccccctctctctatctatctttcatatatgtgtgtatgtgtaaactatctatattctgaaaatagatcaatcaattgatcttttcctatctcaattgttttcacaaccatcagtttgacttttgatcgtttaaggctcgagagaattatcattcactgtagtaaagatagtttataccaacaaacccatttggtgttgaccagctttcaacataagtatgagttagagctagaaccggattagtattaatgttacttgtacctgttcatagtactaaccaaaaatgatccaaaaaaatgaaaataacaaataaaccatttatggttatcacagatagataaaagaagtcaacaacgatg

SEQ ID NO: 6158 - DNA, 3000 bp, Unknown
  misc_feature (1)..( 3000): cDNA_ID_3079731_gDNA_ID_1620852_Annot_ID_50999 3000 nt of promoter + ATG
aaccaaatttgactaccatccgtttgcaattagaattcaattttcctttcatgttactatttcaaacagaaacatgccaaaaatggaacttacctcattatgtccgataactaaccgttatgctactccttaagaaacgtgtgctactatcatatcattaatacacaaattcaactcatttgcttcatattcacaacaatttaatagtttcacgtatcgtggatatatcgcgagattatacaatatcttctattaattaattgctggcatgattgtaaaaaaaaaaaaaaaactgctggcatgtattcaaaaaaatcaatatatacccccatgcagttcttcgtagatggatcactcgactctttctatctatctcttatcaggtcaaatcttattctctcatatctgatagtatttttgtaaatattggttattaaaaaattgtgttcgtaattacaggtaattcgaaagacatcaaaagcaagcaaaagatggctcaaaaggtggaagcacaaggaggtattggaggagatgtatgggatgatggtgctcacgacggcgttagaaaggtgcatgtagggcaaggccttgatggtgtttcgtttatcaatgtcgtgtacgagaatggttcacaggaagttgtaggaggtgaacatggaaagaagtcactaattggaatcgaaacggtacgtaaaaatgttttgcttcgaatccactaatcttgtctttattttgcttaagtttatattatatgttcttaaaactactaaactctcaatactagggatataacgttatgataggataatagctcgcggaccatccaattagccatgtttagaatttaggtcgtatcagttctaatgattaattatagttctaaagccaaacctaaatattaaaaataagaaccaataattaccagaccaattgacgccttatacgtataattatggttctaacaagccaaacctaaaccttaaactattactcaatatatctttctatttttgcagtttgaggttgatgcagacgactacatcgtagcagtgcaggtgacctatgacaaaatatttggctatgactccgacatcatcacatccataaccttctctacattcaagggaaaaacctcgccaccctacggattagataccgaaaataagtttgtactcaaggaaaagaacggtggcaaacttgttgggttccatggacgcgctggcgaaattctatatgctcttggagcgtattttactacaaccacaactcctttgactcctgccaagaaactaccggctgttggtggtgacgaaggaactgcctgggatgatggtgctttcgatggtgttaagaaagtgtatatagggcaagcccaagatggtatatcggccgtgaagtttgtgtacgataagggcgccgaggatattgtaggagatgaacatggaaatgatactctactcggatttgaagaggtataatacttcttgctttcttctcttgtggttgaatgtgaaatgtttttacaaaatgatatgaatatcttacacaaaaatatgcttgggtaagggaatccacataaactttcgtggataaaatcatgcatattttatattagctagtgttgaatatctccatttttgatataaaatattttaactaactcaattgttttatttggtttccatcaattgcagttccaacttgactatccaagtgaatatattactgcagttgaaggcacatatgacaaaatatttggttttgagactgaagtcataaatatgcttaggttcaaaactaataagaaaacgtctcctccctttggaattgaagctggcacagccttcgaactcaaagaagaaggttgcaagatcgtcgggtttcatggaaaagtaagtgcggtgcttcatcagtttggagtccatatccttcctgtcaccaactgatcatcacatatatatatatatatatatgtctcttctataccaccaagtttgtcacgtgtgatatcttcattaagttttaagttttctaatttttcttgttctgtttatctatgttttaagtgtctttaagtatggtgttttgtgaagttgttatgcctgtaatattatatgtgattggctttaataaaagtgggtgattattatacatatcagttgcacattaggagaaaagcttatattcatactcagtatctcggcatctagtgtatgatggaaacaattatctttaagactttagcattatttaaagtgagaaacaagaaaacttcgccataattggagaattggtcattttgatcaaaatccaacaccagactacgcgcagtccgtttcgaaggaggtacactccacttagtatctagatttaatttattatacagtatgtttaattttttttttttttcaaacacatatttttcttcttaagaatatatatggaaatataatatgttaattatgtaatgatcaaataatattaaaacacacatatatatatatatataaaccatatgagcaattggataacgggtaaaatctaaccaggtttcaaaaattgtaactattgttgatttttttttttttttgatcaacaactattgttgagaaaaacatgtattatgtgagcaaaggaaaaaaagggaaaaaaaactacagatcagtaatatcaactactccaattcaacttatttgcttcatattcacaacattctaatattttaatgactcgtggatcacgagattatattaacatttctatagattaattagtggcctacattcaatgatatcaataattacacattttatccagaaataaaaataatcaataaatacgcatgaaggtcattgtaatgcatatcaataactcgttccctctctcctcaggtaaattctcagtctctcgtctgataatagttttgtagagtttggttaataaaactaatcgtgtacgctactaatacgtacaggtaactaattaatattcaaaaagatg

SEQ ID NO: 6159 - DNA, 3000 bp, Unknown
  misc_feature (1)..( 3000): cDNA_ID_1380963_gDNA_ID_1620852_Annot_ID_51001 3000 nt of promoter + ATG
ttggagtattctttatggctagatccatatgatccggttcttgtatctagattttttttacggaatattgtatgatatatctagtctcctctttggttctaaacttctaattaatcttcggtgatttgaattaaacgttactgtttttaaattatgattaaggctttaaaacatgttcatacaataattaccaaatcttaaccaattagactcttaataaggagaacgtatatatatgttgcaacttgcaactttagccctttacaaataattaatcgtacataatctaattgataaacgattctttaaattttaaaacaatgaattagcttgctgccatcgtttaatgggccaacgccaatataaagacgattagttgagaagttgtgcaagtagaagtatatgaatattttcattatctaaaaaaaaaaatgtatatgaacatgcgtttttcccagtaatgctttttatataaatatgcctcgtggatcacgaaagaataaattattatttcccttattatttcatctagtacgatcaatatcaagaagtcaatataaataaacatacaattcactttaattgatcatagcaccgataacaatctactctctttaaaaggtcttatctctattcttctctattatgtaaaaattggttaatagtagatattaacaatttatttttgcaactacagaaattcgtaagtactatcaagaagcagaagatggcccaaaaggtggaagcacaaggagggaaaggagccaacctatgggacgatggatcgacacatgacgccgtgaccaagattcagctcgcagcaggcatagacggaattcaatatgttcagtttgattatgtcaagaacggacaacccgaacaagctcctcttcgtggtaccaaaggccgtgttctcccagctgatccggttcctatattttccttgcccattaatcttcttctttctatatgtatactgttatattttgaagttttgacattttcatcttgatctatttctacagtttgtgattaaccatccagacgaacatctagtttctgtagaaggttggtatagccctgaaggtatcattcaaggaattaagttcatctccaacaagaagacttctgatgtcattggatccgatgagggtactcacttcactctacaagttaaagacaagaagatcattggctttcatgggtctgccgggggcaatcttaattctcttggggcttactttgctccgttgactactacaactccgttgactcctgccaagcagctaacggcatttggtagtgatgacggaactgtatgggatgatggtgcttacgttggggttaagaaggtgtacgttggacaagcccaagatggaatctcagctgttaagtttgtgtacgacaaaagccctgaggaggtcacaggagaagaacatggaaagagtactctactcggattcgaagaggtataatactttctttgctctttttgttgaatgtaaaaattatacatcagagaattcaaattctcttccggtttccatcataatgtattcaattgttttatttggtttccaataactgcagttcgtacttgactatccaagtgaatacatcaccgcagtcgatggcacttatgataaaatctttgggagtgatggctcagtcataactatgctcaggttcaagactaataagcaaacgtctcctccctttggacttgaagctggcacagtcttcgaactcaaagaggaaggccacaagatcgttggtttccatggaagagccgatgttctgctccacaaaattggagtccatgttcgtcctttatccaactgatgatggagctctttatccttgattccatgcatctaataagttatcaaatctatcttctaaatttctcatatgaggtctcttcatgcctctggtgaatggtgatctttgataagtgttttacgcgttgtctcttgcgatgttgttttttctttgttcttcttgtgctctattttaataaaggaagtttgttccaatctgatctttagtttccctatatgttctataatacttacttttgccattatttggttctgatactaattttacttgctataattcaaactaaaatctcaacgtatgaattgtacaatttaaaatgcaaatgttaacttttttggatcaaatatatagttgttcgtattttctcagtaaaaaaatcctgcacaaagtttttatctagaatgtgtgaccatattgaagtttttggccttctccaaacataaaaagttattagttaaaagtatatgagttggccaaaaaatacgaaccggttcttgtttctagattgagcgttacagaaaattgtattatatatatactcttggttctaatttctcttaggtgatttcaattatacttttactgtttgaaataatgtacaatgctgtggaaacatgttcttacaagacttatcaaatcgtcaaccaattagagtcctaaaaagggggtcactaattgtagaattctgacttatataaattgcaacttgcaccctttacaagtaataacgtatataataaaattgacgactctgtgaattttaaaagaactaattagcttgctgccatcgtttcattggccaacaccaatataaagacgattagttgagaagctgtggaagtaaaaaaggagtatatgaatatttgaacatgtatttcttccggtaatgttttaaatatgcctcgtggatcacgaaataatagattattatttctgctagtacgatcaatgatcctatatgcggatatatggttatatgcaagaagtcaatataaacacctatgattcacttaaatcgatcacaatctactcacttttgaaggtcatctctcttttcctctctattagtacaaaattggttaataattgaaaattcacaatttgtttttttttccaattatagtaactatagtaagattgatcagcaagcaaaatatg

SEQ ID NO: 6160 - DNA, 3000 bp, Unknown
  misc_feature (1)..( 3000): cDNA_ID_3070205_gDNA_ID_1620852_Annot_ID_51002 3000 nt of promoter + ATG
atgatggtttctatgaagatgtgaggaaggtatatgtaggacaaggtgactccggtgtgtcttttgttaagtttgagtatgctaatcgcaaggagcttgtagctggagttggccatgggaagatgtcaattcttggaacagaggaggtttttgtgctctgttctcgtattgacctaataatgttttcttgagatccaagtttcactggtctttgtattttgtggcagtttgtgctcgattctccaaatgaatacattgtatcggtggagggaagttacgataaattatttggagtggaaggcgagttggtgacgatgcttaggttcaagacaaacaagcgtacctctccaccgtttgggctcgatgcaggcacaacgtttgcgttggagatgaaagatcataagatcgttggattccatggcaaagctggagattttgttcatcaagttggtatccacgtcacccaaatcaccaagtcttaaagctttgtgagctttctcttctattcctagaataaaattaaaaagccatgtctgtttgttactcctcagcttctagttactctcttttaactatgtcttgcttcgtttgtttgttatgtgttatgaagtggtctgcttctttgaataaagcatcgttttgttggaatgtgataaactgataattgtgttatgctatacttggatgcatgaggataaatgaaaactaactattcaactaaaccctaaaacctatacgatcaaaattatagtaaatagtaacacttaatgagactttaaagttgagatgtgtaactagtcaccactcactcatgttagtgattcatgtgtgtgtcagtgtgtgtgtgtgtgtttttatcaaggtcttctcttaagattcataagtgtgaatctggtgggacttaattggtctggtggagtagaacctatgcgggcaatgaggaaggttaaggtaggctaaccgagcccactctctaagtgtttaatttgtaaccttaattcgtaaataaaagctgtttaatttgtaacctttattagataaaattttgtctttttttttgtcaaaagataaaatgttgtcaatcattttaaaaacaaagaaaaaaacttttttggcaagaatttatatatttgcttgtcataaattttccattttgtagtattttgaaaaaaatattttaacgaatggaagcaataactcgacaaaaagagtcaaactaaagtaccttcacatgcaaaacaaaacgtaaatttggtatttttttcccattaaaaaaaatatatatatattcttggccttgtgtgcgaagacgatcgagaacgagaagaacgataagctcaatacgcacgaacgtagatcgaagactggaaaggtatatcttcatcaaaatattcatgattatggttgagtttaattttgtttacgtatttgttttaatttttcaaaagtccactgttggctggctgttgctatcttggaatgattttcatatctcaataactattgtttactctaagttaaattattggggtgctatttatgatgactgatgaagtgatgggaacatgattgcaatattaaaatctcttttttatttatattaattataagtttgtacccacttcattttaaatagataatgccaagacgtaggtatattattactgaatttattttttaataataagtaaatatgcaggtttcaactagaaaggtaacacatcaacaagaaataccaaaaaccactagcttacatattttgatcatataagtattgaataatatagttatagatgatcaaatagttattattaattacttagctagtgtaatttctatcgattgtttcacattcgcaacagataattatataaataaatacatactacatgttaacctttgtttttgttaaataggatgttttcttgattgatgatctagatcaacttttaataatttatacgtaccagctttcattcgatcgtgcgacttcttggaatatcccatggtacatttgcagtcgagctagaaagcttttttgataatttatgaatcatattaagcgtctctcaattagattaatatttagtaccagtgtaaatgatacaattataaatctttttaccaacgaatacagaatttgttttagaaatattcttcgcaaaattttataatatttcataaatcagttataaaaaaaaaaaaagcagttttgaattcagaggaattcgtaaatttccctaagagttattaaaactagttgtgatattttggagtattctttatggctagatccatatgatccggttcttgtatctagattttttttacggaatattgtatgatatatctagtctcctctttggttctaaacttctaattaatcttcggtgatttgaattaaacgttactgtttttaaattatgattaaggctttaaaacatgttcatacaataattaccaaatcttaaccaattagactcttaataaggagaacgtatatatatgttgcaacttgcaactttagccctttacaaataattaatcgtacataatctaattgataaacgattctttaaattttaaaacaatgaattagcttgctgccatcgtttaatgggccaacgccaatataaagacgattagttgagaagttgtgcaagtagaagtatatgaatattttcattatctaaaaaaaaaaatgtatatgaacatgcgtttttcccagtaatgctttttatataaatatgcctcgtggatcacgaaagaataaattattatttcccttattatttcatctagtacgatcaatatcaagaagtcaatataaataaacatacaattcactttaattgatcatagcaccgataacaatctactctctttaaaaggtcttatctctattcttctctattatgtaaaaattggttaatagtagatattaacaatttatttttgcaactacagaaattcgtaagtactatcaagaagcagaagatg

SEQ ID NO: 6161 - DNA, 3000 bp, Unknown
  misc_feature (1)..( 3000): cDNA_ID_1830258_gDNA_ID_1620852_Annot_ID_51003 3000 nt of promoter + ATG
ccggaggagcacttagtttctgtagaaggtcggtataaccctgaaggacttattctagggctaacgttcaaatccaacaagaagacttctgatctcattggatatgaagatggtacaccgttcactctccaagttcaagacaagaagatcgttggattttatggcttcgctggaaacaatctccattctcttggagcgtactttgctccgttgactaatgtaacccccttgaatgccaaaaagctagaagcaaagggtggtgacacgggagatatatgggatgatggtgtttacgataatgttagaaaggtatatgtagggcaagcccaatatggtatagccttcgtcaagtttgagtatgtcaatggttctcaagtggttgttggagatgaacatggaaagaagacagagctaggagttgaagaggtacaaaaatagataattctatgttgtgattcgtcaaaaggatatatatatatatatatttatatgggtaacctcactcaaaattatttggtttctttgcagtttgagattgatgcggatgactacatcgtatacgtggaaggataccgtgagaaagttaatggtatgacctcagagatgatcacttttctttcattcaagacttataaaggcaaaacctctcagcctatcgaacaaagacctggtattaagtttgtgctacaaggtggaaaaattgttgggtttcacggacgttcgaccgacgttctagactccctcggggcttatatttcattgtcgcccactccaaacttgcatggaaagtggacaaaggtagtaatcttttatatatcaccatgggagctagttcactaagcagactctatattataaaaaatcctaactaacaagtattattaattaattataaggtggatgaaaatggagatggtccagggctaagatgctcgcatgacatagcacaggtaggaaacaagatttactcttttggtggtgagttcacaccaaatcagcccatcgacaaacacctttacgtctttgacatcgagagccggacttggtccatttctccagccacgggagacattccaaccctctcttgcctaggtgtctgtatggtgtcaataggatcgaccctctatgtctttggaggccgagacgcttcacgtcaatacaacggtttctactcgtttgacacgaccacaaacgagtggaaactgctaactccggtcgaagaaggacccactcctcgtagtttccactcaatggcagccgatgaggaaaacgtttacgttttcggtggagtgagtgctacggcacgactcaatacactagactcttacaacatcgttgataagaagtggtttcattgttcgactccaggagattcccttaccgcaagaggaggagcagggctcgaagtggtgcaagggaaggtatgggttgtgtatgggtttaacggatgtgaagtagatgatgttcattactacgatcctgttcaagacaagtggacacaagtggaaacattcggtgtgaggccttccgaaagaagtgtattcgctagtgcggctcttgggaaacacattgtgatttttggaggtgaaattgcgatggacccgctagctcacgtgggtccaggtcaattgaccgatggaacttttgcattggacacagagacgttgcaatgggagaggctggataagtttggtggagaggaagagactccgagtagcagaggatggaccgcgtccacaactgcgaccattggtggcaagaaaggacttgtgatgcatggtggtaaagctccaaccaatgaccggtttgatgatctcttcttttacggaattgactctgcctaattaaggcagatttggtgatgaacgtttgtgatgcaataagggaagggtcttgataccaccatattatcattcgtcagcttgtccattttgttgatgttttttttttcctaaacgttttctatatgtttaattgttttatgtttcgtggtttatccaataaattgtttattttcttaaaataaatccccagataaaaaaatgcgaactagaagggagagtcatagcttaatattaaataaataacgatggatgtgttgtatacgcgtttacaactaatcccatgcaggattcatattgtaattgtttaactagtctagtggtcaaagtcatcttcccacatggagaggtgcagagttcgaaactttgaatctccaacctccttttcattgttcttcaattaaaaaaaaaaaaacattttcaaataataggccgtaattgtttttttgcttctgaccttcaaataattgaggagggctctggttgttgctcctctgcttctagccactctctttaaactatgtgttgtgtgttctctaatgagaataactatgctaatgtgatttctctttacaatggtgaatggtgatctttcttttaattataactgtgtataaaacattatctctattaaagagaatcacatatccaagatgtattgatgcttcaactttcttttcaacgttcactatttaaacccatgcataatgcattcctttgttcgcacttcgtattttaattgaaatatttaggtaagtcatgcctgtctcttttctttttttctttttcttataaccaagtcctgcctttcttggtttgtcactttctcataatcttatccgtgagtattgatctctctacgaaaatttcaattgaccatctcaaagaacttgtaaaatgctcttccttattatcatcctttttttccctaaaatttagtatttgtctttagcatattttgttttagttgaaaacgattgataaattagtgttacatccaaatgctggaattttataataaaataaagaagttagtagggttcatgttagatgtgtaaaatacttttttcactaagacattagatttctgtttcgatagattattataaattcttcagtttgttgatgtcattactattgactctttcagttaaaaatg

SEQ ID NO: 6162 - DNA, 3000 bp, Unknown
  misc_feature (1)..( 3000): cDNA_ID_1830254_gDNA_ID_1620852_Annot_ID_51004 3000 nt of promoter + ATG
actataatcatatacagaaagaaaaaaaacaagtgttacatcacgcttagcttaaaagtttcgactttttgcaccgtcatatttcacgtgtaagcaagaaatacaaatgtaaatagattataattaatgaattctctcgactctctcaacatagtatataaaaggaaatctacacatgaaccgtatctttctcacttttgaaatattttgatgttttaaagaaattttttcaaaattttatataaattataaattaatttaatattttttgattatttatatttttcatcagtcttgttcataattggttgaattgttttaaagtaaatatttctttagctaaaacatcttatacaattaaaagaaaaaagtgtaatcaaataaccaaatataaattagtatttcaaattatacttattgcagggtgataaaccttttgtcccaagtgaagttaaacctataaatatataccccatttagagggtcctatataactaaagtaccacatatttggtggtttatatcattcaatttttttgtaactaacttaatatttgatatgtaaaatcatgttaaaataggatcagcagatagaatatataaaaaataagtcatgtacaaacgtaacgttcttcatatcttaggtaacgtatctaacaattttgttaaatattattattttaaaaaattgaacatattatttggaaacttttcttttgataattttgaaatggcactttgtaattaagagtttaataaagaacacgtcacacacaaaaacgaagaaagagattatagaaattaagttgtgttttcaatcttcgtgtatacaaaacaaaaataaaaattagaaatgatatttcatacgatgttgttaaataatataattatgaaaattagttgtgctttatattattatttttgttggaagctctagaaacgatcgacctaatagtatatttttgtcactaaaaagtgtgattaaaatatatatatatatatatatatatatatatatatatataatattgtaattttcaaccaattctcggtttaggtggtttattattatattgttttttgaaaaaattaaaaaatatatccttattagttcattcttttctggtcattcgttcacactttacaacttggttaatggccacttctcaagttatcgttctttcatttgttctacagtcgcaagaaattatcgttctttcatttgtcattatgcataatgatttctcttttctttttagtgcataatgatctcactacataaaaaaatctatcttacgattcaactatatttagtcccatgcactcgctgcataacacattactttcttcgatttagagtgattttcacaaccttgtttctgtattgtatatttagttagtgtttgtgattaccaaaaaaaaaaattgtttcttcttggcttagtctttttatctttttttttttttttgcttcatctatttttcctcccatgacagatgaagacggcaagagatgcagcaaatctcatttatgatctatctgaagaatcagcgtcatcgatttggagactcgaaccataacaaaaagagcatcacagtttcaatttaattgctcctggcgcttcctatttcagcaacaaacattaaataattaatccaatagagatgatatatatggaaatttcaaaaccaaaaaaagaaactttcaaaaccaaaattgcgaagccatagaaatcgtggatcatggaattgcgaagaccaatgttgacatatgggaatttggtgtcccaatgagcagagatcactaagattggttttcgggaggaactttttgagttcatgatttgaagaattgtctcgcctataagctatcgtccatagtttgagattcatgcgacaagaagaaggtttgattcactttctccatttaattgaatcatcttcatagatatattttcatacttaatcaatgtttttaccaaaaaaataatgttattttattattttggttttatgtggtttgggattggtgtagattataaaccgattaaaccaatgtttttgtgttctgagatttcaaacttttgaactaaataaatatacgttttggggaatatccaatatcaatatgtatcatagtttggactctatctattccagtatgataattcccgtggaaaaatatatcatcgtctctattttatacatgcacttgcaacacaaaccagccataaagtgggtctattcttataatttatgacaacatggaacactatcattgggccacgatgcaaggagcgaaggacgatgcgagaaggtgctttactgatttgatgaacgtggaggtgattctgaatgatacgagatctctaagctgaatatataatagtatagtttttcgtaatttttttttgttaaattttttatcgctgctaaagattaaatggcgagtaaaactatactattatactttcaaagatcacccgagaaaatgatgactgcacatactttcaatatcccatagatgacatatctgttttatttccatcaagctattcatcgaaacaaaagcacatgacgattatgggagagaaacactactctaaaatcccgtaataagctgcaccacctaattttttgtgccttgaccaaaaaaaattcaatgttgcagttcaacgaaccttcttacggaggatctttaaacaaaatttatttggtacatagagaaaaatattttaatatatactaatttaatgcctcgcgatcaacgagtagagaaaaaatatgtcgcgtgtatcttcttccattggtcaataaataccaatgcaatgtttactacacaaatcattacttcagtctcactctcaggtcagctctctccacatctctctcatatgattgtactatgtataagatttggtaatatttgtaattacaagtaaaattcgtaaatacagataatattcgtaagaggttgatcaaacgaaagcaaaagagatg

SEQ ID NO: 6163 - DNA, 3000 bp, Unknown
  misc_feature (1)..( 3000): cDNA_ID_2992185_gDNA_ID_1620852_Annot_ID_51005 3000 nt of promoter + ATG
gcccatcgataaacacctttacgtctttgacctcgagacccggacttggtccattgctccagccaccggagacgttccacacctctcttgcttaggtgtccgtatggtgtcagtaggatcgaccctctatacctttggaggccgagacttttcacgccaatacaacggtttctactcgtttgacacgacaacaaacgagtggaaactgctaactccggtggaagaaggacccactcctcgtagtttccattcgatggcagcggatgaggaaaacgtttacgttttcggtggagtgggtgctatggatcgaatcaagacactagactcttacaatatcgttgacaagacgtggtttcattgttcgaatccaggagattcctttagcataagaggaggagcagggctcgaagtggtgcaagggaaagtatggattgtgtatggatttaacggatgtgaagtagatgatgttcatttctacgatcctgctgaagacaaatggacacaagtggaaacattcggtgtgaagcctaacgaaaggagtgttttcgctagtgcggctattgggaaacacattgtgatatttggaggtgagattgcgatggatccacgagctcacgtaggtccgggtcaattaatcgatgggactttcgcgttggatacagagacgttgcaatgggagaggttagataagtttgaggggactccgagtagcagaggatggaccgcgtccacgactggaaccattgatggtaagaaaggacttgtgatgcatggtggtaaagctccaaccaatgaccggtttgatgacctcttcttttacggaattgactctgtctgattaagcgcgatttgatcatgaccgtttgtgttttatttgtttgtgtgtctgtgtgtctgtgtgatgcaataagggagggatcgtgatacctctatatgatccttcgtcagcttatccattttattttttattttctaaatgtatctttttgttttttgttttctgttttgtatgtttaatgtttcgtggcttgttcaataagatgtttattttccgaattttttttgggtatgttacgttatactacaaacaaaaatattatgattttgattttctctaaagatgaaatgaatagaacaagaagtcagcagatagggtggtttcatctacttttgtggttggtaaatgtggttagaaaaatttgcattgaattgtaagtttctatccataaaagaaacaaaaaattaatgtaatcaagagtggaaagttaccaatggattataaaaatcttgcaattctaataaatcctcatgtcaacggtacagataagataagggtaaggggcaaacaatcttgttggttcaaatggcaagtaaacaagggcaattatatccacctaatccattgcgttttctttctctaatcttagaatctactttaattgtatgtttttctctttcatctactttccaaaactatataacctcatttctatactttttatgcatttattttgaaacccctttatcaaaaaaaaaaaaggggccaatttttcttcaaaaatggttactttaagattctcatatacagtgtgccaaaaaaaaaaaaggtacctaaaatatttattatttcagatattggtcaacatattatctgtaacagaaaaatgttcacgtgatatttgcgaatcacatttttctaggggcaaaagtgatatatgagaatcttaaagtaaccttttctagaataattgcccttgtttacttgccactgtagtcatttatttaatttatgttcaaaaacagattacctacctaattcaccgaaacgaaaaattttgttgccagtttttgttttttttaattttttttttcctctttttagtttaccttctcttttttctgttcaacattaaactagaaggtagagtaataaataacgatggatggatgtgttgaaaacgcgctttatgcatgattcatacgagagcagctgaggaggagacaaaaaacgggtctacactatatcagacttttttttgtttttttggtgtaaaactatatcagatggaaaaatatcaaccaaataatgtagaaactatatcaaacttttaacaaaactatcaacccaatattttatattttattaaaaaacaatactaataatttttccttttcctcgtttttttttttctgatcaaccattcacacgttgtttttcgtaattatgattctgcataatgctttctctaaatcaaaaactccacgccacggttcaactgatgtagtgcctccaccgttgtcgtttgactcgttgcagaggacaccattatgcacttcgattcattttcaaaatcgtctttctctactgaattgttactccatttaattttttggtccatagataacatagaccattatactagtatgttaaatgtatacttatcagttaccgcacaacattaattcttaaagagggttcattttcgagaattgagtacaacactaccattaggccaaaatgcgagaggcaaaaaaagatatagcatatacttatcatgaataatgaaaatcttttccatccaaataaaaatctttcttctcataaaagaaagaagagaaaaaacaatgagtttgcatatctttatcctgtagaatgataatcttccccatcaactactgtagatcgtcaacgtgtactcacttccattatcgatcgaatcatcaatttaatgcctcgtgaatcacgagatcatataatatgacaagaaattcgtcccgtttatctactgctggtcaataaatactcatgcaattcccaccaatagatcactcaaccaatttcttctcaggttctctcttcacacctctccccttctctatgattatagatagtatatgatttggttaaattatctatatttcttttttgataaaggatttggttaaatttttaattgcaggtaatactcgtaagatttatcaacacaagcaaaaaagatg

SEQ ID NO: 6164 - DNA, 3000 bp, Unknown
  misc_feature (1)..( 3000): cDNA_ID_1830250_gDNA_ID_1620852_Annot_ID_51006 3000 nt of promoter + ATG
ctttagctgaaactatttgcccatagcatccaaagatttctcgcagtcttgtttcattcattgattcactcaagttcttcacgtacagattggaccatctcatgttaggctttgcaataaagttgtcactgaatttctgtttcagcatctccctcctttcatctttcttgagtgccttaccaacaaacaatttcttcgatcctgcagattgtcaaaggaatgtttttaaatcaggaactatggtctaatgacaagatactaaataataggttcagacaaagaagttgaattaccaagttgtagtccacagagagattccatagctttcttagcattttctggattgcagaagttaacaaatccgaaacctctagatcttcccataccatccctcataaccacaacactagagacagttccatattgagaaaacagtgtatgtagacaatcatctgtaacagtttcgatcagattcttcacataaacgtttgtagagtcttgatttcctgccatagctgctctttcatccttgttgatgaacttggcaacaaacctaaagtcaaaaatagaccaagtaaataaacaaccatttcatcatcattaccttcggttactaagaatcatacaagcttacagtttcttgccataaaccatagagccgtggagagcagaacgagcagatacagcagattgctctgtatcaaactgaacaaagccaaaacctttactttggccattctcttcaacgactttgcaagaaagtatggaaccaaaggggcaaaacattcgctctaagcaactgctagtaatcgagctatccagattctttacgtatagatttgcaaaaccagtacgagtacgacgacggtacgcaagatccctctgagaccacattattcgcatagcctttcccttcaaatcactatggtttaagcgagtcatagcattcgatgctaatccacagaatcaacaataaagaaacaaagatctgtcagaattagtgacctaaatcggttaatcgcaagacaatcttagagaaaaacaacgaaatttccagggttttaacaagaattgaaagagtccaaaatcaaaaaccgtaaacgttgaaaccaaaatcggagactggaaacgaagaaacgagtaaaaaagtcgaaagtcttgtttaccgctgaaaggtgaatcgaagttgatgtaagcgtaacacatggattttccggtgacagagttacggcaaagatgaacggacactaccggaacattcaaagagaacttatcaatgagatctttctccgtcacgtctgggctaagatcaccgacgtaaagcgaaccaaaccttgaagaatgctggtggtttcctaacgcctgcgtttccgttttcacgagcgccattgttgttctctcacaaatccttatctctctctcgttctgtagaaatgtagaatcaatgagaaagaacaatttctttttccgaaaaactctgcagagaaaaaagagtaaatggagaagacgagagaaagcagagaggtcttattttgtcttggagtgtgtatatatagatgtatgtatcgttctgttataaccgtaatcatagcgcgcacagagacggcggtacgatatttcgtacggaactccacgcgccgcgagtatggcttagtggttaaactcgcgttaatttgctcatacccgaaattttaaatttatccaaatatggaagtgagcccattccaaataattttgggcttatttgagttttagattaataaggctagtattctatttttgggtttgtttagtatgtagtttttataaggcccatcatgtaattgcataggttatgctgtattttgattttgcatttaccatgtcaatgccaactcacacactattgatttgtttaatatattttcccattgtgtattctagaaattatattttaatctaatttgttcatatgatgtatgagaatcttaaagtagcatattcttttgacaaataacaaagtagtatattttaaatgaatttctcttgtttacttgccattatagtcatttatttaaattatgttcaaaatcagattaccttacctactaattcaccctaacgaaattttcatgtctttaatttgaaacaatcgaagatttgacaacttattttacaatttttctataataataatcttttcgacgagttaaaaaagaaaagttatattttattttcctgctcaaaattattgtattcttgtccggaaaacttaactgtcaaccaaatatttataaattgtattctgtaaaaaaaattctaaagggtaagaattccccttgtttacgtttcctttgtttacgtcccactatattcatttatttaatttgtttttggtcgacagcttatgttactggataggttcaaatgaattaaaccgaataaacgttgtttctatatgaaatagaatgtgcgtgaacacgttccatcagctttagaattagttagtatagttaaatatacatgatcttacttcaatcaattaatcaaccacacatgatacaactattaattcttaaagtggtttcccttttgagaattgagggcaacactaccaatccattaagccaaaaatgcaaggggagattatacttatttgaagaacgtggccaagatacagatctttattacgtatagtgagaatctttcttctcataaaagaaataagaaagagaagaaaaaaacgagttgccatatcatgtaaactaaaagtcttccctatcgaccatcatccatatcttccccaggtcaataaataccatgaaatttccctaacatagatcactgcaccaattaaccattacttacttctcaggtaatctctctaccttttctcatatgattatagttagtatagtatttggttacattatatatgataatctttttgaaactatttggttacgtttctaatcgcaggtaataaatcgtaagatttatcaaacgcaagcaaaagagatg

SEQ ID NO: 6165 - DNA, 3000 bp, Unknown
  misc_feature (1)..( 3000): cDNA_ID_1830246_gDNA_ID_1620852_Annot_ID_51007 3000 nt of promoter + ATG
gaaatgaacatcatctacttcacatccgttaaatccatacacaatccatactttcccttgcaccacttcgagccctgctcctcctcttatgctaaaggaatctcctggattcgaacaatgaaaccacgtcttgtcaacgatattgtaagagtctagtgtcttgattcgatccatagcacccactccaccgaaaacgtaaacgttttcctcatccgctgccatcgaatggaaactacgaggagtgggtccttcttccaccggagttagcagtttccactcgtttgttgtcgtgtcaaacgagtagaaaccgttgtattggcgtgaaaagtctcggcctccaaaggtatagagggtcgatcctactgacaccatacggacacctaagcaagagaggtgtggaacgtctccggtggctggagcaatggaccaagtccgggtctcgaggtcaaagacgtaaaggtgtttatcgatgggctgatttggtatgagctcaccaccaaaagagtaaatcttgttgcctacttgagctatgccatgtgagcatcttagccctgggccttctccattttgctccaccttataattaattagtaatatttgttagctatttttaaaaggatttatattctgattagtaaatttccataattgtaaaataaaattaatcaaattataaattgcaaaactgtcattaattatctaaattccaatttttccctctctttttttttctttcgcgtccgtggtttagtatttttggtgctaacaaacaaaaccttcaatatacatagttgtgggagatctttgtatgttggtctaagtgattactaccttaatccagtttccaagcaatttgggagtggacggcaaagaaacataggcccctagggaatgtagaacgtcggtcgaacgtccatgaaacccaacgatttttccaccatgtagcacaaacttaaccccaggttttttaacgataggctgagaggttttgcctttagaagtcttgaatgaaagaaacgtgatcatttctgaggtcatatcgctaactttctcacggtaaccttccacgtagacgatgtagtcatccgaatcaatctcaaactacaaagaaaccatataattttcaatgcggaaagctaagcaacaaagaaaagagacactcttgaccaatcacaacatagcaatcttttttagtacctcttcaactcctagctcagtcttctctccatgttcatctccaacaaccacttcagaaccattggcatactcaaacttgacgaaggctataccatactggccttgccctacatatacctttgtaacattgtcgtaaacaccatcatcccatacatctcccgtctcaccaccctgtgcaactagcttttgggccatctcttttgcttgcgtttgataaatcttacgatttattacctgcgattagaaacgtaaccaaatagtttcaaaaagattatcatatataatgtaaccaaatactatactaactataatcatatgagaaaaggtagagagattacctgagaagtaagtaatggttaattggtgcagtgatctatgttagggaaatttcatggtatttattgacctggggaagatatggatgatggtcgatagggaagacttttagtttacatgatatggcaactcgtttttttcttctctttcttatttcttttatgagaagaaagattctcactatacgtaataaagatctgtatcttggccacgttcttcaaataagtataatctccccttgcatttttggcttaatggattggtagtgttgccctcaattctcaaaagggaaaccactttaagaattaatagttgtatcatgtgtggttgattaattgattgaagtaagatcatgtatatttaactatactaactaattctaaagctgatggaacgtgttcacgcacattctatttcatatagaaacaacgtttattcggtttaattcatttgaacctatccagtaacataagctgtcgaccaaaaacaaattaaataaatgaatatagtgggacgtaaacaaaggaaacgtaaacaaggggaattcttaccctttagaattttttttacagaatacaatttataaatatttggttgacagttaagttttccggacaagaatacaataattttgagcaggaaaataaaatataacttttcttttttaactcgtcgaaaagattattattatagaaaaattgtaaaataagttgtcaaatcttcgattgtttcaaattaaagacatgaaaatttcgttagggtgaattagtaggtaaggtaatctgattttgaacataatttaaataaatgactataatggcaagtaaacaagagaaattcatttaaaatatactactttgttatttgtcaaaagaatatgctactttaagattctcatacatcatatgaacaaattagattaaaatataatttctagaatacacaatgggaaaatatattaaacaaatcaatagtgtgtgagttggcattgacatggtaaatgcaaaatcaaaatacagcataacctatgcaattacatgatgggccttataaaaactacatactaaacaaacccaaaaatagaatactagccttattaatctaaaactcaaataagcccaaaattatttggaatgggctcacttccatatttggataaatttaaaatttcgggtatgagcaaattaacgcgagtttaaccactaagccatactcgcggcgcgtggagttccgtacgaaatatcgtaccgccgtctctgtgcgcgctatgattacggttataacagaacgatacatacatctatatatacacactccaagacaaaataagacctctctgctttctctcgtcttctccatttactcttttttctctgcagagtttttcggaaaaagaaattgttctttctcattgattctacatttctacagaacgagagagagataaggatttgtgagagaacaaca

SEQ ID NO: 6166 - DNA, 3000 bp, Unknown
  misc_feature (1)..( 3000): cDNA_ID_3439543_gDNA_ID_1620852_Annot_ID_51008 3000 nt of promoter + ATG
aaaattatactgagtatacatctatgtgtcatcgaaataagctgataataacgaatacacgttttctttttatgtctggagtagaatacagcattcatgcccttacgttgcaggttcccatcattttacaaatattctcttctcttttctactttctcttttttgatgtaatacgatctatttatttattctatatttcactatatatatctcagatgtccaacgtttcagtattgcattgccactcgaattacctaagataaaaacgaattatcactttgatttttcgcacttatagttaaatctattctcaaaatttaaacaaacatgcagaggcaagtggcactcatcaagcagtccctctttgatcaggttttggtcgtttgtttcttcgtattttcgtaatataacttcgtacgtcgtaccacttatatatgaatttcttcatataatttagaaaatgactaatataggaaaatgcatgcagggatatctcgacgaacaattcatggagttagaagagctccaagatgatgcaaaccctaattttgttgaagaagtttccgcattatacttcaaagattcagctcggttaatcaataacattgaccaagctttgtgagtattattttgttttctattatatatatattttttttttttcagttttctaatcatttttacaatgcagggaaagaggatcatttgatttcaatcggctggatagttacatgcatcagtttaagggaagcagcacgaggtaatttccccccttagtttttgactattctaattacgccttcaagaaataattttacttaaagaaatgcgaatacttaaatgtttataagataaaagaatgtaacgcaaaagtacattaaaattacttccattctcattcaggattcaatgacagaatctactttaaccagaaataattagattttatgatcgttagttatactgacaaatgttgcatttcttttttttgtagcattggggcaagtaaagtgaaagctgaatgcactacgtttagggaatactgcagagctggaaatgcggaagggtactttcgtctttatacttatataccttcatgcttctcgtttttaacagaaaactaagtaacggggtcaaaatgaaaataagtatagtttagatggctaaaattgctgcaattaatccgctgaaccttgaacttttactttacttcattttcgaccccctaattagttttcttcgctttttcttacttgcagatgcttgaggactttccagcaactgaagaaagaacactcaacgttgagaaagaagcttgaacattatttccaggcgagccaataatcaattatgcttaataatttacataattagaatgtgattagaagttatcatcaatcacttttgatatagtatttgctgaagtgaaattttttgtaatgaacagttggcaaggcaggcggggcctaaggagacagcacgtaggcccaagtaagagagaaagagagagagacagagataaatgaggaatcgtcgtcgaattttgtagcaaaactatataataaatagttcctctttatttttatatatttcgatgtacgttataaagaaggttttggacttttatattatgtccgttaataaacggtccaaatgtctctatgtttttccccttatatcgccaaattttcccttgggagttttatagctacgattacctcgtaacatatggcttcctctaataacggaatacagaaaagagtggaccaaaaaaatgcattttttcgattctatgatgaatgcattaccttgtttacaaaaggaaaaaaaaaagaaactaagctttacattattcggtttgtttccaggaaccgtgtccaaatcctaaatattcttacctatttttatatcattatgttaatatttgtctctactagtactgattaataaatatttaaaaaagaaaaaaaaaaccaaaatattcttaggtaaaagtctaaaataacattatcattatgttactatttgtctctactaaaactaattattaaaaaaaaaagaatgccatggcttagatgcaaactattcttagctaaaagtctaaaataataacattatcataaacaattaatattacacttttccatctaatttctcttacatgccctatttttcaaacgatgtcgtttaagaatatcacatagaccttctatttcatgaaaaaactaactcaccaatgcaaataaataaatcaaatgtttgtttgtggataaagtaaaacgttttctttcaatggcccagcatttactaaaatttatttcaagttcttccacgtaaagtctacactacatacactcatacaggcagtgtaacgctgattcgtagagctggagagtatcacaacaataaatttctcttccgaaagaaaacagcctaatattagggagatatttacatactctataagatgttctttaatctcttatatatattacatatgaaagaattaattgtttaattattatccaaagcgacgtgaaaccactctcatttattagccctagctatatctcacaacctccatcttccttactttaaaaacacagaccagatcctatttatagcatccatgtgcgccattgaaaggtaaatttatttaataaagtttacctataatatcaaattatgcaaaacacaggctggttcagttttttccacgaatcaaaaatggttggagaaatattgaataagagagagagagagagagagagagatagagtttcagagttgacacaacattgaagtaaactaaactcctaacctctttatctatgtgtatatataaaactcaaaagtacatataatcttcaccattcacacatagtcacataccaaagcaaaaacatggatcgttgcacgtcgtcgtttttgcttctcacattggtctctaccttgtccattctccaaatctcctttgctcaacttgttccagcaatcatg

SEQ ID NO: 6167 - DNA, 3000 bp, Unknown
  misc_feature (1)..( 3000): cDNA_ID_2125292_gDNA_ID_1620852_Annot_ID_170361 3000 nt of promoter + ATG
ttgaatttataactatggaaattcatctataatgtatcttaaacgcaattgcttgttgtaaaatcgttgggtaacaaacgcgacaattttttcaatattcccataacgatcttttatgtgaccgttaaataacaaacgcgataattttttcacaccctaaacgactttttgtataaccgttagataaaaaaacgcggcaattttctcttaaacctttcaaaacgatcttttgtattaaaacgatgacgtattctaacttgagtatttcttcttattttagaaaagtatttgtgaaaacatactcaaaatctctttaaattaagttaaggataagatgagagatattgcattaatgctaatagaattctcacattttaaggatactaattggtaagtatatgctagatatttatgtattgttgaccaaaaaaataataacacaaattagcttacaagttacaaccatttaattttacaccatgttggattgagaattttgatggttattcctttatatgttgaagaaaccttctgggccaacaactttccaaataggcccaattcaaacccattgtacaaatgcaaggctactttcgtcatttttcgtaaggcgcttgaattttgcgttttcagaatcttggtttctagggtttcacttaccttccctccgcgcccttgagctctctacctgagcttctccgggattcctaaagctgaaattcaaacacctccattttcatcctcaaggtttgctctctctctctccctctccatcgatccattagatagtgtgattactcctatttgtgtactgtcttcgatgattggcgtcaatcttactaccttctcgtttaaaacccagtaacttgcgattttgttgaactttttcctcaattttctttcgattaatcctctagaaacccgtagctaagcttagattagtgatttcaatcgcaagattcaatattgatcttgcccaagtgaattaaagtcgcaaaattgatttgtttttgtttttttagctttcttatgtaattttgctcaaagctatatgattttttgtctttgcagggagataaataaaactctattgagtagaaaatgagtgctgcagcacacaggactcctaaatcagggaggcaatctctgctatttcaagatttagcttctcctgtttcagcacgtagagggaaattctcgagtccgggacaggcagctgcggtatctgcactatggcgtgagaatttcggaggatctgatcttccaccacctccaatgtatactttggatgaccggtccgatttctctcctgagtctggtattgcagactactctgcgtctccagatgctaagtctgacagaagaacaccattccagagttctggaaagaatattgtaactcctggtaaaggaaagttggaagcaagcccttctttttctctactgaatgcacaacagagtcagcaagtttcagggagtccgagttggtggtcgcagtcaaaggcaggtagtagtaccgagcaggatgataaagggaagggatctcctgtagaaggggtggttcagccaggtgcattggtcactcttccgccgccaagagaagttgctaggccagaggttcagaggcagattatacctacaggaaaccttgatgaggaagagtgggtcactgtctatgggtaaggccatttaagctttattgctctcgtttttctcactttactgttgcaaatgttcttgatttgtcaacattctcgtgtctctgaaattctaggtacatggatgataacagttatattggtactgggtagtgttattaagtgccttaacttgtgtctgtctcccatgtttcaatcttagagaactgttcataataaatgctgttctttaccatcatgatgctcaaatatcagcctttgattgtgattttatgttttgatcattgtgaattctgactctttacatggataataactggtagtgttattaagtgccttatcttgtgtttatctcccatcttttcaatcttaagaactgatcataataactgccttcagattttctccaggtgatacaaatttagtactacgggagtttgaaaaatgtggtatggtcttgaaacatgttcctggtccaagaaatgccaactggatgcacatcctctaccaggttactgttcttcccttcaaacctgtttgatgcatgttgataagcattcatagttcttctagacgagtcatcatacatgatagtctaatcaaatcttttatataaaggaaacaacgaactgacaatggtctgtgtatttgatacagaaccggtctgatgcacataaggcgctgaacaaagcagggatgatgataaacggagttgtaatagtaggagtgaagccagtagacccaatacagaagcaagcgttaaacgagagactcaacaaccaaggattcatgcctttacctccaccatcatccactagaaacactgctcgacccctgtctcgtcctcagtacttgcaaaacggcagcgctttctctcctcaaccaagtggtggcgctatggcctctccgtcaaagtcaatggtctcaaagttctttgacttgatgttcggtgtttaaaagctacttcaatggcatttcccgaatgattcttctttacacatagtttgaagtttttgagagcagagtggctaagtaaatcttagagcgtggtcaaaattaaaaattgtaagaggtgtttcaaattgtcttttgtattgacgacggctaaaaatttggtataaatctgattattaaaatctcctcttttagccgtttcattgttgtttgtatttgagcagactagtcatgcctcgtgaatgattgaaagaaagacactgattccatggaagcctcacgggcagtgttttagaaactccattaggaactagccacgtatctagcctgttgtgtttatatatcccctctcgcatgtaaattacattacaaaactcagtaactcaca

SEQ ID NO: 6168 - DNA, 3000 bp, Unknown
  misc_feature (1)..( 3000): cDNA_ID_1830234_gDNA_ID_1620852_Annot_ID_170356 3000 nt of promoter + ATG
agtgattgttaaaaatcgttatttacttacttatttaaatgtcacatagagagaaaagagatttgcatacttgtaataatataatcgtgcttgtataagaaaaaaaaaactttatgagacaagaaaaaaaaactcgggtgtacgtacgtcgtaagtaaaagggccaatgcaagcaagctgtttggctctttccttaaagcaaaataaaagaaaaagttatctttttctccttttatttcaacttttttctttaattttcttttccattttttatgcttaatttttcaactccgagatatgaaactctctactttgtgtttagtttgaactcttttagtcataaaacaacaaactctgccgcaatcaacaaaaagcgaaggagtcaaataaaaacttctttttacgagtgaaagtgactattttacttcaatctcttttgattttcaaaactaagaaaaaaaagaatggaaatcaaagttgtgcatgttcttcccttagtcgatatgtaaaagtgatttgatagacattattgtatgtaaaagtaatacaactctgaaaaattttaagaaaaattgctagtatcagctaatccaacaattagttatatgttttggagaatgtgtaacatgaccgattataaagctaacatcactttatttattgaatttataagtaatgcaattatttaaataggtcttctcgaagaacatctagatggtatacgcttttgtgaggtgagctcccttttatgtttgatttaatagaagaaatgtaatgtgtaatgacttgcttcaaatgatttgtatgttcctattggataagggcatcttgattttatttttattttttgtatctataatgtgcagtaaactttttacttttcattttagtatgatagctggagtttggttgtttcaaagataggcaagtattgtgtttaacaactaaaaataaaacaacacatatttttcaatagaattatttacaaattataaatctaaacacagggaaaatgttagatacaaaaacaaaaaaagtatcaaagacaagcagtgtatcagacatatataatatcatattttcaattcattagaaatacaacttgccatatcgcaaattagtccataatcaccaaggtagggaacgattgtctatcgataagttatgattgaaagaaaaggatttcatgaagaaaaaaaaacttaatttttcttccagaatcgtgacttagaatttttgttaacaccgacgaatttagataacaaaagctactccctcattgactaagccaagaaagttgagtagttgactaacaatgggactaatattttagcaaaatcaatacaattttggtaattattttggttcatgaaaatgttcaatttttttggtctgaattgtggaattcacgatttatttagcctttttgcggtatatataaaattaagatatttttatgtaacactttgttttataaaggataagcttgtatagtttatatataacggctagtcatgctcaaagcctttatcatctgtgggcttcacaatcttatttcttcgacccatttgcttcaagcctcaaaccaaaacttggctgagttcttcgaaagctcattatttcttatatagtaattcttttacatagtgttggaaaatgaagtaaaagaatatcgaaacttgaacgcttagatgacgaatctgtgacattatgatttcaagtatcgacgtgttttatcaaagtgaaaagttgttaatgttggtgttgggtccgtgaaagctcgaagccatggagattaatttcaaacacttttgacctttgagccttgcaagtttggtttatttgttcaacgccagacacgtttgcacagatatgagttggtgagtgcaaatcccatcataccaactaatataaagttataccatcaatgatattctatcgtgaaaaaatatgtaaagtctaatatcattaagtatcatttattaaaagaatgaattgaagggaaaaaaaaaaaaaaagataggcaatccactagtgttcataatgaaagatgatggtcgatgtaatatgtatactaatattatatctctagctttgatcctcaatagtcaatatctatagtgtttatagtgttttaacagcttttgtataatgttaactgtgcaaaatacatgacataaaataaatgattttttttggcttttatgttataagtactattagttggttatctgttttaaaggtttttccttgaattagaggatcagatttacatgcccataacagaaccaagctggtcaccaaatccatcttatgtagtggcataacagaaccaatcttggtcaccgaatacagtagtttcacctttctctttctccaaatataataaaaaacttttttattttgtgcaaaataaactttagtgagatatattgagcaaatatgtatatatatataaagatttcttgagacgatatctctttgcctctttgggtcattgttaattccatgtatcgatttttagggttgaagagacttgtttgtaactttgaccaattgtctactctttttagaccacaatgttagtaagtatgtaggtaggacttgtttcgaatgtgatgatttatttaggcccagacaaattatttactagacccattgttgttctattatttactgtttgaaagaagttgtttttgtcgttgattgtttactagtatttcaaagaaaagggtatgcatagtttaaacttcaaggaaatcccttatatatagtaaaattaaaagaaattccacaattagatttcgtaatacaattttctataacaaaacctagttaattagtccacatgtcctagctcttacccactcagcccgcatattcctcacgctttctttttattttccgaaattttttaaacggctaccaaatcaaaatgcataaataaacaaacccttctcttctttaccaattcccaaatccaccaaaaaaaaaaaaatg

SEQ ID NO: 6169 - DNA, 3000 bp, Unknown
  misc_feature (1)..( 3000): cDNA_ID_2153571_gDNA_ID_1620852_Annot_ID_170354 3000 nt of promoter + ATG
tcgggtctatatttttattttacttttatgattatgattagtcgttatcggccgatttatttgttatttaacaatttgtttaggattatagctttttcggattgggaggaatcatgttcataatatcgcggaggtgtaattattcacgaaagtgatagaggataaaaataaatttgtttagcatatactttatttaacgggtgatagatgattgaagttacatctttcaaataattggatattattgaatttatattaatagttgagaagaatgtttttaattgagtaatcaacacaattaaaagaattaaaaatctgtttgtgtgtcgacatttgaacttttaaggagtcatcttcaatcacgaaccagtcaacattgtgccctttatacgaaatacttagttcaattaggtgctaatagctacttctaataactttagtagcacaaattctggcatcatgtatatccaacaaaaaatctcaagataactttccgaagaatatctatcatttaaaaataaactttctctaaacatgtattaatcttccaatcataggaattaatagtggaacaagctagccttctaaagtattacaagactgattttgtcttgaatatgaatataagttatattacaaactagcctatagtctagcaatttcctaataatatatgaaaactaaatctctacatattttctcccttcgaattaattagtcatttgtaccagaggcagagatgatagttacgagttcataataattaagagttaagactatatatagccttaaagcttagaaatatacaaaagatcataagaacaaaaaataattttcttttataaaattaagatcacatatatatataaaggaataattggattgtgtaacacatatacaacaaaatttagataaatgtcatgaattttgtcctcttttattagaattttatcttgtataatactaaaaggtaaacataataacatttgatttaaatacaaaattggggtttatcatgtaaaaccaacctcacaagttttggaatgaattgttttgtttcttctaattttgtggtattacatatttgttattagaggggaggtcggaattaaggagaataatcgagatgagacagcaagcaataataaaacttagattctaaacccacttccaccgaaaatatgtagtagacaagtcctttatgtgagattggtttggtgggcggaggaataaataaagctgatttttttttgtatatgatcaatctctctctcttctgtaattcgatctcacgatgcttgtctgagagagaaagagatatagaaaggaacaaattatgctgtaatgataaaaagatcttttatgtctttgtgtcaatcatttagatcacacttgttatgtgctcttcagtttttcctttttagatacttgttccttgtttccaataacagaaatttatggtttattttttactcgttggatatatgtataccttattctctctctctctctttttggtttcctacttctttctttttttgttacaatatagaagtaggaaacacacgcatccgcacaagtactagcctttccttggcacacaacaccctctcacctccacacattaatggaagaaacttggaaaagatttgcatctaatttttcaatgtttgttgcagcggtcaaagagaaagaaaacacatcaaacagaaaaccccaatagaaatctatttatttctggtcttgatcatgatactaaccttgactatgtttttaatataaaaatgtcgtttaatgtttatcacaagatataatccttacttagtaattgaattccggaccccaaactaaaatacttcgaattagtattgctttctgttgttgaaacaaaagataagcaataatagtgtttgctagtgtgctagattccaacaattttttcttccaaaagtacaacttttttttgcccatttcgtaaattcatatgtacatatatagttgaatgttgtgggtgtacgtaattggtaccattaaaatcaggaaatcacaaccttaaaaataacaaaaaaaaaaagaaaaaagaaaagacaatgatattatagaaaactttgtgaaaacatgaattaaattcagtaattaatcaagacggaaatggtctgttcagaatatttttcttgaactgtatactttttcaatctataactttctttttcactttcaggaaaattcgtgtccacatacattttactagtatatatttgcctcatttccaaaggtgtgtttcgtatagtatcaacgtttagcttttaggttctatattcgaaattttacatgtttctatgatgtacgtatatatataatattagtcgtattcccattcgtgagatcctttgattacttattaattaagatgcatttcagttatatttttgggcaatagatcaatcatccacagtagtttaagtttcataatggaccatactattaattaaacaatcaacattgaggaattctctaattgaaatctcttattcaaaactttaacataaacactatcttatatatataaaagattactatacattcaaacttatatatcaacacacatatatgatcatttgataacacctaccatttgtgttatacatatattttatagagaagttatagaaaattatactgagtatacatctatgtgtcatcgaaataagctgataataacgaatacacgttttctttttatgtctggagtagaatacagcattcatgcccttacgttgcaggttcccatcattttacaaatattctcttctcttttctactttctcttttttgatgtaatacgatctatttatttattctatatttcactatatatatctcagatgtccaacgtttcagtattgcattgccactcgaattacctaagataaaaacgaattatcactttgatttttcgcacttatagttaaatctattctcaaaatttaaacaaacatg

SEQ ID NO: 6170 - DNA, 3000 bp, Unknown
  misc_feature (1)..( 3000): cDNA_ID_3079737_gDNA_ID_1620852_Annot_ID_170353 3000 nt of promoter + ATG
tatacattcaaacttatatatcaacacacatatatgatcatttgataacacctaccatttgtgttatacatatattttatagagaagttatagaaaattatactgagtatacatctatgtgtcatcgaaataagctgataataacgaatacacgttttctttttatgtctggagtagaatacagcattcatgcccttacgttgcaggttcccatcattttacaaatattctcttctcttttctactttctcttttttgatgtaatacgatctatttatttattctatatttcactatatatatctcagatgtccaacgtttcagtattgcattgccactcgaattacctaagataaaaacgaattatcactttgatttttcgcacttatagttaaatctattctcaaaatttaaacaaacatgcagaggcaagtggcactcatcaagcagtccctctttgatcaggttttggtcgtttgtttcttcgtattttcgtaatataacttcgtacgtcgtaccacttatatatgaatttcttcatataatttagaaaatgactaatataggaaaatgcatgcagggatatctcgacgaacaattcatggagttagaagagctccaagatgatgcaaaccctaattttgttgaagaagtttccgcattatacttcaaagattcagctcggttaatcaataacattgaccaagctttgtgagtattattttgttttctattatatatatattttttttttttcagttttctaatcatttttacaatgcagggaaagaggatcatttgatttcaatcggctggatagttacatgcatcagtttaagggaagcagcacgaggtaatttccccccttagtttttgactattctaattacgccttcaagaaataattttacttaaagaaatgcgaatacttaaatgtttataagataaaagaatgtaacgcaaaagtacattaaaattacttccattctcattcaggattcaatgacagaatctactttaaccagaaataattagattttatgatcgttagttatactgacaaatgttgcatttcttttttttgtagcattggggcaagtaaagtgaaagctgaatgcactacgtttagggaatactgcagagctggaaatgcggaagggtactttcgtctttatacttatataccttcatgcttctcgtttttaacagaaaactaagtaacggggtcaaaatgaaaataagtatagtttagatggctaaaattgctgcaattaatccgctgaaccttgaacttttactttacttcattttcgaccccctaattagttttcttcgctttttcttacttgcagatgcttgaggactttccagcaactgaagaaagaacactcaacgttgagaaagaagcttgaacattatttccaggcgagccaataatcaattatgcttaataatttacataattagaatgtgattagaagttatcatcaatcacttttgatatagtatttgctgaagtgaaattttttgtaatgaacagttggcaaggcaggcggggcctaaggagacagcacgtaggcccaagtaagagagaaagagagagagacagagataaatgaggaatcgtcgtcgaattttgtagcaaaactatataataaatagttcctctttatttttatatatttcgatgtacgttataaagaaggttttggacttttatattatgtccgttaataaacggtccaaatgtctctatgtttttccccttatatcgccaaattttcccttgggagttttatagctacgattacctcgtaacatatggcttcctctaataacggaatacagaaaagagtggaccaaaaaaatgcattttttcgattctatgatgaatgcattaccttgtttacaaaaggaaaaaaaaaagaaactaagctttacattattcggtttgtttccaggaaccgtgtccaaatcctaaatattcttacctatttttatatcattatgttaatatttgtctctactagtactgattaataaatatttaaaaaagaaaaaaaaaaccaaaatattcttaggtaaaagtctaaaataacattatcattatgttactatttgtctctactaaaactaattattaaaaaaaaaagaatgccatggcttagatgcaaactattcttagctaaaagtctaaaataataacattatcataaacaattaatattacacttttccatctaatttctcttacatgccctatttttcaaacgatgtcgtttaagaatatcacatagaccttctatttcatgaaaaaactaactcaccaatgcaaataaataaatcaaatgtttgtttgtggataaagtaaaacgttttctttcaatggcccagcatttactaaaatttatttcaagttcttccacgtaaagtctacactacatacactcatacaggcagtgtaacgctgattcgtagagctggagagtatcacaacaataaatttctcttccgaaagaaaacagcctaatattagggagatatttacatactctataagatgttctttaatctcttatatatattacatatgaaagaattaattgtttaattattatccaaagcgacgtgaaaccactctcatttattagccctagctatatctcacaacctccatcttccttactttaaaaacacagaccagatcctatttatagcatccatgtgcgccattgaaaggtaaatttatttaataaagtttacctataatatcaaattatgcaaaacacaggctggttcagttttttccacgaatcaaaaatggttggagaaatattgaataagagagagagagagagagagagagatagagtttcagagttgacacaacattgaagtaaactaaactcctaacctctttatctatgtgtatatataaaactcaaaagtacatataatcttcaccattcacacatagtcacataccaaagcaaaaacatg

SEQ ID NO: 6171 - DNA, 3000 bp, Unknown; identical to SEQ ID NO: 6165
  misc_feature (1)..( 3000): cDNA_ID_1830246_gDNA_ID_1620852_Annot_ID_170352 3000 nt of

SEQ ID NO: 6172 - DNA, 3000 bp, Unknown; identical to SEQ ID NO: 6164
  misc_feature (1)..( 3000): cDNA_ID_1830250_gDNA_ID_1620852_Annot_ID_170351 3000 nt of promoter + ATG

SEQ ID NO: 6173 - DNA, 3000 bp, Unknown; identical to SEQ ID NO: 6163
  misc_feature (1)..( 3000): cDNA_ID_2992185_gDNA_ID_1620852_Annot_ID_170349 3000 nt of promoter + ATG

SEQ ID NO: 6174 - DNA, 3000 bp, Unknown; identical to SEQ ID NO: 6162
  misc_feature (1)..( 3000): cDNA_ID_1830254_gDNA_ID_1620852_Annot_ID_170348 3000 nt of promoter + ATG

SEQ ID NO: 6175 - DNA, 3000 bp, Unknown; identical to SEQ ID NO: 6160
  misc_feature (1)..( 3000): cDNA_ID_3070205_gDNA_ID_1620852_Annot_ID_170346 3000 nt of promoter + ATG

SEQ ID NO: 6176 - DNA, 3000 bp, Unknown; identical to SEQ ID NO: 6158
  misc_feature (1)..( 3000): cDNA_ID_3079746_gDNA_ID_1620852_Annot_ID_170344 3000 nt of promoter + ATG

SEQ ID NO: 6177 - DNA, 3000 bp, Unknown
  misc_feature (1)..( 3000): cDNA_ID_3079748_gDNA_ID_1620852_Annot_ID_170343 3000 nt of promoter + ATG
aatcacacaaacagttaaattccattataaagtcaccctcatggcttaagaaaaagaggtggaacttttaagtgacctacccgagattccagattcatcagaatcgcagattttgttgctgctttggcgcgatcaagatgtttctgattaactgccaaagcatgtacaccagagtaaataatatgtctgtatgagttgataaatggttctaaaaaagaatggatgaaatatatagaaaaccttttccatcagcaacagcgttcatttcactagctactaattcaattccctgtgaagcaaattcaggactctgcaacgccaaaagaatgtaagcaaacccacattgcaaagtgctaaaaaccgttaataagcaacaactagaaatcggtgcaaactcaccgtgcaaccatagattccaaacaatccggtattgttaaagacgctagtgaatgcagtgcatgattgaaactgctgatgttggttcaaaaggcgaagatctgcatccagacaataaagaaaccaatctcatcatcatcatgaccaacaaataactaacttacattaaaacatgagtgttgaaaaaccgcaagtagaaagagaacacattcagagacttacagagccaagagtgcattccttttccagggcctcccgcagaaaatgagccacctcctcccataagcatctgataagaattggattttacacaattaagtctttgcgtttgaaagatcaagtaatgtatttgagtcaggcacctgaagaacagttgcaatgatagcttccttctcgttattccatcctggcacttcaaaagcaagcgcaaaatgtgtagcctgagaatggtgaaacaaaaaaagaaagatattaggaataataaaccttcttttactcaaagaagcccattgaaacgtcatatttgtacctctccacccgtatgttgacggaaatctccaccgacatattgagactttggctccgcaggtcggggtacattagggaggtcagatagtaatggctcaaccacttttagaagttcttcatgatcaactccactagctgctaggaccattcgtgaagcagtgtaattctcctgaaatttcagaacaaaatgagaaaaaagacacatctacgaaataacaaaccaaaagccagtgatactagttccagcgaatgcaataatctcttgtgttaacggtcttacaaaaacaaaattctccaagacctccccagtcaatccagtaattgcagattcaggtgcatacaatggatttgccaatgcgccagagtaaccagcagaatgaactgcctccaaaagaaaacccattggattcgttgcgaattctcctatctctactttcacctttcggagctgccaggagaaaaatgatgaaaacagtgtaaaaaaattgcttagctttaatgtttgtgagatacatgcaacatgacatgaagtacctcttcattcacttcccaatccaaaaaagcagggttcctcacactatcaataagcacttcaaccatttcgggaacataggttttgagagcatcaattgtgtaacccatctgctctcgggatgcagaagctgaagtattacctccaatagcctctatttcccttacaaggcgaaaatggcttctgttcaatgtactcttgaatgccatcctttcaagcaagtgcgtcgctccacggaattgaggagtctcataaatagaaccacagtcaacgtataaaccaatggaagctgctggattctgaacaaaatttcactcaaaatcactttccagtagtttttaacaggaagttgatgttgggattactaaaagaagctctcaccggagacatctcagtggctatagtcagaccatttggaagagtagtggtcttaagtttgctaggctcaacatggtcagagagtggtggtggaagagagacaccagccaagggaatgttcatagaaggaagtgaactagagtagcctccacttagccagctggaggaagaagagctcgttgcaacagcactagaacttgcataacgagaagctcgaaaattgtggtttagaatgccctataaacacacacacacacacacacatcctaagcatcattaatctcttgattcaattaacattgtaaaaataagaactttcgaaacagagacatttcataaacctgcaaaaagcatgaataatggcaccagctactataaagcgataaaattgaatcaagatctataagaatctaagagaccctttaatccaaatccaaaaacaatgaatcatacaaattgttcaatactaagcattctcctaaaaaaaccagaatctcaatggaaacaagtgaagtaggacattgaccttaagggccttggctcgagaagctgccgtacggtacatgatgatgactgcgaaaccctagcttggtcagatgagtaccggtgaatgtggctgacgacgggagagagatagaggccgagtcagagctgaaaagaaacgagagaagggaacgattttttttcctaattaaggttattggatcgggcaattgcttctaattacattgataggcccatatgatataatagtcttggcccaaattataacatatagaaaagatgaatttaaagcccatgtattgtagtggtgtgatcctattatattttctctcaattatattttttttcttttctttttcacgtaccattgtgtaaaaattcaagtaaggtaacgacatttacatgcagtcacaaatgaaacaagaatttttttgaggtgtgtgtaaagtgaaacgaaaaaagtactaagaaagtttatcttctctaagttaatagaattattttgaaacgtagtatccacatatatagaagactcgtgtgtggtgcatatatatactgcataacttcaattgaactgtattatataactatgactatccatccatgggaagataagaatgagagccgaatgctaaaaagcaagggacccgaattaaacaaaa

SEQ ID NO: 6178 - DNA, 3000 bp, Unknown; identical to SEQ ID NO: 6155
  misc_feature (1)..( 3000): cDNA_ID_1830267_gDNA_ID_1620852_Annot_ID_170342 3000 nt of promoter + ATG

SEQ ID NO: 6179 - DNA, 3000 bp, Unknown
  misc_feature (1)..( 3000): cDNA_ID_1830242_gDNA_ID_1620852_Annot_ID_51009 3000 nt of promoter + ATG
gtgtaattattcacgaaagtgatagaggataaaaataaatttgtttagcatatactttatttaacgggtgatagatgattgaagttacatctttcaaataattggatattattgaatttatattaatagttgagaagaatgtttttaattgagtaatcaacacaattaaaagaattaaaaatctgtttgtgtgtcgacatttgaacttttaaggagtcatcttcaatcacgaaccagtcaacattgtgccctttatacgaaatacttagttcaattaggtgctaatagctacttctaataactttagtagcacaaattctggcatcatgtatatccaacaaaaaatctcaagataactttccgaagaatatctatcatttaaaaataaactttctctaaacatgtattaatcttccaatcataggaattaatagtggaacaagctagccttctaaagtattacaagactgattttgtcttgaatatgaatataagttatattacaaactagcctatagtctagcaatttcctaataatatatgaaaactaaatctctacatattttctcccttcgaattaattagtcatttgtaccagaggcagagatgatagttacgagttcataataattaagagttaagactatatatagccttaaagcttagaaatatacaaaagatcataagaacaaaaaataattttcttttataaaattaagatcacatatatatataaaggaataattggattgtgtaacacatatacaacaaaatttagataaatgtcatgaattttgtcctcttttattagaattttatcttgtataatactaaaaggtaaacataataacatttgatttaaatacaaaattggggtttatcatgtaaaaccaacctcacaagttttggaatgaattgttttgtttcttctaattttgtggtattacatatttgttattagaggggaggtcggaattaaggagaataatcgagatgagacagcaagcaataataaaacttagattctaaacccacttccaccgaaaatatgtagtagacaagtcctttatgtgagattggtttggtgggcggaggaataaataaagctgatttttttttgtatatgatcaatctctctctcttctgtaattcgatctcacgatgcttgtctgagagagaaagagatatagaaaggaacaaattatgctgtaatgataaaaagatcttttatgtctttgtgtcaatcatttagatcacacttgttatgtgctcttcagtttttcctttttagatacttgttccttgtttccaataacagaaatttatggtttattttttactcgttggatatatgtataccttattctctctctctctctttttggtttcctacttctttctttttttgttacaatatagaagtaggaaacacacgcatccgcacaagtactagcctttccttggcacacaacaccctctcacctccacacattaatggaagaaacttggaaaagatttgcatctaatttttcaatgtttgttgcagcggtcaaagagaaagaaaacacatcaaacagaaaaccccaatagaaatctatttatttctggtcttgatcatgatactaaccttgactatgtttttaatataaaaatgtcgtttaatgtttatcacaagatataatccttacttagtaattgaattccggaccccaaactaaaatacttcgaattagtattgctttctgttgttgaaacaaaagataagcaataatagtgtttgctagtgtgctagattccaacaattttttcttccaaaagtacaacttttttttgcccatttcgtaaattcatatgtacatatatagttgaatgttgtgggtgtacgtaattggtaccattaaaatcaggaaatcacaaccttaaaaataacaaaaaaaaaaagaaaaaagaaaagacaatgatattatagaaaactttgtgaaaacatgaattaaattcagtaattaatcaagacggaaatggtctgttcagaatatttttcttgaactgtatactttttcaatctataactttctttttcactttcaggaaaattcgtgtccacatacattttactagtatatatttgcctcatttccaaaggtgtgtttcgtatagtatcaacgtttagcttttaggttctatattcgaaattttacatgtttctatgatgtacgtatatatataatattagtcgtattcccattcgtgagatcctttgattacttattaattaagatgcatttcagttatatttttgggcaatagatcaatcatccacagtagtttaagtttcataatggaccatactattaattaaacaatcaacattgaggaattctctaattgaaatctcttattcaaaactttaacataaacactatcttatatatataaaagattactatacattcaaacttatatatcaacacacatatatgatcatttgataacacctaccatttgtgttatacatatattttatagagaagttatagaaaattatactgagtatacatctatgtgtcatcgaaataagctgataataacgaatacacgttttctttttatgtctggagtagaatacagcattcatgcccttacgttgcaggttcccatcattttacaaatattctcttctcttttctactttctcttttttgatgtaatacgatctatttatttattctatatttcactatatatatctcagatgtccaacgtttcagtattgcattgccactcgaattacctaagataaaaacgaattatcactttgatttttcgcacttatagttaaatctattctcaaaatttaaacaaacatgcagaggcaagtggcactcatcaagcagtccctctttgatcaggttttggtcgtttgtttcttcgtattttcgtaatataacttcgtacgtcgtaccacttatatatgaatttcttcatataatttagaaaatg

SEQ ID NO: 6180 - DNA, 3000 bp, Unknown; identical to SEQ ID NO: 6168
  misc_feature (1)..( 3000): cDNA_ID_1830234_gDNA_ID_1620852_Annot_ID_51011 3000 nt of promoter + ATG

SEQ ID NO: 6181 - DNA, 3000 bp, Unknown; identical to SEQ ID NO: 2333
  misc_feature (1)..( 3000): cDNA_ID_1830226_gDNA_ID_1620852_Annot_ID_51013 3000 nt of promoter + ATG

SEQ ID NO: 6182 - DNA, 3000 bp, Unknown; identical to SEQ ID NO: 6167
  misc_feature (1)..( 3000): cDNA_ID_1830222_gDNA_ID_1620852_Annot_ID_51015 3000 nt of promoter + ATG

SEQ ID NO: 6183 - DNA, 601 bp, Unknown
  misc_feature (1)..( 601): cDNA_ID_1830214_gDNA_ID_1620852_Annot_ID_51017 3000 nt of promoter + ATG
ctttttcatcaattagtatatagattagaatgttctgttttgtcccctgtttttgactgtgttgtattgtctttagaaataatatcaatttaattgatttttcctgtgagtgtgacagaggaaataaatcagtttcatgtgcataatgtgaattgtgaaaaagaaattaaaaaaaatcggaactttgggaaataaggaaagacaccgaagaacacacaaccattcctctttattgaccgcttccttctttctctgtcacatacgaatcggtgagtttttttcttctcaatttctccgttctctgctgatttctccgaggttattgattcgattccgcttgacgcatgattgtgttgtctcaagggtctaattttacctccgcgttgattggtttataggggaaatttggatcccgatcgtgatctttagtttggtgaatttgagctggaattggagcttaaaggatcggttttttgactgatctaattgttttgaggatcggtctttcataaagttgttgtctttgaagcttttttgactggtgaggacgaaaaagttgtgattttgggaattagggttgttttgtttcgaattcgccatg

SEQ ID NO: 6184 - DNA, 3000 bp, Unknown
  misc_feature (1)..( 3000): cDNA_ID_1830914_gDNA_ID_1620863_Annot_ID_51281 3000 nt of promoter + ATG
ttgtagagagattggagaagaatgttaaagggggtgactttttttgaagatcggatggattttttttttctcagagatctcaacagggagagaaaaaagacaaggaagacggtcacttcatggttaaaaaagtttgttggaaaatgaactaaaaattctaaatttagcatcaaagacacgacgagaaagaaaagagacagggtcaaagattttgtttttttttttaaaaagaaatatagttcactaattaaatcatggttaattaccttcttatttgctaagaaaatttgagacagttaactaaaactcacttttcttcgtaagcattgtaggaattcggtactattcaaaaagagggaaaattccaaaacaaaaacacaattatttattaattagacgtttaatatgtaatactttatggttagaagaaaaatatgcatattaataaaaattgtgcaattttatcttcaaaaaactaattgatgttattttcatatcaataattttacaacaaaattttaattttaattttactcttactagttcaattaatcattaatatttaagtgatgcaacattaattttattttatttttaaatttactgtttattaatattttgtttctgtattcatcccaaaagattttgtttttctaaaatagattattttatttttaaaattcaagagaaaacaaattaaccatttttatgaatagataaattttgagaaatacaatgactttgggattgagattttgtcgaaaatacttttattggtgaagaatttaaattcaaatagagagtttctcacgacgaagaagaagttcatatcgatgttcgttgatatcatatccatcacaacgaaaaaaaatcgtgaacggctatcgaattcgatgttggaaaaagagggcaaaaggagattgtttaacggcgattcacatagcgattaatcgagaaaatctagaatcaaaaattgaatcctaagagaaaacgtctctttcattttctcctaattttttatgttgaattttaaaataaatgaatatataatagtaaatgaaattttaaaattaatgtacataaaattaatttctttatccaaaagtgtaaaattaatgccacgtcatcttaaaaactaataattaattgagatagtacgtgcataattatcatatttttttatgatatcgttattatgaaaataaccacatttaaatgtttaaatattaaactacacagtttattaatctttttcatccaaccaaaaactattagatattaaacgtccaaataaaaaatgagattttttcctttcaaaatatgtttacaaaattgggctttttttcttttgaattttgattttatacttctcaacctagcaaaaattcgatgtcggttataaaaataaatctctatcaaaaatttgttacgtagaggaatacgactaaaggaagagaagaaaatagggctatattaatttatatacccagaaaacataaaaataaaaaataaacttataattttttttataattagttctctttccacaacttctataagttggactaaaataccctttcgctcataataaactaattaacaacataagaaaattgttaccgacatcttttatatgattcagatgatattgtttatcaaatatataagtaagaatatattatgaattaactgataactgttatgttaacaagataacaaaatatatagcaataagtttataactatattgtgttaaaccatattgtatcgcgataagtttataaatatattatgttaaattatcttgtaccaataattttttgttgttcattatgttttgttatttgttaattattttaatatgatgtaattatattgatttgatatgatatacatattattttgatataaaatttaatacttatccattaaaataacgtgtgcataatcaaaatccggattattatgattaaatcctcttattattaaaagagaagtacaaattgaatttttgtctaatttgacctcaattttgatttcaattttggattttcttctttgctattcaaaatcattaagggtaatttggtcttaacaatctattaaactttatatgatccgattcaatctaaaccgttcaataaaattaattcccttcaatctaaaccgttcaacaaaaataagtaaataacaaaaaaaaatcccaattattatttagttatgtttgttttaaaaatttttatttataagtttaagatatcaaatttattcaaatatttagtataaaaaccaaataaaccgattgtccgcggtaaaccgcgggttaaatcctagtagatagttaaaatgtatagcaaaatagaatgcgtaagattaaaattttagtttttagaaatttactaaacaaaatacagaaaaggtgtgttgacaactatttaaaatttaaatataatcaataagatatagttaaagttattaagtgtatagcaaaataaaaattgtaagaataaaattggatttaaaatttttttagtaaattaaatattttaaaaatagggattatcatttactgtttagaattcaaatatcatcgataaaaatttatactattgttttataaatccgcttatctagacgggcctaacctagtaaatatataatacacatcttatcattcggtcaaaatattatgaaaacatcattaaaatttgatgattacattccataagtaatttgttaaagcattatgcattttcctgttctatggacattaatttgaaccatacgactccatctaattcacttgttctcggcagctagcattcgaatcctgacttttcaaatacaaattatcggtcaagatgggtgtgcgttacgttcatttacaaatcactaaaaatgagtggtgaataatcatttggacaatacggatacattcatcgaagttgactccattatcctaccgtcgtctcctaacaatcgaagcacaactttgcaatg

SEQ ID NO: 6185 - DNA, 3000 bp, Unknown
  misc_feature (1)..( 3000): cDNA_ID_3079771_gDNA_ID_1620863_Annot_ID_51283 3000 nt of promoter + ATG
aaaataaatatcacttaaataaactatatcaatattgtcacaatagatccagctttagtattgaaaaactatttaaattttttattaccggccatgtcttaattctagctccattatccgtcctaatgaaagtgcaattagttacttggacattctcaactatagattcttctccatctcttcctacacttcccacactgtattttaattttatagataaagaagaaaatgtaatatatatatatatatagaatatataaaattagtatatgtacaatgctattgatgaatcacacacatatataccttattccatgaccaggtccacaattcatccttgcgatattgatattcatacttccgctgttaatagctacacaatcatctcctggaaagttttataagaaattttaaaattaaataatcttaaaataccatttgagattactttttaattagtgagtgtgcaagagagatatctagctatatataccagttccaataactgtgtcgtatatatcgacatcacttgattctgagatattaattccatcagtgttaggactatcgtggggtgctacgagttttatcttcgttattttaactcttttgcattcgctaatcgatatatggttttttggactgttgaatgaggttattccagttatcatgagatcgttgcatctttgaaaatgcaattgctgtaagaaaaattgaaagaaaaaaagaattcatcatgaactttccaaaatattgacgacgatcaatgtatataaataaataaaatattttcattttagaattcagaatgaattttagtgagaaaaagataaactcacggtaggccgtttagaagcaggcagtccttgctggatatattgaatatgaaaaaaagaggaaatattaaattaacacttttgtttatatataattaaaaatcatatcttttattgtgtatataaatttctttcaagattgccaaaaaataaaattgtttcaccttccaaaaagacgagccacgtccatgaattgttcccgaaccattgactgttaaaccgattatttccttaaaactaacccatctaaataacttatagtccgaccaagctgctttatttataggtgcaacaatctttccgtcaaactgcataaatgaatacatatacacctttattaatcagataatttgcacataaaattgtaaaaagatttataaaaatatcgataattaccttaacttgtacggaaggagatttacaagggccttggaaagtaagaggttgtagtaaaaatgttttgtttgatggaataatgaatgtttttgaattcccaccactaccacacatagcgctccatgctttcacaaaagcctatttattttatcaaaaaatcaaatgtattagaattcttaataactcaaattttgtgacaaaacgtatgactacgttgtaggaaaatgaaaaacctaataatagttatgtatactcaaaggctgtatgatattatattggtttgaatttttttttgaaaacttacaaaattcagatattttcataatataaaacaagataaaattttgcaatataatacctttgaatcatcggtaataccatttccatcggcaccaaattcaagcacatcatagatttggccgtttacaagaatagaatgcagtaaagtcaacaagaacacaccacgtagtatgatttcctacaacatacaaaatcaatgttagaaagaaagaaaacatactaacttttataaaaaactttactaacttcttatcattgtgtgatgatgatcagatgtaactcttaccattgtgtgatgatgatcagatgtaatgtagtgtatatgtatgtgatgttgatcacttaaatatacacatacaaaatcatgggtatatcttattaaaacatgttcatggatatagttttaaactttacatattttatgcctaaaatcattagttattatggatattatttcgcatataagtgatataatctctcttttatataagatttagaaataaataaaatagaatttgaagaaatagtaaacaaatacaagttaaaatagaaatgaaaatacttgaatataagggggtactaagtaaaaaacattttggaaaactcaaaaatagaattaaatttggatattgtgatctcattgcattattaacttatatttaacaaatacgagtaatattctgtgtaactacacagccattgacattgaaaactaaaatgcttttctaattatttggtagtgtgatttgcaatatatatagacagtaacttgaactaaaatctgatatgatgaacttattaatataatgtattaatcggtttgatgtacgataaaatgttttaaattatccactagtagggttgcatacatggtacattcaatataaccctttcaacgacaagaacaagcactaggtttctgattttaagctctaaactatgtgatttaatttatttgtttgaaaaaaataaagtgtgctagaatatgggatcatgatcatttccattctgaaaattaacgatgtacatttttttttaaaagatagtgtatattaattagtttgttatagttttgaccaaaaaattaaaataaaattatcagttagttaaatttaaaatccaatctgaaaaagatatatatgtaacaaaatttgtttttttaaaaaacactctctgcgtctggaaaaaaaaaaaaagattaaaaaccaataaagaaagtttcggaactaattagggcttccttttgcttacatgaaatataccgtcgcaagtcatctagcactctgcttcgtaagtttcgtcttatctgttctagagaaaaggtcttaccattccagaagaagtttatgaagacaagatcagtaaattgtccgacgacttgcttgtgcagattctattgcttgtctccacaaaagatgcagtggccaccacggttttgtcaaaacgctggcgtttcatatggacaatg

SEQ ID NO: 6186 - DNA, 1333 bp, Unknown
  misc_feature (1)..( 1333): cDNA_ID_4256554_gDNA_ID_1620863_Annot_ID_170399 3000 nt of promoter + ATG
cttattggtgataaggttgcagaatggtatccatacgacatcaagaatgaggatcccaatgtcttggctagagaagaaaaagagtactttcctaaacctctcttttcttgtttactttccaattgattgctttgtttatcatagaaaactctttgagtgggattgagctggaacatgtttccacaagctttttagttcaattgctatttgggggttagtatccaaaatcctagacatgagaaagaaactagatgtagattgtatgagccttcttgtgatttgtggagcttacgcagagtcatgttctttggtttctggtgtaaaatgcaacatagtcacgaactaatcttatttggcaaggatagtactgtctttgaaattcacttacacttggttttatattcactgcttatgttatcattgttttctctctgttgagaggcattttaacttaagtttgggtgttgttgttgtaggcggatatcgaagcttgagatgttgaaacgtcgtgacaaaggaccaccaaagaagggtcatggaaaacgtgctgcgaagcgtaacaagtagaagtaataaccatagctacaaaaaattctctgcactcttagagtcaaactcttctggttgaatcagatagaacttataagtgaaaatttctcctacttaaaactgaattggtttccaatgatgttactatgttgagacatagttgaaagctatttgcttcccttttgactaaaaatgtcaatggcttttgtttctcttctcttactcttttagtctttagagttttttgagattaatattggtgagatgtttgtacttttttgatctagtttttcttatctcgtgatagatttcaaatcctctttgtcagtctttgatgttggattgaaagtgaatttatagatttttaccttttcgaatttaaatattaaggtgactaaatactgaagtggtaggtcggccattctaattctgagtactagttcaactattctgaggtggtaggtcgaccattctaatactgaaatggaacgtgtcacttgttacttgttcttattgagaattgattttttacagggatcctaattaccacggatttacttgaatgagtttagtccatcaaaaagttgaaaaagaaccaaatattaaaagatggttggtgtaacctgtctgcttatataatccacgtgtgaaaaatgcataaaactcaaacgacaacattttgaaaacgatggcaaattcttgaatgattcttctttttatgttccctttttactaaagctaaaaggattcattagcaagtgtttgtgaaagggagagagaaatg

SEQ ID NO: 6187 - DNA, 3000 bp, Unknown
  misc_feature (1)..( 3000): cDNA_ID_3409564_gDNA_ID_1620863_Annot_ID_170398 3000 nt of promoter + ATG
gaatcagctttccgaggaactaagcgagcgcctcggttctgacttggagcagaataagcggattgcaagcacccttacccttcatgctagcgctttcagagtacctacttctcttgttatatatcatttttctctgcgaagactacgacttaaaacatatttttcctgaaaaatattgcagtcaaaggattcagattctcataagaaatttccttcaaaatcatgtcctatgagatatggagtaaccaagatccaagaagatgcctttaacttgttccaagctgccttacgtgagtacatgggatccttcgggatcaaacctcaaggaaataagctagagacatggaggataacaggtctttctgtttcagcgagtaaaattgttgatataccatctgtaagttcttagagccattaaatgtcttctacttacttatctctttcaaacattggttggtttcttcactgatttggtaggagtgatatcttattactgtagggaacaagctcgatcatgagatattttcaaagtcaacctactgttccttctcgttcagcagatggttgtgttcaaggaaatgtagcgatgactgcttcaggtattctagagtatttctgtatattttcagaactttctacttctcttgattctggtacttaatgtcgtgatctaatctgcaactggtgcagctagcgaaggatgttcagaacagaggtcaacagaaactcaagcagcaatgcctgaagtagacaccggtgtaacttatactttgcctaattttgaaaaccaagataaagacattgatctagtctccgaaaaggtatcagctctcatttccctttactctaaagcatattttaggcctttcttagaggtgtgatctagcaaaaaggctaaacatatttaggctcaattacgttctcagtttcaactttcaaaggagcttctttagtaattataactggtaacgaagtgattggttaggccctgtagtgtttgaatgactcaagagcttatatatatgttcttaaattgtgtatccttgaagaaccaattccacacattccttgtcaggatgttgtctcttgtccatcaaacgaagcaacggatgtttctacccaatcagaatcaaacaaaggcacacagacaaagaaaattgggcggaagatgaacaactcgaaagaaaagaatcgggtacgcaatatattgctttgtttggtgcacgaaaagcttctacctttactgagatttgtttgcttgtttgttctcagggaatgccttcaattgtcgatatctttaagaattacaatgcaacacctccatcaaaacaagagactcaagaagattccacagtgtcatcagccagtaaaagagcaaagttaagtagcagcagccataatagtcaagtgaatcaagaggtagaagagagtagagaaacagattggggatataagactgatgaaatcgatcagtcagttttcgatgaattaccggttgagattcaacgagaactcaggagtttcctacgcaccaataagcagtttaacaccggtaaaagcaaaggtgatggttctacttcaagcattgctcattattttccaccattgaatagatagatctaagctcctttgtctctgttgttgactgtatatagtgtagtccttgtctaccttagatttggtcttgtatcttgagtactacagatatattatgcttaaatcctattaaaaatgtcatttttgagcaatagaaaaactaaatatatatatatcgtctttaaaatccatcgagacctcttgttttttatggtatgcacagtgatagaagggtttttttttttttttggtaaacatgtgaagaagtgatagaaggtttatcagaagtttgtatatctttgctcaaccacggaatctcatgaaatattcaaacatcctacctaattgctctagtttctctagtatgagttctttttggatcaattctatatcaaacgattacattttattttcaaaagtcaaatcaatcgaaatgttaattacaacttcgcctaaatatgacttttttcttaactaacttatttttcatcctactttctagaatagaattctctaatattaattgacctaacataagttttttttttggtaaggaggatttttttttttggtaaggttgaactaccataagtttgtttgctatcaaaacatttttacttcattttgagcgtaaaaacggtaaaaaagaaaacacaaaattcgaaaacctgaaaccgtttttggggttaggacaatactgcaggccactgtcatgccatccaatgggtttactttttattattgttcctcctgtgtgtaaaataccctaaataccctcgaacttgctctccaaaattgcaattaatttacctttaaaagcttaattaagagtgtccgatttctcaagaaatctatctaacaccaagattataatttctattagctgcctaaaatttgtctgtgtgcgcaataatccacacgtacacacgcatctactgtattcgatttcgtctctatatataaaaacacaaagacagtcttcttcgtgatctctcattttactgttgtcttaaagcaaacacaagataagaagaaacaaacaatggcgatttctttcatttagatattttcctcgattcttagcttctgggtacttcaaatctctctctctccttcacgggttcttccaaatttccatactttttaccttgtttcctgcgaaaaaaagctatcttttttttatttgtgaccctacattgatatatgactcaactgctgaaaaattgatactttgcctagattccatcatttattgtttcttgggttaatcaatcaccactttttagcaaaaaccctgaaatcgaatcagttttttctctgtaaatttcatttcttttctgcagaaattagcctatttgagctcagtttcgtgtatttgtgcagattttggtgaaaggatttgaa

SEQ ID NO: 6188 - DNA, 3000 bp, Unknown
  misc_feature (1)..( 3000): cDNA_ID_2141421_gDNA_ID_1620863_Annot_ID_170396 3000 nt of promoter + ATG
caatttcatgctaagatagctattgtgctgcgggaaaatgcagaatcgaagaattggccacggctttcttttatttcctttacttttagaaagcagaagataaataaaatagcctagattgaggaaattaccaaatcaatgtggataatggttgacttcttggccatttcagctgtattctggcctgaatctgcccatttaagtccattggaagagccatgaaatcttttacggtacctgttcctccatgttccaataaaatgcagccttgaattctgcagaacaaaaaaaatacatatagagaaagcatcttcagaatcttcattggaacaatactatccatccaattatttgtagttatataaactggcaatgagactcttactttcagctgaaaggacttttaatacaggcgtactatctcaggcagagatcattgtttatttttcagaagaaaccagcagataatgaatctattgtaagttgtaccttaaagtagttttctacaaaattagggtcctcgagagttgaatgacgccttgtagaagatccagcagcagttgcaattgatttgccaccattcttcccatttgcatgaacggacttgttgtctgaagtggaatgaagattagtagtggattgaagttcactactaacttctttttcttctatgtcataattaccaagtccttctgcattcatttcagaagatttcagatcaccagttcctgtttgttctgtcagttctggagtagtgttctcgatataaacgccatcaatttcatcatcgatgtggtcccttgcttcctctgaatcatctgctctaattgaacttccttcttcagcttcactgtatccagtatcaggctgaaaagatgtaaccggcgaagccatctgaggggtcaaatggcttctgggtgcaaaaaaggcagacaactttggctgggtatcatttagttgatctagctggtaaggaacccctgtgatgcgatggcattgaatcagatgattaaatagattgtgtgcaagataaatgaatgcatacgaagttgacagtagacaatgatcaaatccaaacatttatacttatgtctacatgatttaactgaaactaaatcatcttgtatagacttacagcccagaagtctgttggcagagatagagtccactatccatgtaggtttcacaacaggtaatcctctgctgaatgtcctgattggaaacaaaaatccattataagacacgaacttgcaagaaattagcgaagaattttaaagaaacaactaacctaagattcttgactttactatctggaaggttgctgcaaatgatatgtgtaacagaacgcctagaaaagtagttctcaaatcttccaccatacttcatcatgtatcctttcaactcctacacagatctagacactgttaaatcacatataacccaccagcaaaactgcactacaacaaattctaaggtttattcacctgcaacagtttgtacgatataagagttaagccatttcaaatcaggaaagaactagaaaccaacaaaattgaaaatgggtagaaaccaaagcaatagagcttaaacctgatgagaaggaatagtgaacccatccacaaagattgaaaccccttggaaaataagtttctcagaacccgaaacaccacgagaagcagcagaagcctcagtctcaaattggttctgaagtttcctatttttcacttccatgtaactaacatcaaaaacataaaaaaaataatcaacaaccacgatagtataacaatgcttaacgcatcttacttcattctaacttcataaaatttccaaaattcaatctttctcagaacatcacttttcagagggaaagtttcaacttttacatgggaatttcaaaatctaaccactacccaacactaaaatggcagagaatgatagaaagaccttccgaaatcggagaaaggagaagaccggaaagaagaacgagaagaagcagcgccccatgccgcgcctagggttttctgattgctcggattattattcttcttagacttcttgttacttccactgccactattgtttgaagaatttgaacccaagctacgcttcattgttgttgttggggaggaatctcaacgagacggagaagaagaagcattcaacgaaattttccaatttgtaaagtcacaacctgtgagtggtttatatactaaaacacaaacattttcagattagtacttaaacttgtatatacttccaaaaatccccataagttttaatttttacagttataatttaatacctaatttttttattttatttttgtaatcataaacataattgagagaaaattgtttttcttgaatccaaatctttagttagtgaagattatctagccaaatttaatgagcaataaaaatcgacatttcacaataatagtgaaattaataatagtagtgaacaaatagtaatggatgaaaaaaacatgacccatattatttttatgattgttttatataaataaaaataaactcaataaaaattttatgtaatgaataaatattaaatattttatctatactttttgtttatctaccgaacgatcaaccataattcgaaagatgcagcttgatgtccataattttgttaccacactaaatctctaaaaacaacaatgtcaatcttcaacctatttttacaaataatttgacacggcaaatttggagaaatatttagggtttgagatcattacaatgaatttcatgttttgttgtcaaattacttgtgttctaaacgggttattttgcaaagtttagtttctttgagggttcgttttgaaactttctcattttattaatctgtctcgctttttctcctaattattattttcgcgcgctattcatcagtcatcatccccaagaaacccctctttcggtggtaaaaactctctctctctctctctctctccctctgatttctgcggagatttctgaaatagaa

SEQ ID NO: 6189 - DNA, 3000 bp, Unknown
  misc_feature (1)..( 3000): cDNA_ID_3079760_gDNA_ID_1620863_Annot_ID_170395 3000 nt of promoter + ATG
tagagcaactgatagcaaagggaaaagaagtgcattgttgagattctactcttacagttgagagtgacttcaaagcacgaggtccgggaaatgtctttccagaaccatgacttttggggagaaggcgaccttgcacttcttctccactgatccctcttgctatattccataaccaagtactacaagtcgggggaaaaatcagaaaaacgtattaatagacaaacaagcacgagttgcatgtctttaaatttctattatcaagcaaataagcaactattgggaatttagtatgctagaaggtactaatcaaataatgaacaatctacaatagcctacgagtccaggacaacaaaaattctatcttttccaaagctattacccagtatttactccgtaatgttcttgtagcttcgtttcagaaaattgcagcaagtcccctactgtgtcaactcccaagtcagtttgcaagctagtgcccagctttcctcccagttgtttcctgcacgttatgtctaattagagctcaatgattaccagcactaactgaaaattttatgatcctgggacagcgataaaagatgcaatacacaactttggactgtcttacatcttataaaacacagctgtgttgatactgacgcaaatatttaagtgtattccgtagaatgtgacaaatactaaaagttctcctacgaaaatatgtgttgtgatcaatacactattgaaacttacttacattttctttattggcaaggaacttagtaattcctgtacagctgcatatggtacaactgtctgctgcgcaggtttgttcattccactagcaagtttggctagcatctgcttgttgaagttatatgttattactcgccatacaagcgataaaaggaaaacaaaataaaatagcttcttgccttgttatgggctatgccagcagaacaagtaaactcagtctccttaagcacctgtttccggagttctgcaacaatgataattccacaacttaataacttatcacgtcgatcagcatcttctcgacaaatccaattgcggacactctccttgaaatcatctccatcctgaaagtaaaataaataaattcagatcataatattgactatcgactatacttttgttggagactaaaagacaccaaaacagacctctctgttcattccaagaatatgggatttaagaacttcctcatctatcaattccaaactctctggaggtgcatcagcaagcatgctttctgctgcatcagtgaggtcaagatacacttcatcaatcgaagccctctcacattttccgctttttgctagaatcgaaaccacctgcagcgacaacacatagaatgagatgaatttagcaaatgtcattgtttagacaaacacaaacagtataataataacttccacttccatcaacctcagaaccggcactgcgatataaattaaggtcagctttaccacgagccacaggaacttgaaccaattgaatctgaggacaagcagctttagcctcatcacctctcatcgacctgaacattaacccaaaacacaatttttccctatcctcaaaagattgatacaattgggggaaagaagcatttctgtaattacacactaaccgctttacgccacatttacgtgcttcgtaactaacagcaatcaaaccaccaccttgccattcattgtactgtacaactgcactaggcagtcctcgcaactccggttgcttcctctgctccactaatcactcactcataaaaaaatcccttaaccaggtaagtaaaggagacattttgataaaatagaaacaaaaaagcacactttttggtatttggtaatttcccaaatccctaaaacaaacgccaacgagaaaaaaaaagaaaagaaaccgttattaaaattcgattgaaacccaaaattccaacaaagctaaaaagttcaaaaaaagtgttaaaaagctttgctttctctcactaaagcgtctagtggctgaatacaattcgggttagagagagaaggaccttgaacgtagaagcaatccatgtcgacatgagcgataactctagcatccgatgcttccggtctcgctaccggcatttctatttcagaaatctccgcagaaatcagagggagagagagagagagagagagagtttttaccaccgaaagaggggtttcttggggatgatgactgatgaatagcgcgcgaaaataataattaggagaaaaagcgagacagattaataaaatgagaaagtttcaaaacgaaccctcaaagaaactaaactttgcaaaataacccgtttagaacacaagtaatttgacaacaaaacatgaaattcattgtaatgatctcaaaccctaaatatttctccaaatttgccgtgtcaaattatttgtaaaaataggttgaagattgacattgttgtttttagagatttagtgtggtaacaaaattatggacatcaagctgcatctttcgaattatggttgatcgttcggtagataaacaaaaagtatagataaaatatttaatatttattcattacataaaatttttattgagtttatttttatttatataaaacaatcataaaaataatatgggtcatgtttttttcatccattactatttgttcactactattattaatttcactattattgtgaaatgtcgatttttattgctcattaaatttggctagataatcttcactaactaaagatttggattcaagaaaaacaattttctctcaattatgtttatgattacaaaaataaaataaaaaaattaggtattaaattataactgtaaaaattaaaacttatggggatttttggaagtatatacaagtttaagtactaatctgaaaatgtttgtgttttagtatataaaccactcacaggttgtgactttacaaattggaaaatttcgttgaatgcttcttcttctccgtctcgttgagattcctccccaacaacaacaatg

SEQ ID NO: 6190 - DNA, 3000 bp, Unknown
  misc_feature (1)..( 3000): cDNA_ID_2141433_gDNA_ID_1620863_Annot_ID_170390 3000 nt of promoter + ATG
aaggacacttttaaaggcttttcaggttttggatgcgatatacctaatacctaatttctttgacatgattatactataacattaatttacatttgacttaatactattattgtatgtttttgtaaattaaactcaatttttagatatgaaagatgcacacgagattataaaggcaatttgaattgaataatattagtttggtaggtggttcatgtaccaaacaaagcttttgatgcgtgttttgtaatttttggcgtataaaaaatctcttgttaattcttaaaagaaaaaaagaaaaaaaaagaaaaaagaagaaagaattattttgttagtagattactttttcttatttcattatcctacgaaaacgtacaaaaactatatatgtgaggtttgctttcagaaaaaaggaaaagtgtacaaaacgaaatatgacaatcttatataattattttaaaaagattgcataattgatgtctttggttactcaatttctaatgttattttttttttcgtttttttttttatttttttttatttttaaatgtactacacaatttgtgattactccattgggaagctatatgtactacatatattttaccgtcactcttttgaaagctatatgtactatacaaattatgttttaaggaaccatgaattgtttttaagattacttgaagtctacgttttaggtcttgacaacaaacaaagaaaaaaagaaaggaaaaagactaatagtctaatacatttaggtcaaagcttatctcttgatctttcttaagtggaaggttcatattgttatctttgcctttgtttttcttgttttttatttgttcgtagaaagcataatgaatgattcagacagagagaaagtatatttggtgtattagcttttgataagtggagtggaagtcacattccaacgaaagaaaaagtaaactaactattccaatgtttcagaatttggttctctgtaatagttccgagtttatatcataccaaaaaaagaagaagaagagttatagataaactcattagatatgcgattttggaaatacaatagatataaaatgaagaaaaccaaaaccaaaaccatagctatatttttttaagaatatccaatggcaatagctagtatcagaattcttagattaacgcacatattattagcttcacattgcatgatatcattcgttacaattactatttgattaatctaagaatataattaatatctaatggcaagagctaagaattagaattcttagattaacgcctatattatttagcttcacattgcttgttatcacatggtacattagattaattgacgccatggtatactcgtttccagtactattagactaacttctatcatagtttttattttgacttttgtctttgttagttttttttttgtaattgttttatgcaattattttaccaatcaatgtttttttttaccaactctagtctactactatgtttagtagtctatattagtcagtaaagaaataaactatacatattaatttttcaatgttttttgtatgcatttttattgggtaaaaaaatagttcaattggtaaattttgtatgcatttttttcaacaaactaaaaatagtatcattggattttcttaaagatatctaaatgatactattttgatacaatatttttttaacatcatcttgaatttgaataatactaatctgctactaaaaaattagtaaaatattggcaaatcatatatttgttctaaaagtcatttataattgaaaagattcttataatttgatttaaaattactgacaagttacaacatgctatcaaaaactagaaaatttatcgaaattagatttcaaacatatattattgcatttttttcctcattttcaacgtttaagtataaattaattataaacaatgggtgcatttatttgactactactactatttaaaaatataaataggtctcacgagtctaccactcctcgggatcagactaggctacatccattgaaccatagtaaaattaccgtggaaaaaacagtacagctgtaacttcctatataaacacaaagatccatgtgcccataaacatttactactagtctactactatcgtattttttttccttcgtctatgactacactaggttgtttaattttggaatcaaattaattagtagacgacgacttcaaacaataattatttaacatacacgttttgaacaactgtatgcaataattaaaaaatcaacaagaccaatcaaaatcattaacaaatgctgtaaaaaaaaccattaacaaatgtcatttaacatgtttctaagaatatttaatgaaaaaagtatagatcaaagctctagtgctctagatttttcattaaaaatctattaatattttcagttttttttttaaatgttttcagatattttaaaactctattaatatttccagattttttgttaactcttgaacaagtactattaatatttcctttaattacatacgtacatagtaataatagatttctcctataaaatgcttttctttttttacttcagctcctatataaaatactcggataaatagatcctaatcaataaataaatagattcagtttttcttttgatttagtcgtgtacaatgacgatcacaacaaaaaagcccataaatataatttactcaaagtgattaagggtaaaattgtcattatctgatacgtgttttagttgaaaaattgctatcttccaccttcttctatctctctacgaaaataatatttttgagttttgtttttactttttgtttttttttttaaaatttttttttcttcaaaaattcctccattgttattacataaaggaaaaaagaaaggtctctgagattttcaaatcaccatcatcatcatcgttgaagaagacgaagaagataccttcctctttatcttctccgatttctcaaccttcccgtctgcttgtcgtaaagaa

SEQ ID NO: 6191 - DNA, 3000 bp, Unknown
  misc_feature (1)..( 3000): cDNA_ID_1830899_gDNA_ID_1620863_Annot_ID_170389 3000 nt of promoter + ATG
taaaagtaggcaagatttaaacaaagtgattcatcaataatgatatgatatgtgtcattcatttacaaattatgtaacacataatagatattttgtaccctaaaattttgaaatttattgtacataaattttagaaaatctgttggactgtgactagttcttcaacttatagagagttgagtgtgtttataatcacatactgcctctttaaaaaacgttaaccaagtcgaaactcgaatatggtactaccacacatgacaaaatagaaaaaacacttgaatgtttaccaagtagtacttggtccattggcccaaaaaaaatgagaatttgtgctcctttgaaaggagttttcaactgctagacccaacccaaaagaatgtacgattaggcacattttccataattgatgtaatgtaaagaaacacttgaattttaagttttacatataatatttacatttaattcatcttcctcatgaatatgttgttcaattatcaaagaacctacaaagatacagtattataactataagatcaccaaagaagaaaacaatcatttgaataacaaaaacagtaaaacaccatataataaaaccgtgttctagatacaaatgtaaaccatagtatctcaccttgcttatcgattcatctttgtaaaaaaaacaaaaacaaatgtgttcaacttggtttgcaaaaaacaaataacacaagtacacaaccatccatccaataacacaatcacaatatttgtttcccaacatttatgcaaccttatttttagtggacactaaccatagaagaacaaatttcagttgtagtgttacaaagtccattaaaattacgcgttatcaattacaaaaccacatctgttttttttttttttaaacactttaaattttgtgtcagataaaatgaatatatgttatgacagcaatcactttcaaaaggcctatcaaatgggtcccaaatgtataatcctaatgtcaatcacaagtaacctaagttcggcccaaatacctgatggtccactttacaatttttcattaaataaatattaagtaaataaaataacagtaaaaaaaaagagttattcagtctgaagaacattaaattaaggttattaacgtcaaagaaaagataatcattttctctggtggcggcgttttaaaaacatagatttgaaatttttaactttattctataaaactaaaaagctctctgtctagtagtatctaaacgaatttaactaaaaccagctaaaaacaagaagcataaaaataatatcaaagtagaaactaaaggatctaataagtaagacaaaattcgaaattaagatccatggcggatttttgtctcttctctcattggatcgcacttgacacaaatgatggttcgagacataacagcagagaagggtccggtccgaaccgaaacggaggaagaaagcaaaaaggcaagacctttgttgttgggttgttgataaagagagagagagggggacacgtgtagtgaaaagagaggaagagaggtcactctccgttcccggttctgtctcgtgcggtgcgattgttgggtgccatgtcagagtccgttcccctatgagcccggcgaatccgaatcatatgcctttcttttcgctatctctctctctctctctctccctttaacccaaacccatctctcaaagacttgacctttctctctctctatctctaatttatttatcgtttcgcgtgtcgccttctctctttctctcattctctctctctctttcccttcgtatctctctctcgtgaggccgtgccctagaagaagaagaagaagaagcccctttctccgggacttcaatccctaacttccgtcgccggatttctcgtccttgattatcggaggactctttaacaactttattccgatttcagattcccagatttgtaagctgctttctcctttctgggtatttcctctttttgtatttgcttatgtaatttcgatgatttatcttacttggtgaggggttttgatgcttgtgtaatgttaatgctgtttaattaaggactgatttagtgtgattcggtttaattgagtttctttgggggggaattgggtttatctccaatgaagctttatgtttagtgccaatgtgtgttgtttagctcttttctctattgatttgtgtgtgaaattatgtttgtttgagtttcattaccaatggctgtctttacttgaatctcagtgattcatgaattctaccatctgtcgttgattatttcagttatataggatcattgatctatgttttagaactagtgtattattgccttagagaacacctgattttgaagtagaggaatgtagtttgcagtagaggaatgtaattaagtatgaatttaatggaagtattcgtaaggagtgagggaacgaatcgtttattataaaagctgtgttaagattagattacttactaggtttgtgtctcatctttaattaagacttttgattacggatggtgaggcttctaacgttataccaccatttttaggggtgacatcatttagtttcttagcttctatagcttatatgcttggatgacgctgtttgatttcatatcggtttaaaagtgaatgaaattgtggttatggccttatggtttggtacactgtgctttgtccgatgctgcatcattgatttgagttatacttcatttaatcttatcaatttttctgttcagtatttctgagcatgtgtacaatttaagtatttaactacctcactgttgtttcagtgtctcttgatcttagattatggtttacattactcgttttttgtttacaattttagtgtagagacagagttttttgaaggccagtattctttagttacttcggtagctgtgatttacacatgaaggtctatccggttctctatcaagcatatggtatggaaacagaagtagaaaatgaaagattcaggcagtgaaatgattaaaagagattgggtc

SEQ ID NO: 6192 - DNA, 3000 bp, Unknown
  misc_feature (1)..( 3000): cDNA_ID_3079771_gDNA_ID_1620863_Annot_ID_170386 3000 nt of promoter + ATG
tttttgagtatatcgaataatctaatatttcaaaattattttatttgatcatgcgtaaaaataatttatcatattcttacataacattattagctatataaaattataactatttctcatattttctatgaaaatggatactatgttttgaaacaaccattggcctcgttagcattgatagactttccatatacgttactgcattcaacgattggcttatttccatcgaccgtagcaatatcgattttatcaagaacaatgtctttgcaatatgtgactttgctgcaatctatctttataatctcatcgagttttgatgttcctcggagatctgtaaatgtcacgttactgattgccactgctgattcctaaacaaaaaatatataaatttgtttgcaatctagttattcttttataattttaatatttttatttaatagaagaaaatatattaagatgatttacctccacgtctaggcgacccttatcaacataattttggtcgattattatcggatttttggtttctctaaatgtaagactcttaaaaagtatattttttgcgtatccctttccattctaaacaaaaataaataaaaataaatatcacttaaataaactatatcaatattgtcacaatagatccagctttagtattgaaaaactatttaaattttttattaccggccatgtcttaattctagctccattatccgtcctaatgaaagtgcaattagttacttggacattctcaactatagattcttctccatctcttcctacacttcccacactgtattttaattttatagataaagaagaaaatgtaatatatatatatatatagaatatataaaattagtatatgtacaatgctattgatgaatcacacacatatataccttattccatgaccaggtccacaattcatccttgcgatattgatattcatacttccgctgttaatagctacacaatcatctcctggaaagttttataagaaattttaaaattaaataatcttaaaataccatttgagattactttttaattagtgagtgtgcaagagagatatctagctatatataccagttccaataactgtgtcgtatatatcgacatcacttgattctgagatattaattccatcagtgttaggactatcgtggggtgctacgagttttatcttcgttattttaactcttttgcattcgctaatcgatatatggttttttggactgttgaatgaggttattccagttatcatgagatcgttgcatctttgaaaatgcaattgctgtaagaaaaattgaaagaaaaaaagaattcatcatgaactttccaaaatattgacgacgatcaatgtatataaataaataaaatattttcattttagaattcagaatgaattttagtgagaaaaagataaactcacggtaggccgtttagaagcaggcagtccttgctggatatattgaatatgaaaaaaagaggaaatattaaattaacacttttgtttatatataattaaaaatcatatcttttattgtgtatataaatttctttcaagattgccaaaaaataaaattgtttcaccttccaaaaagacgagccacgtccatgaattgttcccgaaccattgactgttaaaccgattatttccttaaaactaacccatctaaataacttatagtccgaccaagctgctttatttataggtgcaacaatctttccgtcaaactgcataaatgaatacatatacacctttattaatcagataatttgcacataaaattgtaaaaagatttataaaaatatcgataattaccttaacttgtacggaaggagatttacaagggccttggaaagtaagaggttgtagtaaaaatgttttgtttgatggaataatgaatgtttttgaattcccaccactaccacacatagcgctccatgctttcacaaaagcctatttattttatcaaaaaatcaaatgtattagaattcttaataactcaaattttgtgacaaaacgtatgactacgttgtaggaaaatgaaaaacctaataatagttatgtatactcaaaggctgtatgatattatattggtttgaatttttttttgaaaacttacaaaattcagatattttcataatataaaacaagataaaattttgcaatataatacctttgaatcatcggtaataccatttccatcggcaccaaattcaagcacatcatagatttggccgtttacaagaatagaatgcagtaaagtcaacaagaacacaccacgtagtatgatttcctacaacatacaaaatcaatgttagaaagaaagaaaacatactaacttttataaaaaactttactaacttcttatcattgtgtgatgatgatcagatgtaactcttaccattgtgtgatgatgatcagatgtaatgtagtgtatatgtatgtgatgttgatcacttaaatatacacatacaaaatcatgggtatatcttattaaaacatgttcatggatatagttttaaactttacatattttatgcctaaaatcattagttattatggatattatttcgcatataagtgatataatctctcttttatataagatttagaaataaataaaatagaatttgaagaaatagtaaacaaatacaagttaaaatagaaatgaaaatacttgaatataagggggtactaagtaaaaaacattttggaaaactcaaaaatagaattaaatttggatattgtgatctcattgcattattaacttatatttaacaaatacgagtaatattctgtgtaactacacagccattgacattgaaaactaaaatgcttttctaattatttggtagtgtgatttgcaatatatatagacagtaacttgaactaaaatctgatatgatgaacttattaatataatgtattaatcggtttgatgtacgataaaatgttttaaattatccactagtagggttgcatacatg

SEQ ID NO: 6193 - DNA, 3000 bp, Unknown; identical to SEQ ID NO: 6184
  misc_feature (1)..( 3000): cDNA_ID_1830914_gDNA_ID_1620863_Annot_ID_170381 3000 nt of promoter + ATG

SEQ ID NO: 6194 - DNA, 3000 bp, Unknown
  misc_feature (1)..( 3000): cDNA_ID_1830903_gDNA_ID_1620863_Annot_ID_51285 3000 nt of promoter + ATG
tatagtttatttaagtgatatttatttttatttatttttgtttagaatggaaagggatacgcaaaaaatatactttttaagagtcttacatttagagaaaccaaaaatccgataataatcgaccaaaattatgttgataagggtcgcctagacgtggaggtaaatcatcttaatatattttcttctattaaataaaaatattaaaattataaaagaataactagattgcaaacaaatttatatattttttgtttaggaatcagcagtggcaatcagtaacgtgacatttacagatctccgaggaacatcaaaactcgatgagattataaagatagattgcagcaaagtcacatattgcaaagacattgttcttgataaaatcgatattgctacggtcgatggaaataagccaatcgttgaatgcagtaacgtatatggaaagtctatcaatgctaacgaggccaatggttgtttcaaaacatagtatccattttcatagaaaatatgagaaatagttataattttatatagctaataatgttatgtaagaatatgataaattatttttacgcatgatcaaataaaataattttgaaatattagattattcgatatactcaaaaatgctaataattaatgagatcatttgaataaccttggtttgattttcatttagtttacatcagttgtttctaatttatgcaaatcaataagaacttgcaatgaattgtttcttcttgtgtttaatcaaattgtatgaattattacttttaggttacatctgctccattacctcgtccatttcttttgttccagacatgatatatagttgcttgaaaaacataccaattagtatactgaagagttgtaccgatagtagtttgaattgtttagtagagcccaatcaatagagtaaacattggcaaagaaccaacccatgagagaatgccaaactgcagctgagtaacgacatgagaagaaaagatgactataagtttgaatacgatctctgttgaaagacgattgttgatagctaaccatgtgaagaatgagtatttgggagttgcataaggaccagacccccttatatatacaattctttccgtggatgtgttgttcgaataatttctaaacttttatcgtatatcaaaccaatctttcaattttataatcatcgatacattattaataaattcatgatatcatattttattttaaattactgtctaaatatttcaaatttactgtttttctttttttctatttatatttttcgtttaggtaattccacggcatattgtttagctagtttttctagtttattgttttctgaggttaattttgtaaactcttcttctccaaattgggaaaccaattatcgagttacctttaatatatgtgtggttaataaaaataatgacactacctaataatcagaaaaacatttacagtagaaaccctataaattaatactcgataaattaataaacacgataaattaataaaatttgttggtcccaagtcgggccaatgtaaaaattaaccaaaatcgataagataataagataataatttttttgaaatccctatgtaaaattatagtcccaataatattataaattaataatcatagatcttaagtatatattttaagactcatttttatatgaaatttttgttcaagttacaattacaactttaaaaaaaatacaactagtatgatctttgttgtactcgcataactatttgcatatttgatccgtcatagttgattttgtaaaatcttttatttgagaaagcattgctaagatttgggtaaagagaaattggattaagcttcatgtttacgttcacgttaatgtcgtagatatacagacacaatatcttgccgaaaaataaatttaaaaagtcaaagaaaaataaaaatctaacataagtatatatgcaaacaacaaaacatatagaaaattaaattaataacatttttaaaaaaatatagtattgtatttacgtaaatatacctataaattaatttttattaacttatacgataaattaataaatattaatttataggataaattaatatcactataaattaataaaattgcatggtcccaacattattaatttatagagtttctactgtagttggctatttagttacacatgatattattactcgtatttgttaaatataagttaataatgcaatgagatcacaatatgcatccaaatttgattctgtctttgatccaaaatggtttttatttatttccccttactcaagaattttcatttctcttttaacttatattttttaattatattttatctatttgactagataaaatccacttaaataggcgggcgtaagaaataaataaaaaatttcttataatatttgaattctaatagtaatccaaacttttttcattttatctaaatattcttaaaccaaattttaatcttatccattccattttgcagtaaaatttaattatttacgtcatgacaacaaactgaattttaattctatatattttatcttaatggataagagcctcaaaaaaattaattctacatattccatcttcttgtttttattttttatgatatttaaattctaaatagtaacccacacagtttttcaatatttagtgttctaatgtttatctcaatttatctattctctctaaatataaataattaatttatataataagatgctatgattcatttctaaatctgatataataagaaagataatatcacttatatgcaaaataatatccattatattaactaatgattttaggcacaaaatatgtagagtttaaaactatatccatgaacctgtttaaaacacatatacctatgattttgtatgtgtatatttaagtgatcaaaatcacatacatatacactacattacatttcgacaaaaaaatacaaaaaaatacactacattacatctgatcatttgatcatcagcaccca

SEQ ID NO: 6195 - DNA, 3000 bp, Unknown; identical to SEQ ID NO: 6191
  misc_feature (1)..( 3000): cDNA_ID_1830899_gDNA_ID_1620863_Annot_ID_51287 3000 nt of promoter + ATG

SEQ ID NO: 6196 - DNA, 3000 bp, Unknown; identical to SEQ ID NO: 6190
  misc_feature (1)..( 3000): cDNA_ID_1830895_gDNA_ID_1620863_Annot_ID_51288 3000 nt of promoter + ATG

SEQ ID NO: 6197 - DNA, 3000 bp, Unknown; identical to SEQ ID NO: 6189
  misc_feature (1)..( 3000): cDNA_ID_1830925_gDNA_ID_1620863_Annot_ID_51293 3000 nt of promoter + ATG

SEQ ID NO: 6198 - DNA, 3000 bp, Unknown; identical to SEQ ID NO: 6187
  misc_feature (1)..( 3000): cDNA_ID_3409564_gDNA_ID_1620863_Annot_ID_51295 3000 nt of promoter + ATG

SEQ ID NO: 6199 - DNA, 1333 bp, Unknown; identical to SEQ ID NO: 6186
  misc_feature (1)..( 1333): cDNA_ID_4256554_gDNA_ID_1620863_Annot_ID_51296 3000 nt of promoter + ATG

SEQ ID NO: 6200 - DNA, 3000 bp, Unknown
  misc_feature (1)..( 3000): cDNA_ID_1830977_gDNA_ID_1620864_Annot_ID_51299 3000 nt of promoter + ATG
agccctgtttctgggtcattgtttcttagaggacgaaatgtaaaaggagagttttttaggttctatattagggatacgctgcttattagctcttttgggatgattactcttcaggacgccttatgtacaagagcaagtcagtattggttcaggaccaccaggttctaaaatcaggtggtttaggtctacgagcaatgagtcacgttacatcaacactgttacatttgatgccaaggagggagctcctacactcgtcatggttcatggttatggtgcttctcaagggtttttcttccgtaattttgatgctcttgccagtcgatttagagtgatcgctattgatcaacttgggtaagcaactttggtatcattcaacttgtcttcctcaactgtattagtcacaatatggccttttggttgcttcaagtgttaaagatttcatgctgttgccatcacttgattttaatgtcttaaaaatcgaagacaggatattgctgcccattttaaactacttgtatacattgtgaatgtataataaggtagttctctctttttcttcgtaggtggggtggttcaagtaggcctgattttacatgtagaagcacagaaggtatttattccctctactgttaatgaatcgtggctaaactttcattggtaccctctcagtctcttaatggcttgtatatgagttgatataccagtaatgaaactgcattgttccttctttaattgtgcagaaactgaggcatggtttatcgactcctttgaggaatggcgtaaagcccagaatctcagtaactttattctattaggacattcttttggaggctatgttgctgctaaatacgcgcttaaggtgaattctcatatttggtataactaaattagtaagtggtgacagtttttgattattatgatatctgacttttcattgggcatatctctggatctttcagcatcctgaacatgttcaacacttaattctggtgggatctgctgggttctcagcagaagcagatgccaaatcagaatggctcactaaatttagagcaacatggaaaggtgcagtcctaaatcatttatgggagtcaaatttcactcctcagaagctggttaggtatgctcatataatcatttcccattcaccaataggttgattagatagatactcatttcgttgatacaaatttatggcactcaattgagcatgggaacacttattcgatgaaattagttggcaggagtaatatattcactatatttctgtaaatgtgctttgtgtgcagaggattaggtccttggggtccaggtcttgtaaatcggtatacaactgcaagatttggtgcacattcggagggaactgggctaacagaagaggaagccaaattgctaaccggtaagtaattgtttctttaagttccatagaagttatggagagtgataatgcaatcgctgatagtgatggttcgttttgcaatgtagattatgtgtaccatactttggctgcaaaggctagtggagagttatgcttgaaatacatcttctcatttggagcatttgctaggaagcccctcttacaaaggtatgtccaccaaaaacattgctgataaagtttctgcatactcacactcgatgactcctcttttgtgtgcagtgcatcagagtggaaagtgccaacaacgtttatctatggaatgaatgattggatgaactatcaaggtgcggtggaagcgaggaaatccatgaaggtcccttgcgaaatcattcgggttccacaggtaaatctctaaacacattcatttgttttctcatttaagaggtgaatatagagaagaagatgacgcttacaagagattttgtttgatcgcagggtggtcattttgtgttcatagacaacccaattggttttcattctgcagtgctttatgcttgccgcaagtttatatctcaagactcctctcatgatcaacaactcctagatggtctacgattggtttagtcatagtatcttgttccttttaccttccaaatttattctatatgtgtatacaagtatatatgaaaaagaacataaaaaagaattactttctttatttgaatattcggttgtgtattggagtttcaagtcctctttccatgtctaaaagttctatttgtaacgttcttgatttcactctaaaacctcttaaagtgtttcaaatgtgatctcattatcgacatccaagttgtaatctttcacaatccacaataatcttttatctcattttttacattttacatatgaaacaaaattatatgtgcttgaaatggggaccactaggtctggtaaattcttattgttttagacttttagtcatcaacataaggttaactttccttgtacagcaaggaaatagtgtatttaccgtagcgggaagggtaaagagaggttacaatttggcatcattcttattttagtagagagacctggacttggtggtcgaaacatttccaatggccatgccgacatgttctctctcagacagctcaatcagctgaaaacttgaggaagaagaaactagagagggttttttgacctgattatttattttggctgactcattcttctcacatcccaacaaattttcgttgatatctgtctctgtcttcatttccgacatggaatttgttcaacatcaattcttttctttagctttatgatccctcacaaataaataatgtccctctctcaatttgcagcaaaccgctgacgatcaaaaggtgagccaagtcttttacatgtcgataattaggtttggtcaatgaaatgtttgaatgtttcattcttggtttctgatacgatgagaagaagtttggtttcaacacatttttttgttgttgttgtgatatctaaattctgatcatttcaatttgatcaaatgatcatcaactgatttaagcatccttaaatgggtttggatttgcacaatagagaaatatagaaagcaaggaaagatg

SEQ ID NO: 6201 - DNA, 3000 bp, Unknown
  misc_feature (1)..( 3000): cDNA_ID_1830973_gDNA_ID_1620864_Annot_ID_51300 3000 nt of promoter + ATG
  misc_feature (320)..(320): n is a, c, g, or t
  misc_feature (338)..(357): n is a, c, g, or t
tttatcctcatcttcatggtacgatgtagtttgagaatgagacaaaaagagaagacgttacctaaggtcgaagtaaaagcttttgaagaggcggtgtaatggagagagtgttaacggcgttagtgtaggaaacgacaacgtgggatgctgctgtctgtgtcagggagaagagagagagagagttaatgaagatttttgtctgtattctgaaacaaggtcgaatgttggagactaaggaaacaaaaataaagctttttgatggcttatgagtctttgaaatagctacaccgctcctctcaccttagtctttaacctaatangggggggggggggggggnnnnnnnnnnnnnnnnnnnncccccccccccccccccttgtctttaacccaataacccccccccccccccccccccccccccaattttctctccctatcctctcatttttgtagtgcgcactgagagagacaaaaaaacaaaaaaagatggagcctttgtttttaaggttttctttatgttgaggacattaggctaagacaaaaagctctgttttctttctttgttggatttttgggtgttgcttgtttgaagaaataaagctttgagtatctccaaggtttccattacagagacaaaaggggtatttgagcttagtttctctgtttatgtgtttgttgtgcttttaaatcggggtttaaggtttatagaagtggtgtttctggtaacagttgagactttttgaggggatattacagagttcaggaaataaaaaatatagaaatttgtgttttgtgtttaatgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggtttcaagttctcacctttttgttgacttctgagctatgaaaaaattgaattttgttgttatgtgttggttttgatgtgattttggtggataaaatccaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatggtaagatctccctagcctctcacttaaacgtttcccatttttgtcaatttgtcttggtttcatgtgttcttgatctcttgttatcatgtttgatgcaactaaaagccattatgatggtattagaatgtcaagttttttaccagtgttacctcttagtggatacatataggagtggaatgtttagtatttatgctgattacaagaatctgccgttgtctatgtggatgacagtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacaggtgcttttacttacattcttgtagtcaaagtattcaaatccttcccctttgaaatcatttgaaagactgaaacttagtggttgatatgtgaagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaaacaaatggcgctcgagttccggtttagtgattagaaaccatcgttgttagtgttttgtttgaaaaactgagaccttttagctttctgttggtgttttacggttggattttgcagtagactgctcttatgaatggaaaattgtttgagacaacgctttactttcactgctggattagtgaaaagtcagaataatcacttttgctaaacatttgactaattatttcaagagttgaccagaccgacaggtccaagtattgccaacgggaagcttctgtgattttgcaggatacgtgacgtcggcaatgacgcgtgcgaagaacaaattaaaaagcatatatccccttaaagcgacttcgcagcaaaacctcttgtctcgtttatctatataaagaaaatttagtagcaaacttctcgattccttgattcgtgggaaaaagaaagtctagatttttgtggattttgattttgtgattccgtgattgtatg

SEQ ID NO: 6202 - DNA, 38 bp, Unknown
  misc_feature (1)..( 38): cDNA_ID_1830941_gDNA_ID_1620864_Annot_ID_170439 3000 nt of promoter + ATG
cttctttttcttctgtacatggttatcgtcgtaaaatg

SEQ ID NO: 6203 - DNA, 3000 bp, Unknown
  misc_feature (1)..( 3000): cDNA_ID_2123373_gDNA_ID_1620864_Annot_ID_170435 3000 nt of promoter + ATG
tagagtgtataccatagtttattaaatatttccactcgttaataaatgaattgtgtgacgaccaaaaaaataatgaattgtgtataggatatataggccatgaaacattcaaatggttggtctccacatgggtgcgcaaactctatctttgtccagccaatcatagtactatatatcttttgctattttctctctttattcttttttttttttttgtaaaattagtacgtattaaattttaagatcttcattcaaaaattgttttccatgttcagttaacgtgtccagaaaaacaatggagttaaatctagatatagttagagtgttgttgttcacacgtatagatacttatttaattattgtttataggtcttattcatgttttattttacgcatcttagaatcctcatttactaaattactaaacatttcacggcaagatgacttgttcaactacattatcagtatcatatactactattaagtaccattttaattatttaataatttccaaatgtgacccttgactcttaagagggggttaagggactctttgattagaaatataagttaaataaacacacacacgagcatatacatagtataaagtatagtccattatgttaacagacaggtgtcaagcaataaagctatttatacaaaactctatttccatccatttcaataatgagcagtgtaaagataatcattcacacaaatccttacattgattggaagtttctctcctttttgtaccattttatgatttataatagaactctaaaagccaagttataaatgtttaaaccctaattatctttcccactatcgacctctgtgggttttatgtgtagatgtacgtaaaagcctacttatcattccttttccgtagccacttataggacatttataacccatttcttagatttcgaactatacaaagattttccgagatttttgaatgataataataataacaaaactcgttgctaaataatgtggtttgaagtaaatttttggatatataagaagataaatcacgaaaaaactcgtggacatgttggcaacagaaacgcatttggagaaactcgcaacgtctcgtatttatttgaaacacacgttccacaaaaacattaccattaactcttgtatcatatatatacatatatattgtcctctctgtgtgtataaaacatgtgtatatatatatatatatatatattaattatagcttgtgatatatacctagcttaaatcaaagccaggatttgatagtatagacctaaaaaatgttgtttactgatcactaatcctcgatatgtaaaatagtaaattcaagaatcaagaatatcgaacacatgacctaacaaactaaagcaaatttaagatgaaagtttttttctgaacatatcatattttttttttttaaatgaacatattcattgcttctagatttttgctgtcaaatatgagtaactttctgtgacgtatgtttttatacagaggtgaaaacagggaatacgccatcaagaagcagggaatcagtaacctactattttaatagaagattcattaccttgttaatcacgaaattaccttcttgctcatgaatcaccaagtcaatgtcaatgtttttagagaaaaaaacacacatacataatcatcaagtcaatgttcttgcaatagttatacctttagtttcccccaaaaaaatattagccaattaaatcaaacaagaaagaagatattacttaaaaatctctacaaaacacatgactacatgagcgagtgaattcgataagggcttgaagaagtggtatgccgattgactattgggttaaaaatagatgaacaattgagattcttagaattagtaccactaaattgactaaaaatcagtaaatgattgaactcatttgagaccaaacatgtgggagatatatatgggaatgaatgctttctaagtggacacgaaaattctatattacagttgagattcgtttgaacaagctctggggaatatacgggggacaagataccaatttattactaaaataaatacgattaaaatagtctaaattgagaaagagaagatccggagatggtggtggtgggttttaaggcatcttgcttatttatatccttaaagggaacagaaattgtcaaaaatacgtcatacgtgacgttttctgtcataattagtaatatactaaacataattaattagaactaaacgataaagtaattagttaattggtatataaatatatggactatggagtataggctttttcatctttatattttgcttattatttattaaaaagtttggcattattcattgccaaatgactacagcaaatatacgattttgatgcagaaatttaaatttattgatcatctaaagatcgcacttagtttactatacgaaaatccatgcactacactactagtgatggtacaaatgtttaggaaataaaattattatgttaaattttgtattgaaataaatatttgggagttataatcttatcatataaaaaaactaaaataaataactaacccaacatatatgtatatctacattataaggatttgaatttatatggtaaacataactatactaacaaaaattattatattacatatcttggttaaattagtaaaatagatttatttagtgtttttcgtttgtcgcttgtcatactttttgagttccttcaatttgagtatcataagatttttaggaaacttaatcttgatgttataagtgatattaatcgcttatttataacatctacttatttatccatcatcgatcattttttaacggttcaaaagatttcacgtatattaatgttcaaaattctaaaaaaaaaacatttaatcaaaacatttttttctaagtatttaagtaatttttccggataatatttgtttggcaacgatcaacatatatcatgactcaaataaattttgatgtttctaattagtaaaatg

SEQ ID NO: 6204 - DNA, 3000 bp, Unknown
  misc_feature (1)..( 3000): cDNA_ID_1830949_gDNA_ID_1620864_Annot_ID_170433 3000 nt of promoter + ATG
ttgaaccgtttgtaaattcagaaaacgttcccaaatcagttatgctgaagaacaaaaggccccgtcaagttagtgaagtatctgcacttggtgaggcacaatctaaccgccactgatttgctagtacatagcttaagtttccttgctaaatctcacatgctgtgtttagatgtaggcataacagcttcaaacctttggagctctgttttgacgcaaccccatgagtttgcacaatcgtgcatcacctcacagtggagttctcctcagcaatgtcatcgtgatgcaaatgaggatgctaagaaatctgactggctaaataactcttactctgtgtcaaatgtagcaaaagactcaacactgaacgaccaaatggtttccccagtcgagcagaagaagcctgagacaaccgctaattatagattatttggaattgatctgatgagttcctccctagcggttcctgaggagaaaactgcacccatgcgaccaatcaacatatccaaaccgactatggacagccactcagacccaaaatcagagatttcaaaagtatcagaagagaaaaagcaggaacctgcggagggatcaccaaaagaggtccaaagcaagcaaagcagttctacaagaagccgtaccaaggtatatatatgcctacatggctaccgtgaagtgtatatacattgtgtaatctgtgagttgcaaaacagatacacattatgtataatgtttgcgggactgaacaggatcctgaattctttatcgctgaacaggtgcagatgcaaggcgtacctgtgggcagggctgtggatttaaatgcgctaaaggggtacaacgagctcatagatgacattgagaagctgtttgacataaaaggggaactgcggagtcgcaatcaatgggaaatagtgttcacagacgatgagggagatatgatgcttgtcggtgatgacccatggccgtaagtaacttactctttatctcttagtcaatagaatcactacacaaaactcatatctgttgacttaatttggtggtgcagtgagttctgcaacatggtgaagagaatattcatatggtcgaaagaggaagtgaagaaaatgacgcctgggaaccaactccggatgctgttaagggaagttgaaacaacactaacaacaacttccaaaacagataatcattccaactaatttttattctattctctatcagtcttcgtctccttcttatttgctttgtctttcggaattatcttgtttgtgtctgtgttttgttgcgcatggcttaaacaagaaactacatcccctgaggcaaaaaaaatggctcgtttttttggagcctcttatggagaaagggggtttatggggagagggttttctacttttaaaataggcttttggaagtttctttttcttctaggaacttgtgtgtaagagaaacaaatatgtaacgaacagaaagaaaaaaaaaaaaaaaaaaaaaaaaagagaatgagatttgtgaataacttgatgaaggacttttgggactctgggattataagagattaaagagggattatacctcatggctctcgtgttttctgattctttttcgtagttgtgttttctttgattttgtttttcatctaagttttaatgtatatataaaatttcaaacatggctttcttgtatttgtcaaatccccaaaggtacatatattatcaatatttaaaatgttaaataaacaaaactctagacctaaaactatttcaggttttcccactaaccttaacaatgattcaagattattgatgttttgtctgtgaggacatgtatgtggccgctcttgccaccatattcacaaacgtaattgtatgaagtatggaccaccttttcgctactacttctggatccccttatgtttgtaaagtgtatcattcccttatatcactattcactcacatgcattaaaatatcgaatgctgcaaaggaaaaaagagttatttttctctttagatatcatttgggttatgcatattacttggattagtccaatatgtcgtgtacaaccattctcgctgcaaaacaactacaatatgtcaacatagtataacacatgctgatctggtgagattataaattgtgaagtttgtctttataatatgtacatatagtatttctttgattatgacaagtgtgtagaaaatgttaggatattattctaaatcccacatacgaaagattagataatgattatccaacatataagttcaatctaattttaattagtgtatcatttggggaaaaaaaatcgtgcatatctggttgcttggtccaaatatctatattttctgacggtccaatatttatatacgtaccacataaatacacctatacgaatctctttactaatacgtcgataccgttcatagttaatgacgttatttactgccgagataatgaagtgatgatgtaggttatttattgccgagatttgtgaaggcagtggatctcacaatccctatcttttcctcttcttttttttctttttttctttccatatatagagaagtttaaatttaattgtaccattaaaagctcaccaaataccaacttatacatacagtcagtatctatatcaggaatttatatgtatgtgtgtataccgaataatagtaaactcattttactaataaataactttgttttattatatatttgataaacaacttgttataaattattttaatatgttaaatttgaacttattaaattttaagtaatattctagtgacggaagtatacattgtatttaaattgcatagatgtaattacttattttaaaaacttatagcactattcagtgatttacttttccaacctaaaatcgaggtgtagaatgtctactctggaaaaaaaaatcgcctataaaatatcaatatcaatggtgagttttgttctatgtaccaagtttctctaaaacaatttgtctttctattaaaaataaagagtaccacgatg

SEQ ID NO: 6205 - DNA, 3000 bp, Unknown
  misc_feature (1)..( 3000): cDNA_ID_3079790_gDNA_ID_1620864_Annot_ID_170432 3000 nt of promoter + ATG
cctaactaatatatataagtgacatacacaaatccactaacgatagggtttttttttggtaaaacactaacgataggttatcgatagaaaatccataaaagttaatatggtaccagtgatatagaagtgacatgatctagatccgctcatttttaattgattttgagttgaaagtttatgaacctcaaaaccaaacaagtttcattctaggttaacttattagaattagtttttttttgttcgttccatgtaagtgaactaagaacaattagtttctctaatcttagataattatagctaatttttagaaacaaacttgatttcttgattgatacgaaacatagaaaatatcttctttcataattgatagtctaaagtaagatcattggttgtaaatcataatatatttgtttcctagtttgttataccgtataacttcattttatcattcaaaactatgcagattggattcagatatgggtctttagtagaagactactacacagggtataggctccattgtgaaggatggagatcagttttttgcagacccaaaagagcagcattttgcggagattccccaaaaagtctaattgatgtagtgagccaacaaaagagatgggccattgggcttcttgaagttgccatctcaaggtatagccccattacctatggtgtcaaatcaatgggtctagtaacgggagtaggctattgtcaatacgcatgttgggccttttggtcacttcctcttatcgtctatggattcttgccccaacttgctctcctttatcaatctagcgtctttcccaagtcatcagatccatggttttggctttacatcgttttgttcctcggtgcatatgggcaagatctactcgactttgtattagaaggaggaacttatggcggatggtggaacgatcaaagaatgtggtcgataagaggattctcttcacacctatttggcttcatagagttcactcttaaaaccctaaacctctccacgcatggattcaacgtcacaagcaaagccaacgatgacgaagaacaaagcaagaggtatgagaaagagatttttgagttcggcccctcttcgtccatgttcttgcccttgactacggttgccatcgttaacctccttgcttttgtctgggggctttatggtcttttcgcttggggagaaggactcgtccttgagctgatgctggcgagtttcgcggtggtgaactgcttgccgatctatgaggctatggtgttgaggatagacgatggaaaattaccaaaaagggtttgtttcgtagctggaatcctcacatttgtgctgattgtgtcaggttacgtcttcctcaagtaactggacccattatggttggttctgtcgtttcagttaaactaatattacatctgtattgtggtaattaggagagaataatgtgatgaatccatttctcacctcattttagaacatacatttcggtatattgcgtctgtattgtagtaattaggagagaataatgtgttgaatccatttctcacctcattttagaacatacatttcggtttattgtataagcttaaattagtaattgaaaacgacatacactatctattgatattttcactgattaatacgactgtattttttatatttcttaatggatgttttgagcacaatttagtaaatatgggccgtagagatatgctacttcgtcaaaatgttaaaacgtctttgagatattttgagatataatagacgataagacaacatttatcttgcttacttcgatctattgtatttatttgtatttataattgaagtttcaccgtacaaatactttatatttatcttaggtttataacaaattaattattccctaaagttttaaaataaaatatttccctagcgagctagtgggatattaattatcatactcaaagtagtcgattatagaaactaaatgattaaaattttacgtagtctggctctgtttttatctcaaatttctttgcaaataaaaacacaataaatcatatttacttgggagaaacttctatcacatattaatatttatcaagaaaacttcaatcatatttttcgtaaagtgttacttacctttatacaaatattccgtgtattcctcggtttacgattctttatgtctgattgtgtggaaaagtacaatcgatatttttgcaagaagttaagaagttggcacttggcagatgcgtgacgtgaatgaatcgtcaaggcagtgactctccaagccccagtcttcatccatttgacattttcgcatctttttcaagctagagaattttaacttaagttctccattgaaaatttcaaactatataaataaaactccacatatctcactaaaatctaacacgtgacaaaaatttaattacttaagtgtagtatatgttagtaattttctcaactcgcgagcaaacttcagttaacttgattttgataaaataaataacacatcaattatctgaattctttttaaaagaaacaaatatttcatagaattagtttttttttcattttagaattctaattgaatattacagaataaaaacttttacttactaccacacaataatagactttaaagttagttattgtaagtagaatgtattattttgaagttaaaatcgtgtatttatcgtgatgtaaaaatttaccgttctttcttataaactagtcaggctattctggtgttgaactacttcacttcacacgtgtcttttggagaagtagtttcattaataaacacttatctttaattttggcttcaacttttcaaaggcacataatgatcacactgtactgtatcatcttatctcataaatgagaaactcgaccataagaactgtctatagtgtgtatattcagaaaagttatcaatagttcaatactaagaaaccggcctatatatatatatttgtggtcactaatttctccaaaaaccagttgccttccgtaaaaagatg

SEQ ID NO: 6206 - DNA, 3000 bp, Unknown
  misc_feature (1)..( 3000): cDNA_ID_1395585_gDNA_ID_1620864_Annot_ID_170408 3000 nt of promoter + ATG
tgagaaacttagagaggagactctcagagacaggagtcatcttgaggaacttctttctatatgcgagagtacttgagcaaaacttatttcttctttctttcttcataatttagttattaccaacaactaggtatatattgaatttgtggatttttttgcagctcagaggaagattggagagacatctttaaatgagattagctccagatctcatcagattctccgactggtactcactttcatatcttttttttttccccctttttgcattcttgatgaaagtttttgttcatgcagacaattgaaagctcgagtcaacaattttctccagagagctcagcgactcttgcagcatcagtgtgctttgttgatctagctggaagtgaacgtgcttctcagacattatctgctggttcaagactcaaagaaggttgtcacattaatcggagtttacttactctcggtactgtcatccggaaactaaggtcacttttgcaccaatttagtaattctttgctaggtctcatatcacttcatctttgagctgatatgagtcttttattgaaattactacagcaaagggaaaaatggacatataccatatagagactcaaagctaactcgtatacttcagaactcattgggtggaaacgcaagaacggctatcatctgtacaatgagccctgcacgtagtcatctcgaacaatcaagaaacactcttctctttgcaacttgtgctaaagaggtgaccacaaatgctcaagtcaatttggttgtgtctgagaaagctttggtgaagcaactgcagcgggaactggcgagaatggagaatgagttgaagaatcttggacctgcttctgcttcttcaacctctgatttctacgcgttaatgctcaaacagaaagaagagttgattgcaaagatggaggaacaaatccatgaacttaaatggcaaagagatgtagctcaatctcgggtcgagaatttgcttaaatcaacagcggaagagcggtcatcttcaagttcaatggatagcagaagaagaagaataagctacgattcaacggattttgatgagcctcgaatgctaaataacttggggaagagtaacttgtactctcctgatgaggatggtttcctgctggatgatactacccctcaatttccggggcataacctacatgataaatgggaggagatggctcaaagcaccacccaagaaccagaagatgcttgcaaagaagttagatgcattgaagtaaacagtggagaagcagaaagagttcaaatccaagactcactagatgacattgttgaaaagaaggaatatgaacaaaactatgagtcccaaaaggatgatgctgattcatctataaaaaacatagatatggagttgagtttatatactaaacctgaagctgaagatggggtaagtgtaaagaaattaatagaagacgtccaagagactgagcaatctgtggagaaacaaaagcaatctccaaagaaagaagaaatggaacagtatttgtctagagatatgtcagagcaagtaacgaagtcactccctgaagaagagcaatgtgtacaagaatatggagcctatgataaacttgaagctcaagatgtgctaactataaacaagttagaagaatcccaacagactgagcaatctgtggagaaggaagacacaaaaaagaatttgtcttcaaagaaagaagacttaaaacagaatttatctatggatcagtcagagcaattatataaatcacctccagaggatgagaaatgtgtagaggtgtatgaagggtctgataaagacgataatacatatgaggctctgaagaaaaaggtcaaggaaatgcagaagacaattgagtactttatgagtattcaatcagcagaagagaaacaatctccttcgtttaatattatagatgatactttgagtccaggagagtatttcaagatgagaagaagccgaagttgcagagaaaatctcttgtttacaaaggcggcggctgctgctgctagtagaggtttcatattcgagaccactaacacatcctttgattcagatatcactgtctccatggacgcacagagcatcaaagattctgatacagagactagcagtagcagcttccatgaatttatggcaggacttagagaaagaacaatgcagcaccattccacgcatagcgacgatactgatacaaagacgatgaagccagaaaacacagatgatggcggcgagaaaacagagtttgagagacaacaaagccaaataattgagctttggcaagtatgtaatgtacctttggttcacagaacatactttttcttgctcttcaaaggcgatccatccgactttgtttacatggaagtcgaactccgaagactatcttttctaaaagactcgaccgagacatcgaggaaacaaactgccaaagcagtaacacgcgagagggaatggttagctaagcaaataccaaacaagtttggaaagaaggaaaaagaagaagtttacaagaaatggggtgttgaattgagctcaaaacggagaagcctgcaagtaacacacaaactatggaacaacaacaccaaagacatagagcattgcaaagagagtgcttctctaatagctacattggttggattcgttgactcaactctaacaccaaaggaaatgtttggcctcagcttaacacctacaacattcaacatcaaaccctcctctggctggaaattttcaaactctttctctcgtattagcttcactggatgataaataatgaaagcagaaatattcagtctttgtgtgtattgtgaaagatgagtatgtattgattggaatcaaactcaatgaacagagccaaaaaaaaaaagtcgtatatataaagaaaaaaaactgactttgataaaagagaaaactttatagtttatagagtgtagattagataaagctctgaccttggaacgattttgccggagcttgcaatg

SEQ ID NO: 6207 - DNA, 3000 bp, Unknown
  misc_feature (1)..( 3000): cDNA_ID_1830969_gDNA_ID_1620864_Annot_ID_51301 3000 nt of promoter + ATG
  misc_feature (2520)..(2520): n is a, c, g, or t
  misc_feature (2538)..(2557): n is a, c, g, or t
tgttcctctaaaccttgctaatccaattatttcttatctaactcgtttatttctttgtttcatgacacgcaattatatctattttcagaccaacgtagaggttttaataaacaatatatcaccaattcttttttttgtttgtttgttacattgccgtttctggacgtataaggttttctaatggcgatatggttgattcgtccttatatgtgaaaaattctattcactcgtaccaccaaggcaacaactaatataccattatactagttatgacaaatatatatcaagacttcctaacattccggtgttaaataaataatcgacacatctaactgtaaaacggtacggatcacgtaggttaagaaaatgacatacatgatctttggggtatgatgtctttctatcaaattaaatttgtttctttcactcccgagtgtattttaattttgacgcaatactatttctttgttgtataaatttggatatttggttatcgtactgcgtggcagtccatgcaatttcatatatatatttagaatttttatttcccttggatttgcctatatatttctatctttcgtttagtccataaaatttactacatatactacaatacaaatgttgaatgttttaaccagaaaaagaagaagaagatcaatttccattttaaaaagttcataatttttgttctctctcatgatcatactttggcggggaatttaaaacatgtgttaagttattgattactcaataacagaaatatggatttttagtagtgggccattattgagctattatagcggcccatgcgaggctgaaggtgtcgtgatcggcaagtcaagaaaccctagccagagattgtacagataccaaacgtccgtcgcatctcagatcatcgacgatcttatgtcactagacactagtctttttgtaatacagatcagagtcgctcgtgtttgttttcctctcctattgtgcccaaattttattttgttgttacttgcagttttgcattcaacttgtttgattaatgtctctgagagaccaagttcacgttaagacgtgtctttttactcagaagacaatggaatatgaagagacaaaatgtctatcattttttgaagtgatatttctcatacaagagtgcatttaacaagtaagattttgtcagcaactaagatttgtttgagaaatgcacaaagtttgaaattctagtcattccaacaatgaggatgcttcttgggattccttacgtagacaagtcggttctttccaactctgttcttgagaggtgactcttatctctgaatctatcattgcttgtacgcacatttttacttctttctgatcaggttaatgctcacatttacagaggcaagcaggataaaagcaaactattgttagtcgacaaatgccattatgagcttgatgttgaaggtatgttccattcttttatcaccataattgaaatttgtgtcattttgtagaccgtacaaaggaatatagatggtttaattcgactatgtttgtgatatgtagacaaatgctcacatatattatcatgagtttatatgagcattgtgtctcttattggagtggttcctgatttccaaaaagttggggttcactttggagtctttttaaaatgtagtcctcttttggtaaaacacacatgttttattaaaaactatataaccaccgattaagttaggcctactatatatcacttactaacaatgaacttaatagtccatatgttttgacatttgaacctaggtgagtggtcctataattaggggtatacgacaacaaagacaagtagacaactatagttacccaattgataaaaggatataagtagttttattctttaaattatctttttgccgcaatatttatttccattcttcccccaataattatcatcatgtgatctataagagaaggaatttaactaaatcagaagaaaatagaggattaaaagtagtggggtcgaaaagagaaagaagaaaagaaatggggggtgaaaaagatagtaaaatctaagaaagtgacccgaagagagtaaattagttagagcatcacatctctctctggtccccaatgagaagaagctctcacggaaacctcatatgggtcctatttaccaacacacatctccaagcaccctcctttaaaacgccgttacacttaacggagctttatcctcatcttcatggtacgatgtagtttgagaatgagacaaaaagagaagacgttacctaaggtcgaagtaaaagcttttgaagaggcggtgtaatggagagagtgttaacggcgttagtgtaggaaacgacaacgtgggatgctgctgtctgtgtcagggagaagagagagagagagttaatgaagatttttgtctgtattctgaaacaaggtcgaatgttggagactaaggaaacaaaaataaagctttttgatggcttatgagtctttgaaatagctacaccgctcctctcaccttagtctttaacctaatangggggggggggggggggnnnnnnnnnnnnnnnnnnnncccccccccccccccccttgtctttaacccaataacccccccccccccccccccccccccccaattttctctccctatcctctcatttttgtagtgcgcactgagagagacaaaaaaacaaaaaaagatggagcctttgtttttaaggttttctttatgttgaggacattaggctaagacaaaaagctctgttttctttctttgttggatttttgggtgttgcttgtttgaagaaataaagctttgagtatctccaaggtttccattacagagacaaaaggggtatttgagcttagtttctctgtttatgtgtttgttgtgcttttaaatcggggtttaaggtttatagaagtggtgtttctggtaacagttgagactttttgaggggatattacagagttcaggaaataaaaaatatagaaatttgtgttttgtgtttaatg

SEQ ID NO: 6208 - DNA, 3000 bp, Unknown
  misc_feature (1)..( 3000): cDNA_ID_1808803_gDNA_ID_1620864_Annot_ID_51302 3000 nt of promoter + ATG
ttattgggggaagaatggaaataaatattgcggcaaaaagataatttaaagaataaaactacttatatccttttatcaattgggtaactatagttgtctacttgtctttgttgtcgtatacccctaattataggaccactcacctaggttcaaatgtcaaaacatatggactattaagttcattgttagtaagtgatatatagtaggcctaacttaatcggtggttatatagtttttaataaaacatgtgtgttttaccaaaagaggactacattttaaaaagactccaaagtgaaccccaactttttggaaatcaggaaccactccaataagagacacaatgctcatataaactcatgataatatatgtgagcatttgtctacatatcacaaacatagtcgaattaaaccatctatattcctttgtacggtctacaaaatgacacaaatttcaattatggtgataaaagaatggaacataccttcaacatcaagctcataatggcatttgtcgactaacaatagtttgcttttatcctgcttgcctctgtaaatgtgagcattaacctgatcagaaagaagtaaaaatgtgcgtacaagcaatgatagattcagagataagagtcacctctcaagaacagagttggaaagaaccgacttgtctacgtaaggaatcccaagaagcatcctcattgttggaatgactagaatttcaaactttgtgcatttctcaaacaaatcttagttgctgacaaaatcttacttgttaaatgcactcttgtatgagaaatatcacttcaaaaaatgatagacattttgtctcttcatattccattgtcttctgagtaaaaagacacgtcttaacgtgaacttggtctctcagagacattaatcaaacaagttgaatgcaaaactgcaagtaacaacaaaataaaatttgggcacaataggagaggaaaacaaacacgagcgactctgatctgtattacaaaaagactagtgtctagtgacataagatcgtcgatgatctgagatgcgacggacgtttggtatctgtacaatctctggctagggtttcttgacttgccgatcacgacaccttcagcctcgcatgggccgctataatagctcaataatggcccactactaaaaatccatatttctgttattgagtaatcaataacttaacacatgttttaaattccccgccaaagtatgatcatgagagagaacaaaaattatgaactttttaaaatggaaattgatcttcttcttctttttctggttaaaacattcaacatttgtattgtagtatatgtagtaaattttatggactaaacgaaagatagaaatatataggcaaatccaagggaaataaaaattctaaatatatatatgaaattgcatggactgccacgcagtacgataaccaaatatccaaatttatacaacaaagaaatagtattgcgtcaaaattaaaatacactcgggagtgaaagaaacaaatttaatttgatagaaagacatcataccccaaagatcatgtatgtcattttcttaacctacgtgatccgtaccgttttacagttagatgtgtcgattatttatttaacaccggaatgttaggaagtcttgatatatatttgtcataactagtataatggtatattagttgttgccttggtggtacgagtgaatagaatttttcacatataaggacgaatcaaccatatcgccattagaaaaccttatacgtccagaaacggcaatgtaacaaacaaacaaaaaaaagaattggtgatatattgtttattaaaacctctacgttggtctgaaaatagatataattgcgtgtcatgaaacaaagaaataaacgagttagataagaaataattggattagcaaggtttagaggaacaagaaatgattattcaaatggaaaagtaaatacttttgtaagaaaataaaagcttattgaaatgaagaattgtgcatgatcatttgataaagccaagtcatggactgattcttctgtttcacaggacggttcaaccaccatgcacctctttttctttgggcgtttaatgacacaaaccacatttatctttttatatccttttttgttttgaatttatttggttacaactgttatttacctcttttatcttccaatctttctcaatttctaagttttttccatactaagtattttgttcatctgaagaatctggcacctttgtacattcaagaaagttttaaatgttttcactgcaagacaaacaatactgtgtgtacaattatgatagaaaacatttatatatggagaataatatagtcatgtgatacaattatgtaccacatctatacatatagaagaaacaaaaaccaccaatttgtcactcccaacttcattcacaactcacaagttaagaaaatacacatagtttctcttacacgcattactatggaaccttctgaattcgtttccagcaaaagttattttcttatttcaaaaataagttccatttttttatgtataaaaaataaagttaattgcaataaattcgccatcttcctatcaacatatatagatttttcgacaaattcatataaggagagtctaaaattaactcacagccacatgttatttagccaatgtttttaataccagaccggtcaaaccggtggatccgtgaccttatatagtaattctagagtctttaacaaaatctcaacttatgacatcatattatatattaatcacgtatcatctatagactatatacattcatacgactctctgattcttcgtttctctccataatatctcctagtctcaactctcaaatagagagagaaaaacagaaagacagagagaggttctatatattatagataaagtacattacacaattgtacaagtggaaaaatcatcacggatctctcttcaaatatataaagaagatttgtatatcaaactctctaagcttttgttgagcc

SEQ ID NO: 6209 - DNA, 3000 bp, Unknown
  misc_feature (1)..( 3000): cDNA_ID_1815462_gDNA_ID_1620864_Annot_ID_51303 3000 nt of promoter + ATG
ctaagattctcaagaaatcaggatttgttgcgaaaccattcacaagacaagagaacacaatgattcagacatctgctgttgcttgttacggcatcgctgtcggaggttaatttaagaacataaatttgcttttatttatttcttaatagtttattttcttgcgaaacaagcaaagattcagtgaaaggatctgtgaaacagttccaaacatactaaaatatattaactttttgaaaaacttttgggttagttgagtcacaaaaaagggttgatattgcttttgcttttgggtatgatataaaatctaagttgtaaaattttgatttaaaatatttgagtatttgtttttctttttcaggtgggtttgcttcatatcttctggggttaaaccataagacatatgtgttgtctggtgtgaacttggaaggtaactctccaaagagtgtgaaagaacctggccttggttggatgactgcttatctctttgttgtctgtttcatcggtctttttgtcctaatccctctccgaaaggttatgattgttgaccttaaattaacatatccgagtggtttagctactgcggttctcatcaatggcttccacacacaaggagatgcacaggccaagtaagttcattaacctattttacaaaaagtgatattgttacataagtttcctaatctttaattggaatcgatttgcaggaaacaagtgcgtggtttcatgaaatacttctcatttagtttcttgtggggtttcttccagtggtttttctctggtattgaagattgtggctttgctcaattcccaacctttggtttgaaagcttggaaacaaacgtaagcattaattatacaaaaacaaaacaaaaatatttcagtgaaacgagttcttgaatcatataataactaaaaacttttttttggtaggttcttctttgatttcagcatgacatttgtgggagcaggaatgatttgttcacatttggttaacctttctttgcttttaggagctatcctctcttatggcttaatgtggcctcttcttgataaacttaagggctcttggttccctgataatctcgacgaacacaacatgaagagcatttacggctacaaagtcttcttatccgtagctctaatcctcggcgacggtctttacactttcgttaagatcctctttgtgaccattgccaatgtcaacgcaagattgaagaacaaacctaatgatctagatgacgtaggtcacaagaaacaacggaaagatctcaaggaagatgagaatttcctcagagataaaatcccaatgtggttcgcagtttccggatatcttacattcgctgcggtctcaaccgtcgtggttcctctgatatttcctcagctcaaatggtattacgttattgtagcttacattttcgcgccttctctggccttctgtaacgcttatggagctggacttacagacattaacatggcttataactacggcaaaattggtctttttgtcatcgcggctgtgacgggaagagagaacggagttgtagccggactcgccggttgtggactgatcaaatccgttgtttcggtttcttgtattttgatgcaagatttcaagacggctcattacacgatgacgtcacctaaggctatgtttgctagccaaatgattggaacggtcgttggatgcatcgtgacgccgttaagtttctttttgttctacaaagcgttcgacattggaaaccctaacggagaattcaaggctccttacgctttgatttacagaaatatggcgattcttggggtgcaaggcttctctgctctgcctcttcactgtctccaaatgtgttacgggtttttcgggtttgctgttttggtcaacgtcgtcagagatcttactccggcgaagattggaagattcatgccacttccgacggcgatggctgttccgtttcttgtcggagcttatttcgcaatcgacatgtgtgttgggactttgattgtgtttgtttgggagaagatgaatcggaagaaagcagagtttatggttccggcggtggcttcagggctaatctgtggcgaagggctttggactttacctgcggcggtgcttgccctcgccggagtaaaacctccgatatgtatgaagttcttagcttcataggatcagtcaaagagataagaagacttgtgaagttagagtacttagaagacgtcaatgatattaaaatcatcctattcttagaataacaggtagacttctgaacaagaacatctcttcttctaggaattaagactaaaatctacttacatccggatgattcatgctctgttttttggtttggtataatttgtcaacacatctagatctgttccatttccggttatcttctattgggttatctctgaaactgttatgggctcggcccataaatttaaaccttggtgtaacaaaaagtaataaaatcagctatttaatcctatatatttgtttctttttttattatataggaagaaatccttgcctttagattgcatacactagaattttagtattttcaaaaaagaacactatatttcaaataaaaatggtatatatgataagttttgttaagatattatattcaataaattgcctaattcaataagcatattttagtaaaaaatcgcaaaatattcatcatctactaaacaggtcaagatgtatttgactatcttaagaaagaaatattaattcactttgaccaaataaatggacaattaggtaaccaaacaaaaaccacatgaaagtaacaagacagagaattaggcaaaccaaataaataactcacacaacccaccgctcaaccacctaccccttgtaatatatctctccccttcttctttttatttcattatcttccaaaatcctcaccacaaaacattatataatttcctcttcatatttcaagaaaactttaatctttttttgtgtgtagaattctatatttctggtaactaaatg

SEQ ID NO: 6210 - DNA, 3000 bp, Unknown
  misc_feature (1)..( 3000): cDNA_ID_1830965_gDNA_ID_1620864_Annot_ID_51304 3000 nt of
tggttttgggttctcttttcaactcacacttcttcaaaagcgaatttgcttgtaacatgttaatataaaattattattaaatctataggattgtccttaatgggccggccttttacgatataaaatttggttcaaataaatgtcgaatacgtcttttcgttcagcccatgaattgactaaacaaaggggattagaatccaaacaatcaaatttcttctatagtttagtttagaacaagaccatgaccatgaccaatattatatatatcgattattcgtttttatatgttctatatgcttaaaccaaacttaaaatgtaaaagaaaaacactgtgaatcattttcagagttatgatgtattttgttaggaaaccaaacccctgttaaaaactaatactgaaagtctgaaactatgacgatattcactttcaattggattttttttttctatttgatttaaggaagtacttttgaacccgaaaactaactgaaacttaaccacacacaaaaaaaaaggatttgtatcttatattgaacactacagaatttcgacattagattttttatgattttggttttcataagagtttaaaaatgtgatcatctgttttggacactgcaaatagagattttaaaacaataaaccaagtagatataatagtccgtatagtttgtccttatatataacattataggtgtaaaacacggactacataaaagtggacacataaatgcaaaattgttactacgaaactttacactgcatgtgactgatattttacgctcattacatttggatcattcgtagtgataaattaattcagggtaacatggcaagtaagtgagaacgtggtcattaatttcccccaactagttactaaaataactaaggtaaccttcgaacaaaaacaaaactttggtaaaccaaaatacaaaaacttaggtaacatgacaatgaaagtaaagaatatatagtacttgttgataagaatatagtactcgttaataaaacgctgtcggtagaagcgggtttggacgcaatcgcaggaattagatggaaaacaaacaaaaaagaaaaagaaatagagttttagcaaagagtcaaaaagagtcattttcatatatagtttggggtcaatgtagggctataggaggataagttgtgactttaagagtgaatgagattctttctcaaatgaatggtgtcaaggactagtattcattttttcttctttcgtctccatccacctatcaatatccccaatcttttttacatttttgaaatgttttttgttttgttttgttttcctcaattttagataataagtagacgaatctaatccctactaggcctaatccctatataatacacgcattttatgtcatattagaaagcaacatgttagttgaaaagtttaaagtgttttggtttcagctttgtacccactattagattttaattactaatttttttttgtaactgatttatcgtttttagtattgatagatgttaggaactttatatcaaaaataaggtgagacctaatgtataaaagagaagcaatcaacacattaccaattcagtttaaatagaaaatttgctaaacttaaccccgcatgcccttgcgtaaagcattcaaagcacaagtgaaaataaacccacacttcagaagttatatgttagtcaattgtctaattttgattgctattttccttttctctttctttattttcttcatcgccgatgtggtgttccacaatctattattcacgtttacttaggttttgttaatatatattttcttcccctcctacgtgttttcaacatattttcattaattttctctattttcattctgggaattagatctttaacatcgtcactactcatcactgtcaccagtaatgagaaaaaatacaaaataaaaccacacactctcaaagctggatttcttgtcattgaactatcgctaattaatactgtggaactcgtagaataatcaagacgaagggattgcgtagaaagagaaacgaaaaaaaagaaagaagaaagtgcattgtccttgtcatgacatgtggaagtatcggtcttatatggtccattgagccacactcatttagaatctcactactttttcaccattttcacatctatacacgattatagcatctatatacatttactttttcaattattctgctattatgggttttggatattcatgtcctaatcattataattctcttaaacaaatatcgaatttcgaatattttttaaggttattggctatatgtactatatttctatagaatagtttttgttaatatcatcgatcgatcttcagtcttattttgaactatctaatatattcagtggcttttcatatggacataaaacctaggccagtgtcgaaagttcataaacttcgaagtcaaaactagctataatggttatctttgaaaagtaactcaaatataaggagagtagaaattctacacgtaatgctgtccgagacatttaattatggacgatgtgattgcagaaacaattttgttttcaaaccctctcttgatcaaaaaggacatttaaatcattgcatccacttcaaccacacacattcatttggctgtaataacatttcaaagattcttacaaaacaagtgaaatgtcattaaatgtccttttagaacaagatgctaacgacaatctacttggccacttgacttgtataccaaatttctcccaactttttgttcacagaatttgcgtttacaactttggcgtttgtgttttgacggattcgtctaagtgggacaatgcgcgtgtcggacatgcgcacttaagagggtagagacagtgagttctttagctttccttatattctctttcaaaccaaaaaagagactactattttttgtacacttagactaaggaaagcaaagtttcatattcctaaaaattctggttttataagtatcaaagacaaattcagtctccatg

SEQ ID NO: 6211 - DNA, 3000 bp, Unknown
  misc_feature (1)..( 3000): cDNA_ID_1830961_gDNA_ID_1620864_Annot_ID_51306 3000 nt of promoter + ATG
ggtcaaccgatgtgtcgctgtacaagaaggctgtggttgatgaggtcaacgcttttaaagcgtagtgtcggaattagattagagtctgaataaaacgggaattagagtgctttgtaataagtgatgagtttatgtaccccatgattatcttctactttgttagttatgtctactactttgttagttttgacttttgagcaagtcttgttaagattcgcattatccaaaagaaaatttaaagccgcattaacagtgtttagctctggtgttactaaagaaaaagtgattatgcgggtcaaacacttctcaaatagtttgctttgatttctttggagaactgaaatgcatgccgtttcgaaatattagaatgcatgtcgtttcgtggatttcagtaccagtaaaggctaatgctgatgcatcgttgcattttaaaaatcgtgtcgtttttcattccgttttagtggccactcttcgcaaccagataagaactcgaagattttctttttctttatcaaaatgcaatctttatctctgcaatcgcttccatggaaaccaaattcagtgactttacctgaaattaatcttttgaatcccaagcaattgactgcctcgagttctcagtatcgtagaactcgaaactggagaattagaagttcgtcggaagataatgtagcaatttcgagtgacggcggagatttgaagaattctctgtccggtattgtgggaaatcaagtggaggagctattgagcagagaagagaacaaaggtttgcttgatggtctggaaaaagcttcgttgagagtggagattgcgaagagagagctcgaagatatagagagacaagaaattgaggcgaaattgctacaggattatattaatcagctcgaatcaagagccgcagaggtgagagcttgttctcgaaatggtgttagatatgaaaatgattgaacatttgattcttttgctctttggaatttgaggtttttgggaggttctactatagagtatagattaaggttgcattgagaatgattggtttatattacaatggactagtgaatttgtgcagtatatatttatatgccaggataagctcaagttgtgcattgtatgcttaggataggataggtaattcaaagtatcaatcaatatcaatggtgttgcttttgtgcttgaaacctggaaatggggtttctcttagtttgtgtgaaggtacttcattagataaggttactaactaaatcatgagtttggttgcattttgtgttttctcgtgttttggaacaaagtctctagtttggttttgtatttgtagacagagcatgttaatcttattcaatatctgattcaagattgcagaatgccagcaggagattgacgcagcaagatcaatggttgaggaagcagaacgctccttgtcattagcagataactcgacaattggaagttcggagaaaggttattcgattgataaagacaaggagaggttagaatctgcaaaagcggcagtgatcgcagctgcggttgggaccattgcggaactcccatttgctctttctcaagtcgcaagcatggagcagcttgttctgcccctgggaatagcgtttgcaagctgtgcattgtttggagtcacattcaggtatgcagtcagaagagacttggatgataatcatctcaaatccggagccgttgcagcttttgggtttgttaaaggtaacaacacatttgattactgtttctatctaacttctttgaattgttcaaaagcaattgcgttttgtgattgaataagcttaacagaaatggtaaaagaaaaagactttctttgtctttgtcatgttatatattgtgtggaagtatgagctggcaaagttcccatcgttgtcccgccctttggttgtttttaaattataatctgccagtaatagattactaatcaacgatttgatttattctaaataattgatgagttgattattagtctctgacctgtattatttggatctgtctttttttaaaaacagatttattatagattcgattttttttaatgtgttatataggacttggtatgttgagcagaggaccgccattggagctgagctgggaaagcttgttttcacatgggatagacggcgccgttttggtgtctcagagcgtcttgatatttgcgtttgcgtccataggtttggacttctgtttcaagatgaagctcttaagaccatttcctagctctgactagattgaagagcaaattaaaaatgtagaaatgaacaaaatcttcttttgaagactttatttgtttttttttatattattaattttggtctaaaatgtaaatgtttcatcctagatttttatgatctttaacttgtcacaaaaaaagttacacctgattttaaaagcatgatcataaggaatattgaatttagaatgatgaatccatacataattcaaattttgctataaaaaatgaatcagttgggataattctttcttttaactttgtataaaaagttatgaggaatatttatctttgtcaagtgatgaagtgattagtgacttgtgaacttaaccaaagaggtagatggggtcaaggccattcctagccattcattatttatagtaaagccacgtgtaataatcttagaagcttacagatataccacgtcagcacaaaacagttcttttgtctttcgatcgctctcaaatcgcgttttgtcgtggaggtcaactgatcagaaaaatatagcaagcagaaagtgaaaaacagctgaattattatttttctatacaaaaaattaaaaaattagtatccaatttcaatggggtttcgacttgttctcgagtaaactactagtctctatctctctcagctccagattttgtttcttcttcttctgtgttaaattcatttgatttgttgtatctgaaggcgaaattactggtttctgatttttggtggtattcagggcggttttaaagcgacggaagaagatg

SEQ ID NO: 6212 - DNA, 3000 bp, Unknown
  misc_feature (1)..( 3000): cDNA_ID_1808204_gDNA_ID_1620864_Annot_ID_51310 3000 nt of promoter + ATG
atatatcaacatcatcatgattctaaagatgtactttgggttgaatgttgaaagtgacgatggaaagcatactcaataaccaattttcaggaaataaaatgcagagacgagtgtattacttaagtaaataaggcagagatgatttcatgtgatatattttatttacataataaatgttaattttaatacacactaaatattgttaatcgaccttcacaaatacaaataaaaagtattagtccaaggaagccgtatgtatgtaggaaatgaaaatgggtccccattttcgttggctagccaatacaagtgctcttaaaagctgattttccattatctctatatttccaatttttccctttgtcttaaaccgaaagtgatttttactttttagtttaagtggttaagaaagtaacgttttcaatcttttttggacagatttttgcctttggcatatactctttaacattgccatgttgatgaggcgacaatatcgatatttttttttttcacaagtgtgattggtaattatatgagccacacaacttttctcatttggaattcatagtcaatcgacagtgtcagttgcataacaaaattcatagtttgatccaatattaggtcattgaactgaagcaagtttcttatatagaaaagtctctgacaaaactagagtactcgaagatactagatcaaaaagagtactttctacacattatctccaagaaaaaaaaaggtgggtaagaaaacactgattgagagtaagagttcaatattcactcgaactcacttttggataagcgtaatcgagctaccaacgtgacaatgagctggaatcttgtactcaagacacaacaaggacaatacgaaaaaggcaaggagggagagaagctttgcatccccaatcatctattgtcgtttgtatgaaagggaacacacatgaagctctcagatgtgccaaacaagagagataaagaaagcttcacataagcatcatggtttttgaatgtgttcaaagtttgtaaagaatgagattttttgtgtgaatttggggatataaacgacatgtgaatatgtgataaactgaatatattaatttcgttctccttctacaatttaacagaattttatttttattatttttatcaatttcatacttgtaaaactctctgtccttctcttattgatatttgatttgatttttttgtatagtaaatatgttcatccgtgagagatgcatgtgagctttatatgttcaacaaaatttcaagcatatataatcattggctgaatccttacaaaaacttataacaatatgacttaaaaacggtattggatgttacggagactgaattattgaaaaataattgatcattagcaaataataaccaaactaattagtaaacaaattaaatatatttttttgtctatgaccgtgttccaagggagaggagaagcgatccagcacgcggtgagtaaacctcacgtgcgtaaaccttctcacaagattcttctttaacgtttctacgagactaattacttccttattcatccacataccacattgcctctcctgccgttttcacgtttactgctctaactactcgttgtctccatgtacttactttatattgtctacggtagtcccaagaccgcgcttattccgagattgatataggaaatacaagtatttaaaaaaaattaggattagtaaatgaggaaagaataatgagataatgagtgacactaagtatacaactaatacgtcacgattgtataattgtcccctacaagtagtcaaaccttagcccttttgaccgttaatatcttgcatttgacgataatcttttccgtgttttgatctgtttccactgtacaaaactaaacgttaataagctcagtattgggtacgttagtaaaaaatcaatcataaaatataaaataatctcactttaagctccaaccagagactgacagctgttagttagtttgaatactcaatagtaatcaattaggtttgaccaaaatagcttcataaattattcatcaatccaataagtcatttaagtgataattaccaaaaggcacatgatagctctctaaatatagatataccaaaatcaatccataccaaaagttgatgatttctttccctctacaccatcgatatgttgaatagtttagattttttccaatatttgtttaattattatttatattgcctttatatatcaaaagtgaaaaaatccaaacaaaatcttgtcaaagaaattaacactggataaatatttagttatttttggataacttgttttgaaattgagtttaccattccaaaatcagcttaactttgtccaaaaataaggaaaaaatcagtctatatttaacacatgtattctttgtaaagattaaatctaaaattctttaagacaaacttgtgtttttttttctgtatacattgtttccctagtattttatgtttcatcgtaatgcagcatcttttgctaacctctctagtaggttttaaacaagaatgaatattgttgacaataatatcataataaaaatattatactgtatacaacaactagacctaccactacgaaatgatttaaaacaagaagagagtacaagaagaatatgataaatttaattttaaaaaaattcaccgatcgtattgataaaaaagttgtatctacttttctctctttttacctcatcaattaaaaagttgactataaataacacattactatttcttctctctcgccaggcggcgttgcctacaaaaacctgacaatcgaaacacagtttttctgataataatatagacatttaccattatgcccttctaactgaaaacggcaattacgttccttgttatttgttttcttccttctccttctgtttcttttttgtggctttaatttttttcatattaattcggaaagagaaagactcttcactcccataacagtcgccggtaacagaatcactccgatg

SEQ ID NO: 6213 - DNA, 3000 bp, Unknown
  misc_feature (1)..( 3000): cDNA_ID_1839100_gDNA_ID_1620864_Annot_ID_51311 3000 nt of promoter + ATG
acgaggaaatatggatctacaacagacggattaaatcatgtaaataaaacttaaaaaaggggatcaaaatggctgccaaaaaaaaaatcggatcaaaatgacatggaactaggtatgcatgtcaaaacaacttttaacagcatgaaaactttgacttttgaggttaagaaggatagagataccaaatttgcttgctcaaagaatatagtactacattgtttaaaaccgaaccgaaccaataacccaatatgtttattaatttaattaactaattatattaataatattgtaataactaaactaagtaattattatctacaaaattctaacctttaaaaatctaaggttctacttctaactaaataactaaactaaagtatttattatttctaaaactttaactcttaaaaacctaaggttatacttctaacttctaaaaaataaaactcaaaaaaaaactttcgtatttcatttgttctttcgtttatacggctaattgatttttttgaagtaaactaataccaaaccaaatccaaccgaactaaaactggttcaaacacaaaccaaaataacttcggttgagtatggttagagtattacaaaacccaaataaaccgaacccaaaattaaaccgaaatgcacccctgataaatattattactatataaaatatatataactttaataattacataataacacctaaaaatgacataaaaagcaaaaatcccataatcatattttctacaaaattgtaaaacgaaaacctttatctgcgcatccagggaatcgaaccctggtcagtaccgtgggagggtactatgataccactacaccagatgcgctatttctgacaaacaataatcgttttatatacttatatttacattttctcggttcaaaatcgttattcctgtaatatattgatccatcccacgatcttcttttcttggtcgtcttctgaaacgctaatcggatccagaagccatggacaaaagcatcagcatcacctccaacgttagcacgacgacttccatggaaaagatcgaccacgccgctagctggatcagcgcaaccgtaatatccgctttcttcacctccctcgaacgctgcgcctgcgtcaatctctccacctctcatgacgacgacgacgacgacgacgacgaatcccatcaccgtcctctcgctctctccgccgctcctcatccaaacgacaccgtttagctctgttttttaacctctggtaatttataaatttaatccctcgtttgtttcttttgataatcgattggtgtggatttgtaatttcttgatttgaaaatgtatgtctactgtgtgtaaatgtgcatgtctcagaatttgattgttttgcgtgtatctgactttatatacttgggtttaaaatcagaatgaatcatcgtttttgcatttacattgaaaaaatatcaagaagagaatttggtagagatcatttgtttgttttgaagttttcttttgtgatcaatgtttctcgatttacctttttcatttcatttctgatctctgcgttcaactattaaaaccggaacagcatcagtttcatgttttattttgtcaatgtgtcagagatcctgtcactttagatttcatagtttcaaaagtgattatttgatcatgtgggtccctgctgtgagaaccagtgggcactggcctttagtttggttaaaagcaggattcaaaacttcatactagtttctttgttctaaaatgtatttagcctttttcaaactcaagttgcacttgttgtacaaaagacacttttcttttgaatctaatttaacattacattcaaaaaaaaaaaaaacttcatactaagtaaatgtcgtgtttgatccaaacttttcccaatttgtttgcttagcagggtgcaatcttgtttaaatatctttgtcatgtataatgtgattccatctcttcatccatatagagaaaatcttgtttaaatgtcttttgtcatatgaccatattctcacttgggtttctagaaaaagttttgggttctttgagtttgttgaattggatctccttatggcttagaccgtcgttccaactgctgaagaagcaagtatgttgactcaaaacagtcacgttatatctctgtctctttgataattcttggcttttatgtgttgggtgcctagtatcatttgttttaaaggtttagggaacaaaaggtcataaactataataagaatactttttacaatgttatttcctcagcaaaagtagcacgcattcacattctccaagtttcatcatttgttatttatgaacgcaaacaaaaaaactgtactattaacaagcttttgttaagaaaaaagtaaggaaaccctcttaggatatgtatgtttcaacaataagcttatatctttactcattaagcccactagacaactttgtgagatagatcttataagaagcgtatcactttatccccgtgattacttctcaaaacaacgagttttgatttgtgctactttattaaattcacgttctgttttcagaaattttgttttttctgataggttcgtattgaaattgacctctttggaaactggatctttcataagatagaaagagaggtccccatttcccaagtttatcaaacaaaaagaaaaaaaaatctaaattgttctcatcttgagacaaccaatcagaatgaaccatctgagtcagccaaagggtttaatagtcaccatttgccaattgtattcatactctttcctttttggtgcgttattctaagagccctagtcagaattcaaacatttggcaatgaaatcatacaaacttaataaccctaatttactcatctccacgcacacacataataaactcttcttatcctcttctccattcaatctcttattctcttttccttccttcatataccttaaacagcaacgttctctgttcttcttcttctttttcttcctctgtttttctttcacaacttccatg

SEQ ID NO: 6214 - DNA, 3000 bp, Unknown
  misc_feature (1)..( 3000): cDNA_ID_1815496_gDNA_ID_1620864_Annot_ID_170426 3000 nt of promoter + ATG
ggcttttacgccggataatgagaagctcgagtaaagtttttgaaaaaacgttagaatagtgattgacaaattgttgaatactataatattgaagttgatctttaggaattacgtcaatttagaaactggtcggtagcaaattaaaatgtgttgtattgttgtatacgtttggttacgtgagacttgtataaatttacttaattgatataactaaaaaaaaggacttggtgtggtcaaatacgtgagttaattgatgttgcgttgggttctttacacctaaagtttagccagcaaaatctgtttaaattttttaaaaaacttattaatttgtaagtaatctgtttcatggcagaacgatcatacatatatatatatacggaaatcttgaaagaaatcgagacgataattccagatcatgtgatgatggtctgatggatctcatataacttcccgaccactacttctgtattgatgtataaacgccaaagagaatggtgagggtgacatttcttgtctaaaataatttaattgaaatatttaaactcgaaattaaaagatgacatattctacaactaaaagtaaatgaggttgtgggttttctttacatttttaatcattttttatggttgaattttatgattatcataatcataatacacaaactatcgaaagtggaacccgtatcacgatttttttgcctttattttattcgttgcctattaaaattaaaaggaagactaatgatactatcgcctgttccatttagatcctacacttcatgcttttttatatttctccttttggacatctaacatgtttataattactatagcctttaacgaaattttaagaaataaagccagcctataaatgaaatacaaaacggatcatatttgaggaagaccaatgtacatatgtgttgttatttgaacaaaaatttgtttctaatttttttcgaaattaatcttaaaagaacaaatgattcttatcagactttcaacaatattgatcatagtcgaaactcaaaatttcaagccaaattagaatcttaaaacctaacaatgaaaatatatgatccctcgtttacaaaaaaataaaaaataaaaataaaatatatagatatgatccctagtccttatttccgtaccaattatgatattgagagatagttttgggataaccattttcgtttactcgagataaattcactcatcagtttaaaataaaccaaaaccattaccacataagattcttatcccaatttaactattatatttctgctaattaattgattacatgttgtgaagtataaattgggccaactatagaggaatggtgtttgtttatgttttattttggctgctagtgtggttttcttaacttgttagcaatcattttactttttgaaaaaattgttagaaaactattaatgtgaatagttatttactcaataaatcttattgttaaccactgagaatttaaagcatttaaacatctgattattttaattctatgttaattccaggcattaaattttaagcgtaatttatagaagaagaaaaaaaatctagttacattccatctaagataggggtacaaatccatacaagagtctatcttctgtaattcttagcaagttgaacatttcttaatttttattttattttatttttggtcaaacgttttctttaatacaagtggcaaagatattctataacagttataatcatttatagttagggattttttaatcattttgtagtatttgtttttctcttttttcctaacaaagtttttggaacttttgatcatctctcgattgaaagcgaacatataaataatttttactactgcaaatttttaaaaagttaatattcgactttataaaagagatgagagtcaacaaaacaaaaagcaactaattttggacgtacgaaatgctttgtaaatacattgatatcacttatgtttataatatcactcatcccaagtgttggtcaacatttctttgataaaaattaaactattcaatagaacgaaaaccacaaaaaaattataaagaattattgataacaactcttcatgttaatcttatatatttttttaaaaatatttgtttttaggttttaatacaaacaacatgattctagtttattaaactaattaacgcaacttgatggattataaaaatatagcttaactaatccatcaaattaacaagtgaatcgcactataattctaaaagaatcaggtaggtccaggatttgtcttttctccacttctcaatttcccattaataatcccgaaaaggcattacgtaataattaatattttacgctgtagtattattttatgataaacatttccaaattttccaacacttaatcataatttaaggattaaaggaaatttgattggtgcattcccaccacgagtttgcttaacgtgtcgttaaatgcagccgtcggacttgacaatgcaaaaatgctacataatctaaataattaactctcgcaataagattcactaataataacatttttaacgacgatatataattttacaataagaaaaaaaatatgaatctaatatttatttaatattaatttactccattatctgaataatctagaatatgtcaaatatccttttattattttgtagctgtcgaaactatggtgaataaaatctcgaggaatatattagaaaacaaaaaagatctagaggaataataatattttaaatatttggggcacagttgtattgtgaagcagagaatcggttctcaatatattatccgaaaatgtcttaattttaaattttgttttttgtttgattctgcgatattggaatcacacactctgccaatttgacctttctctctcgcttctctttctctatccaatcggaaagagatcaaccaacgatagaggagaagaagaacttgcatacgcaaaaaaactttcccgggaaaattccagaaactgctttggaaaaatg

SEQ ID NO: 6215 - DNA, 3000 bp, Unknown; identical to SEQ ID NO: 6213
  misc_feature (1)..( 3000): cDNA_ID_1839100_gDNA_ID_1620864_Annot_ID_170424 3000 nt of promoter + ATG

SEQ ID NO: 6216 - DNA, 3000 bp, Unknown; identical to SEQ ID NO: 6212
  misc_feature (1)..( 3000): cDNA_ID_1808204_gDNA_ID_1620864_Annot_ID_170422 3000 nt of promoter + ATG

SEQ ID NO: 6217 - DNA, 3000 bp, Unknown; identical to SEQ ID NO: 6211
  misc_feature (1)..( 3000): cDNA_ID_2123349_gDNA_ID_1620864_Annot_ID_170417 3000 nt of promoter + ATG

SEQ ID NO: 6218 - DNA, 3000 bp, Unknown; identical to SEQ ID NO: 6210
  misc_feature (1)..( 3000): cDNA_ID_2123342_gDNA_ID_1620864_Annot_ID_170414 3000 nt of promoter + ATG

SEQ ID NO: 6219 - DNA, 3000 bp, Unknown; identical to SEQ ID NO: 6209
  misc_feature (1)..( 3000): cDNA_ID_1815462_gDNA_ID_1620864_Annot_ID_170413 3000 nt of promoter + ATG

SEQ ID NO: 6220 - DNA, 3000 bp, Unknown; identical to SEQ ID NO: 6208
  misc_feature (1)..( 3000): cDNA_ID_1808803_gDNA_ID_1620864_Annot_ID_170412 3000 nt of promoter + ATG

SEQ ID NO: 6221 - DNA, 3000 bp, Unknown
  misc_feature (1)..( 3000): cDNA_ID_2123338_gDNA_ID_1620864_Annot_ID_170411 3000 nt of promoter + ATG
gatatcctccagctcaatcttggaacgtccgctacaagaaaatcaaacgaaagtaaatttcaaatattctactcctagggaaatattggccagtagttctaaaaaaaatgcatgtcaaatgttatagtaaatatgttaaatgatagtaagatatttcgttgaggtaaaaaaaaacagaacaatcacatgtaatgatgtaaaataaatagctatagattatatgagttttatttatttattatagatatctattatatattagacgaaaagattcattattgtctcttgaaatattacggttaataaaacctgtttagaggctctttttaataaacacatctttgaacaattctgatatagtgatatgagtacattttgcattaattaataaaacataaacaataatgaatatatatacccgagttcttgaagcggagaaagagtgaggatcttggactcgccattattgtgagacaaaaggatcttccctcgagttgtggtgatgggttccttgtccgacaagcaatagcaaggcttccactcggcttcgaagagataatcagctgctttgtagaggagacaaagaaatgaatcaacgatgtctaagatacagaacacgacgaagctaacggcttcgttcagccatgttcctgctacggtcgctgctccttttatcttcatcacagccatggctcaacaaaagcttagagagtttgatatacaaatcttctttatatatttgaagagagatccgtgatgatttttccacttgtacaattgtgtaatgtactttatctataatatatagaacctctctctgtctttctgtttttctctctctatttgagagttgagactaggagatattatggagagaaacgaagaatcagagagtcgtatgaatgtatatagtctatagatgatacgtgattaatatataatatgatgtcataagttgagattttgttaaagactctagaattactatataaggtcacggatccaccggtttgaccggtctggtattaaaaacattggctaaataacatgtggctgtgagttaattttagactctccttatatgaatttgtcgaaaaatctatatatgttgataggaagatggcgaatttattgcaattaactttattttttatacataaaaaaatggaacttatttttgaaataagaaaataacttttgctggaaacgaattcagaaggttccatagtaatgcgtgtaagagaaactatgtgtattttcttaacttgtgagttgtgaatgaagttgggagtgacaaattggtggtttttgtttcttctatatgtatagatgtggtacataattgtatcacatgactatattattctccatatataaatgttttctatcataattgtacacacagtattgtttgtcttgcagtgaaaacatttaaaactttcttgaatgtacaaaggtgccagattcttcagatgaacaaaatacttagtatggaaaaaacttagaaattgagaaagattggaagataaaagaggtaaataacagttgtaaccaaataaattcaaaacaaaaaaggatataaaaagataaatgtggtttgtgtcattaaacgcccaaagaaaaagaggtgcatggtggttgaaccgtcctgtgaaacagaagaatcagtccatgacttggctttatcaaatgatcatgcacaattcttcatttcaataagcttttattttcttacaaaagtatttacttttccatttgaataatcatttcttgttcctctaaaccttgctaatccaattatttcttatctaactcgtttatttctttgtttcatgacacgcaattatatctattttcagaccaacgtagaggttttaataaacaatatatcaccaattcttttttttgtttgtttgttacattgccgtttctggacgtataaggttttctaatggcgatatggttgattcgtccttatatgtgaaaaattctattcactcgtaccaccaaggcaacaactaatataccattatactagttatgacaaatatatatcaagacttcctaacattccggtgttaaataaataatcgacacatctaactgtaaaacggtacggatcacgtaggttaagaaaatgacatacatgatctttggggtatgatgtctttctatcaaattaaatttgtttctttcactcccgagtgtattttaattttgacgcaatactatttctttgttgtataaatttggatatttggttatcgtactgcgtggcagtccatgcaatttcatatatatatttagaatttttatttcccttggatttgcctatatatttctatctttcgtttagtccataaaatttactacatatactacaatacaaatgttgaatgttttaaccagaaaaagaagaagaagatcaatttccattttaaaaagttcataatttttgttctctctcatgatcatactttggcggggaatttaaaacatgtgttaagttattgattactcaataacagaaatatggatttttagtagtgggccattattgagctattatagcggcccatgcgaggctgaaggtgtcgtgatcggcaagtcaagaaaccctagccagagattgtacagataccaaacgtccgtcgcatctcagatcatcgacgatcttatgtcactagacactagtctttttgtaatacagatcagagtcgctcgtgtttgttttcctctcctattgtgcccaaattttattttgttgttacttgcagttttgcattcaacttgtttgattaatgtctctgagagaccaagttcacgttaagacgtgtctttttactcagaagacaatggaatatgaagagacaaaatgtctatcattttttgaagtgatatttctcatacaagagtgcatttaacaagtaagattttgtcagcaactaagatttgtttgagaaatgcacaaagtttgaaattctagtcattccaacaatg

SEQ ID NO: 6222 - DNA, 3000 bp, Unknown; identical to SEQ ID NO: 6214
  misc_feature (1)..( 3000): cDNA_ID_1815496_gDNA_ID_1620864_Annot_ID_51312 3000 nt of promoter + ATG

SEQ ID NO: 6223 - DNA, 3000 bp, Unknown; identical to SEQ ID NO: 6205
  misc_feature (1)..( 3000): cDNA_ID_1838557_gDNA_ID_1620864_Annot_ID_51314 3000 nt of promoter + ATG

SEQ ID NO: 6224 - DNA, 3000 bp, Unknown; identical to SEQ ID NO: 6204
  misc_feature (1)..( 3000): cDNA_ID_1830949_gDNA_ID_1620864_Annot_ID_51315 3000 nt of promoter + ATG

SEQ ID NO: 6225 - DNA, 3000 bp, Unknown; identical to SEQ ID NO: 6203
  misc_feature (1)..( 3000): cDNA_ID_1825220_gDNA_ID_1620864_Annot_ID_51316 3000 nt of promoter + ATG

SEQ ID NO: 6226 - DNA, 38 bp, Unknown; identical to SEQ ID NO: 6202
  misc_feature (1)..( 38): cDNA_ID_1830941_gDNA_ID_1620864_Annot_ID_51318 3000 nt of promoter + ATG

SEQ ID NO: 6227 - DNA, 3000 bp, Unknown
  misc_feature (1)..( 3000): cDNA_ID_1813832_gDNA_ID_1621084_Annot_ID_55336 3000 nt of promoter + ATG
tacctagaaaaaatataaaacaatgtcaaaaacgaaaaaaatctgacaaataaaattaaaattagaaaaccgacattattgtataatggtttgtgctagtaattttgttatgttgctattcggattcaaactcttgtatgttattgacaaataaaaaaatccgacaatcatgtatttttctaagttttgaaagaattaacttattttaaatttctatattggattattaataaaataaaggactgagtagataatgtcaaaaaaaaaaaatgagtagattaataaataaatgagagggaaaaaaaaggcgagattggcggtggtagatgtaggagaagaagagaacaaaacaaggaggatacagttggctatggaatattatggttcataatgcaaccaaacacatataattgaaatgaaccacacacacgcttttaattatacacataagagtgatcgagcaccattacattttctttctttgcttcgttgtaaagccgactttatattatcatctctttttatgtaaaagaaagttgtaatgggttttaataatatatataaacagaatgggtcaatctaataaatattcggaccacaatgttaaaaattagttatctgtttttttccggccggaaacaattatggtgatttaaaagattatcatcatcaatttttattttttttgacgttatcatcaccaattattgattggtatatattcttctacggtttctgtaaatttatcatgaaattccttactatgcttttttttggttaaagaattatttactgtttttgataggaggaaaaatgatcgtccacgttcagtatacggcatcatcagcaaaaccattcaaaaatgtttttactggaacggccaaatatggtataacgacttatagcattgtgtacgtgtgttatacaataacaagttctctaaatgtttcgaagtttacatggtataagagcctctatgaaatggaaacctaattcgttatcatggagctcgtccaatggtgagaaagaactcagcaccaagttggtggaattatcaacatcataagagagttcttctagctctttggtgcaagtgacatgtgagaattacaaaaaatgggttaagaattaaaaatgcactcaaattattggtttgttagaatgaaagtggatcacaaatagaatgtggtcgtggagctagaaactggagggtagaggctcatatcagaactcacctcaaagtccatatccgtgtcaaggcaggcgtggacgaggacatcaattaaggccgtagtactgtcccgtattaaacacaataataaaatcgtaccttgaaagctataagaaaatagaagagagtgaacaatcgacaaatgacaacgagaaacatttaatgaaatgaaaatatctatgctccagacacagagataacccacgggcagccaatgaagcactccacttgcgaatttgtaatagaccctacttgacaatgagtagaagagccatatcatgtatatttaatatttaagttggtgtgttgtagaatacgtagaattgttttgtgccataaaaattaagaaagtgtttattttgttttcttagctcgtgtataatcaaatttaagtagttgaattcgtggaattgtagtaagtaactgtgtgcttcgactaagtgtatggtgtgatggtgtcgtggtgacatttcttcggttcttccaaaggaagttaaaccttgcactgcccgcttgatcccgtttgagagaaatgagtccaataattaaagatatcataaatttcttaagttaaaaacagtgtgttgaccgatgaaatattatacaaaaatgtcttttctacctaattgagagtcacacatctttgatccaatttttctctattacatctttgatacaatttattacatctttgatccaaattgcactctattacatctttgatccaatttttctctctatttttctaccgattacacaataacatattaatttgtccataaagattgttatgaatggttcagtgttacaaaatctccattattccaccttgcatattgctgcggaatgcccaagaaacaagactaaagaggcgaataaatcacagaagcgaaaacgctctaaaattcctaatctaatagacgcattcgcctctttgatttattcgccacaaacaagttttgttagtataacaaataaaaattttcccttcgcagaaacaaagtcgagattcgacaaaacgttcaccattcgaacaccaacaacgacgaaaagaagctaattaataaaccaaacagaagagaaagccttggcctgcaaataaccgtcatgacttagtgctggctgcaactaacgccatgaatggtctatcaattaagaactcttttgatgtaattcactacaaaatctaaatttttgacccgctacaagatttaattgggagatacgttgaatctcaaaaaaaatcgtaagaaactacaatcttccttcctataggcatgaagcttgttgtatgcttcgccaacgttacgtgtatgacttataatgccacgtgacactctcttagttggcggtttttgtctaaatcttttatgtgacgtggtgcgttctgatattcttattggtcaattatttttgctgatgtggtatgagaaaagtcaaaatcgtttcaaggagatttgttatcttagctaaaacaaaaagaagttattacaggaatagaaagagagagagacgaaaatttacgctgatgacgtggtaagggaacgacggagtggggaaccacaagccgttcttgatattcaacgtggtttgctcatggcggcgcgtggtagactcgtggtggcgcgtgggaacagaagcttttcatctataatcagaaaatactcattgaaaagtccatttccctctattttgttctttcttatttcttgcaatttcatctctctcatttttttttctgataaaggtgcaatctcatctcttgcaat

SEQ ID NO: 6228 - DNA, 3000 bp, Unknown
  misc_feature (1)..( 3000): cDNA_ID_2125304_gDNA_ID_1621084_Annot_ID_55337 3000 nt of promoter + ATG
agaaccgccgggaaaatgagcactggtgttgaagccaacgagattggagctctcatgggtcttgctggcttcaacggcgcaaccaacgcagtgaatcaccctccaaatgggattcaacaacagcttcaagctccaccgttaaacaacgtcaacggcgtcactaatcacaacctcaccaatagtaatggaggcatgatgatgaacatgaatgggtacaataatcatcatccaatgaacatgcagagtaggcaaatgatgcatcagcctcagcaaatgatgtaccaaagatcatctttcgttccagcatcaagcaatgggtattattacaattatacccctagtccctacagttattatccttattacccttacgcaagtgatcagtaccaacaacaaagtagtcattcacatgcaacaaacatgtctagtgaagaagacgctggtaataacaatagctgcaacatcatgtaaagtgtggatgcttgctaaggaagatatctatcttttgcttttggaaacaagacttaaaagtttaatcttttctggagtgtgatatattagtgtttggtttttctttctctttttttttggtgtgtgtcatgtagctgttttggactgacatgaagttgtgttggttgatatataaaatcctagaatgttattgatgtttcttgtgagatgcttttgtttgtcttggttctttttcatgagatccggttggtgcggtcgaaacatttgtagatgaggagcgtttaaagcggttggttttgtcacaatgtggtttgtgtgtatctctcgaaaagatattctctctatccactcaaaaagttattccacctgctctcgcttgcctcttggtaggtgtctcgttttacgcgtcacctatttttattaaatgcgacatggttcaaaattttggacttgtgaaagtaataatgctaagccggtcatgcatcaatcagttctttgttttaaatttgatatatttccaagatacaccgatggaaattggtatttgcttaggaaaaatgtttatcagattcgaaccatcttttgggccacatgaatttcaagaaacattttggggtaaagcccaacttttttttctttttcaaacgtatttaaattctttagagcctacacaagattccccaaccagatgacaaaaacatgcaaacgaaaatgctaaacattttgtctgtttatttttgacaaaatgggaagaagttttctcatttaaaagttaaaatgcttttaaaatcgtactctaaaaattggtccaaaataaaataaagatcgtaccctaattttgaggtttagttatgatttctcaccacaatcgcttgtccaaatttatacatgtgaaataatcttatttaccaattatgatttaattaatttaattgttactgaaaaatacattatacaatcactatatgaaactctaaccacaaattaatagcagtgcaggacactaaaattataagtaactagaaaacatttggtacgagtgaaaataactctatgtaatgttcggtccatttgcatgctatagtaggtttatattaataatgtggtttgtgcataataatggattaccaaatggacacttaaacgtaagaagcatcgagtttaggatagtggaccattctcttaaattcttttcacacttgagttcctactttttacgacacgagccgtgagatgtttgcctttgtttttctataatcgaattttatcttgtagattacaaaattatcgagagacttgcttgtgtcttagtttctgattaagtggttataaaaagagactaagaatacttagataaaaagagagagatagatttaagtatgatttctcgaattaacaattttccggtcccttaaatgtaattaggtgctttggtaacgcgtctaggatactagagctttcgtatcacacaataatcaagacaattagtgtgattatttattcaactataaataatacgaggtttaatgcaataattcgagatattttgccacgtaagaaggtggtatctggatacatagctaaatgaaatttgctaatattttatcgtcactttttagtattgcctttctttgtattttccctcgtcaatgtttgctttctctgcttttctgcggatgccattgtatttaatttgtaatttagtatacgtcgctactagctttttcacctgtgaagccaacacaaacatattatctttggggagaatcccaaaaaaaggaaagttgaaaaagagtaatcttttaattttgatttcttaagactcttaaatacttggaactgattgctaactgacaaccaaattatggattttaagatctattatcgatcaaagactcatagttatacgtactaatcaacctacctaacctacctacctcaaataccattgtaagctaaaaaggatgaatcatcgagttaggctctcatttgtcattaagcttcttctttgtttcactagtcattaagcgttgcacattatacgcaactttcattaaatgcagacttcgataaatccggtactaaagactatagagtgtgacaaaaaaaaaaaagagtacaagagtgaaatctcataaaataatacaaagacaaacaaaaattcccaaaacaaacaatttggaaagaaaggtcactgaataatgaaaaaggaaaatgccatctgcacatcatgcaaccattaaaagaaattttttataccaaacttagtttaatgatagaataaatttgtaacgatactataacaaagactcatgggtgtgaaccaaagacaaccacgttctctcaaatactcacacacacactcctatatataagtatctaatctaatcaagaacttaatttctctcacccgaagttaataattcagtcagaaacacacacacacacacacacacacacactcaaaactgaattgacttgtcagaaatggaatctctgttgtgtcggaggaggataaagagagtcatg

SEQ ID NO: 6229 - DNA, 3000 bp, Unknown
  misc_feature (1)..( 3000): cDNA_ID_1813821_gDNA_ID_1621084_Annot_ID_55339 3000 nt of promoter + ATG
ttcatgaaattgtacaatgcataaaataaaacattgagaagttctaactgagtggtcacatatgttagcggtccatacataatttaattcgtcatcattagagaaacaatattgcaaatatactaaatctgagtttgagaaaaaatatagcttgtagacacacttcagtacctagtgatcaaattatcatatgacatatgatacttatgtgagtgtgactatgtaattcctagttgaaaaaatacattgatgattgaaaattacagtctagaaattataccaactaaattaccttggtacaacttatataagtaagtagtccctataataagcctacactctctacaaaataagtaaaggagaagccttgaaggagaacaacatgtcaattcaaaatagtcatggaatcactaaaaggccttaaagaagttcttaaggcccaaaataaataggtttttcggaatttgaagtccagttttctgcgaaccagactagttctgctcactttgggttctttcaggtgggcttgaaaactagacaactgagtcagaccaagatctttttttcttttcaaatcaatattgttgttgttgttgttgtaaatcaatctttgtgtagaaaaaaaagtgaaaaaaatgatcttgttatgaaattcaaaatccatacagtatttgtttttccttcatgattttacttttttaccaattaacttaataatatttttgtccgaaaacagatttttcgaaatatttgttggtcatcaattttgaattcaaaaccgacttgatgagattgatcaatagttcaatactcataattacacacggattctaaaagataagagaaacagtaagtcggttaattttggattaagtaacgcacaagccaaagccttctcctgatcgaatcataaaccaaacaaatctttcttttaaaagaagcggacacaaaccctaaccaccaaccctctccgtcgtcaaatttcccggcgaaagatgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttggaacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttgattttcttgtttataactaactttgcaaggttacttttgtttatcatcatcttttgtaaatttgatcatcttgctctttgctttttaacttctcttgtacatgtttgaattataaaagttctaatttttcaatccagattcttggttttcataattgtacattttgatcagcataactattgcttaaaatttccatattggttttaccttaattgatcaaaagtctttcttttggatcgaaattgagacaattgttctaccaactgtacttgaaaaactgctatatttctcttgcaatttggttatctcctgatctcttttacttatgatgactctgttagatgctgctttcatgagcgtttctttgttaaactaacttggtcggtcttgttgtcactttcaccaactgaaaagaattaatatgttttaagtatgttaaattgctgtcaagctagctagggatgttgtaccgaccagcggaaccggtggagcagtaactgatttattaaaaaaggttgtgaaaaaactgatctggttaactttttgagccggtcctcctcagtaggaccatctttgtcaaaactttgatcagaccgaaaagctgtgttcaaccacattagcctaaagcttagctcacaaagaccatcagaacagaacaggctgaatcatcatcacatatttttttaacaaaaccatataacaaactattagaactgaattctcataaagctatcaaaaaccctccttttttcacaaacctgggttgaattagtagtaggtttagccaccttatctctgaaactttcttgataaccttaattatacatcttacaatgtttaacctatggttttgtttaacctcaattatacaaaaccattaccactaatgggctaatagtgaatctggcccaaaatgtatttgcccttttcttctttagccaaaagccttctcaataagtcttcttcttcttctctgatttctttctcccttcttctctcggtcttgaatctttctttgtttgctaatatggggattaatacttaaacagagaagtttgtttttttccaacttaattcttcaagggcatttcaataaataacactaagtcccctaagtgacaaacgacgacctatcagctaagcaaaaacccttagcttggcagaggcgtcaagggtttcaaatggggaaatcaaagaaaaaggttctaaataaatctctgattactcatcctagcaccagtgacgatactctccaagtattcttctttcttaccatgtttgtttcatgttttttggaaatgaattagaattgtaattagacaaagatcatgctaaactttttgcagttgttcgatccaacatcgtctcctacaaaggaaaaagttaactggaacaatgttcttggcatttctgattacctctctaaacaagccaccagaggttttagggttctctgttaatatttgttaatttctcggttctttttttttgtgatttcttcctctcaatttggttactacttaatt

SEQ ID NO: 6230 - DNA, 3000 bp, Unknown
  misc_feature (1)..( 3000): cDNA_ID_2125352_gDNA_ID_1621084_Annot_ID_170468 3000 nt of promoter + ATG
gtgagtcagatgttgatctctattcgttctgtttagaaacattttgccaactgcttcgtaggttttgaattgtgatttattctggactcgtattgatgaaatatggcttagctgaagtctgaggtgactaatttaatgcaagaagtctaaggctgctttaggtttaggaaacataatcttatccgtgcatatattctcatgtctctagtgtgctgttcatcaatatagttaagattaagattaatataggcatctgttccagaattgctgtaaaaaaacttacatagttcaattttttttcttcgcctttgggttattgaatggcatatgatattatgtgtataatggtcgattaaatacttaaagtcttgattgatgtaagggtctgtgtttcttaatcttattgcagagcaagtgatccaagctattgatcccaaaaaggttgaaatcatacagaggtatagttactaaccgtataaataaatttcacccagttgaattttagtaaaaccttactagtaagaggaaagtccaccagagtttgttgtagcgaagttgggaaaattctaaaacttttttcttgctgaccttatatactggccaggtacttccaatggttgattgaggaaagagactacactgacccgcagctgcatacatcgtatgctctctcacttgccagatcagcacttgagtgtgttgaagttcaaaatggtatccaagaagctgatgttccaaatggtagtgaggcacatgatagcaatgttggaagtatttctttgtttgaagttgacgtacgagaaagattgcaggcctttttgcagtcttcagatctatatgatcctgaagaaatcttggaattggtagaaggatcagaactgtggttggaaaaggtttgtctgtcaaatttgtttccttcgattttgaatggttcttaaaaagtgtcatttagatgtgtatgcgcacataggatgcttcatgattatgttggtgcaccgattttttattcaatggattttttactgtcaaaattatgtgtgtttgcccatttgtcatgtgtaatttttttttatttgataggcaatcctataccgaaggattgggaaggagacattggtcctccaaattcttgctctgtaagttgatttaaataccaagaagtgataaagaacaaaactgaattgtctatctgattgtgtgagcaaatatagtttattttattgtgaatttgaatgtggttactgataagatcttctctggttgggcgccaggaagcttgaggattgtgcagctgcagagcaatattgtgtagagattggaagaccagatgcatttatgcagtaggttcttttccttcatttcgttacttattgtgaatgccattgtatgatcttttttccttgtgaaatccctttaaacaaaaagtttatcttaggttgcttgatatgtacctggatcctcaaaatggtaaagaacctatgttcaaggctgctgttcgtctgctccacaaccacggggaatcccttgatcctttgcaagtattggacgtaagaaacccagtcctcctccatatgtgaaaaagacactgatattgcctcttatcctacagctttttcatttggtagttgtttgatgatagagctgatatctttttttatatgcagaaattgtctcctgatatgcccttaaaactggcatcagatacaattttgagaatgctgagggctcgggttcatcatcatcgtcaaggccaggtaaaaattcacaacccctaccaattgtgtgtttttagttgtcaaatttgccatgtgtaacagtaatatgtacatttaaatgctaagaagagataattattgaaagtagcatagataaacttatcaaaaagttgttactctgttaaaagtgccttcaatctgtatgtggtgtgggtatagctttagtgtctgaatgctctgaattcaattgttacagatcgtacacaatatctctcgtgcattggatgtagactcgaggttagcaagattagaagaaagatcacgtcacatgcagataaatgatgagagcctctgtgattcctgctatgcccgtctgggaactaaattatttgctatgtaccccgacgataccattgtctgttacaaggttagtcccccgcttacaatataattctgttgcatgctatatccaaattcattagggattaagtatatctttcttgcacggtttcttttctctgagggtatttttgttgttcctcttccttcttctcagtgttaccgacgcctgggtgaatcaaagtcagtaacaggccgcgacttcaaacgagatgttctgataaaacccggttggttagttaaccggtagcagaagaagcccatcttgttccgcatcaattggctttttttcacttgacctctaaccctcacaaacacagagttggtacagtacatacagcagctcacgcagtttcccttgctacaaataatgaagaacataaggatctccgttcgatcgccatagcttcatcaagctcgtctctagacttgtgtagagagattcgaatcggcaacatttcaaaagttcttcatcttactgtaaatggtggaaggcatcgtgtagttctataggcattttcgcctttgagacagttaaacatggacaaatgtaactatgggttcctctaataccttgttgtagtctcactttagcttatttatgtaatactttcttctcaagacgaaggactcgtttcgctaataattaaaaataataaattataaaaaccagaaaaacgagtaaaaaaagcagagaagaaaaatcaaacatacatacacacaagtctcgctaagagaaggtcttgggaagaagacgattcgtcgattcaggtttctgctatcatcttcctcttcgggacacagtttcccttttcctttcttcgtcggaatcgcttctcttcactcaccggttggagaaacagttaaattctgacaaaaaaaaatg

SEQ ID NO: 6231 - DNA, 3000 bp, Unknown
  misc_feature (1)..( 3000): cDNA_ID_1813795_gDNA_ID_1621084_Annot_ID_170467 3000 nt of promoter + ATG
ggtgcaggtcagagtaaatgctttgctttgcttagcagagctggttcaaacacttgataaactcgctgttactgaaattctgcaaacaattcaacgctgtactgctgttgatcgttctgcaccgacccttatgtgtactcttgcaatcgcaaacgcaattctcaagcaggtaggtaaaagtagtttactttctcaataatattagatgtttgaaaatcttaattttcaatatttttcatagtgccttctccatcatttctttctagtatggagttgaattcacttcagaacacgtacttcccctgattataccacttctcactgcccaacaattgaatgtccaacagtttgccaaatatattctatttgtcaaagatattctcaggtatacctccgaccaatcctgtcctgtttccaagttcttattccccttataactgcatactgttgtaattgttttcaacatctggtttgtctatcctctggtcactgaacaggaaaatagaggaaaaaagaggagttaccgtaaatgattctggagtcccagaagtaaaaccaggctgtgtggcggatgggcttcagtttcaaacaccaaccaaaaaaactgaaaaggttgcttctgcagcaaagaacagtccagcatgggatgaagattgggccctcccgaccaaaatttctgctccaagagatcctggacccgcaaactctcctcagtttaacaattctacagttcagtcacagtcatcgaaccggacatcagtaccaacaacatgccctgcagttgacctagagtggcctccaagacaatctttcaatgccactgctcagccagctaatgatgagactcggataaacgcagcaggaacaccaacaactccgagttttgatgaactagacccttttgctaactggccaccacggcccaacagtgcttccactgcctctggcggtttccataacagtactaccactcaacctccaatcaacaacagcggttctggtttgagaaacaatttaacagacggtaggcagtttcagacaactaacaacgacttctgggcctttggtaatgcctccctctcttctatgaaatcacagcaagagacttcgggtatcagggcaagtaacgcagatcctttgacctcttttgggattcagaatcagaaccaaggaatgccgtcttttggaagcagttcatatggtaaccagaagccgcaagcagacatcagctccatattcagttcaagcagaacagagcaatctgcgatgaaactcgcaccaccgccttcaatagctgtgggaagaggaaggggaaggggtagaagtgggacatctatctctaagccaaatggttcaaagcagcaacaaaccgaacagccatctttgttagatctattgtgaatctagcttttggtgagacattgaggtaaaagacagtacctgtgagaaaacagacgcatgtgctcattgttttcttcattagtcattctaatctcgtctgtgatttatcatagagcctctgtgcagtgcaatggataggagatcttaattgttttcatcaacatagtgtatatatctcttccagtttggaatatgttccagaaaagaatcattgattactcgttgtacataatatctccttctaaattgatgatttatagttatgtataacatgttttgcaagagatttgaaatcttcttatgtatcaattcaatgcttgtaccctttttttatccctcgagttcttaaggtacttagtccctagtgattaaccaaattagccagcatatttcttttagaacatatatcattttagaaaatatgttactaaacgatatgtttgggcctttgatgatgaaaaagctaagaacgattttcttttggtatgaaatgtttgttattactattccctttagtatttaccaaagacttcgcagggggtgaaaaaaaggatcaacctgatgttatcatattacacgtgaatctcccagatcgagattttgctacaagaatcaagaaatattatgtagggattcgttgtggaacgagagaaagtgtgttttgtttgcttaactttaaatctcagttttcttataaactttttatagccgtcttttatgcaaaaccccttgagtttttcatgccttaacttgtgaatcgtgatagagtaagaagattatggatattgttaagtgttaattaagatcaatttcatcttctacgagatggtattcctgtacgttttccaatcaaataacttcattttaccattgttattatttaagaatatgtatatatataagaaagtgagttcgatattttcatttgtatgtatataatgtaaaagattatacaataagacaataataaagagattaaggaatcatttacgtgttaatcacacttgacttgagaaactcttttaaattgaagtcctcctatagacccgtcgccgttatcttggcgccatttacgtaccctccttttttctaaatcataatccccaaaatccctaacctaactaaactaaatactacctaactaactaccctattatcaagatttaagacattgtttatctatcccctaatcgtacgtattacgcaatgccactatctaaaatacacttcattacagtttactgtggtaaaaaagataagtatcaaacatcaaaactaccaagaaattaccaatttgtgtcggtgaactcatatagacaaacctatgtggtaatcaaactattagttaaaaaaaaattgaacatattaagaagattacagaataatacatgtaatcctccacttgtcagttctataaaatattaattaaaaaggaaattcaaattgaagtaactaagaacagtttttttagcagttaagctgaatttcaaaaagccataatcttcgctctgaatctcatcagccccggtctccttctctagctatatatatacgtgtgtgataaagtcgtaccctcaagccaacacaataacaagaatg

SEQ ID NO: 6232 - DNA, 3000 bp, Unknown
  misc_feature (1)..( 3000): cDNA_ID_3048061_gDNA_ID_1621084_Annot_ID_170464 3000 nt of promoter + ATG
atcttcttcttcttcttcttcgcctctctctctaatcaaaatttttgtcaatttgaagtctctttgactcttctttcaccgccgcagttaaaaacctcgtgtgattcttcttcttcatatagattcccagaaacatcgaaactggtgaaccgtgtacgcttcgtcgttagtgatgcggagacgaaagatatcgccggaaaatcattggcctagattcaatccattagagactcatcggagacgtctacgttagcgtacccaatcctcctcctcttctgggttgtttgctgatcacacatatcttctttcttcgattctctctcaggtgattctttctttctccgatcacttttccggtctattgtgtaatccacgcaccaaaaaatcagatcttggaactcaaattccttatttgcagcttgagtttattaaaagtctttgtctttctgggtttatactataagttgattaactttgacatctaatgtgtatttgctggtaacagggcgtgtcctgtgtaatcgtttagtggatgtgcaatgcaaaggtcgtgtagaactagaagaagagtttctgtgaacaagtttaatggaaggaacagcttttacaaagtctctttgtctcttgtttttctcctttgggttcttctcttcttttccaccttgttgattagtcatggagatggtgccaaaggtaaccttcaagttcttttctttggtggacatcattgtcgttttattaccttaaagcatgttaagaaccaactcttgtgtacttgtagatgagcctttgaacgactctatgggaatggctgatccggatgatggtcagtcagatgagaaagttgtgccctttgatggaccattatccttagcgtctgcttctgttgatgttacgtctgatttgagtcggaatgatgatgtaaacctgtctgaagaaagtgaagacaaagaacaggaagcagagatcagtagcacagtttcagggaatgatattgaaagcaaggacacttaccttttgaagcaaagtgagataaataagaaagatacagggattgatgcaggaagcaaatatgatgactttcccaagaaaagtgagattaacaatacaggtacgtggaatgatacagaaggcaaagacgataataactttttgaagcaaagtcaattgaacaagacaggcacagggaatgatacagaaagcagtgacaatgagttcttggagcaaaatcagatgaacaaaacagttttagggaatggtaccgagatcaacgtttcaaaggttgatcaaccatctcgtgcggttccgcttggccttgatgagttcaagagcagagcgtccaattctcgaaacaaatcgttatcagatcaggtcagtggtgtgattcacaggatggagcctggagggaaagagtacaattatgcatctgcttcaaaaggcgcaaaggtcttgtcttccaacaaggaagcaaagggggctgcaagcatcctaagcagggacaatgacaagtacctcagaaatccttgttctactgaaggtaaatttgttgttgtagaactttcagaagaaactttggtaaataccatcaagatcgcgaattttgagcattactcttccaatctgaaagagtttgagcttcaaggcaccctagtttatcccactgatacctgggttcatatgggaaacttcacggcttcaaacgtgaagcatgagcagaacttcacacttcttgagccaaagtgggtgagatacttaaagctaaactttattagtcattatggttcagaattctactgcaccttgagtttaatagaagtctacggtgtggatgccgtagaacgaatgctggaggatttgatatctgtccaggacaacaaaaatgcatacaaaccccgagaaggagattctgagcataaggagaagccaatgcagcaaatagagtcacttgaaggcgatgatggtgctgataagagcacgcacagagagaaagagaaggaagccccaccagagaatatgttagcgaagactgaagcatcaatggcgaagagtagtaataagctgtcagagcccgtggaagagatgaggcatcatcagccagggagcagaatgccaggggacacagtactgaagatactgatgcagaagttaaggtcattggacttgaacctatcgattctagagagatacttagaggaactgaacctgagatacgggaacatattcaaggagatggaccgtgaagccggtgtgagagaaaaggcgattgtggctttgagacttgacttggaaggtatgaaggaaaggcaagaggggatggtgagtgaagcagaggagatgaaagagtggcgaaagagagtggaggcagagatggagaaagcagagaaagagaaggaaaacataagacagagtcttgagcaagtaagtaaaagacttgagtggatggagaagaaatgcttaacggttttcaccgtatgtctagggtttggcattattgcggttattgcagttgtgattggtatgggaactggtctagcagagaagaccggtagtggggcttggctcttgttattgattagctcaacattcattatgttcgttttgtctctttgatgagagttttggtcttatttttacactgtagagtcatgttaccaatggatgaaatataccttgtttttcaataaccggcacacatacatatacttagcaattttctcaataatctaatgcctaatttgtaacatagattgtattcgatacaatgaagtcttcttatatagtctatagaaaaattgaaaaaaatgggcataattcttttgcggacgtaagtaaaagtgaaagtaagtgcgttgagtggatatagtaggtgagtgggtacaagggacccgtgagtactacaactttcaacgaggcttcattttcttaaataacagaggagctggtcttcgttatatattgaatttgtgggagactttgatcgacaacttattttaagcaatg

SEQ ID NO: 6233 - DNA, 3000 bp, Unknown
  misc_feature (1)..( 3000): cDNA_ID_3048091_gDNA_ID_1621084_Annot_ID_170461 3000 nt of promoter + ATG
gttatgaaattgagagagagtagaacactaaattagcaaaatggctgcaaaaacatcaaatttagttgctcttcttctctctttgtttcttctgcttctatctatctcctcacaagttggactaggcgaggccaaacgcaacctacgttagtattttttacactcattttcatgcttataatataggtctcgtctcgtctatatacatattgttatataacttatatttgtattcaccttctttgttattatatttatagattttttttgtttggagaaactaatcatacaatgtggtgcaggtaacaatttgcgtttggattgcgtttcccatccctctcctcctcctcctcatcgttccatggcccctccaatttttgtaccgccttctacatcacacaaaggacaaggcccataaacaaaatcatacaagtaaccgagaagaagtgatcaaaatttcataccaaaaaaagaagtgatcaagattccatatagagaaaagagtattgtgtaagaagaagggtcaagatttttcttttattgggtcaagcttttacaagttgactattataaattatacaacttattgtgtcttatacaagttgaaccttttcagagcatgttggaattttaaatcatatattgtgaatatatatgaatatgttgtatatcttatataataaagtcattttagataaattgattattgtactctcttttccacaaattatagtattttaatcagaactatttttttgttattcgaactgaaaccggccagaaaaaaaaaaaaaaaaatttgacgaaattttcatatctaaaccaaattcaaaccgttctggtttattctgatcgaaccgaattcatgacctaacaacaaccataattaaaacatacatacaattcactaaccaaaattttgctacaccgtccctttcgtccgaagacactcacacgtccaaacatacatttacacatctcaagtcgagatttatttcaaactaaaccttttaaactattaaggagatccacaaccaaaagaaaaaagagagcaaagtgaaacaatttattttcgaattacataaacaaatcccaaaagttaatgccaaatgaagacattatactcaaccacggcatctatatttacaaccttataagtctttggcagtgcatatcctctagcaaacctgaaatcgccggtacctccgatgatcggcaactctctctcctccagcagtatcggattccgtccatacaacgcagcggtgctgccgttaaactctccttccgtgaacacaaagttaaagaccattgtaaaaccaaacgttttcatgtccgtcgatgcgtacaacccctgagctctccccacttccttcgagctcagctcaggtccctcagtcaccggggcgtcaacaataagaaccgcaccgaatacagtggcggaggagtttgttcccggggcttcagcgactctgatggtggtgggtttgtcaccggagatgatgtcatggaagtagaagtggaggtgtgtgagtttatccggcttatttccttgaaacggagtcgttttggagtaaggtttggattgtgttacggtgatggtaagaaggagaacagttgagaatatcaaaggaagtagaagaagcagaaaaggtgtagccatgttcgttatttgtaacatatgtgacttattgcatgaaagcacgaatttttgttggtttatataacatttttgtgtgtgtatgtatattgttttcagattggtgacaataacatatccgttgacgaggaaaactaggaagttagatttgtagacaactagatattcccacccctacgaatatatatgtaaatgataaggtgtaaacaaacaaacaaaaagaaaaaattggacaaacaacaaataaggaaaaatattagattttgtattgcgatgactttgctgaaatttgcaagaaattgttgtctatattgatgggattacagtaaatggttctagtgttcagtgttctctaatgatcttcgttttgtagaccatgaatgactaattaactagaataatacttccatgataattaaaatttgtattataaaagaaacatgtgttcgagaaataaagaccccatgcaaaaaaagaaactcaaatttgatttacaagtgatgatacaactgatacctcaatcgtacgtcatctccacaagtatacaaataaactcaaaactgccttatttgccccaaaagaaaaagtttaaatcctgcaattttctcaaaatcagttgtattattttgtatacaaccacaactatacatcaataagatcaatggttcgcataccaatgaatgacacaagtacaattacaactacaaccgttgcttaaatttgaccaacaagatgtgagttgttccaaaataacaaaaattaaatatgtactacgtatttagctcgagaaaaatgaggaaataaaacatttttatcatttaatttctaattttcctcctttatttccctttaaataattgaacgtaccggcaggggataattcaataaaataaaatacccgatgcctcaattctcacgcatattcactcgcgtcacgaccacagatccttggagctgaggctgcgtgagagacacgagcaaaaaaatgcgtcgagggtgttagataatgtgggcaatattgttatctttctccatataacactttaattattattttttccgctttcattttttctcttccctcttcttcttgttctcattacatatcaatcaaccctaaaaaaaacttatcttatgaatctattaagtagatctctaatctctttcctactatttatatagactccttttgttgtagcctacttcttgcatattaaccccttgtgtctctcacaatcccactagtactgaaacatagagatagacttagctcaagataagctaatttgttttcactctaatatagagagagagagaaagagatcggagaggaaaaaatg

SEQ ID NO: 6234 - DNA, 3000 bp, Unknown
  misc_feature (1)..( 3000): cDNA_ID_1813809_gDNA_ID_1621084_Annot_ID_170459 3000 nt of promoter + ATG
acaaatgtcaattaaaaatcaacttcaaattactatggaatatctcaaggaaacttattgtagaaatttggtggaactagtaatcaaacttgttcatataaatgcatttggccttttgggttcgttgttggtctagagtttaacggtttagagattgttttaagattttatttcccatgtacaatgaaagtctaatacaaataagtactataaactaagcgttatgatcagtagattataatttatatcctactatattatttgggaagtacattttaaatgtaaccttaatttttgtaagtaattacataggtatgccattagaaataaaattttaaagagtaaattaatttatctctttaaggattaaaaagtcaaatactaatttaattaattaaatttaattaaaaaatgaaatatattattaatttccaaaaataataaccaatcaaaatcaacatataagatttgatatctaaattttaattaatttaatttaattagaaaaacaaaatacattattaatttccaaaaagtaaccagttaaaatcaacaaattatgtttgatatctaaattatcatattaattttttattaattattatagttcacttctcatcgttatatgattctatttttgcggaaaaataatatcatcattataaaaaaataattagagtttttttgcatatgccataatttgaatttttaaaaacaaatataaactgttcaatacatgaaaaaatattataagggtaaaaaatagatttaagaaaactttttactgagtaacgggtcataatttgaaatatttatattcaatttcatacatattatattgaaaatttataatttatatatactacaataattaataacatgttagatgtgattcaatttttaatacaagctggaaaatcctagaattgacgggtttagatcgatattaatacaagatagtatactacaggtgaaactcttaaattaacaatcaaactacaagtatataatcttaaacactaaacaatatagataatatcaacaaaacgtatacaactcacagtttactatacatttaaaatcaaataaaataatattatatattttttaatcatctttacaataaaagtttttagtttaactaaaatataagcctacatgcggtatactgcaggttaatatctagattatagagcttattggatctaaagacgggtcatcaaagatttcctaaactgaagcaaaatatactaaatattcaaatatctatatgttaccaaattataaacaaataagtcaatttaatattttatatacaaaatcaattaaatcttaatcacataaaaattagcacaaaaaaatgtattcaacaattaaaaatttatcaaatctctgtgttatataagttttgatactatattcaaataaagtgtaatataccttttcaatttgtattctttaactaatttaagctaactaatatatttgctaatcttatatctatcaaaaccgactatcgtttcttatctctatattatttttgcaagatttttttggtggatttggataaaagtgcattcgggtcatatggtacattcccctattaaataaatatggtgcactcctatgttattagctaaaatatttagattataattcagagtcatatcattaataaaattaatattaataaaataaataggtttttggcaagacggatttggagggacgggtttttgaatcaacattaataaaaaagtaaaatataattaatccaccgtttcaatacgggttaaatctttaatttattattttttaagaccactaatattaaacatatcaaatcatcctaatttagaaaaaattatataaaaccaaaaatgttatgtagtatgtataatgttactatatataaaattaaactataaaatataaatgtactagagaatgatacaatttgcaaaacttttatatatgaaaaataattcttaaattttaaaaattactactttaaaaaaaaatcacgggacgggtaaagaaattacagaacgtgttttattttggaattgggttatatggtggatgtatttgaatcaatatttataaaattttaaaatattattaatatgctgttttaataggaattaaaaacttcagttttttaacaattgtctcatgaattcgtggtatagttttacttaataacaattataaactgtaaaatataaatattttataaaaataaaattttcaagttttaatatatattactttgaaaaaataaatcatcccgccggttaaaatctagtttcatgtataataatcttacgaataaatatatacaagatgaccaaaatgaaaacaaaatttagataatcaacgcaaatgacatgatacatgccactaaagttttgcttagttccaacgacctttttgcctagttcgtttaatcgttttgtttaaagcatatattatcgtgtcgttaacgaaaaatgagttgagagaacttgatcacgttgattactaaaatctgattagctgtcgatgattacctttaaaattcaagtctattgccattataagatcatgcaagaatgtgggttaaaaaaaagaaaatctagaagtaatcaattatttcggatagtagagtaggtagcgtcagaaaattctgctacaacaaaaggggtattattgtcaatttaataaaataacacggttaggttcgtcgcttacgtgtcgagttcttagataacctttgaatgcaaaaatacgcagtttcgatccaacaaggcaacgctttgtgaccaaacagtcttttttttttcccttataaaacaaaaaaaaaaatgattttcttaataaaaagaagggaaagaaggaaaaacacacaaagcaacttcttcttcttgttcggcttttatcatctctgaaaattgctttatttggttgaattcattggattgttgatcgagattggtttactgattgatcgaaagtatg

SEQ ID NO: 6235 - DNA, 3000 bp, Unknown
  misc_feature (1)..( 3000): cDNA_ID_2125311_gDNA_ID_1621084_Annot_ID_170453 3000 nt of promoter + ATG
acaacaacaacaacaatattgatttgaaaagaaaaaaagatcttggtctgactcagttgtctagttttcaagcccacctgaaagaacccaaagtgagcagaactagtctggttcgcagaaaactggacttcaaattccgaaaaacctatttattttgggccttaagaacttctttaaggccttttagtgattccatgactattttgaattgacatgttgttctccttcaaggcttctcctttacttattttgtagagagtgtaggcttattatagggactacttacttatataagttgtaccaaggtaatttagttggtataatttctagactgtaattttcaatcatcaatgtattttttcaactaggaattacatagtcacactcacataagtatcatatgtcatatgataatttgatcactaggtactgaagtgtgtctacaagctatattttttctcaaactcagatttagtatatttgcaatattgtttctctaatgatgacgaattaaattatgtatggaccgctaacatatgtgaccactcagttagaacttctcaatgttttattttatgcattgtacaatttcatgaactctatcaaaacatttgttgtatatgtttattttacaaagatagttttggtaccctatagttgcttagttaacttgcttataccctaaatcttaatcaacaagaaaacgtaaaacccactcagtgaatcaaattatcaaccaattaacgtaaaacgcatgatatcatgttttataagatgtgttatgtgtaagaccaggtttgaaaaagtgtgaaataatataatattactcttcgattgatccttaattgcgatatctttcgtatgatttcaactatatatgacgcacttacaagttacaacgatattaattatattaatatcgttttctcatatattcatatatgcatatgatatgactgaattatttattattcgcctccacaagttacaggactataaattattcatctccagaagttgcgttgcaccactaaatatgaagagaagataaaaccgaacaggtaaaagggacgtttaccaaaatatcaacctaatcttcccctaaaccaaatttttccaattaagtttattcttaagcacaatcaactctctgttactttaaagtattctcgtgaccactgattgtttttcctggtgtataagtaagtaccacaaaatataagaacatgacataagactctataaaatatgtataactaaacatttttcatttgtagccagataaaagaaatctatgggccggaagtcgtattatttgacacggcacttttggttaacgtataaactatctgattttataagctgtcaaaacaaaaaaatggtaaatttaacattcataaaatatcatgatgttccacaggtcacatcagtgaaagactaaactttctgattttttgtaaaattgactatgaggacatgcatgaattaatattctacgaccacaattacttctctaatctggattgaaaaatggccaccgtatacatttctttaaataacgtttttcaaattttattataaaatctaggggactaccatattatatgtataaacgtccatatccatcttagaaatgttatcaataataggtctgaaaaatttcatagaaccacacttattttggagctgaattcaatcccccaacgtactttctcgttcttgttatgtttcgttgtcgctttgtttatatttcttcttattttaggggttttttcagttcgattttgttttgtttttagttagcggacgaaaatatacagatggtagtactaacttttctcctagcattctcatctatgtgtgtgtgttatacatttatatcggtgctcttggttgaccttagaaggtactttatatatggttcgagggtccatatggataagttcagattaaacatctaaaagtgcatcttgtgaccaaaaaaaaaaaactatccatatttaaatgcaaaaagatctttggatgaattattatgacacaagcaatcgcgatagaataggaaaataataaaatgcatgcatcctcagcattggttgctaaatttccagttcgattttcaatttcgaaaggtgggctccatttgtttactagatgtgtttttttctttctttttgttgtgaatgtttactagatatgtttattttcaattatttgtatacgtgtgggtcgcaaatgccgcttgcgtggtacacaaaataatatcaatcctttgagaaaattaaaagtcaaagtgcataataatatactcagtatgtttttttcctttgcagatattccatgcatatgctaaataacatcatttatatatcattaaaaatgtacaacaagaaaccaaatgcatatgctaaaccaatccatataatatgttttgcaggttcatttaaatcgactaattatattatggttttttttttttgcttctgatattgcatctaaattgttgttgaactcttttccgccaatagaaacaatatttcaaatttgtagcatcgctaaataaaatacataataagttgaaacaatatagttgttgagtaaattatataatcatctttgctattgttaattctaaatttatttaacacaaaaagctaaccattaagcaaagaagaaagtgacatgatgatcgaaaggaacattagaaacgtcctcattgtccgccgggaaatattttggagaaggacatcgattaatctatagattagaggacacctcttagtttaaataatgatatcgttatacacctaatgaaattaaataaatgctcaattcatcaataaataatttaatgtgtgtttcctaatactcggaacattataaccaccaatcaccacctccaaacttccctatataagacacgacacccattctaagcatcactagctctctccctctccctctccctctccatctctctgctcgcttgtgacagtaaacatg

SEQ ID NO: 6236 - DNA, 3000 bp, Unknown
  misc_feature (1)..( 3000): cDNA_ID_2125304_gDNA_ID_1621084_Annot_ID_170451 3000 nt of promoter + ATG
aaccagaacactcaacaagtaatggcggctatgagaatgagaaccgccgggaaaatgagcactggtgttgaagccaacgagattggagctctcatgggtcttgctggcttcaacggcgcaaccaacgcagtgaatcaccctccaaatgggattcaacaacagcttcaagctccaccgttaaacaacgtcaacggcgtcactaatcacaacctcaccaatagtaatggaggcatgatgatgaacatgaatgggtacaataatcatcatccaatgaacatgcagagtaggcaaatgatgcatcagcctcagcaaatgatgtaccaaagatcatctttcgttccagcatcaagcaatgggtattattacaattatacccctagtccctacagttattatccttattacccttacgcaagtgatcagtaccaacaacaaagtagtcattcacatgcaacaaacatgtctagtgaagaagacgctggtaataacaatagctgcaacatcatgtaaagtgtggatgcttgctaaggaagatatctatcttttgcttttggaaacaagacttaaaagtttaatcttttctggagtgtgatatattagtgtttggtttttctttctctttttttttggtgtgtgtcatgtagctgttttggactgacatgaagttgtgttggttgatatataaaatcctagaatgttattgatgtttcttgtgagatgcttttgtttgtcttggttctttttcatgagatccggttggtgcggtcgaaacatttgtagatgaggagcgtttaaagcggttggttttgtcacaatgtggtttgtgtgtatctctcgaaaagatattctctctatccactcaaaaagttattccacctgctctcgcttgcctcttggtaggtgtctcgttttacgcgtcacctatttttattaaatgcgacatggttcaaaattttggacttgtgaaagtaataatgctaagccggtcatgcatcaatcagttctttgttttaaatttgatatatttccaagatacaccgatggaaattggtatttgcttaggaaaaatgtttatcagattcgaaccatcttttgggccacatgaatttcaagaaacattttggggtaaagcccaacttttttttctttttcaaacgtatttaaattctttagagcctacacaagattccccaaccagatgacaaaaacatgcaaacgaaaatgctaaacattttgtctgtttatttttgacaaaatgggaagaagttttctcatttaaaagttaaaatgcttttaaaatcgtactctaaaaattggtccaaaataaaataaagatcgtaccctaattttgaggtttagttatgatttctcaccacaatcgcttgtccaaatttatacatgtgaaataatcttatttaccaattatgatttaattaatttaattgttactgaaaaatacattatacaatcactatatgaaactctaaccacaaattaatagcagtgcaggacactaaaattataagtaactagaaaacatttggtacgagtgaaaataactctatgtaatgttcggtccatttgcatgctatagtaggtttatattaataatgtggtttgtgcataataatggattaccaaatggacacttaaacgtaagaagcatcgagtttaggatagtggaccattctcttaaattcttttcacacttgagttcctactttttacgacacgagccgtgagatgtttgcctttgtttttctataatcgaattttatcttgtagattacaaaattatcgagagacttgcttgtgtcttagtttctgattaagtggttataaaaagagactaagaatacttagataaaaagagagagatagatttaagtatgatttctcgaattaacaattttccggtcccttaaatgtaattaggtgctttggtaacgcgtctaggatactagagctttcgtatcacacaataatcaagacaattagtgtgattatttattcaactataaataatacgaggtttaatgcaataattcgagatattttgccacgtaagaaggtggtatctggatacatagctaaatgaaatttgctaatattttatcgtcactttttagtattgcctttctttgtattttccctcgtcaatgtttgctttctctgcttttctgcggatgccattgtatttaatttgtaatttagtatacgtcgctactagctttttcacctgtgaagccaacacaaacatattatctttggggagaatcccaaaaaaaggaaagttgaaaaagagtaatcttttaattttgatttcttaagactcttaaatacttggaactgattgctaactgacaaccaaattatggattttaagatctattatcgatcaaagactcatagttatacgtactaatcaacctacctaacctacctacctcaaataccattgtaagctaaaaaggatgaatcatcgagttaggctctcatttgtcattaagcttcttctttgtttcactagtcattaagcgttgcacattatacgcaactttcattaaatgcagacttcgataaatccggtactaaagactatagagtgtgacaaaaaaaaaaaagagtacaagagtgaaatctcataaaataatacaaagacaaacaaaaattcccaaaacaaacaatttggaaagaaaggtcactgaataatgaaaaaggaaaatgccatctgcacatcatgcaaccattaaaagaaattttttataccaaacttagtttaatgatagaataaatttgtaacgatactataacaaagactcatgggtgtgaaccaaagacaaccacgttctctcaaatactcacacacacactcctatatataagtatctaatctaatcaagaacttaatttctctcacccgaagttaataattcagtcagaaacacacacacacacacacacacacacactcaaaactgaattgacttgtcagaaatg

SEQ ID NO: 6237 - DNA, 3000 bp, Unknown
  misc_feature (1)..( 3000): cDNA_ID_1813832_gDNA_ID_1621084_Annot_ID_170450 3000 nt of promoter + ATG
aaaattagaaaaccgacattattgtataatggtttgtgctagtaattttgttatgttgctattcggattcaaactcttgtatgttattgacaaataaaaaaatccgacaatcatgtatttttctaagttttgaaagaattaacttattttaaatttctatattggattattaataaaataaaggactgagtagataatgtcaaaaaaaaaaaatgagtagattaataaataaatgagagggaaaaaaaaggcgagattggcggtggtagatgtaggagaagaagagaacaaaacaaggaggatacagttggctatggaatattatggttcataatgcaaccaaacacatataattgaaatgaaccacacacacgcttttaattatacacataagagtgatcgagcaccattacattttctttctttgcttcgttgtaaagccgactttatattatcatctctttttatgtaaaagaaagttgtaatgggttttaataatatatataaacagaatgggtcaatctaataaatattcggaccacaatgttaaaaattagttatctgtttttttccggccggaaacaattatggtgatttaaaagattatcatcatcaatttttattttttttgacgttatcatcaccaattattgattggtatatattcttctacggtttctgtaaatttatcatgaaattccttactatgcttttttttggttaaagaattatttactgtttttgataggaggaaaaatgatcgtccacgttcagtatacggcatcatcagcaaaaccattcaaaaatgtttttactggaacggccaaatatggtataacgacttatagcattgtgtacgtgtgttatacaataacaagttctctaaatgtttcgaagtttacatggtataagagcctctatgaaatggaaacctaattcgttatcatggagctcgtccaatggtgagaaagaactcagcaccaagttggtggaattatcaacatcataagagagttcttctagctctttggtgcaagtgacatgtgagaattacaaaaaatgggttaagaattaaaaatgcactcaaattattggtttgttagaatgaaagtggatcacaaatagaatgtggtcgtggagctagaaactggagggtagaggctcatatcagaactcacctcaaagtccatatccgtgtcaaggcaggcgtggacgaggacatcaattaaggccgtagtactgtcccgtattaaacacaataataaaatcgtaccttgaaagctataagaaaatagaagagagtgaacaatcgacaaatgacaacgagaaacatttaatgaaatgaaaatatctatgctccagacacagagataacccacgggcagccaatgaagcactccacttgcgaatttgtaatagaccctacttgacaatgagtagaagagccatatcatgtatatttaatatttaagttggtgtgttgtagaatacgtagaattgttttgtgccataaaaattaagaaagtgtttattttgttttcttagctcgtgtataatcaaatttaagtagttgaattcgtggaattgtagtaagtaactgtgtgcttcgactaagtgtatggtgtgatggtgtcgtggtgacatttcttcggttcttccaaaggaagttaaaccttgcactgcccgcttgatcccgtttgagagaaatgagtccaataattaaagatatcataaatttcttaagttaaaaacagtgtgttgaccgatgaaatattatacaaaaatgtcttttctacctaattgagagtcacacatctttgatccaatttttctctattacatctttgatacaatttattacatctttgatccaaattgcactctattacatctttgatccaatttttctctctatttttctaccgattacacaataacatattaatttgtccataaagattgttatgaatggttcagtgttacaaaatctccattattccaccttgcatattgctgcggaatgcccaagaaacaagactaaagaggcgaataaatcacagaagcgaaaacgctctaaaattcctaatctaatagacgcattcgcctctttgatttattcgccacaaacaagttttgttagtataacaaataaaaattttcccttcgcagaaacaaagtcgagattcgacaaaacgttcaccattcgaacaccaacaacgacgaaaagaagctaattaataaaccaaacagaagagaaagccttggcctgcaaataaccgtcatgacttagtgctggctgcaactaacgccatgaatggtctatcaattaagaactcttttgatgtaattcactacaaaatctaaatttttgacccgctacaagatttaattgggagatacgttgaatctcaaaaaaaatcgtaagaaactacaatcttccttcctataggcatgaagcttgttgtatgcttcgccaacgttacgtgtatgacttataatgccacgtgacactctcttagttggcggtttttgtctaaatcttttatgtgacgtggtgcgttctgatattcttattggtcaattatttttgctgatgtggtatgagaaaagtcaaaatcgtttcaaggagatttgttatcttagctaaaacaaaaagaagttattacaggaatagaaagagagagagacgaaaatttacgctgatgacgtggtaagggaacgacggagtggggaaccacaagccgttcttgatattcaacgtggtttgctcatggcggcgcgtggtagactcgtggtggcgcgtgggaacagaagcttttcatctataatcagaaaatactcattgaaaagtccatttccctctattttgttctttcttatttcttgcaatttcatctctctcatttttttttctgataaaggtgcaatctcatctcttgcaatatggtattaggagaaacgaataagaaagtgatcaagaatgtgattaagctcttaacg

SEQ ID NO: 6238 - DNA, 1291 bp, Unknown
  misc_feature (1)..( 1291): cDNA_ID_1019898_gDNA_ID_1621084_Annot_ID_170471 3000 nt of promoter + ATG
ttctatcatttccggttttgcatacaacgagagatcagaagaaacctctttcctgctcaaggagatgttgctctctggatttcacccaaatcacattacgcttgctagcattctccctctttttgctcgggtgggaaacctgcaacatgggaaagagtttcactgctacatcctgagacgccaaagctacaaggactgtttaatcctgtggaactcccttgtcgatatgtatgcaaaatccggtgaaatcatagctgcaaagcgagtatttgattcgatgaggaagagggacaaagtgacatacacttctttgatcgatggatatggcaggctgggtaaaggagaagtcgcattggcatggttcaaggatatggacagatccggtatcaaacctgatcatgtaactatggttgcagttttatcagcttgcagccattccaatttagtgcgtgaaggacactggttgtttacgaagatggagcatgtgtttggtatacgccttcgccttgaacactattcttgtatggttgatctttattgcagagcaggttacctggataaagccagagatatattccatacaataccttacgagccatcaagtgctatgtgtgctactctactgaaagcgtgcctcatccacgggaacacaaacattggggagtgggctgcagataagttactactagaaacaaagccagaacacttaggtcactatatgttgcttgcagatatgtatgcagtaactggttcttggagcaagcttgtaacggtgaagactttactgagtgacttgggcgtgcaaaaggctcatgagtttgctttgatggaaacagattcggagttagatggagagaataataagccgatgaacgatgattctgtcatcaatcaggagcaaagttcagatgaagaacgtcttgtagaagtaggataaagaatcaaattctgatagaaatattttatcaaactggagaatcaatttgtacataaatcttatatacaacaagttttaattgcatgatttcctgtaaacataagtttacatgaactaggggatggtccttcgcaagtatgagtaacaagcataaacagcattatatatgaaataaatatgagcccacctaaacccattaagggcccattaagattggagatactgcttttttaagagaggtcactttttccacagtgaaaccctaaggaaacttcggcaagctccagagaaacgagagttccgtaatcattttctcttgttgttcctgatcgcgtagctcaagcgaaaaaaatg

SEQ ID NO: 6239 - DNA, 3000 bp, Unknown
  misc_feature (1)..( 3000): cDNA_ID_3048083_gDNA_ID_1621084_Annot_ID_170469 3000 nt of promoter + ATG
acttgaaggaatctactgcgcctaagtgaatctgatggtggattgattctgagttgttaagtctctctcagatgaggcttttttactttgctatattcttttgccaaataaaatctcaaactttttttgtttatcatcaattacgttcttggtgggaatttggctgtaatgtgtgctgaggctcactttatcgagtacatttgattttctgaggctcattttccttttttttgtctagaaagcattttctcacttattattggtgcttaaatttgaaggacaaaaaagattcgaattatatatcaactattaacaataatggagcaatacatttaacgttgatacatgatactctgttggcgttttacaaatcctagagagtcaaaaccattatccaatcgctggcttgtttcctactttgcatctctcttctcatcatcatcaatatcctttatagcatcctgcaacacacggcaagtaaaagatatacatgagacagattcatttcactttacatcttttaagtttcaaccaaatgtgggacttttctgagcttatatgctacgaagctttgaaccagttggtttgatatcagaagtgggaggcaaatataacgcagaacagagaaagaaaagaagtaaacaagtatgagtttacctttgcaaggcttgtcacatatgttccagccaatgcagtaaccaacagacccaccccgagagttaaaagctggccgtttcctccaggcaagccaacattagattcttcttgctgaagcgacatagacagaagattgtcatttgatgattttatgatgcttgccagagtcaccatgtattcacaattcaacaggatatcagacacagtttctacaattcaagttaacttccataagttgactagcctccctcgtattgagtacatgtttaccattcgatatcgatctccttttcattaagtcaaaaacaaaacttttagctgatgattttagctagctttctaccctacacaagtgctgatcaacatgaacttattgtacaccataggcttgaaatgagagaagataggcatgtttttgtacagttcatttttttgtgtcaaagtgatatagagattagataaaaagacaacagaactcacaatgattgctcgtccaaaagccccggcgctgacataagcccaagagcctggaagcatacccaaccagctgcaaaaacagtatgatccatgaatgagtatgtaaactcagactatagcttatcaagttgaaatcttgttctcaaatgcaaaacaaattgaatcaactcctggtcaagattgcttgagagtaaacaccaagtggacattaagtgctgggaactaattgactactacaactcaagtatcaagcttctacagcggatatcatagggaaataagtataacaaagttgcaagaacacagaccttcctaatacataaggcacaaacttcacagacgtcaacccgtacaggtaattgccaagagagaaaggaagtagagggcttagccgaaggagagtaacaactctaaacccattttcaccaatcgctttatcaatggcgaggaacttcttgttgtcttcaactaacttaaggatgcgctctcgggcaaaatatctagcaattaagaaagcaacactagcagccatctaacacaggaaaaccaaaataacatatatcaacatgggaaggtcacttgatgagattaaggattgtgttcttgggaagaataaacttacagttccactgatagaaactatgatagtgccaatgagtggaccgaagagaagaccagccgacatcgtcaatgggagagctggaatggctagtatctaacacaaatgattcaaaaaacaaaaccttgaaactggggtcaatgaagagtataaaaaacatcaaaagcagatgaagaagtataaaaaagcttgcctcaagcccagcatagacggcaatgaataacgcatacccagccgtaccataacctgttgtttgattcatcaagaacacaaaactccatcaacttacttctatctaaatgcatcatcaatatctaaaggtctattctcactaagttctattagcttctatgtatcgaatcgttaccttcgatgtaagtggagaattgagtaaggaaagtattgatctgatccctgtagacatatccaacgccggcgaatccaccaacagtaccaatcaacaaaactccggctaagatagtacccttaatagcagcatcaccttccgatccgccatcatcatcgctctcagacttaacatcatcttcgtcgttttcatcattagtggatttagaattgaagaaccaccggagactctgaggaggcggagcggtagatgggagagactgttgcttcttcttcttggtttgctttagggaagagcatggtttaaggaaatggaatcgtttgtagagtctaaaggacgaagaaggaggaggaggagagcagaagcgggagttgcaggtgaatggaagagaagaggaggaggaggatctgagagtcagacctagagtgaggctgcgcattcttaagcagctttaatggagatgatgatgatgaagacgaagattggattgaagcagtgccatctcagtttgggcttttggattggcgcggctttgttcttgccaagtatcgtattttcggatgggcttctggcgatctagagcgccacgtgtctatctgttcttaggatcacgaaattaaaattagttttcttccagaaaaaactacaaatcaaaaattcaagaaaattgaatttatatcgcatattcgcatcaaatttttttgcaaccaattaattcagacaaaaaaacaaaatttttttagaaaataacattttaaggaacttgatttgtttagggcttaacttgaaaattaagtttttggcttcaaaaaacaaaaacaaatattataattgaacgatgctttaaacgacagcgtttagtgtttgttaagctgtaatg

SEQ ID NO: 6240 - DNA, 3000 bp, Unknown
  misc_feature (1)..( 3000): cDNA_ID_1813836_gDNA_ID_1621084_Annot_ID_170449 3000 nt of promoter + ATG
acgtcacataaaagatttagacaaaaaccgccaactaagagagtgtcacgtggcattataagtcatacacgtaacgttggcgaagcatacaacaagcttcatgcctataggaaggaagattgtagtttcttacgattttttttgagattcaacgtatctcccaattaaatcttgtagcgggtcaaaaatttagattttgtagtgaattacatcaaaagagttcttaattgatagaccattcatggcgttagttgcagccagcactaagtcatgacggttatttgcaggccaaggctttctcttctgtttggtttattaattagcttcttttcgtcgttgttggtgttcgaatggtgaacgttttgtcgaatctcgactttgtttctgcgaagggaaaatttttatttgttatactaacaaaacttgtttgtggcgaataaatcaaagaggcgaatgcgtctattagattaggaattttagagcgttttcgcttctgtgatttattcgcctctttagtcttgtttcttgggcattccgcagcaatatgcaaggtggaataatggagattttgtaacactgaaccattcataacaatctttatggacaaattaatatgttattgtgtaatcggtagaaaaatagagagaaaaattggatcaaagatgtaatagagtgcaatttggatcaaagatgtaataaattgtatcaaagatgtaatagagaaaaattggatcaaagatgtgtgactctcaattaggtagaaaagacatttttgtataatatttcatcggtcaacacactgtttttaacttaagaaatttatgatatctttaattattggactcatttctctcaaacgggatcaagcgggcagtgcaaggtttaacttcctttggaagaaccgaagaaatgtcaccacgacaccatcacaccatacacttagtcgaagcacacagttacttactacaattccacgaattcaactacttaaatttgattatacacgagctaagaaaacaaaataaacactttcttaatttttatggcacaaaacaattctacgtattctacaacacaccaacttaaatattaaatatacatgatatggctcttctactcattgtcaagtagggtctattacaaattcgcaagtggagtgcttcattggctgcccgtgggttatctctgtgtctggagcatagatattttcatttcattaaatgtttctcgttgtcatttgtcgattgttcactctcttctattttcttatagctttcaaggtacgattttattattgtgtttaatacgggacagtactacggccttaattgatgtcctcgtccacgcctgccttgacacggatatggactttgaggtgagttctgatatgagcctctaccctccagtttctagctccacgaccacattctatttgtgatccactttcattctaacaaaccaataatttgagtgcatttttaattcttaacccattttttgtaattctcacatgtcacttgcaccaaagagctagaagaactctcttatgatgttgataattccaccaacttggtgctgagttctttctcaccattggacgagctccatgataacgaattaggtttccatttcatagaggctcttataccatgtaaacttcgaaacatttagagaacttgttattgtataacacacgtacacaatgctataagtcgttataccatatttggccgttccagtaaaaacatttttgaatggttttgctgatgatgccgtatactgaacgtggacgatcatttttcctcctatcaaaaacagtaaataattctttaaccaaaaaaaagcatagtaaggaatttcatgataaatttacagaaaccgtagaagaatatataccaatcaataattggtgatgataacgtcaaaaaaaataaaaattgatgatgataatcttttaaatcaccataattgtttccggccggaaaaaaacagataactaatttttaacattgtggtccgaatatttattagattgacccattctgtttatatatattattaaaacccattacaactttcttttacataaaaagagatgataatataaagtcggctttacaacgaagcaaagaaagaaaatgtaatggtgctcgatcactcttatgtgtataattaaaagcgtgtgtgtggttcatttcaattatatgtgtttggttgcattatgaaccataatattccatagccaactgtatcctccttgttttgttctcttcttctcctacatctaccaccgccaatctcgccttttttttccctctcatttatttattaatctactcattttttttttttgacattatctactcagtcctttattttattaataatccaatatagaaatttaaaataagttaattctttcaaaacttagaaaaatacatgattgtcggatttttttatttgtcaataacatacaagagtttgaatccgaatagcaacataacaaaattactagcacaaaccattatacaataatgtcggttttctaattttaattttatttgtcagatttttttcgtttttgacattgttttatattttttctaggtattaaagtttagatgttggatttataacatagtttttaggatttagatttagaatttaaactttgattattttgtcttataaaaatatagactaagactatttaatttcttaatgacttttcttcttttcgagactattccttaattatgatttgaaatatacactaaaaaaaaaagttgacaacaacaaaaaaagtggaccaagacgtaggtccttaaaacggtgccgtaacaaggacctctcgcttgacaaaatggtcgcgtgaataaataaaagcaacgttagtcgcttctgagtaaagaaccaatcccaaagctcatttattctttccttttcaattattctttcaatttttccgatcgacggaggttgatcggcgacggcgtaatg

SEQ ID NO: 6241 - DNA, 3000 bp, Unknown
  misc_feature (1)..( 3000): cDNA_ID_1813817_gDNA_ID_1621084_Annot_ID_55340 3000 nt of promoter + ATG
ttcataattgtacattttgatcagcataactattgcttaaaatttccatattggttttaccttaattgatcaaaagtctttcttttggatcgaaattgagacaattgttctaccaactgtacttgaaaaactgctatatttctcttgcaatttggttatctcctgatctcttttacttatgatgactctgttagatgctgctttcatgagcgtttctttgttaaactaacttggtcggtcttgttgtcactttcaccaactgaaaagaattaatatgttttaagtatgttaaattgctgtcaagctagctagggatgttgtaccgaccagcggaaccggtggagcagtaactgatttattaaaaaaggttgtgaaaaaactgatctggttaactttttgagccggtcctcctcagtaggaccatctttgtcaaaactttgatcagaccgaaaagctgtgttcaaccacattagcctaaagcttagctcacaaagaccatcagaacagaacaggctgaatcatcatcacatatttttttaacaaaaccatataacaaactattagaactgaattctcataaagctatcaaaaaccctccttttttcacaaacctgggttgaattagtagtaggtttagccaccttatctctgaaactttcttgataaccttaattatacatcttacaatgtttaacctatggttttgtttaacctcaattatacaaaaccattaccactaatgggctaatagtgaatctggcccaaaatgtatttgcccttttcttctttagccaaaagccttctcaataagtcttcttcttcttctctgatttctttctcccttcttctctcggtcttgaatctttctttgtttgctaatatggggattaatacttaaacagagaagtttgtttttttccaacttaattcttcaagggcatttcaataaataacactaagtcccctaagtgacaaacgacgacctatcagctaagcaaaaacccttagcttggcagaggcgtcaagggtttcaaatggggaaatcaaagaaaaaggttctaaataaatctctgattactcatcctagcaccagtgacgatactctccaagtattcttctttcttaccatgtttgtttcatgttttttggaaatgaattagaattgtaattagacaaagatcatgctaaactttttgcagttgttcgatccaacatcgtctcctacaaaggaaaaagttaactggaacaatgttcttggcatttctgattacctctctaaacaagccaccagaggttttagggttctctgttaatatttgttaatttctcggttctttttttttgtgatttcttcctctcaatttggttactacttaattatgatagtgaaaacgctatggactggagaaactccaaaagctgaatcagttaaggagacaatggagtcttacttcaaggctcttctagggtttttgctctgttgtcatggaagcactcttggtgctggtcctactttgtcttcaatcgtacacggttctgttaagcaaatcgttgactccagcttcagattgtttcagggttctgtatctctttacggtaataatgaaaagttttatacttttcaactatctcaatgtaacatctattgaactcgtcttgtcaaaggatagtgtagccactgtttcatttgctttcaacatacacttctcgtgagtgctttaactgtggatgatgttgccggtgttttgtttgtatctgttaaccagatggatcatatgaaaagggggaaaagccgtctatttcgcagctttcaggagcagttttggaggcatgctctagtttcaagaaggttcctacaacaaacctcatcgcgattggcagtgctatttctcaggtttcggttatcatgaaggatgttcttaatgagatgaaaaaagtgaaaccagcttgtccttcaagtgagggtgaggcatctggtgatgatttttctcctgagcaaatagaagttgctaaaatggttgctgacattgtgtatgaggcgatgacggtaataatagtcattcgagtaatcaccaggatgatggagaaggagaattcaaatgagaatagcgtgtttgtggagtcgctagagaagctacttaagttgtgtcaaagaagtggagtagtgatagaagagcttggtacttgcgtttatcatccaccgctgaagatagacaagataactcaaacggtgaagatactagagggaaatctcgatgaagttgaggctcaagttgagtatatgaagaggtcttccaacgcctttccgggagtttgcagaaagctgcgagacgcgatcaaactcatggaagttggattggaaaaaagaaaggatttgaatcaaattctgatttctcgtcaaaacactctctacaatgctctccaggtatgtttcttcttacctatttttgttttgtttcatgttttctcgcaatgaattcgacaaggattaggccaaaatgttttgcagttgttggatccaacagcttctccgatgaatcgatgttcttagatctctgagcagccctctaaacaagataccatagggtcaatgttcggtttcctctgcatttacatgagaaacagacatgtctcttataagttaaagactgcttcaccttttcccaagttcatctttcgttgagactttatgttcatgagcgtttcttgttaaacatgactctgcttctttaaaggatctgaaaacttttcccaagtttatagtctctgatctttctttaatactttcctatgcaatgtttttgatcgcttcatagtcaataacaagagacttgaagttttttctttaacttgaaaagcaaaattttgtaagggcttttctgtaaataataacactagtttccaaagtcttcaaacgacgtcgttacgaacctgtgaagctttagcttcgacaaaacccttaagctagtagagacgtcaagaggttgaagcaagacaaaa

SEQ ID NO: 6242 - DNA, 3000 bp, Unknown
  misc_feature (1)..( 3000): cDNA_ID_1813813_gDNA_ID_1621084_Annot_ID_55342 3000 nt of promoter + ATG
aagatgacctggttagagcagcttgtcagcttgagctttctatgattcaaaaatgcaagctaactccagaaggggttgacactatgctcactcatgataagaaagcaattcaaatgcaggtttgcttactcaactctctgttatttcctttttagtcttttgatatttttgttgtgtaatgtgaattctcgttgtaggtaacacaagatcaagaactcctaacagagaaagtacgacacctgagtggagttgcaggagttgagcgcatggaaagtgcgttgttggaaacacgaacaaagtactttcaggcgaaggaggatggaagccctatggctaatcagctcgcacatttcttttctccaagcccagcttcatctccagttcagtctgtgtctagttccagcagcagaagtaaagatagcataggtgttgaaggatcaaatcgtgttaatcgttctttattgaaggatgatactccaccctcatctggaccctctagagtcagtaatggcactgtggacgaggtttcaaatcagaatgagttgatggtgaatgagttcctgcatgatgggaacctcaactttcctggtggatccactgtcaaggatgaagaggacaatcttaaggtttgctttctttgcagttctgcacattgttgttggactcattacaaattctggttatagtatgttcttgccattgattttgtaaatgtgtgttgcagagaaggataaaggagactatggagagagctttctgggataatgtcatggaatccatgaaattggagaagccagactatagctgcatctctaaccttatgaaagaagtgagtgacgaactttgccagatggtaccagatagctggaaagtagaaataactgaaactattgatctggacattctctcacaggtttgcctcatctctctggtctcatattacgtgtctgtcgttttttatatattttagagggtggttctcatttcatcttttattggtagttgctcaactccggcaccttggatatcgattaccttggaaagatgcttgagtttgcgttggctactctgcggaaactctctgccccagctaatgaccgtgagaatgaaagcacccaccgggatttactcaaggaacttcacaggttgtgtgaagctgaagatgagtctggtaacttccgtgctgttgcaatagtcaaggggatccgcttcattcttgagcaaattcaggtctgtatgtacaagctcttttttcttcattcttcctcttcatcagcaatagctttggatagaaagaaaaaatatacttttgctttgcttgtccacttatcagtttcttcattttttattctatatccaacaggaacttaagcgagagataggcataggtcgcatagcaatcatgaaaccctttttgcaaggaccagcaggctttgattaccttacaaaagcatttgaaaagcgttatggacctcccactcaagcctacgaatcactaccagtgacacgaaggtggatatcaactcttttgtctagcaaagaagagtgggaagaacacaacaatacgctttcagccttgaatgtggttgagagatcctccatgggtatttctctcaaaacgggtggaagctttctatccccagtcaataccacgtccaagtcaactgttatggacactgcaggttttgcttgttaccctcattgaagaagtctagaaataccttcttttatagattatagcactaaaatgttttcatttgctttttggttcataaggtcaactatcagaatgcaagggagaaagagttgatttggcagtgaggcttgggttgttgaagctggtgaatcaggtagctggtttaacaccagaagttctaccggaaacttttcagctcaacctctttcgcgtgagggatattcaagctgaaattcagaatataattgtggtaaccacaaggtatgaacgattgttacatttggtaagaagactcatatagaaattagagtactttctcatcttaaaaggatttgtgttatgcagcttgctcatttggcgtcaaatgcttgcaaagagcgaaagcgaaacagaaagtatggcaaagaaattgttggagttgttagatgggaaggaaggagcaggactaacggagataatcgaaacaacaatgagtgaagaagatggagagaagaagaagatgatgagaggattattggggaagagtttgggagaaggtaacacagtgtatgagagagttacaagttgtatatacaaagcggctcgaggagctttattggctgggaatggagaaaatgggaagagaatggttgaaacagagatgaagaaagtaggaggaggtggaggattgaaagaaagggttttagagacagctcgagcccttggtgttgtagcttgtgtctcagtcagagttcatggtccatggttgactcagctcatgccacaacattgaaccaaaccaaaccactcggtaaacttgtatagcctcttgtatatattatgatatatatcaataataattacacgtgtaatgtaagatgcattttgatttgaagatgcattatgctgatttgtaaaacataaacggctttggtccctttttagtgtgtccgaatgaataaggtgttcaaaatagcgtgtgatttgtaatttgtaatttgtaattagtctgaaacgttgtatatatgaatattcttcaattatataaaagcttgctttcaaatatatcaatttatctatcttttgattatattgtccctttttcgtggaccacaagtattaacttatctcatacaaataattcgtgcttaagtttggtgttaaaattattgaaaattgatttacattgaatttttttcgcggtaattgataattcatgaaaatcgatgaaatttactaattttatttcacattaaagtcaataaaatgggaaaatatttgatgagaataaaataaaataaaataaagagaagggacgagaaatg

SEQ ID NO: 6243 - DNA, 3000 bp, Unknown; identical to SEQ ID NO: 6234
  misc_feature (1)..( 3000): cDNA_ID_1813809_gDNA_ID_1621084_Annot_ID_55343 3000 nt of promoter + ATG

SEQ ID NO: 6244 - DNA, 3000 bp, Unknown
  misc_feature (1)..( 3000): cDNA_ID_1813805_gDNA_ID_1621084_Annot_ID_55345 3000 nt of promoter + ATG
actacggattgaacttaatcactgtcattgttttcgtaacaatttgtgacaaaaccacgaaaaaattgtactcacagataaatatttggctatatgacaaaaatatatatcctatatggtttgtatagttgtctaaaattcaacctaagtaggtggaagaaataaatttaaacagaacaggacgtgagccaagagactttcgtatggaaaattaaaggcgcgttgaatagaaatgtagttggcgactagtacatttcagcgatgcttatcctttagccttttacatttcaaggaagcttttattatataaatcatcctgaagctagtctttgttatgaaattgagagagagtagaacactaaattagcaaaatggctgcaaaaacatcaaatttagttgctcttcttctctctttgtttcttctgcttctatctatctcctcacaagttggactaggcgaggccaaacgcaacctacgttagtattttttacactcattttcatgcttataatataggtctcgtctcgtctatatacatattgttatataacttatatttgtattcaccttctttgttattatatttatagattttttttgtttggagaaactaatcatacaatgtggtgcaggtaacaatttgcgtttggattgcgtttcccatccctctcctcctcctcctcatcgttccatggcccctccaatttttgtaccgccttctacatcacacaaaggacaaggcccataaacaaaatcatacaagtaaccgagaagaagtgatcaaaatttcataccaaaaaaagaagtgatcaagattccatatagagaaaagagtattgtgtaagaagaagggtcaagatttttcttttattgggtcaagcttttacaagttgactattataaattatacaacttattgtgtcttatacaagttgaaccttttcagagcatgttggaattttaaatcatatattgtgaatatatatgaatatgttgtatatcttatataataaagtcattttagataaattgattattgtactctcttttccacaaattatagtattttaatcagaactatttttttgttattcgaactgaaaccggccagaaaaaaaaaaaaaaaaatttgacgaaattttcatatctaaaccaaattcaaaccgttctggtttattctgatcgaaccgaattcatgacctaacaacaaccataattaaaacatacatacaattcactaaccaaaattttgctacaccgtccctttcgtccgaagacactcacacgtccaaacatacatttacacatctcaagtcgagatttatttcaaactaaaccttttaaactattaaggagatccacaaccaaaagaaaaaagagagcaaagtgaaacaatttattttcgaattacataaacaaatcccaaaagttaatgccaaatgaagacattatactcaaccacggcatctatatttacaaccttataagtctttggcagtgcatatcctctagcaaacctgaaatcgccggtacctccgatgatcggcaactctctctcctccagcagtatcggattccgtccatacaacgcagcggtgctgccgttaaactctccttccgtgaacacaaagttaaagaccattgtaaaaccaaacgttttcatgtccgtcgatgcgtacaacccctgagctctccccacttccttcgagctcagctcaggtccctcagtcaccggggcgtcaacaataagaaccgcaccgaatacagtggcggaggagtttgttcccggggcttcagcgactctgatggtggtgggtttgtcaccggagatgatgtcatggaagtagaagtggaggtgtgtgagtttatccggcttatttccttgaaacggagtcgttttggagtaaggtttggattgtgttacggtgatggtaagaaggagaacagttgagaatatcaaaggaagtagaagaagcagaaaaggtgtagccatgttcgttatttgtaacatatgtgacttattgcatgaaagcacgaatttttgttggtttatataacatttttgtgtgtgtatgtatattgttttcagattggtgacaataacatatccgttgacgaggaaaactaggaagttagatttgtagacaactagatattcccacccctacgaatatatatgtaaatgataaggtgtaaacaaacaaacaaaaagaaaaaattggacaaacaacaaataaggaaaaatattagattttgtattgcgatgactttgctgaaatttgcaagaaattgttgtctatattgatgggattacagtaaatggttctagtgttcagtgttctctaatgatcttcgttttgtagaccatgaatgactaattaactagaataatacttccatgataattaaaatttgtattataaaagaaacatgtgttcgagaaataaagaccccatgcaaaaaaagaaactcaaatttgatttacaagtgatgatacaactgatacctcaatcgtacgtcatctccacaagtatacaaataaactcaaaactgccttatttgccccaaaagaaaaagtttaaatcctgcaattttctcaaaatcagttgtattattttgtatacaaccacaactatacatcaataagatcaatggttcgcataccaatgaatgacacaagtacaattacaactacaaccgttgcttaaatttgaccaacaagatgtgagttgttccaaaataacaaaaattaaatatgtactacgtatttagctcgagaaaaatgaggaaataaaacatttttatcatttaatttctaattttcctcctttatttccctttaaataattgaacgtaccggcaggggataattcaataaaataaaatacccgatgcctcaattctcacgcatattcactcgcgtcacgaccacagatccttggagctgaggctgcgtgagagacacgagcaaaaaaatgcgtcgagggtgttagataatg

SEQ ID NO: 6245 - DNA, 3000 bp, Unknown; identical to SEQ ID NO: 6231
  misc_feature (1)..( 3000): cDNA_ID_1813795_gDNA_ID_1621084_Annot_ID_55348 3000 nt of promoter + ATG

SEQ ID NO: 6246 - DNA, 3000 bp, Unknown
  misc_feature (1)..( 3000): cDNA_ID_2125352_gDNA_ID_1621084_Annot_ID_55349 3000 nt of promoter + ATG
ttctaaaacttttttcttgctgaccttatatactggccaggtacttccaatggttgattgaggaaagagactacactgacccgcagctgcatacatcgtatgctctctcacttgccagatcagcacttgagtgtgttgaagttcaaaatggtatccaagaagctgatgttccaaatggtagtgaggcacatgatagcaatgttggaagtatttctttgtttgaagttgacgtacgagaaagattgcaggcctttttgcagtcttcagatctatatgatcctgaagaaatcttggaattggtagaaggatcagaactgtggttggaaaaggtttgtctgtcaaatttgtttccttcgattttgaatggttcttaaaaagtgtcatttagatgtgtatgcgcacataggatgcttcatgattatgttggtgcaccgattttttattcaatggattttttactgtcaaaattatgtgtgtttgcccatttgtcatgtgtaatttttttttatttgataggcaatcctataccgaaggattgggaaggagacattggtcctccaaattcttgctctgtaagttgatttaaataccaagaagtgataaagaacaaaactgaattgtctatctgattgtgtgagcaaatatagtttattttattgtgaatttgaatgtggttactgataagatcttctctggttgggcgccaggaagcttgaggattgtgcagctgcagagcaatattgtgtagagattggaagaccagatgcatttatgcagtaggttcttttccttcatttcgttacttattgtgaatgccattgtatgatcttttttccttgtgaaatccctttaaacaaaaagtttatcttaggttgcttgatatgtacctggatcctcaaaatggtaaagaacctatgttcaaggctgctgttcgtctgctccacaaccacggggaatcccttgatcctttgcaagtattggacgtaagaaacccagtcctcctccatatgtgaaaaagacactgatattgcctcttatcctacagctttttcatttggtagttgtttgatgatagagctgatatctttttttatatgcagaaattgtctcctgatatgcccttaaaactggcatcagatacaattttgagaatgctgagggctcgggttcatcatcatcgtcaaggccaggtaaaaattcacaacccctaccaattgtgtgtttttagttgtcaaatttgccatgtgtaacagtaatatgtacatttaaatgctaagaagagataattattgaaagtagcatagataaacttatcaaaaagttgttactctgttaaaagtgccttcaatctgtatgtggtgtgggtatagctttagtgtctgaatgctctgaattcaattgttacagatcgtacacaatatctctcgtgcattggatgtagactcgaggttagcaagattagaagaaagatcacgtcacatgcagataaatgatgagagcctctgtgattcctgctatgcccgtctgggaactaaattatttgctatgtaccccgacgataccattgtctgttacaaggttagtcccccgcttacaatataattctgttgcatgctatatccaaattcattagggattaagtatatctttcttgcacggtttcttttctctgagggtatttttgttgttcctcttccttcttctcagtgttaccgacgcctgggtgaatcaaagtcagtaacaggccgcgacttcaaacgagatgttctgataaaacccggttggttagttaaccggtagcagaagaagcccatcttgttccgcatcaattggctttttttcacttgacctctaaccctcacaaacacagagttggtacagtacatacagcagctcacgcagtttcccttgctacaaataatgaagaacataaggatctccgttcgatcgccatagcttcatcaagctcgtctctagacttgtgtagagagattcgaatcggcaacatttcaaaagttcttcatcttactgtaaatggtggaaggcatcgtgtagttctataggcattttcgcctttgagacagttaaacatggacaaatgtaactatgggttcctctaataccttgttgtagtctcactttagcttatttatgtaatactttcttctcaagacgaaggactcgtttcgctaataattaaaaataataaattataaaaaccagaaaaacgagtaaaaaaagcagagaagaaaaatcaaacatacatacacacaagtctcgctaagagaaggtcttgggaagaagacgattcgtcgattcaggtttctgctatcatcttcctcttcgggacacagtttcccttttcctttcttcgtcggaatcgcttctcttcactcaccggttggagaaacagttaaattctgacaaaaaaaaatgtcgattaatatgagaacgctaacgcaagcactagccaaaacggctgcagtgattgagaagacggttcaaaccacagtccaggaggttacaggtcccaaacctctacaagactacgagcttctcgatcagatcggttccggtggtcctggtctcgcttggaagctttactccgccaaggcacgtgactccacgcggcctcagcagtatccaacagtttgcgtctgggtgcttgataagcgcgctttatctgaggctcgtgctagggcgggattatctaaagctgctgaagatgcgtttctcgatttgattcgtgctgattcggggaagcttgtgcggttgagacatcccggtgtggttcatgttgttcaggcgcttgatgagaataagaatgctatggctatggttacggagccgctcttcgcatccgtggctaatgcgcttgggaatgtggaaaatgttgataacgttcccaaagatcttaagtccatggtgcgttagaatttgagcaattgagtgagcaaatggaagatagtttactgtttcttataattgttgtaggagatg

SEQ ID NO: 6247 - DNA, 3000 bp, Unknown
  misc_feature (1)..( 3000): cDNA_ID_1813791_gDNA_ID_1621084_Annot_ID_55350 3000 nt of promoter + ATG
ttcttggtgggaatttggctgtaatgtgtgctgaggctcactttatcgagtacatttgattttctgaggctcattttccttttttttgtctagaaagcattttctcacttattattggtgcttaaatttgaaggacaaaaaagattcgaattatatatcaactattaacaataatggagcaatacatttaacgttgatacatgatactctgttggcgttttacaaatcctagagagtcaaaaccattatccaatcgctggcttgtttcctactttgcatctctcttctcatcatcatcaatatcctttatagcatcctgcaacacacggcaagtaaaagatatacatgagacagattcatttcactttacatcttttaagtttcaaccaaatgtgggacttttctgagcttatatgctacgaagctttgaaccagttggtttgatatcagaagtgggaggcaaatataacgcagaacagagaaagaaaagaagtaaacaagtatgagtttacctttgcaaggcttgtcacatatgttccagccaatgcagtaaccaacagacccaccccgagagttaaaagctggccgtttcctccaggcaagccaacattagattcttcttgctgaagcgacatagacagaagattgtcatttgatgattttatgatgcttgccagagtcaccatgtattcacaattcaacaggatatcagacacagtttctacaattcaagttaacttccataagttgactagcctccctcgtattgagtacatgtttaccattcgatatcgatctccttttcattaagtcaaaaacaaaacttttagctgatgattttagctagctttctaccctacacaagtgctgatcaacatgaacttattgtacaccataggcttgaaatgagagaagataggcatgtttttgtacagttcatttttttgtgtcaaagtgatatagagattagataaaaagacaacagaactcacaatgattgctcgtccaaaagccccggcgctgacataagcccaagagcctggaagcatacccaaccagctgcaaaaacagtatgatccatgaatgagtatgtaaactcagactatagcttatcaagttgaaatcttgttctcaaatgcaaaacaaattgaatcaactcctggtcaagattgcttgagagtaaacaccaagtggacattaagtgctgggaactaattgactactacaactcaagtatcaagcttctacagcggatatcatagggaaataagtataacaaagttgcaagaacacagaccttcctaatacataaggcacaaacttcacagacgtcaacccgtacaggtaattgccaagagagaaaggaagtagagggcttagccgaaggagagtaacaactctaaacccattttcaccaatcgctttatcaatggcgaggaacttcttgttgtcttcaactaacttaaggatgcgctctcgggcaaaatatctagcaattaagaaagcaacactagcagccatctaacacaggaaaaccaaaataacatatatcaacatgggaaggtcacttgatgagattaaggattgtgttcttgggaagaataaacttacagttccactgatagaaactatgatagtgccaatgagtggaccgaagagaagaccagccgacatcgtcaatgggagagctggaatggctagtatctaacacaaatgattcaaaaaacaaaaccttgaaactggggtcaatgaagagtataaaaaacatcaaaagcagatgaagaagtataaaaaagcttgcctcaagcccagcatagacggcaatgaataacgcatacccagccgtaccataacctgttgtttgattcatcaagaacacaaaactccatcaacttacttctatctaaatgcatcatcaatatctaaaggtctattctcactaagttctattagcttctatgtatcgaatcgttaccttcgatgtaagtggagaattgagtaaggaaagtattgatctgatccctgtagacatatccaacgccggcgaatccaccaacagtaccaatcaacaaaactccggctaagatagtacccttaatagcagcatcaccttccgatccgccatcatcatcgctctcagacttaacatcatcttcgtcgttttcatcattagtggatttagaattgaagaaccaccggagactctgaggaggcggagcggtagatgggagagactgttgcttcttcttcttggtttgctttagggaagagcatggtttaaggaaatggaatcgtttgtagagtctaaaggacgaagaaggaggaggaggagagcagaagcgggagttgcaggtgaatggaagagaagaggaggaggaggatctgagagtcagacctagagtgaggctgcgcattcttaagcagctttaatggagatgatgatgatgaagacgaagattggattgaagcagtgccatctcagtttgggcttttggattggcgcggctttgttcttgccaagtatcgtattttcggatgggcttctggcgatctagagcgccacgtgtctatctgttcttaggatcacgaaattaaaattagttttcttccagaaaaaactacaaatcaaaaattcaagaaaattgaatttatatcgcatattcgcatcaaatttttttgcaaccaattaattcagacaaaaaaacaaaatttttttagaaaataacattttaaggaacttgatttgtttagggcttaacttgaaaattaagtttttggcttcaaaaaacaaaaacaaatattataattgaacgatgctttaaacgacagcgtttagtgtttgttaagctgtaatggtaagtcaaaataactcgaacgtgtctgactctttactttaccggtaagcggcgacactgatcaccggagtttttcaatcgcggtctttcttctacttaaatccgatcactaccattgtacatcgtatatctggtttaggtcatg

SEQ ID NO: 6248 - DNA, 1291 bp, Unknown; identical to SEQ ID NO: 6238
  misc_feature (1)..( 1291): cDNA_ID_1019898_gDNA_ID_1621084_Annot_ID_55352 3000 nt of promoter + ATG

SEQ ID NO: 6249 - DNA, 3000 bp, Unknown
  misc_feature (1)..( 3000): cDNA_ID_1813895_gDNA_ID_1621085_Annot_ID_55355 3000 nt of promoter + ATG
aaattggaaaccacagttcagagaattacctgaagagtatgtagactgttgcgaaagcattctcgagaaaactctctgtgatcaatgagagaagaatccagtctctgtcttcttatacgaacatgatctgcaacaataagaagaaaaaaacaatgttaggtaaatatacaagtctttgatcgcttaactgtactcaaaattaaattcacgattacagatattgaaaccctaattcaaagaatcaaacacaaatattcgattaattggaagtaaaatcgagtaaatcaaaacaaaaaagatcgcaagatcttaaaagaaaagcgatttttgagaatttgaaaccctaaagagttaattcgatgaagaggattatataaatctttgtttaattttacccaaattgaagagagaaacgagagaaagaacttaaaggcgaatactaaccgaagagaaaaccatcaatctccgattagttatactcaaatcgagtacaacaagggaaagaacttgaaaatttgaaaccctaaacatcgattacagaaattactgactgaagagaacgataagtcatgataaatccagatgaaaccgaagatttgaacgaaaacttacagagcaaaattcaaaatcgccgatcaaagagtcgcagagaaagagaataatgaaaacctttttttttggcattataatagaaatctcagggaatttgatacgcttatatacgccacgtggcacattcctaacgttgtcgccaacgctaataacggctacattacgttttagaaacaaatgttttgatttttgcgtgttgtgattagtgaatgtggccacgtcataagcgttacatgtaaaatttgttaaatattaaattatagcatgccaaaaaagaacaacaaaaaaaatattaaggaaaaagcaaattacaaatacatcttttatgtaacacgatcacattatcattaaataaattaaaatattattattcaaaagtgaaacatgtggacacaaaattatttaccgaaattatttattcttcaaatcctaatcatcaaatagtatattttaatgtttgatgattctgattactaaccatctagaatatttgctaaagtttgtattccctctatttcataaaatttgatgttttacgttttgcacgaaaaagtaaattttttattttttaagtattattttgttagtttaataatattattgttatctcttccttttaatattggccacaaacaaaattaataattatacttttacaaaacattaatcttttgtggaacaagtaaaagaacccaaagcatcaaataatttggaagagagggaaaaattaacaacgtaacaaggtttttataagtcgtccattgttaagaaattgggctatagtctaaatatttttttaacaatgggtcttaaaagttaaaacataaaaaaaaatccaaaaattgtgatgagcttctgcaccgatgcccctttattctacccatttttggtctgggtctggtcttcacgtcggctcttggtacactgccactataaattccgaaagctgctcgtcgaatctctacattactgacatgtttggttagctatctgttcatcgtcttattcaccgggcagaatcattcaagctagctatctattcttgagaaaagctttcgaaaatattgtactgccacttcacctttagaaccttaagtaaattgttcgataccattgccattgtaagaaaggattttttattttttccggtttaacattggttttcattttaacttttaacggatcaaaatattaacagagaagtccgatagtgactgactgactgactgtgacgctttttgtttttagctaccgttaatgtttgttttccgttaacggcgtattttagtgtgcgtggacatatacgctcaagtacgccgcacgcttctcttctttttgtcgcgcattcaaaaaccgaaacgatcagaaaaaaaaaaaaagaatattaaataaacattttggactaaacaattaatttttttttaaaataatttctcgaaagagaaaaaaagagagagagagagagagatggagcttctacagtactaaaagctgagtgaatccgaagaaatctccgccaacggaatattttttttctgggagctgaaaatcgttggtgacgatggcggattctctttctagggtttacggaactctgtttagtggtgttaatatatctctcttctcggatccaccgttgaaaaccccctgaagagtgtttttttttccgggtttaaggtcttttacgtttcgttttttcttgagatttcgtcttccgctgtgagtttctgttctcgcggcgagtttttgtgtagatctgagggttttcaaggcaagagaaagtgtcggtgatgtcgattttctcactcgcgagctcttctggtaaattctcgtttatctattagcttcttatactgtctcttccaagtgtagtgatctcgatttttaaggaattttgaaattggaggaaaaaaagttgtgatgtttcggatttctaattttgtctatgggacctatgtgatatctagttactttgtttctttatctgttaggtcactctgattttggttagtgaatatcaagtcacaatatagatttggaatgtagtttggatttgaacttatcgtgctcaagatttttaggtttatagtttctaaatatatggtacatgatctttagctctggacctatatgttagattatccaggctcaaaaaggcaaagtatgttggaagtgatttgggttttggaccatgtctttgtatattttcatgaatatagaatagtaggttgaattcattaggttgcttaaagacattctttcaaaattactcccgaatggttgcaatacctaatcacatggctagctttagttctgttcttgtcttagctctatctcactgtttttaacgatataacaatcccagattcacaaagagatgacctaata

SEQ ID NO: 6250 - DNA, 3000 bp, Unknown
  misc_feature (1)..( 3000): cDNA_ID_1813891_gDNA_ID_1621085_Annot_ID_55356 3000 nt of promoter + ATG
tagttggaacatgttcttgaacgaatttgctacccagcttggtctcctacctcaccaaatcgagctgattaacttctatgtgctaagcttatcaaggatgaacatatcgatggatatcacccctcattctggaattagtttctcagctagtcaggcatccgcaataaactcttcccttatcagccacaagattcaatttagccctactttggtgggagattacaaacttctaaaccttacttggtttgaggcccctgcaccttcgcaaggtaaagtacttttctacaattgtatctgggaaagaattcaatcgccccatcaattctgcacatttgatttcacatctgcggtcaaagtttcatcacattcaagatagcatagccgaaagaaagtagactgatatagttttttatgttaaaaaagcatctcccagtttgatgctttttggagtatatcaccatgattccttgcatttgcactaagataggtcttaatatgtttgcagcacctctagtggcttcttcacctcataaagcaccatcacaaggatcctcagcaactacgtcagtaagatctccagggaaaaagaggcatcccaatcttattcttatcttttctatagccgctggtgtgcttatacttgccataatcactgtacttgttatttgttcccgcgcactccgagaagagaaagctccagatcctcacaaagaagctggtatgtacctcttctgattacaaggtttaaattataggccgatctcagttaggaatacgtgaatcatgtcaaaaggtacacatcatgtgagcagcacattgggaagttagcatagatgttgggataatgtcaacttttatattgggtttaaagttgtgttgttagttgtcaacagaccttatgtaaaaagccaacagaccttaggaatcaaacaaaaggattgagaaaaatggggatacatagatgatgaatgattgctgtccacttaccagtgtgatttatgttactttcctaaatcctggcaattaacttttagttcttgttcttagtaaaaacttgatcgcatattcctttctttcagtaaaaccaaggaacctggacgctggttcatttgggggatctcttcctcacccagcaagtacacggtttctgtcatatgaagaactcaaagaggcaactagcaattttgaatctgctagcattctaggagaaggtgggtttggcaaggtttacagaggcatcttagccgatggtactgctgtagcgattaagaagctcacaagtggtgggccacaaggtgataaagaattccaggtggagattgatatgcttagccgtcttcatcatcgtaatcttgtgaaacttgtgggttactatagtagtcgagattcttctcagcacctactttgttatgagcttgttccaaatggcagcctcgaggcttggctccatggtaatatctcctctttgcttcccttgctgcctatttttagatctgacattgtcaaaagtagttattgtacactgagttcatctacaagagtggtttatttaagtcattgtttatgcttcagggcctctcgggttgaactgtcctcttgattgggacaccagaatgaagattgcacttgatgctgcaagaggacttgcataccttcatgaagactcgcaaccctccgttatacacagagattttaaagcctctaatatactccttgaaaacaacttcaacgccaaagttgcagattttggcctagccaaacaagctcctgaaggcaggggtaatcacttatctactcgtgttatgggcacatttgggtgagttgctcatatctctcgacagttttcatatacaaccttaaattctgagttgcctattgaatccgcgatctgttttcagatatgttgcgcctgaatatgcaatgacgggacacctactcgtcaagagtgatgtttatagttacggtgtggtccttctcgaattgttaactggtagaaaacctgtggatatgtcacaaccttcaggccaagaaaatctcgtcacttgggtaagtagaaagttcttgtcatctcctagatcttcctgcactttcattgtcgaaaacttaagcttttgaagtctcgaatgtaaaaatttgattctggatgcagacaaggccagttttaagagacaaagaccggttagaagaactagtcgattcaagacttgaaggaaaatacccgaaagaagatttcataagagtatgcacaatcgctgcagcttgtgttgcacctgaagctagccagagaccaacgatgggcgaagtggttcagtcacttaaaatggttcaacgggtggttgagtatcaagacccggttttaaacacttcaaataaagctcgtcctaaccggagacaatcatcagctacgttcgagtcagaagtaacctcttctatgttctcttctggtccttattctggtctaagcgcttttgatcatgaaaatattacacgaacaactgttttctcagaagatcttcacgaaggccgatgatagaagccagggttttcttctttttatttgtttttctcccacttacggtgagaaaatttccaccagagaagcttttgagtttgggacattattacagctctttggattttggattctcctttattggaggatagaattttgtatatatttttgcgttaattaattaatatttgccacaaccatcagatatacaaatagaatttgaatatactttttccaatataaaaaaactatgtacaggtgattagtttgtactgttaatttttaaaggctttttacagtaaaagtttttacagctaaaagtaacagtataatactttttttttatggaataatctaaataaaatataatctgttgaaaaactaatattttaaatataatttttatggtatcaaaccaatatttaaagtaattcctttcttattagttaaaatcacagtttttattattattatttttgatagtggtt

SEQ ID NO: 6251 - DNA, 3000 bp, Unknown
  misc_feature (1)..( 3000): cDNA_ID_1813887_gDNA_ID_1621085_Annot_ID_55357 3000 nt of promoter + ATG
caataaagtaaacagagactcagaagctgatgcaaaagaagtaggtgagcctattccagacaattcggtccatgatggtggttcctcaatttgtcagccacaccatggtagtggaaacggagcaataatcattgcagaaatgtctgagacaagtcgaccatctacagagtggaatcctatcgagaaggatctttacttgaagggagtcgaaatctttggaagaaacaggtaaactggatcttggtaaattattatctttaaacacagaacacctataacgtatttacatctagtatgttttgtccgtgctatctcagctgtcttattgcaagaaacctgctttctggcttgaagacatgcctagatgtgtccaattacatgcgtgaaaacgaagtttcagtttttcgaagatctagtaccccaaatttgctgttggatgatggcaggactgacccagggaatgatgtaagctcttgatcttcctagggtcttttgtcttttcaaattttctgcagtatctgcgactttgggcattgttgtattgaaagttagcttgtcagactgatagggttagagatctattccagaagaaaaaagttctgatccggaaaagccaatttccttgcttaatttttccctgatacctgcattggacaagagaaaacgatagttgaccataagttggcttagacaagtgattattttatttgagattttattgatattagcatgccatgtctgtcagaatcatattttggtttaccgctctcttactttacttgacagaatgatgaggtgcctccaaggacaagattgttccgtagaaaaggcaaaacccggaagctaaaatactctacaaagtctgctggtcatccgtctgtctggaaaagaatagctggtggcaaaaaccagtcctgtaaacaatacacgccgtgtggatgcctgtcaatgtgcggaaaggattgcccttgtctaactaatgaaacttgctgcgagaaatattgcgggtatgcaaacaaattaacgtcaattgaagtaacagaggatcttcttataaccatccattgatttaattcaggtgctcaaaaagctgtaaaaatcgtttccgaggatgtcattgtgcaaagagtcaatgcagaagtaggcagtgtccctgctttgctgctggcagagaatgtgatccagatgtttgcagaaattgctgggttaggtagtcattttaaatctagatctcttgatgtgccatatacaatcaaatctactatttgatgagtaacttaagatgccttgcttattcactcagttgtggagatggttctctcggtgaagcaccaagacgcggagaagggcaatgcggaaacatgagacttctcctgaggcaacaacagagggtataatactgtcatcaaatcatgtatttactaaaaataaaatgcattcattgttgataaatctagtttctcatgtgctatatttaccagatcctattgggaaagtctgatgttgctggatggggtgcttttctaaaggtaaagcatgtgaatatcttcctcattaacttctgtttcatacctcttgtatgtaatctgaacctcatctgatcatcagaactcggtcagcaaaaatgaataccttggagaatacaccggtgaattgatctcacaccatgaggcggataagcgtgggaaaatatatgaccgggcaaattcgtccttcctctttgacttgaatgatcaggtgaccaaatctctcacccttctttctgatagtttcctcttgaatttcgcatatgtcagtaagcttttgatatttgcagtacgtcctcgatgctcaacgcaaaggtgacaagctgaaatttgccaatcactcagctaaacccaattgctacgctaaggtactaaatgcttctctctcatatccattttggtatgaaaaaaccacatgatcggttagtaattataccttctttctcacctctagccactcaaaagttccatttagaaggaggactaggattataacattttgtagaaactaatcgcaattagcactatagaaaacagatgatcaaatctagctttgtaggttatgatcaaaacacacttgtttctacaatctttatgattgtaatgtgtaaagtaacatgtgtatatcatctgctagatttattcaacccttttcgaaaggtgttaattatttacaaaaaagagcgattttcagtctattgtcgtagtaaccatggtctcatcgcttcccgcataagtacggtgtctttttctgtgtggtgtaggtgatgtttgtagcaggagatcacagggtcgggatttttgcaaacgaacgaatagaagctagcgaagagcttttctatgactatagatatggaccagaccaagcaccagtgtgggctcgcaaacctgaaggctccaagaaagatgattcagccattactcatcgtagagccagaaagcaccaatctcattgatgattactggctaagagaagtaacttttataaaaataacttatagagttgtgagagatgatatttgaagtttgataacttaagcttgtctttattaattaattattatagagttgagattttattttattttgacatcgagtttggactttgtataggtgataaaacaatttatgaattattggggtcaataagtaaaaatgtatcatttcgaaaaatagtttcaaatttatggatttttgaacagctaaagccaatctatgtacttttcaacgaataaaactgatttaaaataagtgaacgaaccaatcacactaaaccagtgcctaatctcataaaaagtaatccgactgctaaaccgtattccggttcgaatcggatacggatccgtttcccagttgattagtcggatccagtttcttcttgctttttcaattcacattacgaatctccgacgccaaaattctgcttccggtaacagatattttcgtcgtcgagaagaagcaggagtttagaaaa

SEQ ID NO: 6252 - DNA, 3000 bp, Unknown
  misc_feature (1)..( 3000): cDNA_ID_1813879_gDNA_ID_1621085_Annot_ID_55359 3000 nt of promoter + ATG
gaaaaatccctgagaactcaacaacatcacctggtgatacctacaagggtttaaggaaatttagtaagaatttcacaattgtacgatagtaaatgacgctgatatcacaatatctacagatagagtcccagtacaacattggaaaaaaaaatcctcttaatcaacaactgttcagcatatgcttttaagccgaacaacaacttctcattggactattcctaagcaaccgagctattgattccgaaagtagaacaaatagactccaatagtagcatgagactgaggtcaagaaaaggtacctttcttgtcaactctcctcttagatgaacagtcatagacctcggaatatgccctttgggaacatgttcagccaactcttgcatcttggcctgcaagacaatgattttttactcattagtttgatatcagtgcattcacataaatggcactcattgaccagaaacagaacctcctgaaactttagaaactttgatgctctgagctgaagaataggattcccggctttactattaagacgacagcgactagaaggacacttaaacaaaggcatgaagactctagatgtaacttcctgatttgacatgtaaaagaaaataatcagagttagtagttaacaaaataaaaaagaaactacaatctggcaaaagcatagttgtacctggtaaatctcatgaccacaatcttcacatgtgtaaacagcaaccgccatcaatggcttgacatcggaacaacgggtcacaataccagatatcctaacaagttgcccaatgtgtgaagccttaacctccctgatggtagatggccttccctttgaaggagctttaaaataaacctcactgaataaaagtaaattcattagcaaactattgtaaaactcattccctaaagcttatgtccagcaaatagactcagacaaaacttactaatatcttttaatctcagaaggaatctgctgatgaggatcagaaacatctggattatcagtcccatcatctgctctctgagtcatgagaatatcatgatcatcatctggaaacgcttccgttggttcgggtaacaactcgtcaacagcggcggagaaaattgaaacatatcggcgagtgttttccgtcaaccgtccgagaaactcctcactttcatctttatactacacaatatcaaaagagatgagtggcttctacaatagcaacatccaaaacagaaacaacattagagagaaacaaaaaaaaactcacattgaataagtcatcgagatcgacttgaatagctcgaatcttacgatttgaaacctcttgctacacaaattcataaaatagaacataaaaccctaaaattagggagattcgcgaaaaccctagaagagagaaattggtggaagatattggaaatgagacttacgagaatctccatgtacttagatctgccattagcgtcggcgaaattctcgagaaatcccttggcaagccctatatacaagaagaaaaaaagtgagaatcaaaactcagcgaaaaaagagggaaaagattatcgagaacggagaagaagagagaatgtaacctttgtcgccgtcgaaatcgtggtctttcatggtttcaaaacttgggtcgagagagagagtggaagaggaagaagagaaaggaatgaaccagtgactgcaaaattgggcggtaaaagggttgtagatgacgatgagtttaggcgggaaaagtattatagagagaaatggcggggagtaaaatgaacggtccagatctaatgatcacgtgattaatgtaatgtcgaaactacccctgctggaaataaaaaagaagaggtaacaaaaagtgtggctgccgggattcgagcccgggtccccacggccacaacgtgggatactaaccgctatactacaaccacttttgtgttatttctttcccttagtatttaattaaccaaagatttaataatattatcatctgtttccaaaaaatgggtgacaaatgtggatacaataatgtcatcttcatcatcctccttacgttgaaaactagtgtgatttcttcttacacttgtcttaaatccatagctactatcgaaatttgtgtgtgtgaatttaaagcttttgatttttttttttgttgttgtatatttagtctctctgtattcgactttgatcaaaacttggtcaacatcatctttaacatcgccttcatagtaggcgatcaaaaaatccatggaataaatagcacacacaagtctgaatcatttcccagtctacaacaaatcgttacatcttccttcttctttctcctgtaagtcctcttcttttttttttaatctgttttctttcaacctatgacgaaaatcatcacacttgtcttgattcttcactttctgtctgaaaccaacttttttttttttttttactaggaaggattttgatttcttttttttccgaggtgttacttgttagaacgggataagatcgtaatctttttttttattatgaagatgacatttgaccaaaaaagtataaaacctctttttgtatttgttttcttatatagcattagtatattctgacaatattccaacgagcattgatgatttttgtggaaatagagatcaaagtaggaggaagacatgcaaaatcagtattaaatttttaatttgttatgtgaagataaggtcaagaaaatgacgtatttacttgttggaacttaattccaaacaattatgtaccaaacacgaatccatacgcaattatcacaaatctcaaagtggcaaaacttcacatttaaaattttcccaaaacctaaccaaattgaaatctatctaaccacgtgaagatgtaaatgtgtataaccctttttgtttcgttgtctctcagattctggaatttgagtaaaagcaagaaaaaaagtcaaccgttgcaacaaactcttaaaaagaagcaaagtagtagcagaagaagaagaagaagaagaagaaaagaaaatg

SEQ ID NO: 6253 - DNA, 3000 bp, Unknown
  misc_feature (1)..( 3000): cDNA_ID_1813875_gDNA_ID_1621085_Annot_ID_55361 3000 nt of promoter + ATG
ctcagggatttttcttcccattccttacactgggtttaaggcacttcgagctggcttagtagcagacacctatctggaagcaacgtctgttactcatttcaagaagaaatatgaggagtaaggcgttgttacacctttacactaacgaaacattctgatttagtaacctattccatgtttttctgcatttgcttaagatacaaagcagctttcgtgtgtgcacaatatcagaaagcatctttatacctttttcattatgatctacagatatgagtttcagaaagatgaggaagaacagattgcacgtttggctgaggatggtgacatatacaataagctgtcgcgatccctggcccctgagatttatggacatgaagatattaagaaagctttgcttctccttcttgtgggtgctcctcacaggcaattaaaggatggaatgaaggtgaactttcctgtcctctgatttattctggcaaaatttccatgatattgctatctattatgataaagagtaaagactgtacactgattagaaagcagttgcttgctttagttcatctccgactatattgttttacctatttccatacagtgtccgcagtcttcattgattgagttatggagctttattatttacaaacatgttcagtcattcaagagcacattgcacttgattggaacacattttatctgtgaagatttaaaaacaatacattcattaattatcttttgcagattagaggagatgtgcatatctgtctgatgggtgatcctggagttgccaagagtcagcttctcaagcacattataaatgttgctccaaggggagtctacacaacaggcaaaggtagcagtggagttggtctaactgccgctgttatgagagatcaagtaacaaatgagatggttttagaaggaggagcactggtgagagacaatgcccttttgctttggatatattttagaaaatatgatgtaagagctatgtgatttagaagtttgatacaatctctatctcaggtgctggctgacatgggaatctgtgcaattgatgagtttgataagatggatgaatcagatcgtactgctattcatgaggtcatggagcagcaaactgtaagcattgcaaaagctgggattaccacgtctttgaatgctcgaacagctgttcttgctgcagccaatccagcctggtaagtgaactctcatgatatgaattaaaaactcatgaatgttgagtgatcattgctatcattattgaactatgtatctttgtgtttatgaaggggaagatatgatttgcgaagaactccagctgaaaacattaatcttccaccggcccttctttcaagattcgatctgctgtggttgatcttagatcgagctgacatggacagtgaccttgaattggcaaagcatgtgcttcacgtacatcagacagaagaatctcctgcgcttggtttcgagcctctggaacccaacattctccggtaagttaaatcgcttttacagcattcttgttctgcaaagtcagaaactttaacatgagcatatttggttctctagtgcatacatttcagctgcaaggagattatcaccatacgtcccagcagagttggaggaatatatagcaactgcttattccagcatcaggcaagaagaagcgaaatcaaatactcctcattcttacacaacagtgaggacactgctcagcattctgcgcatatccgctgtaagtagaatttgtgtaggaacttgagtaaattagttggactattgagtgttaatatatttccgatttgttctataggcattagcaaggttgagattttcagaatcagtggcacagagtgatgtggatgaggcgcttagactaatgcagatgtcgaaaatatcattgtatgctgatgaccgacaaaaagcaggactagatgcaatatcagacacatactcaatcataagagacgaagctgcaagatcaaaaaagacccatgtgagctacgcaaatgccctgaactggatctccagaaaggttagtttcttccttcatcttcatcttcatgttctttctgaaaatggatgatcactgagacgagagatttggggtgtgaaaacagggatacagtgaggctcagctaaaggagtgtttggaggaatatgcagctttgaatgtttggcagattgatcctcacacctttgacatccgttttatctgagtaacaccacccaaaaaaaaaaaatggaaacaaaccaagtctctcttgttatgttgtgtgctttatctctattatcttatcacatttcttaacgtagagaccttagaagtggaatctatagaagtgatctcttgattgcagaacaaactttacttttggaaatttagatgtgactttgtactcttgcagttcttttcactctcgcaaatttactacggttttgatctaggtttgattaaaacacttcttagtctaattttgtatccatgtcagtaatatactttcagtttggtataatttgatttcattattacaatcataaaatattgtaagtaccatgctaacatattttcaaaaaaattctaaaagtggaattttgggatttttatgacaattttggaaaacagaacaattttcggtttagtaacataacagatcggttctggatcggtttaagaattaatgggccatattattatacttttaagcccattaatacagagcaaagcccatttacgtcgttgcaatatctcactcactccataagcttttaacggcatgaataattcgattttcgagatggcacagagagagagcgagtattattactagagcgttgtttcccgccaattagcaactttcgccggcgtattttcccggtgaaaaattcccgcgcaatctcttcactccataataagcttctctcatcaatctcgctctcttcgccgactgtttcactccccttctctctcactctctgtgcgctttattccactctccg

SEQ ID NO: 6254 - DNA, 3000 bp, Unknown
  misc_feature (1)..( 3000): cDNA_ID_1808549_gDNA_ID_1621085_Annot_ID_55362 3000 nt of promoter + ATG
ttaataagattctgcttacatatatcttttgattggatgatgtctattggatatgcatataactgcaagaatagttatataaaaaaaacttcaaatcactatggtcttatatctaaaactcaattaccctaaaaaataataatacattaggttagctttcatatcacaaaaactttttaacttgtcatttcttgcccttctcttagtattgcatttttgtatttggattaattacgtcaaaccataggattgactagttcagcaacaaactaaatacacacatcataataaatgccatcaaatttcaatatcttcttggaattgtcgatttatacattctggccttagaaagttcattttgtcaactagtatcttaactaatcatatcaataatacgaaagaaaaaaacacttaataaaatactaagatacaatctcacaaagaggcaagaaccaaactcaacagtggatgaaaaaaaactccaaccacaaaaataagcgataatattctgattttcaagccttaaatatgtgataaactgaaatttaaactcgatttagctaacaacataaaaaaaagtttaggtaacctgatagtgactatttatcattatttttttgtggacacagaaaatttatcatgtaactcatattatataacaaaatgattgtgcaatatgtgaaactggaacgaatttgaatatgaagcctaataaggctcacgaattctatgattgctttatcaacggtcgcctgatcagctggtgagtacaccagaaatttaaactcgtgggtcctatttttatttttaaaaataatcagtataccaaaccaaaaaacccattacaaaatcttatgattattagtgttcctgaaatttcatgtttattcttgaaaaaaagtgagaccataaatgcaaatgaaaattgacccatactgaatatacgttttattatcattattttagcaaaacacatatttttcaaagaatcaaggtcaagtttccatattagattatacttctccatactctgatgttttctatttaaaacgaagacaacaaggtatatcatctgatcatcaacatgacaacatatcacgacaatagacaattatcttcatttgttataatattagttatgtaattattgtattgcataattattagcttcttttgtttccatacacttagacgctgacatttgtgcttatctcatttttttggcgaccttatctttctacgttctatttttgttggggttcaagtttcaacgactaaaaggaatcaattaaaacaaatattttgatatttaactcactctatttcaaaattcgccgactaatcattttcaggtagattcttgtaaatatcattatacacataattgatttgttcaattttaaacgaatataatataaattgtgccggcataaaatataaatattgcggttaaaaaaaaaaaaactttgccatgaaaatatgaagaggtattcgcgtaattgtgtaaatagatttgattaaattcgtcacaaaaaaaaaccgtggcagaaaagtataataagatagggcgattgacacaaatagcactaaaaaactttattattccaaaaatggcatctttttttgaaacttccaaaaatagtatataaaaattttaatcctctataaattaattcaataataaagtttttttattaccatttgtatcaatctcccaaataaaaatgagagcaaacactaatctaatattaaattgaattaaaaacttttaaatagtggaaatatataccctaaattggaaataaaaaacccaaatataatattacaaactaattttaaaataaaaaatctcttttaaatggtgaaaatatataccctaaattggaaataggaaacccaaatataataccataaacttatattaaaatgaatcaatatttcttttaaatagttgaaatatataccctatattggaaatagaaaactcaaatataatatttaaatttatttctaatttattttggttgaatagattttatataaacttgtggtattattattgtccataaaacttgttttagtgttacttttaagaatttttcaaataatcatttgagtgctaattatgtgtaaacaactttttaatgctatttttgtccaaaaaacttaaaaatgtgctatttgtgggaatttttcaataagatataaatttaaaactgagttgattaattaaaagtgtcacacaaaaaaaagtttaatgtgaacaacaacattaattcttttttaaaaaattttgttttatactattattctattaacatgttaattaatataactagaaaaaaaaatcaatctactaaaactaggttttttagcattttataaatatttgtatgagaactttctctaattcagttcatccagttaaccattgttcgcttattctgcaattcatttatttatctgatataccagttaaccttaaatgttgtgtaatcagtcgtaaaattgttttgtgtaatgttacataaattaatagaatcaaatttaaaatgtgttctaattatgctatgacgttataaacaaacgataaattccgattcatgattatgaagtatttcaattgaaaacacaaaaatcgacaaaattttaaaaatattttagatcttacattacatacctgtattgtcgcaaaggaaaatttatttcttgtcctaaaaggccatttggaacttgagctaatgtaaatatataaatgggcttattgggtcctctaatgggcttgcctttgacgtagaagacagaagcatcgttgtgactcccgtttgtgatttaggaatccgcactgcttgccgttttccgtttctactttacttttcaattcagaaacgcctctctcgtcgtcttcaaagctaaattagaaacctgacgatctctctctctctctctctctcgatcggataatatttgagctttgtggttggaggatctgagttagtc

SEQ ID NO: 6255 - DNA, 3000 bp, Unknown
  misc_feature (1)..( 3000): cDNA_ID_3593647_gDNA_ID_1621085_Annot_ID_55365 3000 nt of promoter + ATG
gtttgtttcttctttattcttcactatgcctaaacgacaaaacccaaaataaaaagtgaaccataatattatgaaatatttacatcactattcacatttgtgaaatatttatatcaaataataagcggtgtaatcattcgaaaattttgtatttctaatagtttctgttagttaaaaagcaagtattgtttctcaagtaaaagttttactgtctataatatggtttcacatgatctttgcagatatgaaataaagaaatgtgtagatgtaatgttgttttccttatgaaaatatccttaaagttaatctttttggttacaagtggaatactttatgaaggaatgcaaattataaaatactgttgagaagtgagactggtgaggaaattgtagagatcacaacatgtttgattgattgtctcctctttttgctcctatgaattgttttaaaaatcattttgataactaagaaattctgtattgaggtctatacatctttttaagattggatcaatatagaataattatatgtagcaacagcattcactcgatcatgtgaatttgtagatgactacaaaatacattttcagtcgaggtatcaacttctattagagaaaagtcaattgagaaaagaactacttacaatttgatcatttgttatataagctatcaatcactcaacaaactaattataaaatcgactataataaaattattattaaattatattgattttccttagcagaaaatactaatctttcaattagtctaaaaatttgttttaacatttatgttattgccaaatgaacgccatgacaaacaaacgggtctccttacaaacatacatagctaaattacaaaaatattaaatttggttaataatttttttttgtgtcaattaaaattttgttttaaaaatttgtaagtaaaaccatttgctataacaagaatttatagcttgattctggtgggttgtgttatcatcatactatttcacgtactatttcatcttgtcgactggaaaataatcgttagccgggatctacatgattcaagatattaagaaatagccaattgaaaacgcagtcatctcaagacccactaatttttgatggttaggagaaaagtttaaagatgtttttttgttgtaaattaatgattgtgtaactaataaattttcagacaacaggttacatcagaaattaaattatgagaaggaaaggttaaaaaattctaaggaaagaattgacagaagtccaatcaaatgcacataaaacgaagaaactagcaaaggacaaaagtttcttcactttggacatgacatatcgaaaggtacgtgaatgtataatatatagtttattacgataataataatactgctgcccataacgttgattcactttctcattggttagtgtttttgtcttctcttcttcactttgataacgcggttaaacctttattttgtgtaatgtctttgcatgccacaaatcagacagcacattggtaaatgagggtttgtcgattttaccaaggtaaaaagtatagaaagaacagtaggctaggcatgttcaatcagtttagcttaaatcaggtgggactaaaatgaaagcaaaattctaaatcgagttcgttcggttatgcagctgtcgacctttcaccaacaataaattcatcatgcaaatcatcaaaaaccacgatcggcttcgagaatgaagaagaaagcgatcaaaaatgtatttggagatcaaaaacatcacctaatagatcgaaagggctcgacggtggagccaataaagccagccgttgagaagacaaagggatttagaagtatatagttcatacacaaatcatgcctaccgcacttacgttgggttaggttagcatcaaagctcttactgtttaattatatacatgatcaaatattacttcaagaaaatcgatggataattttgaatttaaaatagtttgatgattattcagattgaaaattgtctcgtgcgtatgtcacttggtcgcttgtgttattggtagttccaaccaaatatttatgtatagcacaatcgatgtcttaagttttctatatgttttcgaagctcatcaaccatgaccccgtcaagcgactagtctattatactattgtagaggattattcgtcgataaaagttaagaaaaacctagcctctttatgatgaaaagaaatcgaaaagctcaatcatgtgactgcgttttgcgctacgggagtatatatagagattttgatattgttatatcactgttgcggtgcggttttagatgcagtatatatcaccattcatggctttagtttctcgatatttgtattttaagttatatttactaacgaaaaagaaaacaattaatttaagaatatgagtcaaacgtgcaattgagattttctaattcattcacaaattcatcatatcatttactatattttagatttttcttaacagaaattttataacaaaaccatattaaatgtaacgtaaataattgagtcattttgaaacgtaacgtattattatattctcgaagtcattttgtgagaagactatacgctatgacgctcgctcatggtcaaagttgggttttgcttccgatattgggtcgaaccgaatataaccaaaccaattacaatcttagtatggctcaatttgagtaaaaccaaaccagttttgtttttctacaaatggtggtggaatattgtgatggtgccacgtggatttggttagcccgccataccgcttcatcttaaaaaattagaaaatcaaaagttttcattttttcaatttcccccgcttccttcaaatcttccccgagacgctctctaaatcccaattttattaatttgttcgtcttcttcttcttctgattcaaagtcaattacagttaaaatctgggtttttcttttgatttcaaatccaagtatcgatcttcgattcctccaccctaataaaaccctaatttttcaaaaaaaaaa

SEQ ID NO: 6256 - DNA, 3000 bp, Unknown
  misc_feature (1)..( 3000): cDNA_ID_1813843_gDNA_ID_1621085_Annot_ID_170516 3000 nt of promoter + ATG
ttgacgaatacttaccttgaacaaaagcagagactttacaaggatgagtcatattcagcattttctccagggactaggaaatacttacagtctctaatcgatgagccgttgtctactaatcatacatctaaaagtgttctggacccattattatcatttatatacaatccgccgtcaccaaagaagtccaagcttgtacaacctgattcatctagtgaagcaagcatggaagacaatagcttaataagggattcaacagaaaagtaagtaattctttgacattttcttgattctgcttgctttatctcatcttcttaaaccttgtctaaagatacatttcgtatttctgtgtgctcagagactgggaatcgccgtctcccttgtcagatacagagctactagagaaggcaaagaagagagagtttgtacaaggtttaatatcatcagccatatttgatcacatttacaacttctaagagcataagtctttgtatatgaaactctcgcaaagtagtctgtactctgtagtataagccaatgagcttctgtttatcgtcaaacttctactttgcttctttacagctcataatcctcaagtcacttgaggtcggagtttccttaacaaccacttcttgcgtagtttcacatctagagccaagaaagttttcgccttgagtttatcttcaagcagatcacaagcatccaatataagttcatcgtccatgtctggtaacgcttgaatagcctcaaccgtgtcctctattgacatggtttgggtttcatcaactcgaggctttttcgggtttatagggcttgtatcagtattagcaagttgatctcttttgttcttggggtcaaacaaaagagagttgctatcttcttcctcagctgaaatagacaaatctgtagtaccactggacttaaattcttggaattcagtttcagggtcaaaccaatccatagctacaaagcattcgttttcttcgatcccagaatcgccacagagcacacacagatctttatagtacggaattggccgagtcataaattgccttgcatctctatgagcctgtgattaattcagacaagaacacacatcaaaacagagacgaaaacactgtaactaaccacacagcatagatcagagcgattaagttacctttatatagtcttgccatacattattatcagctgtaaccatttgacgctcattatcccaagcaaacccatctgatcgaagaatactcttgatcgcgttgaactgtcttctcagagacttataccggttcttcaacacatcaacatcaaagttagactcaaatttcgcattgaagagattaaccatctcagtccatgcttgtttcctgaaaacaccttcaatctggtttcctctcctcgcttggtccaacatcagatcaatgaaataccggtccattggaggatgccaagtagtcctgcaccgtgtgacactgcttccttttgagttagacctgactgttgacgattcacatattctgttgtacccatcatcttcctgaatcagtgtcttggattctccctcactaatactctcctcagctgaaacatacatattcattcacaggttacttaagaatctttgatctttggtgacaagaatgtacaatgaaggattcaagtaacaatcaatagattaaagattgtacctttgtgctcagacattccatctgagtaaaccaagcacagatctttgtaacaaggtatagactttatccgaaaagatctcgaatcaggatgaatcttcaataacccaaaagcaaaaacaaatcaatccctgagaagaagacacaaaatcacaagtaaacaaaacgcaaaacgcaccttaagatactcatcccaaacgcagttatcagcaacaaccatctgtctagtatcatcccaactaaaaccatcttctatcaaaagattattcacagatttaaacaagttcctcaatgtcttatgcctgtttttcaaaacatctttgccataaagaaacttgaacttggcagtgaaggaacaagacatgaacttccaagctcgtttactaaacaaatgatcttcaaatctgttgccttttctaacttgttccaccataagctcgatgaaatactgatccatttcaggtgtccacactgttcttaatctctcattgccgtttctactgctcattatctatttctcccttcttctttacctgcaaaaaaatcgattgcaagaacacaaatttgaaatcgagaaatcaagttataaaatcagaaatcagattctcgtaagaaactggatcagacccataatagagattcgactaaattagctaaagagcagagaatcttcgcttacagagagtcagagctccggtgaacgggagttggagtaccggtgagattttaaggataaggttgtccgggataaggttatacttttattcgtaaccaatttagaaacctttatgggcttatattactttattgggcttagtctattataggcctatgttaaacgacatcgtctattctagggtttgtttttgggccagagtgacgtttgttttcctttcgtcgtcgtcgtcgtcgtcgtcttcgtcttcgtcttcgtgaaagatgtttacaaaattttgctgtttaaattgatagaagaagattcgacctttaaaggctatctgaagaacatctccatcatcgcctggtgttgtaagtttcttttggattttgattcttgttgatactgactagtgagctcatttttaacatttgttcgtaccaattctgggatttgtaattagctgagtattgagctctaaatcttgaaaaattagtgagtttagtattttgcgaaagacccattaacagattatgatttgtgcgttgtttcttgccaaatacttttgagaggtttatgaaacagagtaaaaccctagaattcaattcctttgctctgttatgcagtcttcatttcatcaaattcaacacagaagattcg

SEQ ID NO: 6257 - DNA, 3000 bp, Unknown
  misc_feature (1)..( 3000): cDNA_ID_1810073_gDNA_ID_1621085_Annot_ID_170514 3000 nt of promoter + ATG
aaatagaggatcctaagttgtctgactgtatagttgaacccagacaaactcttccttgtaacttaagctcgagtcacacgagttctcacaagtgtacaccacgattgttgcccaatcgagagattccctctcgttcttcccaccgaagaagaacagtagctgcggcatcacctgataaaaccgccatcgaaatgatcaagaacagagccaagcttccaatatgcaagaacagagaaatgaaatggggaaaattgtgtgttttattggtttaaagttgatttgattcagctaaaattgttggccaattcttgactggtttataaaataagcaaaagaagtgactaagaccaagctaatacaagtttataaagaagagaagaaagaattacctgaaattcaaaacaacgaggaccaccacaagatttgcaactgggaagctcagatttagagactcgtccgcttgctattggccaaaggggtttagcaccagagctccgggaatatctgtatcaatacgtatttcacaaatcgatgttatgggagaatcaagatcaaaagtatgcagaaaatcataagcgtttgaatcacacctcagaacttgttcaggggctttgtctacgcgttgctggaaattaacccaattctttttatcagcatctccctgtacaagcatggaaaatgagaatcatttgaggccttttgaagtttgcaaaaatggccatgacaagtgaactgtttacctcaaaatcgttcattagcgatttcatttggtcgtcaacttctctctttgagaccaaaggtttagctacttcatcatctcctgacatctcagtatcatactcactttcatcctcattgatcaatacaaattctttccataaactcttactcgcaactgcacaaaccgaaaaattcatatcactagttatacaaagtttcagggctaggaaaagtttgtgaattcagctaacctttctgcttttcagttggagcaaccccattattgacagggcctgagtcagatgtttcgctaaccgttcgaagctgttggcattcggttttatgacccaagcgccaatgcagggcctggaaattagaaacaacacagattgttcaaatttgctcaaaagagcagaatctagcggaacaaaagaaactacgatgcacatatgcacacacctggtgtttcggtgaacagtatcgagcatttttgcagccgctacatagtttatctcctttccatgttccacaccaagtgcaaagcggagctaaagtgaaacaaacaatatcaagaattgacaattaaaagagaattctcggcattcagtcaaacccatcaatcagttcataatacctccatgacccaatggcttgtctgttccatcgtgctttggagcctcactcgagtaaaaaggattagctcgaggcaattggcaacggaaaaccttcgtacttcaggaacaaaaaaaacagtactttagtgtaacaacccacttggagaggagacaaacaatacaaagatgcaatatatagtaagaggtttctttctacctccgcatagccttctctggggcacgtttccattgttcatgttgatcacgaaggagacaagacatagatggacacatgaagagaaacaatgtccgatgaaaagctgattccttgtctgttaaaggagcataaagctgccaaatttccacaacaaatttcataaataaaccgacaaaaaacatgcaagaaacaacaaaatagtttgtatgaaacttacttgaagtacaaattgcataggttcttcacatagatcacatagaattgacttccctgatggtaaattaactggatccaaccatgcctatattgacaaatatcaacccaaagaatcaatacctaagaacataaagaagaaacagtttttgattgcacaaattgaaagatgttttaacttagtaccggaacaccaccagctaaattagggaacagttgacgaagatttgaccatgcgaatttaggactctcaacgaaacctaacatcacaggttcataatcttcatcatcttcctcatcatcatcatcaaattcatccatatttataggttccaccgcagtttcatcatcgtcatcatcatcaagctgagttattcggaggcctttgaaatcatccatggagtctccgttgaagctactcatcgaatcttctgtgttgaatttgatgaaatgaagactgcataacagagcaaaggaattgaattctagggttttactctgtttcataaacctctcaaaagtatttggcaagaaacaacgcacaaatcataatctgttaatgggtctttcgcaaaatactaaactcactaatttttcaagatttagagctcaatactcagctaattacaaatcccagaattggtacgaacaaatgttaaaaatgagctcactagtcagtatcaacaagaatcaaaatccaaaagaaacttacaacaccaggcgatgatggagatgttcttcagatagcctttaaaggtcgaatcttcttctatcaatttaaacagcaaaattttgtaaacatctttcacgaagacgaagacgaagacgacgacgacgacgacgacgaaaggaaaacaaacgtcactctggcccaaaaacaaaccctagaatagacgatgtcgtttaacataggcctataatagactaagcccaataaagtaatataagcccataaaggtttctaaattggttacgaataaaagtataaccttatcccggacaaccttatccttaaaatctcaccggtactccaactcccgttcaccggagctctgactctctgtaagcgaagattctctgctctttagctaatttagtcgaatctctattatgggtctgatccagtttcttacgagaatctgatttctgattttataacttgatttctcgatttcaaatttgtgttcttgcaatcgatttttttgcaggtaaagaagaagggagaaatagataatg

SEQ ID NO: 6258 - DNA, 3000 bp, Unknown
  misc_feature (1)..( 3000): cDNA_ID_2139462_gDNA_ID_1621085_Annot_ID_170512 3000 nt of promoter + ATG
cggtgcaggactacttggcatcctccaatggaccggtatttcattgatctgatgttggaccaagcgaggagaggaaaccagattgaaggtgttttcaggaaacaagcatggactgagatggttaatctcttcaatgcgaaatttgagtctaactttgatgttgatgtgttgaagaaccggtataagtctctgagaagacagttcaacgcgatcaagagtattcttcgatcagatgggtttgcttgggataatgagcgtcaaatggttacagctgataataatgtatggcaagactatataaaggtaacttaatcgctctgatctatgctgtgtggttagttacagtgttttcgtctctgttttgatgtgtgttcttgtctgaattaatcacaggctcatagagatgcaaggcaatttatgactcggccaattccgtactataaagatctgtgtgtgctctgtggcgattctgggatcgaagaaaacgaatgctttgtagctatggattggtttgaccctgaaactgaattccaagaatttaagtccagtggtactacagatttgtctatttcagctgaggaagaagatagcaactctcttttgtttgaccccaagaacaaaagagatcaacttgctaatactgatacaagccctataaacccgaaaaagcctcgagttgatgaaacccaaaccatgtcaatagaggacacggttgaggctattcaagcgttaccagacatggacgatgaacttatattggatgcttgtgatctgcttgaagataaactcaaggcgaaaactttcttggctctagatgtgaaactacgcaagaagtggttgttaaggaaactccgacctcaagtgacttgaggattatgagctgtaaagaagcaaagtagaagtttgacgataaacagaagctcattggcttatactacagagtacagactactttgcgagagtttcatatacaaagacttatgctcttagaagttgtaaatgtgatcaaatatggctgatgatattaaaccttgtacaaactctctcttctttgccttctctagtagctctgtatctgacaagggagacggcgattcccagtctctgagcacacagaaatacgaaatgtatctttagacaaggtttaagaagatgagataaagcaagcagaatcaagaaaatgtcaaagaattacttacttttctgttgaatcccttattaagctattgtcttccatgcttgcttcactagatgaatcaggttgtacaagcttggacttctttggtgacggcggattgtatataaatgataataatgggtccagaacacttttagatgtatgattagtagacaacggctcatcgattagagactgtaagtatttcctagtccctggagaaaatgctgaatatgactcatccttgtaaagtctctgcttttgttcaaggtaagtattcgtcaaggaacacaaatgtcagataaccgatataaaacataccaagatatagaataagcacaaaaagacttacaagttttctactaaatggtaacgaaagcaagaagagtaaataaaaaaggataccttgaagacatctctatgctgagtggtaatgtgatcaaccatatgcatcttcactcgtctgctacaaaccggacatatctacatcacaaccaaagctgaatttgtgagaagttattacattcatcatcaccaaaagactgttttcatttctcacaccaaacacttcacaactacaaaatggttcctcatagcatcaagcaaataatccaagtgaactaaaatccaagaagtccctaccaactctccttacagaatcacaatcctgcctactaaagtaaccattagagtacaacaatgaacatcacacgataaatagtctaaatttacaactaactgcttcatgtaaaaactcaaatgtatagtttaaagaacagtaactgatttgggagatggatacgagttgcaattaccccattgttggcgtctagttgatgctcctcatcgatatggtgacacaattcaactaaatcataatcatctgagcaaaacgggcatggataatccactgccatttcatcatcatcttcaaactcaatacatgaacctaaacaaaaatttcaccatcacaaaacttttatcaattacataacataaagtttacccataaagtgacaaaatttaaactcactagaccttaagggccaaaagaattgaaatttgataaagaaattaaaaccacctgcatataaagcataaaccctaaaacaaagctaaatgcaattgggaaaaagaatggatctttacactaacccgactgatacttggcaagttcttctaatcgatatttcttcgacgaatcaaacccacaaatgcccaacaaatcttcttccattttgattctgaatccacacgaacttgaattgaaaaatctcagataataattaaaggagcatattcttcctccgtgtatttattagcatctgtcagtactttgttcagcctgaaagtgcgaggaaacacaccaaaaaggcaagacctttaaatgtggtctttttctctggcgacatgagggaatccatggacacgaatctattgagctaaatccaatgaccaaactacccctaaccggtcactatagcctcttttaccctgaaccaccaacgtccctctgttgacttttagccgccacgaatctacgggcattttcgtctttgcgccaccgtcttaaaacgtgtgctccacacacttatattgaccctatcgcgcaagtggactataagcccaatatataaatgggcctaaaaaggcccaaatacttctccttcgttgctaagtctgtaacacgcgctaatgagaaacgattttgcgattcagattcgtttgcttttgccgacgacaaaagctccgattttgtttattttctccgggaaattttactttcgagattctgttgagaatcaattgatttggtattgatg

SEQ ID NO: 6259 - DNA, 3000 bp, Unknown
  misc_feature (1)..( 3000): cDNA_ID_2999876_gDNA_ID_1621085_Annot_ID_170506 3000 nt of promoter + ATG
agtctttgcaccacccaagccttgttttataaaacaaaatttctaagcgccgttttgacatgtattttataaaaacataatatagtattttatgatgtttatgattggttaaatttcctttatatcaggtattgtttaattttctattatgaaatataatcactgaaacatgaggaaagaataattcttaatcatccgttagggcaaaaaaacaagcattattcaagtgatccataaacagggaaaatctctttttcttttatttctatcctgagctcatgaaactaaaacttttattctattaactataataagcaatataaatatttagttcaagtgaggcaaaatatttgcatcaccaattctaaattcatttatataagtaatgtaaaatttatgtacatcaactataactgatgttaatattcaaattaagcgatgcagactatatttattttttaagtgatagttcgtgtaagtcgtgaatgagcctcggaagcttgatgcaaataagcaaaggtttgttatacgcttccgaactatatccacatttaaaaggtaaataaaggaagcaccaacttttgaacccaaaaataaaataaagaaggaagcaattaccaaaataattagctgttctttaacttcttgttcccgtaactaacgattaacacaggaagagcacgctgtcttttctagttatgacgtgaaatctctcttaagagacagcttttacttccaccattaaacccaaaactcttcatatcttatagttttcacccaatactttaaaaatagtggttgcatgtatttattttcataagtataaatagacttggtttgtatgcaagaaaccttgggatcttctttcaaaatctttcttccctgctcatcgcagggaaaagtctccccatcttgaatatccttttgatcaccattaattcttatatatggaaattcaaaatcagattaatggtggccaagaagagatcaagaatatgaagaagaagaaacgatcacgtggttttcacgtgatcggtgtcgttttatacatgcttcggcgtcggaggaggagcaagccgcttaataacgggttttggcggcgagttgtcgagtcctttgggcagttgaaaaacgacaatgttacggtacttccatcgtcgtctaatattacgatactaccaccatcatcttctccggtgacggatgaagttccggcgagtagtgacgatcaggtatcggagatggttgaggttctcacggcgacgtctagttcttgctcttcgggaatctcgggatatggatcagcaaagtcgttgcgagatatggattgtcttgatgaagatgatgatgatgatgaaaattatggtaatgatgatggaggtgatgagatgattgatgcgaaagctgaggagtttattgtgagattttatgaacagatgaggatgcaaaatcaggcttatacagaacgttacaaagctaaagagatgatgatggtctaaatcgcacattgtaattctattcactgaagcataatgtcatattacatgagtatacatatatgcatggagacgtgcacagagtttgtctttgattatttcgatgatttttttttttcgtctattatttcgatgatttaagtaatgatatatatattgtattcagttagtcttgattgtatacttttatagtagacgatgaatttgtacgcaaactatattaaaatatatttataaaactgatgtcattttggtttactatatatcatcttcaagtcataatgctagaaccaaattgcagctagcttcttgtgagtgatatagtagatgatgaatttgtacgcaaattatatacatgactctgagcttctttggcagttttcctagggtgtcatatacatgactctgagctacaagcctttgttgttgtcatatttcaagcaattcgtttttttcttttttttcttttgaaccaaaaacccaataatgagttaagtagaagtttataattcacttatgggtacaatccaatataatttagaattttcctattggtttgagaatccaatttgcttgaagagaaaatcagagacatggaagctaaagaagagagattagaagtttatgatgtggagagtaaattgaatcggttgcaattcggtttattatactagatttttggtttggcattaggtttatgacgttaacctaataataaactacaaaatttggttttgtggagactaaattctctaactttcgatttaggaggatataataatttaccttctattttgtgttgactgtaaacgaagttctaaatctgtgtagttgtggtactatgtgaaactgcgtaggggaatagaggtcgttcactcaagtttataagatggcacaaatagaaagaaatcaatttagttgttctctcatttgaaaggaattcaagcaatatggttgttctcgtctttccaagatgcattgaatagtaaagcatctaattagtaaagttctcataatgctcagttgctcacattgatctttttaccccttttaattagagtacagtcttgtaaattacgttgttttagccaagtttggcctatgtaataatttatttgggctttaaaaagcctcttcaaattagagtattgctgctgcagaaaaagaaaagaatatttgcgtggagaaaataaaggaaaacaaatccataattagtagtcggtgtatacatacctaaaaaggcagagagacgttaagattcaaatttcaaaaaagaaaaaaaatatgagtggcaggttcgttattaatgataaaacttaggggcaatattggattaacaacaagtctcctgaatcgtggcctcctaagtacacgctcttgtataaatacactcgcatcaaactccaaaacccttatcactctctcattaatcgaacttggcgtgtttaaataatcttccgatcgttaattctcttccgatttcgattcgattttagcggcgatg

SEQ ID NO: 6260 - DNA, 3000 bp, Unknown
  misc_feature (1)..( 3000): cDNA_ID_1394744_gDNA_ID_1621085_Annot_ID_170505 3000 nt of promoter + ATG
tgtttttggtcatagattttgtatttgattgcaaaaacttgcgatgtgtatgtgttgtttggtgagagtatttgttactaatgtctgtttaattgactgggaatttgagcggtgttgaatttgacatgtaaagagaattagggttgatatctcaacggagatcatcaaatttactttagctagaggagatttttgactatgatagtgtctcttcgtgttacagttaaaagataatctacctgctatggttgctggaatctggtcagaggatagcaattcacaattggaggcaacaaatctcttgcggaaactgctttctattggtttgtgatttatgttattgatcgttactagtagtacataacaatcagtgttttggttagagtctttagcagttgttttttcttttgtagaacaaaatcctcctatcaatgaagttgtacaatctggtgttgttcctcgtgttgtgaagtttctttccagggatgacttccccaaacttcaggtgagtcgcagctgcagtcgtttttttttggatatattgatagttactagtttgatgtatttgttaacttgcttttgctgtttacttctgcaatgtgttttagtttgaggcagcttgggcgctcaccaacattgcttcagggacatcagagaacacaaatgtcatcattgaaagtggagctgtcccgatattcatccaacttctcagctctgctagtgaagatgtccgcgaacaggtatatgtttaaatcctcactgttatcgttattgtcacagaagaaacacttagacattaggatcaagtggaaattcattgagactgttaccattctgagttctggtctttccctgactgagtataggctgtttgggcattgggaaatgttgctggagactcaccaaaatgccgggatttagtcctaagttacggtgccatgacacctcttctgtctcaattcaatgagaatacaaagctttcaatgctgagaaatgctacatggacattatcaaacttctgcagagggaagcccccacccgcatttgaacaggtttccttaaatatacacactttattgaatctccacaatattttttaacatgcttctgatattttgttacttaaaacatttttcgagcagacacaaccagctttaccagttcttgagcgccttgtgcaatcaatggatgaagaagttctcacagatgcatgctgggctctgtcatacctctcggataattcaaacgacaaaatacaagcagtcattgaagcaggagttgttcctcgcctcatccagctcttagggtaagcatctgatagtgatcattttaatttttattgccaggcatgattatgttatctgatttatgtgcttcctctttctccgtatagtcattcgtcgccatcagtgctgattcctgctcttcgtaccattggaaatattgtaaccggggatgatctacagactcaggtgcatataatacattcaccattcgatttcgagttttcagaagcaaatgtctctaacttattttcctaacacagatggttctcgaccagcaagcgcttccttgtcttttgaaccttctaaaaaacaattacaagaagagtatcaagaaggaagcttgctggactatctccaacattacagctggaaatgcagatcagatacaagtgagttttgtttataatatatggcatttaacaagaaagtcgaaaattgaagtttcctgtgtctgattttattcgaacccgtatgtgcaggcagtgattgatgcaggtataatccagtctcttgtttgggtgcttcaaagtgcagagttcgaagtaaaaaaagaagctgcttggggaatatcaaatgctacttctggtggcactcatgatcaaatcaagtaaaaccataaaaaccgaaacgaaatgtttccttaacaaagaatggtcatttctaaaacacgtctgtgtttattgtttgtttcttctcaggtttatggtgagccaaggctgtatcaaacctctatgcgatctccttacttgcccagatctgaaagttgtaacggtttgcttagaagcactagagaacattctcgtggttggagaagcagagaagaacttaggtcacacaggagaagacaacctctacgctcaaatgattgacgaagcagaagggttagagaagattgagaatcttcagagtcacgacaacaatgatatctacgacaaagccgtgaagatcctcgaaacattttggactgaagacaatgaagaagaaggcaacgacgagaatcatgctccacaatctggtttccagttcggaagcaccaatgttcctcctggtcaattcaactttatttgaaaggtaaaatagttgaattgggtcatagaagttgcttggacttttaagtaagccacatatcgaacgaaagtggtaacatcacaaagatgaaatatcaatcttctctatctcttcatgcccactccttaactcgtggacatgaactatgaagaaacatagtacgattttcttttctttttggaagtttgtctcaataactaaatcatttggggaagagaaacaattattctgtgttagccatcatctcgtctttcaacaaagttcccttttttcatatattagtgccattacaaaatcgtagttatgccttaactaaaccagaaacatttttattcaatagttaatcatttttactcgcaattttagaaaacagagaagctagaaatagtaatatacgcttgtggaggtttgaggcaacggtcaaaacttcaagagcaatatacgcatgtggagtttttattgggtactttggtgtctaattacaaataggagagattagtggtgattaagtggttattatcatggtcataatttctatatgcgagaaattagggtttaggctatgtgactaattcgtgtatttaaaacactctcattgttttatatccaacagacaacaagaacaacaacatagccagatataatg

SEQ ID NO: 6261 - DNA, 3000 bp, Unknown; identical to SEQ ID NO: 6254
  misc_feature (1)..( 3000): cDNA_ID_1808549_gDNA_ID_1621085_Annot_ID_170496 3000 nt of promoter + ATG

SEQ ID NO: 6262 - DNA, 3000 bp, Unknown; identical to SEQ ID NO: 6252
  misc_feature (1)..( 3000): cDNA_ID_1813879_gDNA_ID_1621085_Annot_ID_170491 3000 nt of promoter + ATG

SEQ ID NO: 6263 - DNA, 3000 bp, Unknown; identical to SEQ ID NO: 6251
  misc_feature (1)..( 3000): cDNA_ID_3090935_gDNA_ID_1621085_Annot_ID_170489 3000 nt of promoter + ATG

SEQ ID NO: 6264 - DNA, 3000 bp, Unknown; identical to SEQ ID NO: 6249
  misc_feature (1)..( 3000): cDNA_ID_3090939_gDNA_ID_1621085_Annot_ID_170488 3000 nt of promoter + ATG

SEQ ID NO: 6265 - DNA, 3000 bp, Unknown; identical to SEQ ID NO: 6260
  misc_feature (1)..( 3000): cDNA_ID_1394744_gDNA_ID_1621085_Annot_ID_55368 3000 nt of promoter + ATG

SEQ ID NO: 6266 - DNA, 3000 bp, Unknown; identical to SEQ ID NO: 6259
  misc_feature (1)..( 3000): cDNA_ID_2999876_gDNA_ID_1621085_Annot_ID_55369 3000 nt of promoter + ATG

SEQ ID NO: 6267 - DNA, 3000 bp, Unknown
  misc_feature (1)..( 3000): cDNA_ID_1813855_gDNA_ID_1621085_Annot_ID_55372 3000 nt of promoter + ATG
ggaaatggaacacggtttcgtggaaactagaaactacaataaggagacagccgcaacaacatgattcaacggcacacaactaaactaatcaagccttccttatctcccaagttttttttactagacctctaattacttttaattatagtccttctttaattaatcataatgaaagttccatacaatatttatgtatttgttttcttctaagaaattaattaccttcgcaagttcagtagtgatccagcttaccagattattatagagttgcaactattcgtttataatattattcaaaatataattgcatttcgtaaaagacaaaacaatttaaactctttctagtcagtcataaattctcttaactcttttgttatttcttggttgtaggcttgtagcatttacacaatttggtaaaccattatgtaacgtaattaacatttatatttcaataacaatttttatatataaacaatatctaaacgtaacacatctggagacagaaaacgtgaaactaataattaggtgaaaccaacaaagaatactaaagatgttgaacgtatttacttttaaattaaaaagcacaacagacgaaataaatcgaaaaatgcgtaattgagaaacaaaacggctaaacacagctaagatatggtccacgtccagccgtgacccacatgaacttatttgtaattttttcgtaaaatattattaacaaatatttttttcttttgaaaaattatgataaacaaatttatatgatgtattatacataattaataatacatattgaagcatgtaaggtttaaaaaaaattcggatattagtgtctatggaattttattactttttaaatcaactataaaactatctttttaaaataattcatacaaagaaatactttaattaaggattaaataattaatgtcagtcacgtaggatattatatatttttggagttaaatgtgataatttatttttatttgttactccgcgttgggcaaaattgcaaacagcaagcaaaaagctgcatacctttgtgtatataatacacatacacacacaatcatttcatgaaccataagcaacacacaacaaaaacttcatcatcaaggaaaaagaaaactcatctctgatcaaaaatcgagagtataataaatcatcaatggcggattcgtctcagaagaaaatcagaagaaacgcgataacacataaagcatggagtctcatgaagatggctcttctatggggaagaaaaggtggagttttcaaaaaatggccattgttcgaactacgtagcttgttcttcaagcatctcaaagccctagctcatcatcatagtaacggtgaccgttattacggagaacgccagctttcctttgatgaaacgccgttatttaacgtcaagaagaagatgcattgtcctacttcgtctatgaggttcctcctcctcccctgctttgctcctcccgtagattttgactatgactttgaaatggacggtcaagattattccgacgaggtacaatcgtacggttacgatgaatcttgttcggaagaagagaaaggggtggatgtgagagcagaggagttcattgctaagttctatgagcagatcaagttgcagagacaagtgtcttatttgaaatacaaacaacacaacgacgccgtattattatagatttatgatgatggttttatttactaatatgaatgaatgcagcttgtttttgtagataactgagtctatatatcatctaattacaacaacaaaaagatgtttcatttttgatttcatatgtacttcattttcctttttttttatgaatttccttttaccgtattgttgtttcaaacaaatattaatagataagtagtacattgtttgttaactggaagtcagtacccaatttgccccaaaacctaaaatattagtcaaatgcagtacgatgcaatcttaatagtttaggataggtgggcgcaatctagattgaatcatccaatccaatcatatatataatttaattcaagtttttttttcaatcttcctacacaaaaaataacaaatattacccgttttggtaatttaatatagagagttagggcatctccaaccctattatattttagagtaaaaatgcaagattcttctccaaccctactttataattgactcagagatttctgcagattgactctatatatagagcaactttatttttgagttcaactttttttatttatactttaatccctcaaattcaaacttttttatttaatacatatacacatagttttataaacttaacaatcaaacaagtactaaatttaaaataaacaacataagaaaactaaaacataaaactaataatttaatagtccggtaaattgtttgtagatccgccaaacatcatttttttttgaatcttcaaatgatcttttcgttgtgcacttgtcttctttagttcttctaaaagtttttttatttccttcttctaaggtgttgataaccgacgttgttatatgatgtaattttttcttaataaataattagtgtttaattcaaattatatcaaattttatgggaattttgcaaatctataatatatgaggtcaaattgtaaattatataattaaaaggtattagtatataaagtaaaaatagaatatttttaagaatattattttttagagtagaaatcctaactctattttaaagtaagatataaaactatacatttgagatgttcttagatacgaatttacaaaccatcctaaatatcaaaactagttaaataattaaaattttccaaggtacatgtcactataaaaacagccaaaagcttttctacatgctagtgtagaaactgacccaagaggtatcattaggggaatccaaattcaaaggggatacattcatcaaaagcagttggtgagcctccgttttttctagcatcatcggtcttctttgcgataaaagatgcaatgagatctagagccgag

SEQ ID NO: 6268 - DNA, 3000 bp, Unknown; identical to SEQ ID NO: 6258
  misc_feature (1)..( 3000): cDNA_ID_1813847_gDNA_ID_1621085_Annot_ID_55374 3000 nt of promoter + ATG

SEQ ID NO: 6269 - DNA, 3000 bp, Unknown
  misc_feature (1)..( 3000): cDNA_ID_1808414_gDNA_ID_1621085_Annot_ID_55375 3000 nt of promoter + ATG
cgtttttgttttatttttttctcccttgcacaaaaagatcattttcaatttttcattatgagttgattacttgatttccttcatgtgttattgaatttggaggactagtgattcttgtagtgattatcacattttcccactaggtagtttagtgtcagtttatttcttaactatagtgattttaaccatttacggtttacacaaaatacttctacagatttggtaaaacgattggaaaagagaattcaactagaaaaaagagagggttactgtttgttacaaacaagacaagctgtttttcattctaaattgttggcatatgactaaaacaaaatattcttaagaattaaaagaacaatcatgatcaaacagagtacaaggagtatagttgcacatttcaccattgctccttctctttgtgttctctccgcctatttaaaaattgaaatgtctttgtgagttccatacggtgaaaaatctgtagtactcacaaaatcttatgagttttgggtaaagaatcaaaccttttgtagttgtttatagccttcctcgaccgatgtagaaacgttttggacattgtagtctatccgatcaacaatcgtgccctaattgatacaagaatataagaaaactaattgttgagaagccagcaaaaactttgtatctagccagttatgtaattcataagccttttaatgactaagctaggcacctggtcaatcacaagggctgataagtctttcattatctgtgcaaggtcattcacggaacccagaacctagacagaactctgaagttaatcgccatcgaaaatgtgaagcacgcagcttcttaaatatggtcgagtaacaacttccattacctgttgtatctctcgttccctttccgctgagacatgttgcccttccttcaacttgattgtctggtgttcatcgaaaccctacaatttattgaagaccagcgattctcattatggtattggcagagtaaggacgacaaggttctgaagattgattaaaaaaaatctgactcgtcctagcatgataaccataagaagtgtttcttaaaaatgtaaggaagacaaggataactgattaaaaatctgaattgctctagctagataaccatattaagtccttattaatttgtcaatgatatatagttttacaatacaagtaagcacttaccatcccaccaagttcatcctcttcatccagtctcgacatctttccattcacattaaactctaaatctacttcatcctgaccctatgattagagaagccaaatacaaataagaacatcatattacggtacatgcatgtctcaagaatcaacactttttttgtttatttcttgaaaataaaggaaacatacctctttctgctgctgcagacgttttaagtaagtagactgttttctgcggagctccatggaaaggttctgaagatctgttgcaagagaacgctgtcaaaagcagtatgccaaaaagtaggtcaagtccattggagagccccactatacatgtacacagaactttatcctcatgctacaaactcaaaacatagaataacccaaagtacattatatagagggaaaaaaaaacacttcatacattttgctgactgataatgtcaactagataggtagtcaaaacatatgagagtgatttaacccaaaattcctaactttcttctctaaaagcacaaaagaaaaggtaatgaccatgcattctttattgttaacaagctcgattctgaaaaagtgtccaacaacctacctgcacatttttcctgagatttgattcttcagaaggccctctagtagataacatctgcaatctcttttctgacttcctcaacaaatctgtgatctcatgagtgagcatctcgacttcacgatgaatccctttgttatctccaaatgtaggcataagagcctttgaatgtgcctttgctagttcattcattttgtctcgcaccttttgtatattaaaagttatctcctcagaatcatcaacccaagctggtggcataccaattgtgaaggcatcactactgcaaacattcacaacaacacttaaatcatttgctcattctgttacctaattcgtttagggttctaattctgtatctcaaatcaatcccatgattacaattcgtttctatatataagttcatagaatttcccaggttttgcagaatcaaacaacacattatattattaccttgatggaccaggatcataggaattcaaaggagcataagaggagtgattggaccgggaaaatgaaccgctaaccatttcgatcaccggaccaccgaacgaatcagacgccgataaagataatggagcacgcgcgctcttacacgcatccctgtgtttccggtacaccgtcgttcgattcctcgtcgccatcaataccaaatcaattgattctcaacagaatctcgaaagtaaaatttcccggagaaaataaacaaaatcggagcttttgtcgtcggcaaaagcaaacgaatctgaatcgcaaaatcgtttctcattagcgcgtgttacagacttagcaacgaaggagaagtatttgggcctttttaggcccatttatatattgggcttatagtccacttgcgcgatagggtcaatataagtgtgtggagcacacgttttaagacggtggcgcaaagacgaaaatgcccgtagattcgtggcggctaaaagtcaacagagggacgttggtggttcagggtaaaagaggctatagtgaccggttaggggtagtttggtcattggatttagctcaatagattcgtgtccatggattccctcatgtcgccagagaaaaagaccacatttaaaggtcttgcctttttggtgtgtttcctcgcactttcaggctgaacaaagtactgacagatgctaataaatacacggaggaagaatatgctcctttaattattatctgagatttttcaattcaagttcgtgtggattcagaatcaaa

SEQ ID NO: 6270 - DNA, 3000 bp, Unknown
  misc_feature (1)..( 3000): cDNA_ID_1810073_gDNA_ID_1621085_Annot_ID_55376 3000 nt of promoter + ATG
ttccttgtaacttaagctcgagtcacacgagttctcacaagtgtacaccacgattgttgcccaatcgagagattccctctcgttcttcccaccgaagaagaacagtagctgcggcatcacctgataaaaccgccatcgaaatgatcaagaacagagccaagcttccaatatgcaagaacagagaaatgaaatggggaaaattgtgtgttttattggtttaaagttgatttgattcagctaaaattgttggccaattcttgactggtttataaaataagcaaaagaagtgactaagaccaagctaatacaagtttataaagaagagaagaaagaattacctgaaattcaaaacaacgaggaccaccacaagatttgcaactgggaagctcagatttagagactcgtccgcttgctattggccaaaggggtttagcaccagagctccgggaatatctgtatcaatacgtatttcacaaatcgatgttatgggagaatcaagatcaaaagtatgcagaaaatcataagcgtttgaatcacacctcagaacttgttcaggggctttgtctacgcgttgctggaaattaacccaattctttttatcagcatctccctgtacaagcatggaaaatgagaatcatttgaggccttttgaagtttgcaaaaatggccatgacaagtgaactgtttacctcaaaatcgttcattagcgatttcatttggtcgtcaacttctctctttgagaccaaaggtttagctacttcatcatctcctgacatctcagtatcatactcactttcatcctcattgatcaatacaaattctttccataaactcttactcgcaactgcacaaaccgaaaaattcatatcactagttatacaaagtttcagggctaggaaaagtttgtgaattcagctaacctttctgcttttcagttggagcaaccccattattgacagggcctgagtcagatgtttcgctaaccgttcgaagctgttggcattcggttttatgacccaagcgccaatgcagggcctggaaattagaaacaacacagattgttcaaatttgctcaaaagagcagaatctagcggaacaaaagaaactacgatgcacatatgcacacacctggtgtttcggtgaacagtatcgagcatttttgcagccgctacatagtttatctcctttccatgttccacaccaagtgcaaagcggagctaaagtgaaacaaacaatatcaagaattgacaattaaaagagaattctcggcattcagtcaaacccatcaatcagttcataatacctccatgacccaatggcttgtctgttccatcgtgctttggagcctcactcgagtaaaaaggattagctcgaggcaattggcaacggaaaaccttcgtacttcaggaacaaaaaaaacagtactttagtgtaacaacccacttggagaggagacaaacaatacaaagatgcaatatatagtaagaggtttctttctacctccgcatagccttctctggggcacgtttccattgttcatgttgatcacgaaggagacaagacatagatggacacatgaagagaaacaatgtccgatgaaaagctgattccttgtctgttaaaggagcataaagctgccaaatttccacaacaaatttcataaataaaccgacaaaaaacatgcaagaaacaacaaaatagtttgtatgaaacttacttgaagtacaaattgcataggttcttcacatagatcacatagaattgacttccctgatggtaaattaactggatccaaccatgcctatattgacaaatatcaacccaaagaatcaatacctaagaacataaagaagaaacagtttttgattgcacaaattgaaagatgttttaacttagtaccggaacaccaccagctaaattagggaacagttgacgaagatttgaccatgcgaatttaggactctcaacgaaacctaacatcacaggttcataatcttcatcatcttcctcatcatcatcatcaaattcatccatatttataggttccaccgcagtttcatcatcgtcatcatcatcaagctgagttattcggaggcctttgaaatcatccatggagtctccgttgaagctactcatcgaatcttctgtgttgaatttgatgaaatgaagactgcataacagagcaaaggaattgaattctagggttttactctgtttcataaacctctcaaaagtatttggcaagaaacaacgcacaaatcataatctgttaatgggtctttcgcaaaatactaaactcactaatttttcaagatttagagctcaatactcagctaattacaaatcccagaattggtacgaacaaatgttaaaaatgagctcactagtcagtatcaacaagaatcaaaatccaaaagaaacttacaacaccaggcgatgatggagatgttcttcagatagcctttaaaggtcgaatcttcttctatcaatttaaacagcaaaattttgtaaacatctttcacgaagacgaagacgaagacgacgacgacgacgacgacgaaaggaaaacaaacgtcactctggcccaaaaacaaaccctagaatagacgatgtcgtttaacataggcctataatagactaagcccaataaagtaatataagcccataaaggtttctaaattggttacgaataaaagtataaccttatcccggacaaccttatccttaaaatctcaccggtactccaactcccgttcaccggagctctgactctctgtaagcgaagattctctgctctttagctaatttagtcgaatctctattatgggtctgatccagtttcttacgagaatctgatttctgattttataacttgatttctcgatttcaaatttgtgttcttgcaatcgatttttttgcaggtaaagaagaagggagaaatagataatgagcagtagaaacggcaatgagagattaagaacagtgtggacacctgaaatg

SEQ ID NO: 6271 - DNA, 3000 bp, Unknown
  misc_feature (1)..( 3000): cDNA_ID_1813843_gDNA_ID_1621085_Annot_ID_55377 3000 nt of promoter + ATG
catttagtagaaaacttgtaagtctttttgtgcttattctatatcttggtatgttttatatcggttatctgacatttgtgttccttgacgaatacttaccttgaacaaaagcagagactttacaaggatgagtcatattcagcattttctccagggactaggaaatacttacagtctctaatcgatgagccgttgtctactaatcatacatctaaaagtgttctggacccattattatcatttatatacaatccgccgtcaccaaagaagtccaagcttgtacaacctgattcatctagtgaagcaagcatggaagacaatagcttaataagggattcaacagaaaagtaagtaattctttgacattttcttgattctgcttgctttatctcatcttcttaaaccttgtctaaagatacatttcgtatttctgtgtgctcagagactgggaatcgccgtctcccttgtcagatacagagctactagagaaggcaaagaagagagagtttgtacaaggtttaatatcatcagccatatttgatcacatttacaacttctaagagcataagtctttgtatatgaaactctcgcaaagtagtctgtactctgtagtataagccaatgagcttctgtttatcgtcaaacttctactttgcttctttacagctcataatcctcaagtcacttgaggtcggagtttccttaacaaccacttcttgcgtagtttcacatctagagccaagaaagttttcgccttgagtttatcttcaagcagatcacaagcatccaatataagttcatcgtccatgtctggtaacgcttgaatagcctcaaccgtgtcctctattgacatggtttgggtttcatcaactcgaggctttttcgggtttatagggcttgtatcagtattagcaagttgatctcttttgttcttggggtcaaacaaaagagagttgctatcttcttcctcagctgaaatagacaaatctgtagtaccactggacttaaattcttggaattcagtttcagggtcaaaccaatccatagctacaaagcattcgttttcttcgatcccagaatcgccacagagcacacacagatctttatagtacggaattggccgagtcataaattgccttgcatctctatgagcctgtgattaattcagacaagaacacacatcaaaacagagacgaaaacactgtaactaaccacacagcatagatcagagcgattaagttacctttatatagtcttgccatacattattatcagctgtaaccatttgacgctcattatcccaagcaaacccatctgatcgaagaatactcttgatcgcgttgaactgtcttctcagagacttataccggttcttcaacacatcaacatcaaagttagactcaaatttcgcattgaagagattaaccatctcagtccatgcttgtttcctgaaaacaccttcaatctggtttcctctcctcgcttggtccaacatcagatcaatgaaataccggtccattggaggatgccaagtagtcctgcaccgtgtgacactgcttccttttgagttagacctgactgttgacgattcacatattctgttgtacccatcatcttcctgaatcagtgtcttggattctccctcactaatactctcctcagctgaaacatacatattcattcacaggttacttaagaatctttgatctttggtgacaagaatgtacaatgaaggattcaagtaacaatcaatagattaaagattgtacctttgtgctcagacattccatctgagtaaaccaagcacagatctttgtaacaaggtatagactttatccgaaaagatctcgaatcaggatgaatcttcaataacccaaaagcaaaaacaaatcaatccctgagaagaagacacaaaatcacaagtaaacaaaacgcaaaacgcaccttaagatactcatcccaaacgcagttatcagcaacaaccatctgtctagtatcatcccaactaaaaccatcttctatcaaaagattattcacagatttaaacaagttcctcaatgtcttatgcctgtttttcaaaacatctttgccataaagaaacttgaacttggcagtgaaggaacaagacatgaacttccaagctcgtttactaaacaaatgatcttcaaatctgttgccttttctaacttgttccaccataagctcgatgaaatactgatccatttcaggtgtccacactgttcttaatctctcattgccgtttctactgctcattatctatttctcccttcttctttacctgcaaaaaaatcgattgcaagaacacaaatttgaaatcgagaaatcaagttataaaatcagaaatcagattctcgtaagaaactggatcagacccataatagagattcgactaaattagctaaagagcagagaatcttcgcttacagagagtcagagctccggtgaacgggagttggagtaccggtgagattttaaggataaggttgtccgggataaggttatacttttattcgtaaccaatttagaaacctttatgggcttatattactttattgggcttagtctattataggcctatgttaaacgacatcgtctattctagggtttgtttttgggccagagtgacgtttgttttcctttcgtcgtcgtcgtcgtcgtcgtcttcgtcttcgtcttcgtgaaagatgtttacaaaattttgctgtttaaattgatagaagaagattcgacctttaaaggctatctgaagaacatctccatcatcgcctggtgttgtaagtttcttttggattttgattcttgttgatactgactagtgagctcatttttaacatttgttcgtaccaattctgggatttgtaattagctgagtattgagctctaaatcttgaaaaattagtgagtttagtattttgcgaaagacccattaacagattatgatttgtgcgttgtttcttgccaaatacttttgagaggttt

SEQ ID NO: 6272 - DNA, 3000 bp, Unknown; identical to SEQ ID NO: 6254
  misc_feature (1)..( 3000): cDNA_ID_1808549_gDNA_ID_1621086_Annot_ID_55381 3000 nt of promoter + ATG

SEQ ID NO: 6273 - DNA, 3000 bp, Unknown; identical to SEQ ID NO: 6254
  misc_feature (1)..( 3000): cDNA_ID_1808549_gDNA_ID_1621086_Annot_ID_170530 3000 nt of promoter + ATG

SEQ ID NO: 6274 - DNA, 3000 bp, Unknown
  misc_feature (1)..( 3000): cDNA_ID_4254415_gDNA_ID_1621088_Annot_ID_55409 3000 nt of promoter + ATG
agaacattgtatctgaaacgttacgtctgtaccctgcagcccctatgctgcttcctcacgtagcctcgaaagattgtaaagttgggggatacgatatgccgcgtgggacgatgctattgactaatgcatgggctatacacagggatcccctgctatgggatgatccaacgagcttcaagccagagaggttcgagaaagaaggagaggctaagaagctaatgccgttcgggctaggaagaagggcatgtcctggatccggtttggctcagcggctagtgaccttgagtctcgggtctttgattcaatgttttgaatgggagaggattggagaagaagaggtcgatatgactgaaggtccaggactcacaatgccgaaagctagaccgttggaagctatgtgcagagcacgtgactttgttggtaaaatcttacccgactcctcttgagtttttgtatgtaaaatgctaatacgttgcttagcaacggtaacgaattaaatgaaacgtattagcataataaaaatcagagacaaaaatcatattctaatttccaataacccattgttaattatgttacagtcttacaaatatgaatgttcagtgttatcaatcaaacaaaattctaggtgtgaaaaaaaaataaaaaaatctaggtgtggcattgctatgctaaatgtcatataattagctaaaataaataaataataatgattaggtatctaaacgactaatgggcacatgtgatttggccgaaataagattctgttttcgaagtcaacgtctatggagtagttcaagcagattttgcaccacatcatcctctgttacaacccctgaagatccttgaggaagaagaagtcaaatatggaaggtcaaaccctaattttcacattccttttcatatctctttctctcacgtttatcatcggaagaatcaagcgaagacctaaccttcctccgagtccgtcgtgggcgttaccggtgatcggtcacctccgccttctcaagccgccactccaccgagtttttctatccgtctctgagtccctaggcgatgctccgataatctccctccgtctcggcaaccgactcgttttcgttgtctcttcacactcactcgccgaggaatgcttcacaaagaacgacgtcgtactcgcgaaccgcttcaactcccttgcttcaaaacacatctcatatggctgcacaacggttgttacagcttcgtacggcgaccattggagaaatctccgccgtattggcgctgttgagatattctcggctcaccgtctcaatagcttttcatctatccgccgagacgagatccaccggcttatagcttgtctctcacggaactcttcactcgtaagtttgttctttgttctttgttccaattttatgctaattagcaaaatttattataatcagaatccttagtccctagtcaatctctgcttataggtgaatttcagtgaattgtagcaaatatttaacatatgatatacaataaattttgcaggaatttacaaaggttgagatgaaatcaatgttttctaacttaacattcaacaacattataagaatgttggctggaaaatgttactacggagatggtgcagaggatgacccggaggctaaacgcgtgcgggagcttatagcagagggaatgggttgttttggtgctggaaacactgctgattatttaccgatcctgacttggatcacaggttccgagaaacggataaagaagatcgctagtaggcttgatgagttcttgcagggattggtcgatgaaagacgagaagggaaggagaaaaggcagaacacaatggttgatcacttgctttgtctgcaagaaacccaacccgagtactacacggacaacattatcaaaggaatcatgctcgtgagtaacattttaagttcattagtctattgtcacatttggtatgggattaattagttatgtttgtttttttgtgtatgcgtccattgtgttgaagtctcttatactagcggggactgatacatccgcagtaacattggaatggacattgtcagctttgttgaaccatccacagatactaagcaaggcgagagatgaaatcgataataaggttggcctcaacaggcttgtagaggaatcagacctctcacatcttccttatcttcaaaacattgtgtccgagtcgttgcgcttataccctgcgagtcccttgttggttcctcacgtagcatcagaagactgtaaagtagggggttaccatatgccacgtggaacgatgctattgactaatgcatgggcaatacatagggatcctaagatatgggatgatccaacgagcttcaaaccagagaggttcgagaaagaaggggaggctcagaagctattggggtttgggctaggaagaagggcgtgtcctgggtccggtctggctcaacggctagcgagcttgactatcgggtctttgattcaatgttttgagtgggagaggataggagaagaagaggtggatatgactgaaggtggaggaggagtcataatgcccaaagctataccgttggtagccatgtgcaaagcacgccccgttgttggtaagatcctcaacgagtccgcttgagcttagacttttgtactaaatgctaatttgtgttttttgagtaacggttacttttgtactacttttgttattatgtaaaaagaggaaataatttcgaggtgatacatccaaataatatattaatacacttatattttacttttaagaaagaaaatcttgagaagaaatctagaattataatttcgtctgcttttttaaaaggtttttcttaattagagtccaacgttcgaatttgaacttgtgacaatagtacattatcttttatagagcataatttttaaaaataatatatttccttgaccacatgtatatatctccaaaacaatagtaaaaaaaagagagacgaaaagaaagaaagagagagagccccacaaacaaacaaa

SEQ ID NO: 6275 - DNA, 3000 bp, Unknown
  misc_feature (1)..( 3000): cDNA_ID_1814056_gDNA_ID_1621088_Annot_ID_55410 3000 nt of promoter + ATG
tatagagcataatttttaaaaataatatatttccttgaccacatgtatatatctccaaaacaatagtaaaaaaaagagagacgaaaagaaagaaagagagagagccccacaaacaaacaaaatggatttgaaccaaatcttgatcctctcatttctctctctttttaccttagccatattcttgctcacaagatccaaacggaaactaaaccttcctccgtcgccggcgatctccttgccggtgatcggacacctccatctcctcaagccaccgcttcaccgtaccttcctttccctttccaaatccatcggaaatgctccggtcttccatctccgactcggaaatcgcctcgtttatgtcatctcttcacgttccatcgctgaagaatgtttcacaaagaacgatgtcgttctcgcgaaccgccccaagttcaccataagtaagcacctcggctacaacgccacctacttactctcggcatcttacggcgatcattggaggaacctccgccgcatagccgccgtcgagatattctccactcatagactcaattcgtttctgtatattcgtaaggacgagatccgacggctcatttcacatctctctcgtgattccttacacgtatgatctccttcaattctttttatttattatttgttctgtattcattactttatctttggtttgtcaactaacaaatttattatttattcattactcgtgacgactactttcatatagtacatacttttatatttattgtggtgataaattgtccatgtgactagtttatttttttgaagcattgcgtgtatattacgatactagctatttattcacgaaagtctgatcactatattcataaatattacatagtttattcacaaattacaaatgtacagaaaagcttaattttaaatttatagaaaaagatgcagtgtaggttttaattgtcttaagttggttgaataattatttggttcaaaataaacacattgttctaatatgttaaggtggcgaatatggaaatgcacaaatttttacatacttaccaaaactcttatctgtttactaatattgtattcgtactctcagggatttgtggaggtagagatgaaaacattgttaaccaatttggcatccaacaccaccatcagaatgttggccgggaagagatatttcggtgaggacaacgatgacgctaaactcgtgaagaaccttgtgtcggaggcggtgaccagcgccggtgcaggaaaccccattgattatctttccattttacgttgggtctcgagttatgaaaaacgaatcaagaatttgggaaataggtttgatacgtttttgcagaaattagtcgacgaaaaacgtgcggagaaggaaaaaggtgaaactatgatcgatcacttgcttgctctccaagacattcaacctgattactatacggatgtcatcatcaaaggaatcatacttgtaagtatcaatcaataagaaagtttttatatatatatagagagagtttaatgattgaaattttgtttagaccctgataattgcagggacagatacgtcatcagtaacactagaatgggcaatgtcaaatctgttgaaccatccagaaatacttaagaaagcgagaatggaaatcgatgaaaaagtcggtttagaccgattagtagacgaatcggacattgtaaatctctcttatctccaaagcattgtattggaaacactacgtatgtacccggcagtcccactactactacctcatttgtcatcagaagattgtaaagttggaggctacgatataccaagtggaacaatggtattgaccaacgcatgggccatgcatagagatccagaggtatgggaagatcctgagatattcaaaccagaaagatttgaaaaagaaggagaggctgagaagctaatctcatttgggatgggacgaagagcttgtcctggagccgggctagctcatcggctaataaaccaggctcttggaagtttggttcaatgttttgagtgggaaagagttggtgaggattttgtggacatgaccgaagacaaaggagccacattgcccaaagctataccattaagagccatgtgcaaagcacgttctattgttgataaactgatataaatgttttacgttgaaaaatgtattctatttaatgacatgtttttaattatgtgttttggtcttcaattcgtccttcaatcttttgttgtatctttgaatcttgcttaatatcatcgggtcaatgaagctgggcttgctcaccgggttagtgggctggctcttgcgttgttggtccaatgttttattgattgatatattttttaatgtgattgcattatagttaggttaaatatagtgtttttaatgaagttgtaaaatcaataggtcacgttgagtcgttgacccgtattttatacttgacccgtattctccagtaaaacgtgaagaatcgtaaaaaaagaactatcatatagtataaaattcacatcacataaagtcactacagattcgataataaatgcattgagtcttgtgattctatattttctattcatcgcccccaattaagctacgtaataacagggacataaattgtctttttaatagattttttaagtcggcaagtactgtcttttagatatttcggttgtcctatgtagaaggtagatatgtaaagggtagattaaaaaaggaaatttaccttctacatcctatttagtatatttactatactaaaaaaggaaatttacctaactttctcattgaaaattagttattaccttctctttcaaaaagcagatcaaaatctctatccaaccatttccaaaaattcaagtctctttagttttcagtcaattaattttcgtgttttaaaggccacaaagtacccatctggtccatctcgatcccacacacgacacaactttacacaaaaagaaagaaaaacccaaaaacaaaagaagcaatcaacaagaaa

SEQ ID NO: 6276 - DNA, 3000 bp, Unknown
  misc_feature (1)..( 3000): cDNA_ID_1814052_gDNA_ID_1621088_Annot_ID_55411 3000 nt of promoter + ATG
agtctctttagttttcagtcaattaattttcgtgttttaaaggccacaaagtacccatctggtccatctcgatcccacacacgacacaactttacacaaaaagaaagaaaaacccaaaaacaaaagaagcaatcaacaagaaaatggacctcacccaaatcctactcctctcctttctctttctcactatctccatcaaactcttgctcacaaaatctaaccggaaacctaatcttcctccttctccggcttaccctttaccggttatcggccacctccacctcctcaagcaaccggtccaccgaacattccactccatctctaagtcccttggaaatgctccaatcttccacctccgcctgggaaaccgcctcgtttacgtcatctcctcacactccatagccgaagaatgtttcaccaaaaacgacgtcgttcttgcgaaccgtcctgatatcatcatggccaaacacgtcggctataactttaccaatatgattgcagcatcttacggcgaccactggaggaatctccgccgcatcgccgccgtcgagatattttcttctcatagaatcagtaccttttcttctatccgtaaagacgagatccgacggctcataacacatctctctagagactccttgcacgtacgtaaccaccttcttatttaactcattatttatcttttatttactttggcattactaaaatttaccaaaaaacaaaatatcaaaaatcaaaatttttatttatcgactattgcggttgaatttgtccatgtgagtaggattttccactttcaagccgcccttctttattatattaacacgcatatttaattatttgtcgcttattggctggaaaataatatatttatcagttaggttacttgtatgcatcaaatttgtcacgacagaaaataaaataaaagctctcagtcgtcatagatggaactgaactatacacctttgatatagatctattaaaaattacacaatgtaataaacttgactagtaatcgtcccactgcagggatttgttgaagtggagttgaaatcgttattaaccaacttggcattcaacaacatcatcatgatggtagccggaaaacgatattacggtaccggtacagaagacaatgatgaagccaagctcgtgagggaacttatagcggagataatggccggcgccggttctggaaatttggctgattatcttccgtccataaattgggtcacaaactttgagaaccagaccaaaatcttggggaatcgactcgatagagtcctgcaaaaactggttgatgagaaacgtgcagagaaagaaaagggtcaaactttgatcgatcatttgctttctttccaagaaaccgaacccgagtactatactgatgtcatcatcaaaggaatcatactggtaagttcttattaactaatattatcctccttatatgtggagtgggtttacttattagagatatatatatacacaggctttggttcttgcggggacagatacatcttcagtgacgttggaatgggcaatgtcaaatttgctgaaccatccagagatacttgagaaagcgagagcggagatcgatgataaaatcggttcagaccggttagttgaagaatcagatattgtaaatctccattatctccaaaacattgtgtcagaaacattacgtttgtatcctgcggttccactactactccctcatttctcatcggatgaatgtaaagtggcgggctacgatatgccacgtcgcacgttgttattaacaaacgtatgggcgatgcatagagatccaggtttatgggaagagccagagaggttcaagccggagaggttcgagaaagaaggagaggctcgaaagctaatgccgtttgggatgggacgacgagcttgtcctggagctgagcttgggaagcggttagtgagccttgctcttgggtgcttgattcagtctttcgagtgggagagagttggtgcagaacttgtggacatgactgaaggcgaagggatcactatgcctaaagctactccgttgcgagctatgtgcaaggcacgtgccattgttggtaaaacgatataattgacgtatgtaggatctattgtgtagaaacctatatagtttcttacattccacgtgttcatggaaaataaaagtattctgtggtcaattagttggatgcagagcaatgtcacggcttctatagaaagttcaacagaaccaaaatttcactgtttccatctctccaatgttggtttcttgaaatttagaattggtttggtgacttggtcatgtagtgggcatgtgttgggcctcgtcaaaatgttgtctttctctgcattttaaattaaatacccattaacaaatctgtatacatatgttcttcactgtctgaactagtaattcagcataagctaaaagtataatattttttttttaataaaaggactgttgttaaaaacgaaaagtttggatttcatgttagtgttggtaccgaatctgccacgttttgatgattatagttgtagaaaatgtcaaccaagcaatattattgtaaagacaataatggatggaaatctaagaatttcgattgaatttttatcttatcgagaactttcaacaaaaccttttggattgatcaaatgaaagagacataagtggttatacattagacttgttcacgacactccaatgtagtatgatttttctgtttgtttgtcaaattcattgtttacttgtcttataggaattttccttattttacaaaaacaaaagaaataaaagaaaagaaaattggtgcttgtttttccaaattagtacgctaattttatcactattgtatgcactattttgttatttgactttgtaaatgcatgaattaaagagtgtttaaaaatcagtatcttatactatattatttaatagcgcacggaggagaaaccaaaatatacacaaagttagagaaaaaaagaagagaaaaggagttatat

SEQ ID NO: 6277 - DNA, 3000 bp, Unknown
  misc_feature (1)..( 3000): cDNA_ID_4254989_gDNA_ID_1621088_Annot_ID_55412 3000 nt of promoter + ATG
taaatctatataaaagcaaatctttaatccattcaaatagcagatatgtatctctagggattaaggtagtatacaactataacatctcaaaagaaccaaattgtgactgcacaatgcaatatcataatttgtatatcgaaaacatgatatgttcacatggttcgtccataaacagtacttatattcatatttgaccactaaatatttcacattaaaaaatcgaaattagaaataattatggatttagttctgcaaactcgattttttttaaaaaagattcgaagatgcaagattgataatgaaataaaattgagggtacatcatacatgtgggggaagtgacgtttaaaaacaaaaaggaaaaagaggaagaagatagatgccaatattgttatcatgacaactatgaagcagagttagagtccgtccgtccatacaagtattttgtgtgagtaccaccgaatttgtctgtctatgttatctcccttctttttctcatgcccacgaaccaacatgacaattatgttttgttcgttttttgaaaaattctagagttttcatttattaattatcgttgagttatgatttagtatgattttggtttaaaaattccacttcttaggactcattgtttgatctttgtgtttcttatttatttctttgcacagtactaaaaatcatgcattagttcttaccattcacaaatcttcaaaacttaattagaaaaagaaaaaaaaaaatcgatcaatacaatgaaaacgttctcctatgcactatgcagaacaagtctcgaggattcgtatggtcaaatttattccgatcaaattattcgcgaaagtgtgagaaacaaatacgtactttatttctcttacctcctcctacgtcacttctacgcattcgtgccctaccttcatcagtactcttccagtttctaaaggttaaaaccgagtcgatgatccacgaccgtagagttaaatcaagtaatcaacttaagtcattgtaataagaaagcctccgctcaaaaaaaattctacaatattagtttgacataaaacttcaaatgatagaaatatgaaatcaaatagttgtagacttgtagtctagtactttcatttggctcatttggcaattgcaaagtttacgtggtgattactaaactccttgtcggtataaatgtttttgatcatgaaaccatataccgaaaatattggtatatatagtcctgcctaactccactaacaaaaagtcaggatttttaaattaccaactacaacttgaattgtcatttggaagattgattcattggaatattgtgtatcttaagccataaacaaatcccataatttaatagtgtgccagaattttgtattcatattttaagcagtaaaaacaaaaacaaaatacatatatatattctcaatcaaactataatactttagatttaaagctattaagaaaaacatttagctagtcaaaaaaaacaattaacacttttcgaaaggtccatttccaaggaagctagagaccgtccttttttactaattcgcctgcaccatccccttgtatcgagggtctaattctacaccttattccattttatattccctaacaatttttttagtttttttttttatattactttaattctaatgaaaactcctatcttccttcctctccatcctttttcatctacctttgaatcttttgacacttgtatataaagctttacttcctcctttgttactccttttctatcaatcaccaaaacacattcattgtcttaaaccctaaacctcaagaaccgaacaaccacaccaaaaaatgagaccggttggcttgatctttacggtcatgttcttggtctcggccttttcggaatcaagaaccgcggattgcagagttctccttggtggttcgacggaggaaatcgatcaatctaaaattcatggggtcgatttacgaagtgaagacttattaggggtcgtgatacatggttataagaagctaaggtggctctcatcggccggggagaggatgcatacaatggcttcaggaccgagcaggagaggtgctggtcactaaaatacgaacccaaacaaaacattatacttcgatatttgtttagctcaggtcatagaatcatatttttcattttttatagattattatatttattcagtcgctaaagatccatgtaaagtttagaagggtgatattctttgatcatacaatagtcggtttccttctcataaacaccaatttatagtacgtgcccattaatcgatatttattttagtttaacaaatttcaattttgagatctacgttaagccatcaaccatgcaaattgtatatgagtcaataatatagattgaggagatatgttatcggccattctggtgcaacttaaatgatatacagccacatgattatctcttttcctttttggtaaggttgataccacatgattaattataaagaagacattgattagttcatgttttaccacataattggaattaaaagtggtcgcaaattataatcaaacgtggtcgcaaatcgaatttcgatgagatgcaaacgttttttcagctgtaccttttaattcttttcttatttgttcgaaatgttggcctttggggaattaaaaggacatttcaaaaataatttattgtctttccataggagccggaaatggaaaagcttcaatcttcatgcacactatgttttgagtggacccaatttcgacaatctttttttaaatgaagaagataaaagttgttttttttggtaataatgtcgagtatttatagttttataccatgtttagtgagtatattgcagtttcacgttatgaaatttgtaatgagaaaattaaaggactaaaaaggcccactaaaagcccatatacattttcttttaaacacaactaaaaaccagtgagcaaatcctttctctttttgcatgtgtgtgttgtaaagcagtggacagagacgacgatg

SEQ ID NO: 6278 - DNA, 3000 bp, Unknown
  misc_feature (1)..( 3000): cDNA_ID_1814049_gDNA_ID_1621088_Annot_ID_55414 3000 nt of promoter + ATG
aactctagaatttttcaaaaaacgaacaaaacataattgtcatgttggttcgtgggcatgagaaaaagaagggagataacatagacagacaaattcggtggtactcacacaaaatacttgtatggacggacggactctaactctgcttcatagttgtcatgataacaatattggcatctatcttcttcctctttttcctttttgtttttaaacgtcacttcccccacatgtatgatgtaccctcaattttatttcattatcaatcttgcatcttcgaatcttttttaaaaaaaatcgagtttgcagaactaaatccataattatttctaatttcgattttttaatgtgaaatatttagtggtcaaatatgaatataagtactgtttatggacgaaccatgtgaacatatcatgttttcgatatacaaattatgatattgcattgtgcagtcacaatttggttcttttgagatgttatagttgtatactaccttaatccctagagatacatatctgctatttgaatggattaaagatttgcttttatatagatttaagtaaataattgaaattcttttgtccaaagatatttgttcaagaattatattaatttcatgtaattggaaggaatacaaaagactggaatcttgataatgaatttattaatgcagaatttgattccattattaatggactaccacgtccgaactatacatagttaaacattttttcttcttgtattattctggcgtggtcttacgccacttataaactatattattttggccaaaccaatatttataaaatcgaaataaaacattaaaccgggttttaagtactttgtttgtattattcaataattggttattaaactaagttaataatttcaaaatagtgatttcaccttaaaatatgggaaagagtttcctgatgctctggaatttggtttctttgtcttatactctaactgcggataaaaaggagcgattttgctataaaaaggaacagtttgagatgatattacactttattccggtaaattatttggctaccatcaataatatattcttcaaaactatcaatcttcctttttttttagaaaataaataaatttcatcacaactctgtttgaaaaatcgtttatgaacttgagacggaaaaattatcataattcaacgtcatatagcagcaagagttgaaataaaaattaatggttttgtcttttcataggatagatttcttatttctacctaacaaaaactaaaatttggatgttgaattttgagtagtataaagtttggttgttcaatgttttttgcaagaaaaatcacgtgagaaggaactatttttggtcgtgcaagaaaaataacaccaaagtgtttgaacttttgaagcattgatgattaggtttggtgtatctaacaatattataaaacaaacacatgagatccgactcatagtcaatttagcttatgtcactccttaaatcagctggtttaaccgaaccagaaaccctaaccaaatttttaaaaaaaattcaagttatctgattttaaatttattttctatatataaaaaatttggctgaaagttgaaacgaaaccaaagctagagatgtacattttctagtaaagtaaaataaagtaaacaaattcaatctgaaaccaacaatataccataatatacttacgaaaaccaaatctaaaccggctaacgatatatgtgagtgtgactttatatacgttgcgagtttgaaattcaagcattatttttggtctacacaactacaaatctaccttaatatttagctgccgtctgctccaaacaatgaaacttcatgtttggtctacgatattaaattctttatttctaatattcaattccttatccttttcttcattgatggctttcactattttgtgttcaataaatacacacaaaattgaatgctcaagaaacaagttggtattttcccaggaagcagcatactaactaatttcaatgatcacattcttttcaattcaaacttagtcaagaataaaaattcaaactttgcatctccacgaacactactatatagtcacattctcaactcacaaaacactcacaacaaaattcattatctgccaaagagaaagaaaaccatattttttataaacagagttaaattgttcttaaacatgatgatgaacaaaaacgttctgagttcgattctgttcttcatgttgattggttcggttcttgtcgagagtcgtccgcttggtctaacaaagaccgaggagaagttcgtggctagtttattcgatggcttatcacttggttcgatcaaagactcaggtccaagtccaggcgagggtcataaggtcgtggacaggaaggatacgtttcgatttgttaagcactcaggtccaagcccaagcggaccgggccactaatgtttcaatctttagttcaaaccgggccggttaaagtgcccatacccatctaggtcgagaaaattatttcatttttttgttccagtttcattagtggaaaatattatacatgtctcatgtttctgatcgatacataggaagaagaatggcaaaaacaataattattgtctcatttttctatatttaggattattgttttgttagtgaaataaagttacttgaaaagtatacaaataaaatgtattaatcaatttttttatatttatttgaatgtaataatagttaataaacatcagtgtccaaagtgaaatatgagtccaactgctcaacgaccaataaaggcataaatttttttaaaaagacaatgctttataaatgggcgacgagtatatttaaaaggtttaagagatttaatcgaactattgtgaaagttaagggactcaattgaaaaactattcgcaacgattcagtcattcagcagttgtcgtagattcatttatctagacggttaaaggggtgccttgtgatgtgaagatctttgcctctcgctctcgctttcggtgaca

SEQ ID NO: 6279 - DNA, 3000 bp, Unknown
  misc_feature (1)..( 3000): cDNA_ID_1814045_gDNA_ID_1621088_Annot_ID_55415 3000 nt of promoter + ATG
cgtcgaaggaagagacggcgagtgacggagatacggcgagcggtggcgcctcaccgtccaacgacggcagactcttctcggagggcgagcgtgttctcgcttaccatggtcctcgcgtctacggagccaaggcaaataaaaaacctctctctctctctctctttctctgtgcatcgtcagatgttcgcataatttgaattctagagattatcttgttcgtgttaatttagcaattcttgtatttcacgtgggttttggttgtatccgactacggaattaactggtttcattgaattgagatctctctgctagatttggcttaggggtttcttggtagatttcggtttcaagttacgacgatccgaaagatgaacccattgagattggattcgagttttctttttttggtaatggattcatgtagcattagagctttttagattggaatgatcataaatgcttagtcgtaatagatgcaaaagaataattcacttgccgttggagcaaggaattcaataaattactcggaaaatagggcaagctaatctacttgcatgtttattttttcaatcatatattatataggtcactggattgagtctcattcatatcaaatgtgtgtcgttgttatgctaaatcttcatagttttgaaaaaaatctgttattgcatagtgttttcagtgtgtgggcagacctgatagattattgacattccattacaggttcaaaaggtcgagcttcggaaaaaggagtggaaatactttgtgcactatcttgtgaggcctccttcttctgagctattatagtttcattatcctgtttcatgtactagctattttcattttggtttgcagtaataagtgatacagcgatctttgtctgcagggttggaacaaaaagtgagtatctctctctgctctcatgtcgattctggtttatgtagcaaaatcagtagattgggacccatgacatgattgtcttgccaacagttgggatgaatgggttagtgcggatagattgttgaaacataccgaggagaatcttgtcaaacagaaagctctagacaaaaagcaaggagttgaaaaaggtaccaagtctggccgttccgctcagacaaaaactagaagctctgcaggtgagttgttgcctccacattgaccatgctgagagtacatgatacatattttggtcatccaggctaagaaactaactatttctttctgatcttgcacttgcagacacaaaggctgataaagatgacaccaagaccaatggtaggcaacatattaatttacgctccctttgtagttcagggttctcccaacaatttccaaggaaatgatttggtagactgggtgcaacttaaattatttaagctggtgtatagatgattacattttctgttgcagctgcaaaagggaagaaacgaaagcacgagtcaggcaatgaggtcaggcttgcaaaaacttagagatgtatttggttcatacctgttaggtctttgttaagattatattttacagtacaatagatggctgatgtgttgttatgcatatacacacatacgaaaagggtcaatttttcaggtcttctaatatcgataaggtttttgttttcatttgtaatctatagaaggataatgtaacggcggagaagctaatgaagatccaaattcccgcatcacttaaaaagcaactcactgacgactgggagtatattgcgcagaaggacaaggtatcatcaattttctctattttgtgcacatacttttagcactattagaattgttattgaatcagctagacttgaaagttaagagacataagtgtgtatttgtagtcgaatgaattgtgtataccaaagtgaagggaaattgatgtttggtaatctgtcttcaaatgattatataggttgtgaaacttcctcgttcacctaacgtcgatgagatattgtccaagtaccttgaattcaaaaccaagaaggatggaatgtgagtcttttactcgaacacagagtttgatatatttgaatcttttccgaaatccaacgatacaaaattttgtgtttctgtttttgtgcagggtaactgattcggtcgctgaaatattgaaaggcataaggagttatttcgacaaggcattgccagtgatgctcctatataagaaagagaggcgacaataccaagaatcaatcgtggatgatacttcaccttcaactgtttatggcgccgagcatttgctccgtctctttggtaaaatctcattaagttcttatttggacagtaaaattcgatgttctgaaattttatttttgctttttttaaaaatctgcagtcaagttgccagatcttttttcatatgtaaacatggaagaagaaacatggagtcgcatgcaacaaacattatcagacttcctcaagtatatatctaatctctctgtttcatcactaccattttgatttctcggttttaacggttaaattcacaatttctggaaaaaaatctttacaggtttattcagaagaatcagagcactttcttgctaccatcagcatatgattctgataaggtttcagatggtaaaggcaaaggaaaagacgactgacatctccaggaaaaaaatattgttgtaatttagaattccttcatttttctgatgaattcataattgtaagatttgcagctgaatatgaaatattttacaggcctttgaagttaactatttggttcatgtaaatttctttaagtggtcaataaaacatccggaacaatggaaccttggttggtagaaggcaacaaaaaaaatggaaaaaataaaaaagtgtatgagatgagattatttatgtggctaatgtcatcggaataattacattggttctccttctctgttattattctttcatctttttcaccaagacgaacgactcttacacgcagagttcgcgagatcagaatcaatggtggcatgaaaaacgacgcttgagctcaaattcgtcgacc

SEQ ID NO: 6280 - DNA, 3000 bp, Unknown
  misc_feature (1)..( 3000): cDNA_ID_1814041_gDNA_ID_1621088_Annot_ID_55417 3000 nt of promoter + ATG
ttgtactttaagtctttaagatacattatgcttaaaaatgacagttaaaatttggtttgtatactacttagacgaattctttgactgttaatattcaaatatatttgcattctctgttatttcattcatatccaataaatatatatattatttattatagtatgatataaactaacacataatatatacatagatatatttcgtttaaagatgtggtgtcaatcgtattttttatagagcaaaatttcgaggtaaattagttttttcaaacatctacagtttgtacatggcattggacttaaataaaataatgtcacgtagctatcgacaaaaagaaaagcatctgatgtagctatgaaatttacaaccactgctaaacaaattgtccacttaataaatagtttatagataatttgggaataaagctgacaatgactgtgtcggatatcgttattcgccgaagctaacattcatataaacgaataacgttttttgttttttttggtcgaaataaacgaataatgtataaaatgaaattttgtttacaccaaaaaaagatccaccggtaacaagaaaaaatcttagtgctctgaattagaagaataaattaattatcacaaaaaggaaaggccgtagagaagattgtaagctttaaaaagcccaatatttttggacaattttcgtttggttacctgtccccgttcgtcctttcaagtacatcttcttctctctcgatttagcttgaggtataaccagtcaaccgccacatttccttgtattacaatgaataattgggcctttaaagcccataaattggcctctaaacgtttcattcggttaagtcccttgcattttaagatttcatcttgtcatttcacctacaattacaaaacaaaattacaaatcatctctctgtttcagagtcaatggttgaaggaaaaaaaaaaaaaactcactgtacttttatttttatggatcaaaagtgagttgttctatgatttactttttgtttcacaaacagataccgttttgtttctttaatacaagtttaaaaaaaaaaatgtaatcgtcattatgatttaagtttattatttccataactgtatactgtatagtgtgttgagaaaaacatatgatataaattttagatgttttcttaaaacgagggaatttaaatcatttaatagcatatcgtaagtttaaagtcaactagaggagtgaatggcaggctaattattcttcttcttctcaacccaactcgaggaaatttagctgaattagcataaacaatacgtaaggaggaacatgatccattgattaggcaaaaagtttaggttacaaattcatacatttgcatcttacttaaaaggagcaatagaattcctagttccaaggtcaagagtcaatttacatttccattttttaaaaataattttgtttgatgttataagttataacttaagtaatagatacaaatcatggggacataaacatagatgagcttttcttatggttgaaagaaataaaaatccaaatggcgaaggatcaaatggccgactagcattgattgaattgctaaagcgagactttaccttttacattataaatcatttgatttgacctcatttgtgacttaagttatctaatagcgattttttctctatgtttttttttataataagtttttggttgaagattaagatgtagatcataattcagggaaaagatcatctaatgaaaattcatggtccaccacaagactaacaaggctgggtttgtggcttttactattggactcattatagttgatgaactttattgaatctttttcaacccaaattttgtattttataaagaagtgggtagagatcacctccaacctttacaaaagaaactgtttaacagttataaagaatgcaaaaagggaataataagagactaaaatgatgagttatggagtatggaccatgtgtgcactcgtatatctaattattgaaaacctttacacttttttttccagggatgccttaaatacaatttacccacctcatgaatcatgcttatccaaactcaaacatatccaaaaccatgtaactgatcttcaatttgttaccattttataacctcgaagtaaatgcgtatttttttgcttataatattgacaatttcaatttccttacatataatcattcatataaagaatgtgaagctcttttaaactcatggagtgttatattattttccctccaattaatcatatgtagcttgaagacaaattattatttcgtacagaattgaatgcagaatcttccggacgactgaaatagctctacttattacaaaaaaaattgtaatcaaacgaataaaaacaaatgataataagcagcacatggaaaccatttacagagtaaaatacttgtaaagcatccataaacaaaaaaaaaatccccaaaaaatggaaaacagcagagacattcgaaactatattctaaaaacaaaaaccaagaacatgcccttatttttctaaaattcaaaaacatccattatattcgatttagattccttcgagctatattggttgtgtgaaccaaaaacagaagaatatcatgtaaaagtcaaatttacaactttagctatagatgatataaatgtcttgtagcttactgattctaagaatctatctactcgtttcttcggctcactaaagaaagagagagagagagagaaaaaaagaaagtacaatttcataataataaatgaagaagaccgtaacaagaagtgtgtagtcgtattgattatagaattaaagaaactctgcaatatttttgcagagagacagagacacaaagaaagagagagagagagcatttagggagcaggaagtggagtgtttggttacgtgagctgttttctctttctctatctttaactcccttcacacctctccctctctcttcttcatatctctctctgtcacaatagtgtgatgatgcaatgaga

SEQ ID NO: 6281 - DNA, 3000 bp, Unknown
  misc_feature (1)..( 3000): cDNA_ID_1807333_gDNA_ID_1621088_Annot_ID_170554 3000 nt of promoter + ATG
aatctttcccgaaattggtgttcacagttcccatcctagaagagctcatttcagcagcagcaggaacaaccttgtcactggcatttggcttagctgataccatgcccattagctcagcaagaacctgctttgggttctctgcttgttgttttaaatcctcaagctgcagaaaaaaaatgttggacattagtatgggtttagagatattttaatgaactgataggtttagtttacttgccttcttttctagatcttcagcgagaccagctaagtctccgatctcaacttctttgtctgaagcagatttatcaatgtaaggaacattggatgattgttggatgccttcatctatttcagagacggttgaggaagttgctgaaccagatgcacctttgatttcattactgagcctctccatccgagctttgcatattaacaaagctttttgacaatatggtattgcttccttaggctgacatccagtctcaagacaaatgcagatgcggaagtttctgaaacgttcaagttaagatataatccaacaactgaattgacagaaacgaaaatcaggtacaatttaagaaaccacaaggatacaattcagctgtgcgtcgactgtcgggctcaaccagtctctctaagatggataatgcattcttgtagtcagacagggaagactcaatgtcctctgcatagtaaacaacagaactcaaaaccaaccaatagctgacatgagaaaataagacaatgcaaaggtgaaaggaagaaaaaatacctctttccaaggacacttcagcaagcgaacagagtatatccactttttccattgtctcagtagactgtttgtcagtaataaccctagcaatgtccagcattttccaggccatatccaaatcagactcatcttcatcagcatcaccatcagcatcagataggtcatcatcttgacaatcttcaccatcctctccttggtctttaccaccagaacctatacatgagggagaaaagaagtcagcaaacaaagaagcagaagcatctatacccataagcttaacctaagacaattcccaataatccataccttcttgcccacttgaactcccttgtctctctgggtcacctgaaacaacagaaggagccagcgattcaccattgctggactcttgctgaacttcaccttctttcttaggcatgttcccaagtggatcagcttcagcttgagcctttgccaggagagctaatccatatcgatagtatgcgtttatacactcagcatcaagttcaccataatgtgcaaccctaaccataccattaaaacaagcaatgttttcattagatcctttgataaaaggaccagatactaaagaattcagtcgagagaacacacaattgaaactcaactaaaaattcagaaccatgattagatcattcgagcataaactagattcagaaacatctgaaaccctaaacccttgattgagaggttctcgactacaaattctcaaatgaatctcccaaaaagatacctgatttcgagagcacggctgaagcaatcgacggcttcagcgaaatcgttctctttcaaaaacacagagcctttctccgtcaattcctcagcgaactcaagcgtcttctcacgctcctcatcacaaacctcagtagcagcactgtcagcggcgttgttgttattagcgtcgttgttacaagtcgattcagtgcctccctgaacaaccgattcgacggtggcttcgattgaggctaggttaggttctagggtttgcgcaatctccgtcgccggctcggttagggtttgtatcaccgaagcttccgacgcagaagctgattcttcaaccatcgcggattgagattttttctgggtgaatttgaatttcgaagaacaaaaacgtcaaatttgttgagaagagtggaatcgtattaaaaccctctcttcgctttttttggcggacttgaaaatgaaaaccaaaattaaagaattaggggaaaaaatatttttatgttttaattaaaatattcacggtaaacactaaaatatacgaataaaaaatgcgtatgttatcccactaacggttagtctagctaaactgctccgcttttgttcaagctatttgactcatgacgcacataggccataggaaaattgttacgctgtaaaaaaatatatgaccgttgtaacggaaaagggtaattttgtcttaccgaagttgtcttaccgaaaagggaaaattgttagctaaaagtttttctattatataaaatatttttattacaaaaatgtttttaaacttaaatgttaaatttaaatactggaacggttagatttaacatcccgtcttttaggtatgtaactcgtgcgttatcataagttcaacatgttttctcatatttaaatttaattttaagattttttcaaaaataatctgttttgatattttaaagctaaaagtttattaacaaaatgttttcaaacttaaatgttgaaatttaaatacttgaaagcgtttagcatcctgttcttttagtctgtaactcctgcgtattataagttcaacatattttcacatatttaaatttagttttaaggcttttttaagaataatattgtaagtaatccgttgatttttttttttcgtcaagtaatccgttgattaaacgcaaattttaattatatatattctttttattcaaaacttaaatgttaaatttcaaagatgtacaaactaaacttgatattctgtccttagaaaaaattaccacttagctttataaatattaaagtttatcaaggtaaaaaaaaacactttaagtgtatgtggaatataaagagtgactcatttcatattattttgtaacaaagtttaaatctttgtaacaaaaagcgtgtggctctaatagcttggttagacgaagaagctactactccttcgataataacgatctgatgagtagcagttttgtcatctctctcactctctcccgacg

SEQ ID NO: 6282 - DNA, 3000 bp, Unknown
  misc_feature (1)..( 3000): cDNA_ID_2105093_gDNA_ID_1621088_Annot_ID_170553 3000 nt of promoter + ATG
ggggagccatgggatcagatgtggttagggcctggggatttgggagagaagaattgcaggaaatgagggagaatctgtcaaaaatggtatctgagctgaatcctcagtttttcgaatcttcggattcagattagttatgtcttaaaacgaatatgttgtatcatctttaaagattttttctggtttggtttgaaactttatggtcaaacccgttgttgattgacttatcttctttgtgtaagtcgcttgagagagttgatattggaggcataggagagaagcattgtcaaacaagaacaaaccgatatcaacatttatagttccaatgggattcttttgatcaatttgaaacattgctactttccgactttcctttcctgtctactttttttgtgcactatagagttagaaacaacttctatcatctgccagaagcatgatagtgatgccactctctttatccatggcttaagggatcagtaacctgatgcaccttacgagactctgagcttgagtactgtcccacggctcgggcataaggaattgattgtttcccggctgcaagcgcattcacattttcaactaaatactgtcttgggagcctcccgaccacattaccttcttcgttcccttctctatcgaggaaggcgaaatgaggaataccctcaacaccaaactcatccaactcttgctcccatttcgtgttgtccacatttagcatcacaaagttaactttgtccctgcgaaatcacaacaccacaagtaaacatcaactttagcctacaaaacgtcaaattagtgtctaaaaagctccatgttccattaaactaacatgagattaatggtttgcctctgcaactaaaatctcaaagctctacctttttcattagcgtctatctacatagccaacaatccaatcctaaagatagttccctaatccattaaaccaacacaaaataagaactcttctgcaactagaatctttaaagctctagctagttcattagctaaatccattccaagacaagattccttaatccatgtttttcgaagctctagcaatgctcatcttaatctccagacaagttccctaatccgttctgcaactagaaagctctagcttgtctttcatctatatataaaggcttcattttgaaaggagattgattttgatcaaaaatcacataaaagacgattcattacttgtattgctgctcgattttataaacatcaggagctagttctcgacaaacttcacaccaatctgcatagaactcaacaacagtcggcttcccattcgataacgcctaaatatccattcacaaaactcattaagcattctatgagaatagaaacacagatgaagaatccaaaaacaaacctcctcgtaaggcaacgcagaagcggttaaatccttcaaagaaatcccaaaatcgagccttgtcgatacaaataacgacaaagccgcgattacagtaacagccgcaactcttctattgatatccttattgggagattcagggaatcccgaagaagaagaagaagaagagtcagcaacagatgatgatgattccacttccttcgatgcagatgaagtttcaccattatctattaccaatttctcctgaatcaggtaaaggctaaaactttagctaatttgccttcgacccatttcaaaaagaatcgaaattttcacctgtttggtttcggaagattctgggtttggtttgcaacgaacagcgcgaaatcgtggagctcctgtttgggtaacgaagaaagattgaagatttcgaggactgagattgaatccatgactagatggaaggtttaaagaaaatactaagcgagccatcgtcgggagagagtgagagagatgacaaaactgctactcatcagatcgttattatcgaaggagtagtagcttcttcgtctaaccaagctattagagccacacgctttttgttacaaagatttaaactttgttacaaaataatatgaaatgagtcactctttatattccacatacacttaaagtgtttttttttaccttgataaactttaatatttataaagctaagtggtaattttttctaaggacagaatatcaagtttagtttgtacatctttgaaatttaacatttaagttttgaataaaaagaatatatataattaaaatttgcgtttaatcaacggattacttgacgaaaaaaaaaaatcaacggattacttacaatattattcttaaaaaagccttaaaactaaatttaaatatgtgaaaatatgttgaacttataatacgcaggagttacagactaaaagaacaggatgctaaacgctttcaagtatttaaatttcaacatttaagtttgaaaacattttgttaataaacttttagctttaaaatatcaaaacagattatttttgaaaaaatcttaaaattaaatttaaatatgagaaaacatgttgaacttatgataacgcacgagttacatacctaaaagacgggatgttaaatctaaccgttccagtatttaaatttaacatttaagtttaaaaacatttttgtaataaaaatattttatataatagaaaaacttttagctaacaattttcccttttcggtaagacaacttcggtaagacaaaattacccttttccgttacaacggtcatatatttttttacagcgtaacaattttcctatggcctatgtgcgtcatgagtcaaatagcttgaacaaaagcggagcagtttagctagactaaccgttagtgggataacatacgcattttttattcgtatattttagtgtttaccgtgaatattttaattaaaacataaaaatattttttcccctaattctttaattttggttttcattttcaagtccgccaaaaaaagcgaagagagggttttaatacgattccactcttctcaacaaatttgacgtttttgttcttcgaaattcaaattcacccagaaaaaatctcaatccgcgatg

SEQ ID NO: 6283 - DNA, 3000 bp, Unknown
  misc_feature (1)..( 3000): cDNA_ID_1814035_gDNA_ID_1621088_Annot_ID_170552 3000 nt of promoter + ATG
cttgaacaaaagcggagcagtttagctagactaaccgttagtgggataacatacgcattttttattcgtatattttagtgtttaccgtgaatattttaattaaaacataaaaatattttttcccctaattctttaattttggttttcattttcaagtccgccaaaaaaagcgaagagagggttttaatacgattccactcttctcaacaaatttgacgtttttgttcttcgaaattcaaattcacccagaaaaaatctcaatccgcgatggttgaagaatcagcttctgcgtcggaagcttcggtgatacaaaccctaaccgagccggcgacggagattgcgcaaaccctagaacctaacctagcctcaatcgaagccaccgtcgaatcggttgttcagggaggcactgaatcgacttgtaacaacgacgctaataacaacaacgccgctgacagtgctgctactgaggtttgtgatgaggagcgtgagaagacgcttgagttcgctgaggaattgacggagaaaggctctgtgtttttgaaagagaacgatttcgctgaagccgtcgattgcttcagccgtgctctcgaaatcaggtatctttttgggagattcatttgagaatttgtagtcgagaacctctcaatcaagggtttagggtttcagatgtttctgaatctagtttatgctcgaatgatctaatcatggttctgaatttttagttgagtttcaattgtgtgttctctcgactgaattctttagtatctggtccttttatcaaaggatctaatgaaaacattgcttgttttaatggtatggttagggttgcacattatggtgaacttgatgctgagtgtataaacgcatactatcgatatggattagctctcctggcaaaggctcaagctgaagctgatccacttgggaacatgcctaagaaagaaggtgaagttcagcaagagtccagcaatggtgaatcgctggctccttctgttgtttcaggtgacccagagagacaagggagttcaagtgggcaagaaggtatggattattgggaattgtcttaggttaagcttatgggtatagatgcttctgcttctttgtttgctgacttcttttctccctcatgtataggttctggtggtaaagaccaaggagaggatggtgaagattgtcaagatgatgacctatctgatgctgatggtgatgctgatgaagatgagtctgatttggatatggcctggaaaatgctggacattgctagggttattactgacaaacagtctactgagacaatggaaaaagtggatatactctgttcgcttgctgaagtgtccttggaaagaggtattttttcttcctttcacctttgcattgtcttattttctcatgtcagctattggttggttttgagttctgttgtttactatgcagaggacattgagtcttccctgtctgactacaagaatgcattatccatcttagagagactggttgagcccgacagtcgacgcacagctgaattgtatccttgtggtttcttaaattgtacctgattttcgtttctgtcaattcagttgttggattatatcttaacttgaacgtttcagaaacttccgcatctgcatttgtcttgagactggatgtcagcctaaggaagcaataccatattgtcaaaaagctttgttaatatgcaaagctcggatggagaggctcagtaatgaaatcaaaggtgcatctggttcagcaacttcctcaaccgtctctgaaatagatgaaggcatccaacaatcatccaatgttccttacattgataaatctgcttcagacaaagaagttgagatcggagacttagctggtctcgctgaagatctagaaaagaaggcaagtaaactaaacctatcagttcattaaaatatctctaaacccatactaatgtccaacattttttttctgcagcttgaggatttaaaacaacaagcagagaacccaaagcaggttcttgctgagctaatgggcatggtatcagctaagccaaatgccagtgacaaggttgttcctgctgctgctgaaatgagctcttctaggatgggaactgtgaacaccaatttcgggaaagatttagagtcgcctacagtctcaaccgctcataccggtgcagcaggaggaggagcagcatcaggtgttactcacttgggtgttgttggaagaggagtgaagagagttttgatgaatacaacctcgattgaatcaagtgcatcaaagaaaccagctctagagttttcagacaaagcagatggcaactcctcttgaaaccggaaaaaggtataaaaattcctgttactagtgaagtatctaacctaagaaaactgagaaaaacatttggtatcttcctcatgaatcttccaagactagattttcaggttcatgttttgtaatggagtccgtacttgctacttttttaaatcgctgagatattttttactttttattcttgtttaatcagtcttattttttcaaagtgttttttagtttaggcacaaaagcagaatcttattatcacattatcagttgataatcatctgatgagaaatagttctttggagatcttttagggaattttataagtaataattaagggataattggatatcctttattaaaaaatgtaggctacttgtagaattaaaaactggaatcttataatatgattagtataataagattacgctatatctggattctggagatatcatagataagctctgtctatgaaaacgagacccttggggaagccacgtgtcaaatctatctctgtcaccagcgaagcctacgtggcgagcagctcctagaatatccaaattcacaacagtatttttttttctttcgttctgattcaacagttgtcacaaacagccaaggtgttttgtgattggttataaatactctgctatgtgagagagtttactacattcacaaacaaactaaaacttaaaaatg

SEQ ID NO: 6284 - DNA, 3000 bp, Unknown
  misc_feature (1)..( 3000): cDNA_ID_2155693_gDNA_ID_1621088_Annot_ID_170550 3000 nt of promoter + ATG
tctgctatgtgagagagtttactacattcacaaacaaactaaaacttaaaaatgggaaggggtgagtttttggccatgaagactgaggagaacgcggctaacctgatcaattccgatatgaatgagttcgtcgccgctgcaaagaagctcgtgaaagacgtagggatgctcggcggggtaggttttggcacgtcagtcctccaatgggccgcttcaatcttcgctatgtgagccaaaagacaaaaccatataacctctctggtttttgtttgaatcatatattgatatgatggttcttattgttttgctttgacagttatctgttgatattggatcgtaccaactggaaaaccaaaatgttgaccacccttttagtaccatacatctttttcacacttccttcggttatcttccagttctttaggtaatcaagaaaaactgttctttaacatgatgttatggagttcttttgaaaatataatccatattcgatataatttcacagcggagactttgggaaatggattgctctcatcgcgatcatagtcaggcttttcttccctaaagaatttccaggtcagaaccagcagttttcatgacttaacattagtttgaaactttgatcttgaaaatcttctttcttttttgcatataaatgtagagtggctagagattccggtagcattgattcttattgtggtggtgtcgccgagccttatagcttggacactaagagaaagctgggttggagcagtcatatgtctagtaatagcatgttaccttttccatgaacacattaaagcttcaggtggattcaaaaactcttttactcaaaagaatggaatctccaataccattgggatcgttgccctcctcgtttacccggtttggaccatcttctttcacatcttttaagtcaatccgacccattggtttgtagacacattcaacattttgtgtcttcaattcgttttcaaggtttgaattttataaggagcatttgtgtttgagaaagtcttgaatataaaaaagaagtttcaatcgtgcactgctgacttgtaagattgttttttttttcttgtaaatgtgtgacttgtaagatatataaataaatttgcatattggttgatttgttgaatcaatcttgaatattgtagactttttaattgatcatgactaatagttgttttttgaaaattgtttttcatttcattaacaccaaacaataaagcaacacaaatttctatcacctcctagcattgaactacgtgccgttgttcgtatccaaaagtgtatattcttgtaatcattcaccgtcaaagctcaagtagttagtagcaccacaccagatttccaaagcacaaagctcatgactagccttacctacacactcgatgaaatcgaaggccctttcgaagttgattacgcagcagtgacagtacacaacttcctggtggggagcgtgtaccgttcttgttcacgatcaagcagctcgtggcatcgcagaggatactttggtcccaagtcgatcccttcagcattcacccaaggccacgttggaaataaatctgatcgtaaaacacaacatctgcagattattatcaataaaaattcagaaatcaataaaattcactctgaaaacgcagaaaatctaaggtaaattcataacgaccttttgaatttctagtgtcgaagctgtattgaagaagaagaagaagattccgaagctaacaaaggagaagacgagagtggattgattgctcctctctcctctctgatgatattcgtgcttctacactcacagagatacactgtttattattgttttcaatatatgagaggaggagcttccctactatttttagttttttagccaatgagagagctccacttcataccccacttttaccaatcgtgcgatttcacagccactctcacccatgtcgcgttgagcgcgtgtctacgatttctaaaggggttattaatccacaaaatttatgcctttttgaatccacgcacctcgttcttaaaaacccatcgcgtgtcttatttgttttggttttcttctctaaaccaaattaaaccgaaccgagatcaatttgaatttcgaaaccaatgtaaacccatcgctgtgaaaacaaaaagctcggccacaaaaatggagacgacacaacttggaagagaaatcaactcgaaatagccaagagaatgttcgtaaaccccctcaaatccgatgcttcctttgattccaacctccaaaagcccatctgctcaaatccgaggagtattacaaggtacctctatagaatatcaaggctatgacaatgcggttgcattacctgctagaggaaacaatgaggagctagctaaggagaacaacaagatcacacttagtgtaacaaagagtaatcccgagagcggtgaagtgattggtgctttcgagagtattcaaccttcagacactgatttgggtgctacgactcctaaggatgtcaagattcaaggaatctggtattgccaacttgatgaataaaacatagagaatctgtttgttttctttttctgtaaatgttgttatgattaaggaatattgattccagttcatagtacatgtggtactccatttggtaacactttgcacttttggctttaatcagatactaattattgtgattaaaagactaattattgcggattaagataacatatttgtagatctgtataattgcttgtaacagcaaagatgatttctggttaagaagtaagaagagatttataattaagcaaaccatttgccttatgaccccattgttgtcacatccactttgtcttttcaccttccctgtctcaaaaaacagaggacccttgctctgtttcttaaccctgttttatctcctactcaaagttcaaatcttttgcgaaacccagtaatggaagatcaaagcaggtgaaaatgaggagaactagagacgttaacaagggctcttgttcaaggagatg

SEQ ID NO: 6285 - DNA, 3000 bp, Unknown; identical to SEQ ID NO: 6280
  misc_feature (1)..( 3000): cDNA_ID_1814041_gDNA_ID_1621088_Annot_ID_170546 3000 nt of promoter + ATG

SEQ ID NO: 6286 - DNA, 3000 bp, Unknown; identical to SEQ ID NO: 6278
  misc_feature (1)..( 3000): cDNA_ID_3093606_gDNA_ID_1621088_Annot_ID_170541 3000 nt of promoter + ATG

SEQ ID NO: 6287 - DNA, 3000 bp, Unknown
  misc_feature (1)..( 3000): cDNA_ID_4254989_gDNA_ID_1621088_Annot_ID_170538 3000 nt of promoter + ATG
gtcacactcacatatatcgttagccggtttagatttggttttcgtaagtatattatggtatattgttggtttcagattgaatttgtttactttattttactttactagaaaatgtacatctctagctttggtttcgtttcaactttcagccaaattttttatatatagaaaataaatttaaaatcagataacttgaattttttttaaaaatttggttagggtttctggttcggttaaaccagctgatttaaggagtgacataagctaaattgactatgagtcggatctcatgtgtttgttttataatattgttagatacaccaaacctaatcatcaatgcttcaaaagttcaaacactttggtgttatttttcttgcacgaccaaaaatagttccttctcacgtgatttttcttgcaaaaaacattgaacaaccaaactttatactactcaaaattcaacatccaaattttagtttttgttaggtagaaataagaaatctatcctatgaaaagacaaaaccattaatttttatttcaactcttgctgctatatgacgttgaattatgataatttttccgtctcaagttcataaacgatttttcaaacagagttgtgatgaaatttatttattttctaaaaaaaaaggaagattgatagttttgaagaatatattattgatggtagccaaataatttaccggaataaagtgtaatatcatctcaaactgttcctttttatagcaaaatcgctcctttttatccgcagttagagtataagacaaagaaaccaaattccagagcatcaggaaactctttcccatattttaaggtgaaatcactattttgaaattattaacttagtttaataaccaattattgaataatacaaacaaagtacttaaaacccggtttaatgttttatttcgattttataaatattggtttggccaaaataatatagtttataagtggcgtaagaccacgccagaataatacaagaagaaaaaatgtttaactatgtatagttcggacgtggtagtccattaataatggaatcaaattctgcattaataaattcattatcaagattccagtcttttgtattccttccaattacatgaaattaatataattcttgaacaaatatctttggacaaaagaatttcaattatttacttaaatctatataaaagcaaatctttaatccattcaaatagcagatatgtatctctagggattaaggtagtatacaactataacatctcaaaagaaccaaattgtgactgcacaatgcaatatcataatttgtatatcgaaaacatgatatgttcacatggttcgtccataaacagtacttatattcatatttgaccactaaatatttcacattaaaaaatcgaaattagaaataattatggatttagttctgcaaactcgattttttttaaaaaagattcgaagatgcaagattgataatgaaataaaattgagggtacatcatacatgtgggggaagtgacgtttaaaaacaaaaaggaaaaagaggaagaagatagatgccaatattgttatcatgacaactatgaagcagagttagagtccgtccgtccatacaagtattttgtgtgagtaccaccgaatttgtctgtctatgttatctcccttctttttctcatgcccacgaaccaacatgacaattatgttttgttcgttttttgaaaaattctagagttttcatttattaattatcgttgagttatgatttagtatgattttggtttaaaaattccacttcttaggactcattgtttgatctttgtgtttcttatttatttctttgcacagtactaaaaatcatgcattagttcttaccattcacaaatcttcaaaacttaattagaaaaagaaaaaaaaaaatcgatcaatacaatgaaaacgttctcctatgcactatgcagaacaagtctcgaggattcgtatggtcaaatttattccgatcaaattattcgcgaaagtgtgagaaacaaatacgtactttatttctcttacctcctcctacgtcacttctacgcattcgtgccctaccttcatcagtactcttccagtttctaaaggttaaaaccgagtcgatgatccacgaccgtagagttaaatcaagtaatcaacttaagtcattgtaataagaaagcctccgctcaaaaaaaattctacaatattagtttgacataaaacttcaaatgatagaaatatgaaatcaaatagttgtagacttgtagtctagtactttcatttggctcatttggcaattgcaaagtttacgtggtgattactaaactccttgtcggtataaatgtttttgatcatgaaaccatataccgaaaatattggtatatatagtcctgcctaactccactaacaaaaagtcaggatttttaaattaccaactacaacttgaattgtcatttggaagattgattcattggaatattgtgtatcttaagccataaacaaatcccataatttaatagtgtgccagaattttgtattcatattttaagcagtaaaaacaaaaacaaaatacatatatatattctcaatcaaactataatactttagatttaaagctattaagaaaaacatttagctagtcaaaaaaaacaattaacacttttcgaaaggtccatttccaaggaagctagagaccgtccttttttactaattcgcctgcaccatccccttgtatcgagggtctaattctacaccttattccattttatattccctaacaatttttttagtttttttttttatattactttaattctaatgaaaactcctatcttccttcctctccatcctttttcatctacctttgaatcttttgacacttgtatataaagctttacttcctcctttgttactccttttctatcaatcaccaaaacacattcattgtcttaaaccctaaacctcaagaaccgaacaaccacaccaaaaaatg

SEQ ID NO: 6288 - DNA, 3000 bp, Unknown; identical to SEQ ID NO: 6275
  misc_feature (1)..( 3000): cDNA_ID_3072305_gDNA_ID_1621088_Annot_ID_170537 3000 nt of promoter + ATG

SEQ ID NO: 6289 - DNA, 3000 bp, Unknown
  misc_feature (1)..( 3000): cDNA_ID_1813961_gDNA_ID_1621088_Annot_ID_170591 3000 nt of promoter + ATG
accttctcacaagttcatatttttgtgaatatattatatttgattttttcttatatccattatgacacatccaacatgatgcaagtggactactaccggaggacttagatagctaagattggttagaagctactggtgactttcgaaaaataaaaaatctttgagatgaagacattggaaaagatacttcgtgagaaagaaatgtgaagaaagttgataaaacaaacaaaacagaatcatagaaaaaaacagaggaatttaaagggagagacaaagactgcaaacagatttataactgaaataatggaggaagataaggcggttttgtcagaagatcacatgtcttctttaaccacttttttccttttttcgttttttttttctttttcttactaatttattgtcgtcgtaacaatgggttcgtgtcctttgaccattttacaattcatatcggtatgagtcggtttcttcggattaggttttttgaattcttaaggaagaatcaaccaagccataaatgttcccatgcttcgtgcgtagcttagctagcttcccatacaaaatgatatcccaaattgaacagaactataaagaaacagaaacggtcacacctttttcctctaaacgaaacggtcacctttagttgtcacatgtcagaaacacgagcgagacacttttgtttctttaaccttatcaaaagccacttccgtttgaaacttggttaaagacacctctttgcctcccatttcctccaatcccaatttttctcttcttttcaagtttcaaaaaatatgaatgaatcacttatatatcaagtatatgaaaaattccaacggtcaggatggggcgccgcctcatgaccaaagaagctgccgtgaaatgggaacatctcatccacccatcattcaagattccattctctttcttatttcttctatgaatcttcttcatagagatctacagccaaaaatgaattatttcagacgtgaacttattaaaccagactacagtttcttggaaactgttgtaacgttttgatttcagaagttctcagacatctatacctagttaaactcttcacaaaccaatgtcaatatgcttgcatgtatttggattaaacttttcgacttactaaactcctctgaataaataaataaaaaagtttaacaaaaaaaaaactcctatgaatatacatgcgtatataatgtgaataattcgacgtaaataaatgagatcactaagaagatactcgtaaatattttcaagtgacatcattctgttttaatggtattcaagttcccatgtgtatggttagtagccaataaacgtttgcctgattgactggaatcaacatatcagagggaacaataactacataaggcgtaagccatgacagctttttttgaatatttgtatgtgaattttgattgggttcaaaaagatcaaattagattgcgcgaccatgaaaaataaaatcattttaaattatttgaaataacaacgcaaagctgttggggggagagcaaaaaaaaaagggggtttaatataccacaatcaatatcgttttgctaaaactcaaaatgagagtgtttgtacgtattatacgctatatcttctacaataagatagttatgtacgtcagatatgaataaatatgcgatttttaatgaatacgcaaattaaatctctcgtgatatgctgatgtaaacaacaaaccacggaaaagtaaaaggaacaaaccatcttataatgtgcattttaatatgtatgaaaaagtattacagtataaaagataattcagtcaaaaagttagaagagaatagtaaactatttgaattacaagcgaatagtttgaccccacacaaatcttcgaagtttgatcgagttatttttttggtgaaatatatactcgcaagggaaggggaatttgtttcttggtcgactatctcacgaatctgcttagacgacatgtgctttattctaagttgttatgttgtattccatacaatcagaatggttgatatttaatccactttcttataatattcttttgcctaaattcttttatgtgcatatgaactaatttaggaaataagacgtttatatttgttgatcaagtaaaaaaaggtaaactgaataatgaataatattcaaacgaaagtgtgaagactgaaatcgatttttcaatgacatattattagtatcagataatcagataaatggtacgtaatatatataagtatgttatgtttttcttgattctatttttattagtgcgtcaaggtatttgttggcgttggaatcgttggatcatggatggcaaaaaccgtttaaatgtacatatgaactttacacagtataattcataaatactatttacaagtaaaattagtgtacaaattaaaggttaatcatgtgtaaaactaaaactttaagtacttttaagactcaataatttaacttggttgagacttactttcctctggagccgacgtccaacattgaaacgaaaacaaaatctcttctactcttctaccatagctttgatgcatgtgaggatgaaatgcaagtaaacaattagtgatataaggttaggacagaaatttaagatatactaaaactcgttttggagaaattgtagatccataagatgcattataatctcgaaatatattatttagttttaaaactaataaaaacagataaatatctcccgttatatagtattttgtgcaatatataatgttctttaatgaaaaatttgatgatgttatagataaataatgggaaataaaaagtattcaaatttcggattaaaaaatccatcgaaccgtccaccatcttgcatgtccatcattcccatttatttgtaatagaaaagtataccaacttgaaatattaaataccaaattttttgttataaatagtcccacagttttctcatcctccagaaaaacaaatcatcccaagtaatcctaactatacaaaacacataacaat

SEQ ID NO: 6290 - DNA, 3000 bp, Unknown
  misc_feature (1)..( 3000): cDNA_ID_1383434_gDNA_ID_1621088_Annot_ID_170588 3000 nt of promoter + ATG
ttcgactcgagtaataatggccaaaatatgaaagtaaattagaaagaaaaaaaaagactcaatttaaaaaagaaaagcaagagagaagaatgttttaagatttttcaaaatgaagttttaagttacaaggcttaacttatcaaagaaaaagataaactgtcgaattagagacatatgattaagaatttggatgatgatatttatatatgtgttagtacaaagcggatttacgatatggcttggggacaaatgaatactcagggttaaattattgagaagggaaaaaatctaaaggagatgacaaaaaagggacaaaggggaacacgttaatgtacaaatatagtaaggagtcaggaacttaggtacgatgtccatacgttttgcggtccaaagactttccatttttgtaaatctttgaaattaaccccacttggttcccaaacatccttcgacaccgacgacacacacaaacacaatttatttcttttaattaagttttactttttaaccttttttggtactatatatcgaaaccacacccaaattttagtacggtcccatttgcaataattcacgttagttaatggagggaccaacgaattattccgacttttcaagttttcatcaatatgggaatcatttccatttttcactttaatttctgctttaaaattgtttcgatgtttcagacaaaataaattaatttataagatgatggacgataggtcgggcctaactgaggcttaggtaagagatacattatgattcttcggtttcaagcttgaagaaaatatctcattatggttagttgacaagaaaacgacagcgtttgatataccattttattttttagagtacatattattatagtatgaaagcaccaaagactatatagtctaatttttagttgatctatagattttttaaaaagtttgcagtcaaaactgttgatatcggaaataagataacacacgaaaccccgaacgttagtcatgggaatctattatcaccaaagtaaaagatggaatgaagtttagtcggaatgatagacactgagacacccaacgatggtattataatagattaagaccttgaatgttttgtacattttgtaagagtttttgggttttgtttttcaaaaacttattttcataccaatcaagattttaaaattttggtttctctatagtttagaaaaactattttgttgtaatttttcattcctcattttagttttttttgttctcttaaaattttgaaaatctagtttatactcaatcaacgttatttttttcaaaaccaaaaatcatttttttgaaattttttaaacaaaaatataattacaaaaatctaaaactaaaatctaaaatctaaatccaaaaactgaatcgaaaatcaacctccattcagggcctaaattgtcctcttacaatacatttttctttccatatgtgatatcataacggataggtaaaaatgaataaaataaaaactttggtaaatggtaacaaaatatcatcaaaattttaccatttaccataccccaaaaagcaacatagcaattaaaaaacaacaaactatcatcaaaggcattataagagaaccctttgagtacaatgaaaggttcttgaatattgaatgcacgaatcaaaaggacaaaatgctaagtctatgtaatttttatgtatttacatttaagtttgaaaacatatcgttaataaaagtattttgtatgataaaaaacttttagataaaaaatataatagcgatttacttaaaactttgaaaaagtttaaaattaaatttaaatacgtgaaaatatgatgaacttatgacaccacaatacttacggaccaaaaggacgggatgctaagtctaaccattttcacgtatttaaatttaacatttaaatttgaaaatattttttattttacaatattaattaccaaacagcttttatttattttgaaactgaaaatttaaaacaaaattattatttttagtaaaatcaattgttatctataacgttaattaataaagaaaccaaaaaaaatatttttaaaaaaaagaaattaagaaaggaacatacctcgtgaaatagggagacgtttgtcatcagggattgttgtttgctaaaaagcccatacgctgttttgcgaagcccatatcatattgggccaagattgcaaattgtagatgagagatctgagtcatcttcatcttctctcctagggcgagtccttaacggtctgattctgagtcattgaaactccaaacctactcgtcggttgttgatgagagtttctttgcgcttttcagaaagaaaagacaggtccgcataagatgcatccatggttggctagaaatcaacatcgattgatcaaacacgagagaccactccaagtggcgttggtatggatatgatctctaaccagtaaccttgtcggattaatcctccatgattgatcagagattgtgaaatattagagagacctctctcgacatggcgttggtaaagatcggcgacgtatatggatcatcaatttcacggtttcgaaatcgacgatcgtctttgtaaaacagtagcagagaaaagaagaattttgtttttttgtctcttaaagaaaaattatgatttcccaacacaagacagatgaatatttataaggaaaggctcacgcaaagaaaaaaaggaaacatcaggttgttttccttttttcatatttggaccttaacaaaaaaggaaattgaatcgcacaattaaggagcgtttacaacggtcttatttttctaatctcaatttgcagatttcgttaaaaggccacgtgttcgatttttttttaacgcataaattgtattgtaattccaaaactacatcgttttgaggtttagccattaaagtcacagtcacactttcgcttttcccaatacgaacaagcggtgacgcatatctcctgtatcatcactcttttacttccggcgatctctctccgacggcca

SEQ ID NO: 6291 - DNA, 3000 bp, Unknown
  misc_feature (1)..( 3000): cDNA_ID_1807542_gDNA_ID_1621088_Annot_ID_170586 3000 nt of promoter + ATG
tgttattgcatcatcccactcaaaatatgtacaacgtgtcatgtaaaaagcttttgaggagcttagatttttagatttcattgaaagtttcactgatttttcttattttattttcacattcatatcgtcctactctattttcctctaattatttttttgtttcctacatcaactaatttgatgtttaattacatttgaaacatatcttatgttcattgaaaattatttaagattttgaccgacatatgggattagtaaaatatatcagcagctttagttatgatatgataaatccactacatggaaatatttgatgagtttggaatacactgaaaaaagacacagaattcttcaattcctcattcattcctttagaataaatcattgcaataaactccaaaaaaaactcgatggtaaaatcacaaagtggatagtgacgtggcaacctcaaaaattttggtttcaatttttttgttagcccatctttcttcttggacccaacaaatacacgaaaataaaattattcatgtttccctttccgacacaagtccatctccttcatctttcattcgattatttttgtggagatttttcagttagtaatagttttaatatctataaagattaaaaaaatattatggtgatgtaaaggatgacgaatttgctcacaaacaaataaaatacgaatctaacaatccaaatcttataattatataaaacaccaaaatgtaataacagttggctccagcattctagtcagaaaccaaacgtcatctcgagtcgtatctcgtgttcctcacgcgcgtttataagaaagggtgataaacacgcgggttttagagcgcctgaagatgaaaatacgaggtatagagagaaacgaaaggttattggtggatggaagagggaaaaagtggaccccatagtttgtccgtactaaaggattgatcttttctggtaacattttcctttttctctcataattcctttttccttttttcgatacctcttcctctctctaataacaaatcaacgtttttttgttttttgagtatttacgtttatatcctcgtagtcctctcatattttcagattaacctcaagggttttatatgggccactcattcttatgtaatctctccctttcttaatcgattttttaaatcttttactgggcattaccgatcaagcccgattataataaacccaaatagaataattagtaatctggtttggtgtatatttcaaattagaacaaacaaaaacaaaaagcaaaaagtttcattaaaccgaaccaaatggttgtaaatcataagaattgaatgcctaacctaaagcaaagcaatgcctcattttgcaccaaattagatggaaactagcttatgatatctcaaaattagtttgttcctagcaagttgatgaagcaacttgtgagctatttccactacgatttcgttctcttgagtgttttggttgtaattaattttgattaggtctaaaatcttcgtgtcacatgttctgcatgtacaactgtatttttcttgagaaaaaaagccattgcacaaacttcagttcaaaacattttgtgtttcttctatcaattattactatatagaaaaagtttctctcttgatatttgagtttaaaatctggtaatcatcaatgaatattgtcaacagttgttaaaatcagcaactttactaaatatgaacagagaatgcaaatggtggaagtttcacattatattggcaagtgtagaaaaatgtctgaaagtatatgggcgactgggagttatcattcattaagaaaacaaagaaatctagatcgttaaattctacggttaagaaagactttttattatggtaaagaaaaatagtcaaataaccaaagtaagcaattaatatagtttgatcaatgagttcaaaagcctttggttggaataactcattaagaaaacagatagtttaaaatcaattgaattatgatttcagacatagtataagtttgggcaaagtattttaatggaaatagaatacaaacttgataacaagttattgccatttagaaaatgttataactccttatatagtgagaaccctattgcttgcttgtgttcaaggaattgctgtttatggaactccactttaaataaacatataaataatctatttagtatcaaaaacttaatatcccatctactttgaatttgcccgatcatgaaaacacctatttattgtacataaatatacatctttaacaaatatagatctatgcgtgatctatttgtatttgtatcttattaccttttattcatatagaaaaaggaaaaaacaaacaaaaagctttgttccaagagtttaaagtatatcaaaattggcaaaattgtggggttttgaagtaatctactagattattcattttcttgcaaaaaacacctttttatagaattgcttaccgaaccaagccgtggacttcactttcttaaaacatgaaattacatattaaaggaatcttttgattaatcaaagaagatgtttgtatacatagataataaatgaaagtggaaatatttttttaaaataaaaataaaaaaaataaagaaactccaatacgaggaattgtttcgaatataatcttttttccaaagaaagcaagtggttagagagagaataatattattttattaaatttttacaaaaaaaacagtgacaagagaagagagagagagaaagggcagtggaagtaaatataaaggaaaggataaaaatgaaagctttcgtagaagcaatctatcaaatttttattttattttcttctctctctctctttagctcttttttttttgttttcattaaagtttttattttattttctaccaaccaaaagcttttctctttggtttctcttatttagcttctaaccttgaggagaatcataccagaggattgaagtttgaaccttcaaagatcaaaatcaagaaaccaaaaaaaaacaaaaaaaatg

SEQ ID NO: 6292 - DNA, 3000 bp, Unknown
  misc_feature (1)..( 3000): cDNA_ID_3093527_gDNA_ID_1621088_Annot_ID_170583 3000 nt of promoter + ATG
tttacgactagtttgaaaaaccgtgagctgacacaagctcattgctaatgctacagtaacagctaccttcacttttaactaaatgacagaccaatcattttaacctctgttttcttagctggcgcgtgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggttttttctcaatctctgttttttatcttttgcatgttttaaaagttgattctttgtctctttcccgagaaaatgtttctacagagatttctctttaacggatctgtactttattttcccccttaaaatccgcaatttttttggttgtgattttgagtgaagttttgtcatttgtgagtgtaataatgaatgcacaccgagtgtttgataatttgcttcaatgaaaatacaggaaggaggagaagctgtagttgatgaagctccctcttccaagtcaggtccttcttctcgtagttcatctaaaagatgcagagctgctgaagttcataatctctctgagaaggtttggtttagagtctctcccaaaagtagaaactttcttatttgagatttatgtttatctttcttgtaacagaggaggagaagtagaattaatgaaaaaatgaaagctttacaaagtctcatccctaattcaaataaggtaatgatactatatatagagagacatctacatgaatcattctattttctgtagattctttttgtgtctgattattgcaatgtgtttattggggaagacggataaggcttcaatgcttgatgaagccattgagtatctgaaacagcttcagctccaagttcaggtcactaaagataccttatgtttatcattataaccaaaatcctaaaaccagtctatattctgacataagtctttttttgttctgatatttgcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggtgcgtagttgaattacacatttttcattctataaccataaagctagtttgcttactaatttttttttgttacttaaggagatgagtcgggaaggtgggttaactcatccaaggttgaacattggtcattccaacgcaaacataaccggtaaagtcttgttgttttggaatcctaaggaagttttaggacatttacaatgttaataacgttacgatatttggggatttgcaggggaacaagctctgtttgatggacaacctgacctaaaagatcgaattacttgaacagtgtcccaacttcgggatctctatgtgttcttgtttcttagaacgcaagccataaagctgtctgacaatggagatgcatttaactgtctttattttttctaaggttctatttaaaatcaattgttggtgacacgaattctagagtctaatcttttggatctaatagctatatataaaaaggactgaaattttattacaaagtaattgactaattgttagattgttgtatgtttatggtggatgtaaattttctagatcatcttcgtattgtatttgagagtttgatactcgatggctttggatatgtaaattaccccgataagcttctagagaagttttcgattctacaagatggatttggtatctttaaggttgaccatgttcttttggtatctcttgttctcaaattgatcatttacaatacaattttttaaaatcttttacccttcacatttttgtacttacatttggtatattagtaatttcatttgtaagtgtcttttaaaagtttttcatttataagtgttgttttaagatcttttatgataattaaaaaatgcttaaatatcttattaacccttaattagtatacttatagctttagttctccaattaatctttagtaagtaaaagggacagagctagaactttatttaaaattggattgaaaatacataaatcttatatttttttcaaaaactagtattgaacatacaatttatttattttattttatttgtaaaacaacaataaaagtaaaatcatacaacgatatattttgaaaaaaggaaaagtaattaggattctctttcggtgaaaatatcagagaacaaaatatatttgaatgcgactgtagttgaaacttgaaaaaaatttagatactaaagtttcgtcattctctttttgttaaagactcagtgacgaccctctcctaaaaaacactcataaataaactcgctggagacgccggaaccaaaaacagagttctaatg

SEQ ID NO: 6293 - DNA, 3000 bp, Unknown
  misc_feature (1)..( 3000): cDNA_ID_1808519_gDNA_ID_1621088_Annot_ID_170579 3000 nt of promoter + ATG
taagaaagactctgcaacagaaacggctaagaaacgagaacaggagcgacaaaggctggagaaactagcggaaacaagccggttaagtcggaataggcagcgcagccgtagtaggagtattagtcgatcaccaccaccgaggttgttaataaagttatcatttttgcttcgtgattaaaatggggggatttgtgaagatgagaaggaagttttcggttctagagctctgattggatccgctctcttgatattcactaacacagttgtcatctctccttctcccgtttgattttctttactaaaatgttttgtctacagaagacacaggcgaagcagaagcagaagcggaagcaggagcaggagatcacgcaggcacagttcaaggtcacggtctaggtccccatctaggtcgttatcacgctctccgaaacgtcacgcagacgctctccatcttattcgaggtctcccaggtaagaacagatggaaagcattacatgtacgtcgaaaatggtgtctttgactctttgctttacctttgcctatataacatattgagttgttgtgtttgcaggcgaagaagcagcaggtcaaggcactgaagagaggaaactctaattgttgcggcagctttttttgttgcctctgttcattttttttttttttctgtgtgttttcgtatccttacgattcagtggtaaaatatggttttgtgggtttacatgggataataacaacgttttcatatgatgttttagaaatttataagatgttataaaaaaataattattttagtagttgaatgtgaagttttatggttagctttgtttgttggattagttaacaaatgtgtgtgtttgtcgtctctgtgtgagacgcagcgtaaccatctccatgcgttgcatcgttcgtgaaagtaaaacctttcataaagtttctaactttgaataatcatccgcaatctttataagatattttcagctaattggaattgcaaatacacaatttcaaaagtcttggttctttccaagaaataatttgttatagagagattgtcatactttacaactacatttagaaaaaatagttaaggctggtcccataaaaacaacttgcttaaccatgttatttgcaaaaacaaacttttataatctccatagtatagatttcactcaatttaagtaagaagaagaccatgaatatcaagcttggggcttgaattctcgcgaaaaggaagcatttaaatggttataacaacaatggaaacaaaaaacgtgacattagttgaaaaatctatttctctgatgtctatatgtatattcttcattttcttcttgtgatgaatatatagataaggacgatttggatgaaggagaataaaaaaaatcaaacgttgaatgtggtaggagcggagtcactataattcatgcgtcaatattgaatattggatacatgacatggtttccattaattggacccattctctgattttttggtctgtttattgaagcagaattatttattattattgttataattgatgcctttgttttgttcgaaaaatcaatgctacattaaataataagagagactagtgtgtgttgtcgtgtgtgtgcttgaccatccccatgcgttagttagataacgtgattataactccgtattactttaaactatactaacaatttgaaattttgtaacttcatctataatccacattctgatgagattttccagctctttggaattgttaagtactaaaagccaaaagtcatgctaaaacaaatcatttcaatgaaattctaaaacaaattgtattttctctcgttaatcaaatttattaaatgagattaaaacggacacctagggtttacaataccatcgatcaataagaatcgacagttaacacttaatccaataaagttggaatacgtagttctttaattaaatagatgtccatttatagatgatacaatattcctttatttgaaataactcccaattgattgtctattaaattttatatcttacccaatggaaatactatgaaagagagtgttaatagcctatagagtgctagctctcaataccatttgttcatctctcaaccatactagtatttttctgcatttaattaagaggtaaataaagtaattttcctcaatttcactgtatattctaggaaattgtttgactaataaaattgaataatttcattgaataatctcataattgtctagctaccaatgagaagtactagtaaagagcggaaactacatagcagaaagagtcttagggtctacgatcctagctttttaggcctgcagaagctaacagttacaaatatctgtaaaaataacctcaaagtgaaaaggaaagaggaaaaaaagcagaagctagttaagagaaacgacaaaagagtctgaatttatcgaaagaacaaaaagagcagaaaaatgtcacatggcaatagtcgtggcttctgtaataacggtacagagtaatcggatgaagaaaattaccaaaaacaaacaaagagaaagctctaacgtcagttaaatctgtttcttttcaccaattttttttttttttctctctcacaatttcatgaagaaaaaaataagattaacacattgaagagcgtgtaaaagaagaaactggtaaattgcattatcccaattcccaaatagagatttgtttggcttttcctctatttttcattattcggacaagccacgacacttgtcttaatgccaccaaaaaaaaaaaaaaaatcactcacatcatctctcttccctcaaagttctcaccttttgagattattacaaagaacacaaaagtacagtttctttattcccttttttgaacactttaaacatcatcactcttgaaacacttcaaatctccggtcaacaaaaaccatgacttcaatttcttaaacaaaaagtttcaatctttttccaaacaaaacccatttcagattttgttctttgagaaaccaac

SEQ ID NO: 6294 - DNA, 3000 bp, Unknown
  misc_feature (1)..( 3000): cDNA_ID_2106105_gDNA_ID_1621088_Annot_ID_170578 3000 nt of promoter + ATG
tattattgttaaaattattagatgtcaaattatattttaatctatagttgagtttataaatcatttaatatatgcagaaatatgtaaatgctaaaatatgttgagtcgccaatcaaaacaatgttattttaaaacaaacacgcacgaaaagagaaaattatatacttgtgtttttctagaaagttttaaaattaacagatttgtaattttttttttttcaaatatgacgggagacggaaagatattttatacaatacaaattgcgactttgttaattagttttgtttctattatatttctttttgtatatttaaatgtgttcacctaacacatttcggcttcatttcacatttaggcaccaatgagcttcatttaccttttctttttcaatatatgtgtgtctttagactaaacaattcggataatatattttaacgtgtgagtcgtgacaaattcaagttcttaaaatacccatcgacatctacgtcttcattcttggatttatttccaacacctttggcttttatccgcatttttattatcattcattgataacgccacggctaagtatttaatatcaatcaaagacagtaaaatcttacctaaatagttggcatggttgaagaaaaaaggtcttagagagacgagtattcatagtttacacaaattcaagtctccattggagaaagacgatatcaacgtgtgaaaatgtcgatagttgcatgcacatctccatatatatggacctcatcatacaaatcgtctatttttaaacgctatataattgagtcagtatacttattttgcaagttatagtagaatttagagctaattatatatctatataaatgattcagtattttgtgaaccaaatactcctttggcattgataaatgataaatatttgcgacctttttcatgtcgatagagtttttgttttttttcttaattcaagctagttgaggtatctcattttagacttctatacttcacatttactaacagcgaattgtttcctcttcttttacaagaaattacattctgttaaattgtgcacaatgatagaattttttttctccacatagaaaagtcggaatgaacaattttgacttcgtgaaatactattcaagttgatagtaaacaagaaacttctttaaaacatgcatgtattatgaactacattgttttttttttgttttttttacattagtttttactcaaaaatcatctaacagcttaaacggaaccatttactgtattttataacaaagaaattacagattctgactttatgttgggataaataattaatataatgcggatggtaacacatcgatgacattaacacaaaccactatcttatatagtatgtagtatttgaaaaaaaaaaaatggaaagaaaacaaattagaaaactatcggaccaaaagcataattactccgactttcgttatcataaaaatcttcacccattaactcgaattcaatgaactaatggcttaggtcctttttaaaacaattttggaccatttattcagttcttctatggaaagttcgaactaatttctagggtttggacctttggtgacatgagaaaaaaaaagaccacttgaccaaactcactgaagtcagagtaatggtgagtactctcgacacgcgtcaagaaacatccattttttttgttataaagaaagaaacatggatttgaaacgtaagtctattattttccacgaatctttttgatggaacttgaaagatgagtcatggtaataatataattgcgtttgttgagtattagaatgtttgagttccattccttgttcccatcatgacttttaaactttactttcttccatattctcatcttaacttttgagtcgacaaaaactgttcataaacacattcaaaatccaatataaactaacattgtaatatgttttacggtgaaaagaaaacattatacatacgaatattcaaatgcttatatcaacacattttggggttacagaagcaacgataaaaatatacatgaagctatatcctattatccatatctaagtaggatttgtgtcaaattatatcacttaaagctaaacttcttttactactactttaacaatacttggctacttggctacaatgaacgcgttaaaattttttttttttttagatttcacattttttgaagattaatatgattttagtttgaaaattttcagtatctagtttttagtgatcactccgattcaaactaaaaaaaacataaatgttcttctcatgacctcaaatcaagtggtccaactaatgggatatgatatatgaattaaatgcaatatgattattatgattaagttcatgtaattattatgtacgccatatgttaacgtcatacgttgccactacactcacctcaaaaacaaatgatcaatcacagcttcctgaatgtttggtcaccaccactaattcatttttttctctctcaatttgcagttctataagcgaagacaaataaataaaaaccatttttgcattataaactaattacttaaaaaatgaaaagaaaatatttttaactcgtgacacagctctttcaacaaccggattaaggctttaaacaaaatacaattttttctctaaaaaactatataagtaatttttatttttctgaatctcattattggctttttactcgatcacatgcaacatgcttctaccattttaaaagttggtgtggagccataaaaacacacacacacacacacacaaaactacatactaaaaaatattaaattgagtaaaacttctacatgaatcagaaggtttcattaaaataggggacacgtggaaaacctagatctattttcgctttacatcggacggtccaaattctctgtaaactagtcgtcggaaatataaaattatcgccaaaattcgcctgaaaattttcccaattcgaagagctaattagggtttcttctgagcttagagagcaaggacaag

SEQ ID NO: 6295 - DNA, 3000 bp, Unknown
  misc_feature (1)..( 3000): cDNA_ID_1813986_gDNA_ID_1621088_Annot_ID_170577 3000 nt of promoter + ATG
taatcataataatcatattgcatttaattcatatatcatatcccattagttggaccacttgatttgaggtcatgagaagaacatttatgttttttttagtttgaatcggagtgatcactaaaaactagatactgaaaattttcaaactaaaatcatattaatcttcaaaaaatgtgaaatctaaaaaaaaaaaaaattttaacgcgttcattgtagccaagtagccaagtattgttaaagtagtagtaaaagaagtttagctttaagtgatataatttgacacaaatcctacttagatatggataataggatatagcttcatgtatatttttatcgttgcttctgtaaccccaaaatgtgttgatataagcatttgaatattcgtatgtataatgttttcttttcaccgtaaaacatattacaatgttagtttatattggattttgaatgtgtttatgaacagtttttgtcgactcaaaagttaagatgagaatatggaagaaagtaaagtttaaaagtcatgatgggaacaaggaatggaactcaaacattctaatactcaacaaacgcaattatattattaccatgactcatctttcaagttccatcaaaaagattcgtggaaaataatagacttacgtttcaaatccatgtttctttctttataacaaaaaaaatggatgtttcttgacgcgtgtcgagagtactcaccattactctgacttcagtgagtttggtcaagtggtctttttttttctcatgtcaccaaaggtccaaaccctagaaattagttcgaactttccatagaagaactgaataaatggtccaaaattgttttaaaaaggacctaagccattagttcattgaattcgagttaatgggtgaagatttttatgataacgaaagtcggagtaattatgcttttggtccgatagttttctaatttgttttctttccattttttttttttcaaatactacatactatataagatagtggtttgtgttaatgtcatcgatgtgttaccatccgcattatattaattatttatcccaacataaagtcagaatctgtaatttctttgttataaaatacagtaaatggttccgtttaagctgttagatgatttttgagtaaaaactaatgtaaaaaaaacaaaaaaaaaacaatgtagttcataatacatgcatgttttaaagaagtttcttgtttactatcaacttgaatagtatttcacgaagtcaaaattgttcattccgacttttctatgtggagaaaaaaaattctatcattgtgcacaatttaacagaatgtaatttcttgtaaaagaagaggaaacaattcgctgttagtaaatgtgaagtatagaagtctaaaatgagatacctcaactagcttgaattaagaaaaaaaacaaaaactctatcgacatgaaaaaggtcgcaaatatttatcatttatcaatgccaaaggagtatttggttcacaaaatactgaatcatttatatagatatataattagctctaaattctactataacttgcaaaataagtatactgactcaattatatagcgtttaaaaatagacgatttgtatgatgaggtccatatatatggagatgtgcatgcaactatcgacattttcacacgttgatatcgtctttctccaatggagacttgaatttgtgtaaactatgaatactcgtctctctaagaccttttttcttcaaccatgccaactatttaggtaagattttactgtctttgattgatattaaatacttagccgtggcgttatcaatgaatgataataaaaatgcggataaaagccaaaggtgttggaaataaatccaagaatgaagacgtagatgtcgatgggtattttaagaacttgaatttgtcacgactcacacgttaaaatatattatccgaattgtttagtctaaagacacacatatattgaaaaagaaaaggtaaatgaagctcattggtgcctaaatgtgaaatgaagccgaaatgtgttaggtgaacacatttaaatatacaaaaagaaatataatagaaacaaaactaattaacaaagtcgcaatttgtattgtataaaatatctttccgtctcccgtcatatttgaaaaaaaaaaaattacaaatctgttaattttaaaactttctagaaaaacacaagtatataattttctcttttcgtgcgtgtttgttttaaaataacattgttttgattggcgactcaacatattttagcatttacatatttctgcatatattaaatgatttataaactcaactatagattaaaatataatttgacatctaataattttaacaataatataaaatatgagatttataaattacgaatataaatattcaagggagagaaaaagtagaacataattcaaaagataagactttttagacttttttaacaatatttttgatggataaaaattattcaaaagagaagaaagtaagaagaaaagatgtttctgagaatttctagaaacagcatccgtttttataatttaattttcttacaaaggtaggaccaacatttgtgatctataaatcttcctactacgttatatagagacccttcgacataacacttaactcgtttatatatttgttttacttgttttgcacatacacacaaaaataaaaaagactttatatttatttactttttaatcacacggattagctccggcgaagtatggtcgtcgtcttcatcttcttcctccatcatcagatttttccttaaatggaagaaaccaaacgaaactccgatcttctccgttctcgtgttttcctctctggcttttattgctgggattgggaatttctcaccgctctcttgctttttagttgctgattctttttccttcgactttctatttccaatctttcttcttctctttgtgtattagattatttttagttttatttttctgtggtaaaataaaaaaagttcgccggagatg

SEQ ID NO: 6296 - DNA, 3000 bp, Unknown
  misc_feature (1)..( 3000): cDNA_ID_2999338_gDNA_ID_1621088_Annot_ID_170576 3000 nt of promoter + ATG
agaaaaggtaaatgaagctcattggtgcctaaatgtgaaatgaagccgaaatgtgttaggtgaacacatttaaatatacaaaaagaaatataatagaaacaaaactaattaacaaagtcgcaatttgtattgtataaaatatctttccgtctcccgtcatatttgaaaaaaaaaaaattacaaatctgttaattttaaaactttctagaaaaacacaagtatataattttctcttttcgtgcgtgtttgttttaaaataacattgttttgattggcgactcaacatattttagcatttacatatttctgcatatattaaatgatttataaactcaactatagattaaaatataatttgacatctaataattttaacaataatataaaatatgagatttataaattacgaatataaatattcaagggagagaaaaagtagaacataattcaaaagataagactttttagacttttttaacaatatttttgatggataaaaattattcaaaagagaagaaagtaagaagaaaagatgtttctgagaatttctagaaacagcatccgtttttataatttaattttcttacaaaggtaggaccaacatttgtgatctataaatcttcctactacgttatatagagacccttcgacataacacttaactcgtttatatatttgttttacttgttttgcacatacacacaaaaataaaaaagactttatatttatttactttttaatcacacggattagctccggcgaagtatggtcgtcgtcttcatcttcttcctccatcatcagatttttccttaaatggaagaaaccaaacgaaactccgatcttctccgttctcgtgttttcctctctggcttttattgctgggattgggaatttctcaccgctctcttgctttttagttgctgattctttttccttcgactttctatttccaatctttcttcttctctttgtgtattagattatttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacgtgagtttcactctaacgaaaactcatttactctcaatttaatgcttcatttaattcgtttggtgaattgaatcattcttttgtagttggttagccaatttcgtaattttctcataatttgggggttggtgagaaaaccttctagaagctgagaatgttcttgttctttttttttttttttttttggtttagggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaataaaacagatgttgaagttttattgttgcttaatttatgtcttcataatgtaaaaaagcatgtgaaatacttggtctaaggtcatctacttagttgaaaacttgtgaaagaggaagaaattttacttttatgtttgattgattttctttgcaagtagtagtaggtggtttccgtgtttttacgtaatccgttgaatatttttccctcgaaattgtctttataaaagtcacagaaacattttctagaactctttatcaggaaaataaaaataaagatgtcttcaaggaatcgaaaaaatacagcaatatactaaatagaaaatgctatgaaattaaataaaaatttagtaaggttccaaagacactacttaactagagagaaaaataattccaactagctctacaacaaacaaatcatttacttgtttaagaatcgaaaaatttagaaatttattcttattatttgtttgcccaattaagtcgctcttggcccaatacttgcatcacttgattgagtagaagaagatcacttaccaactctcaaaccatttaaaaattaaaaagcatagtttattttatttaaatatgtgtatgtaataattcaccacaagaaatatattacaaaccacaaaactataatcccggtaaaatagtaattaatttcttcaaaagtgtaaataaaaaagaagagacataatttagtcatagccacataaaaaatg

SEQ ID NO: 6297 - DNA, 3000 bp, Unknown
  misc_feature (1)..( 3000): cDNA_ID_1813957_gDNA_ID_1621088_Annot_ID_170592 3000 nt of promoter + ATG
tgtaaatatttctttataagtttgtgatttttggtagcaaacattttgttttatggactcattgtctttgctttcatgttttttgtttttcgtaggaccaaatttataggttatacattcatctaaaaccttaaaaaaatcaactaaagatttacattcttactgatcatagcaagtaaattagtctcctttgtgttgtcgaaatgactcaacctcacaacatgatcacactttctgatccaagagctatccaaaatacaccggttacattaaactacgaacacatttcaatgataatgaacagttaaacacattacatagctttggttataagacgcagaaattaaaaaatcaatcaaaatattcgatactatgaaattgaatgttcatgtgaggtcgaaaagcggaaacgtgtcgaaataaaaatgaagagactaataaatatgttgaaggttagacaattgacaccattgaagatatgataaagcagaggaaaaaggatccattacaagttggctttggtgggtaaagagtataaatgcctaagaagaagatcctctccacacgtacgaaaaaggaaggttcggcacgtaacagatagttgtgcatacgtgtgaaaggagggtgggattcacgtgagagagattgaaccatttctatttcagaaaggaaaaaatagaaaacgagaaaaaatatcggtaggaaggtagaaaggttaagctgtcaattgtcattccaggttttgtagttggaacataaaacttttgtagctataattttaaaataaaacctgcaacgtatttttatgaaattttacgtttctagggaatattaaaatggaaaaacagagtgtttttattttattttattttaattactactccgacatgaattaactgtgtaaaaataaaaaataaaaaataacagaatttgcgtgctgatatgattttgacatgaaagattcccacatggtgtcacacaataaacaaaattcaatgttattatataagtggagttacacttgtgctttcgacatttccattaattatttatcccaatatggacttatgcctacggtgcgatatctaatactttctctaaccatttgtgggatatgcaccaaaactcgaatttgggaatgctatttttttagcaagacagacgtgatacgaaatatgtcaccgctttaagaaagaaattccgatatctatatattaaccatggaattaaaaatatagtctagccataccaaaaaaagaaactcaagtactcgaactcaaagctgttgaaccaaaaaaacggttatgtgtcgatttcatcggttttctagattatcccccacataaacctaattaacattttgagcacttgacttctgaaccgtcctcctacctttcacacgttccaaaccacaactcccgctcgtgcgaactctcatcttttattgtttatttgatacaccaaacaaaaaaaatgcacaccgaatttcattacattatccttcaagccattcatagttacatcgtactcgaccctcaagtagtaaaatttaatttatgatcacaagatcgatggccggaaaaaatagtttgaatatatactttttctagcctttgcattattttgcatgagtattattacttcggccatgctaattgttagaaaatacagcttacattttatttaacactgtattggtatatatgtatgtgggatatattatgttatcattagaaaatgctaattaatatgtaactaatttgtcatttccctgaaaagtcgattggaagggataattaacttgtggttagaacttaaaatcaattgattatatgagattaatttgttgtggtgttgtgattacgaccagtcgtacggagttttagagagtcatattctcgcataaagtaagtaaattcaattttgatgtagtagaaaaaaaaaattaacaaacgttaagaagattttttttttttttatgaagttttttatttacgaagatcttttagggtattccaggttaagataatagagatatgctacatttaaaataaatgtgtagactttaaattatgctgatgaggactggggagctatgcaccaacaatgaccagttacgtaaatatggacttaattgaccctatctgcgagtcagtccagtgaaatcagaagaatgacagatgagggtattatgggaaatataaatatggcagtattttaaatattatatatgttttttttttttgtcacgatagtattactaaaatttatggtggtggttcgtatcattgagatatgaccttgtactcacttaaaaaaaaaaaaaaaaaattacgaaaataaacatcttcaaattgttaatggcagaagacatttacgtgaaaaaaagacgcatcttagaaatttctatccttcaatcctactattaaccttttcaactaaatctttcataagaaaccatagtttaaaaaatcaccgattttttttttgcacgagcagctttatatatatataggaaaccaactaataaagaagattggtgggctaaaaagggtgacgaagaagaaagaagagtgacctctctctcgcatatttttctttccgatatatatatcttttataatatttgtgaattctgaataaactcttagtaagaaagaaaaggagagtccagaaaaagaaagcgagaaagagagagagaaaacgatacctaagctcaattatcttctctgcaacaaactccaaaggtattatcttcttatgctctctctttgcatacatacatatatatagatacctacatatatatatctctatgtctttgttcatcatcagttatataggtgatgtagatagatggacaaaaaaacagcgtaagacctagtttctgacttacatatgttttaaattctttgtctgaatcattacaggatccgagagagagagctctggaacgatattaacatatatcatgaagaaaaagattgaagtattgatatg

SEQ ID NO: 6298 - DNA, 3000 bp, Unknown
  misc_feature (1)..( 3000): cDNA_ID_2155718_gDNA_ID_1621088_Annot_ID_170573 3000 nt of promoter + ATG
tgtcttttttttacgtacgttctatatcggttattggtcaatttttttggttgtttcggtttttagtcggttatttcggttttggtttatttatggttaccaagtttaatatccgaaccgttcctcaaatatccaaatggtttttatattactataagtgaaataaccgaaatcatgcgcaaccgaaccgaaactgaatggttaaccgaatgcccaggcctaattcaacttgtttttcctattattatgtagatttagcattccagtttttaattttgaatttttaaaagttgttttccatattttgtttttttttttccggattttaaaaaccttttttgtgtttgtttttttttttaaatttatttgcttgaattttaaatttatataatgataggaaatctaaccaaattttggattcaacattaatcgcgatttcagacattcaacatttatttcctattattatgtagatttaatattcaagtttttgattcagatttttataacgagcatctttgcaaatgcccacaaaggaccttttatgtttacaaaattaaattttaaatttaagggaaatttacaaaactagcctttttttactatcttttgcattaataccctattgtgttgtccatttttaaaaataccccttccattgaacagaatgaccaaattaccctcatctaataggaatatttaattggaaactgaaattttcccgccaaattttctttttcccgctaaaaaaatattccgccaaactttttcccgccaaaaaaaagttcgtgacaaattttttttcagcaaaagaaatgcttttaaaaatccttgtaaattttttttggcgggaaatagatttacaagggattttaaatgatttcaaagatttataagagattttaaaagggttcaaaaatatttacaagaaattttaaagggctttcaaagatttataaatgtttttaaatgatttttaaagggtttaaaagtgttttaaaagatttacaaatgattttaaaagggttttataatatttacaaaggattttaaaagtgttttacaagatttacaagagattttaaaaggttttaataaaatttacaagagtttttaaaatgttttcttgtaaattgtttaaaaatcttttaaaaatccttgtacatcttttaaaactcttttaaaatttcttgtaaatctttaaaaccgttttaaaatcccttgtaaatcttttaaaacgcttttaaaccctttaaaaatcttttaaaaatctttgtaaatcttttaaagccctttaaaattctttgtaaatattttaaaaccttttaaaattccttgtaaatgtattaaaacccttttaaaatcacttgtaaatcttttaaaacccttttaaaatcccttgtaaatattttaaaaccttttttaaatcgcttgtaaatctttttaaattcttttcaaatcccttgtaaatctttttcccgcaaaaatatttttgaaaaaaagttttggcgggaatctttttttcaaaaaattttggtgaaaaagtttttggcggaaaatttttggtgggaattttattttggaatattttaggcgaaaatattaatatttcattttgttaacataaaataatttctaaatagggtaaaatggtaaataaaaaattaaagagagtaaaaataaaaatggcaaatagaaaagggtagaattgaaaaagggtagtgtgcaaaggacattatcagcaattattctaccaaatttaaatacataaaaacaaaccagacttaatatttcatccttaaatccgtaagtcttgtggtaccatattttaacatatttttacataattaaatttaacacttaaatgctttcacaaatattgtcctaaatatttttaattttatttttaaattgcaaactttcgtgatcctttactatttttgtaaaatataaatgtttatcggttttcattttgcgacgaaatttcctttagaaggtcaaaccgaagcaacacatttttaaaaagcattaactaaaaaagggcactccttagttttgactttgacaatgagtttgtcgaatgcacacctttgatccccaactgctatttacatttctttatttggattggaaacaatgaagattaaaatataaacacaacgatttaattcctaggatgtcacatatatacagaagaaaataatcaaatatgatatagttcattatcgcatcatgaaaaccttaaaatacaatgaatctatttcatccgtcttgggtataaatttgatgtcaaaataaacgagtttatgtgatttttcatcattcttattaaaacaaaaaggaaaaacgatttgtttgaatataaagagttaacgtacttttgtatcatatatttggtagttgaaatttttgagtttggatggaggatctacttagcatgagaatttttttcttttttttaaaaagaaatctaattagcatgagaagtaacattaatgacaataaacgataacgagattaattctagagtgactaaaaccataaattcagactattcatttagtatgtataatgactttatccaacataaaaaaaatcagtaaaaataatgaatacaacagtaacattcagagaggcacatagtttgcttggcacgccattaataatatctgcaaccaattccaatgacgtctttacacacgtctgaccactttttcttcaacaatttctcctatcaactatatataacttattcatggaacattcaaataaactataaaaaaattctctcaacatttttatctaatgggttctcgccttctcggtgtttgagtctttgcgtttcttgtcaattgtcatcacccctttgtctttttcctgatttcatctcttttgtagacttggacaacacgcctttctctctctctaatttttccacagctataaaatttgtaaaaattgatacaaaaatatctgagctttcctttccggaagactatg

SEQ ID NO: 6299 - DNA, 3000 bp, Unknown
  misc_feature (1)..( 3000): cDNA_ID_1027467_gDNA_ID_1621088_Annot_ID_170572 3000 nt of promoter + ATG
gctgtctgaagatttcttatgtcatctttgccttttgttctgctttctttctcggtgctatcaaaggtttcaatttttcttctttgttttggctctgttttcctctgtttctaactttctatgattgattcttcatgatgggttcttttgaacaaaacaaagtttgattttttatatatatttcctatgcaggtttgatcgtaggtccaattgctggattaacattaatagttgggaatgttggagtgattctttgtttgttccctgcacatgttacttggactatttacgctgttgcaaagtaagaaaacttcaacactgttttctcaaaagatttccctgcaatttctttcttaaaggagaatcaattttataaacatgtcttcttgtgtattttctaactttcaggacaaatagatttgacattcctctgaaggtagcaatcttagtggcacttcctgcattgtttgggatatggttaggtctaagtctagcaattagtgttcttgttggtgttggctatggattcttcactccttggatctctgcttttgaagcctttagacaagacactgaatccaacaagttcttccactgtcttgtggtacttacataacttcccccagaagtttctttctcttaagcacttgttagtgaatcatatcacttgactgctctgtatattaggatggaacttggggaaccatcaaagggagttgcattgtggttactgattttgcagatttttgttaccattcttatccactttacttaaaggagttacgcgaatccccggtttcagatgagcttcaaactcttaggtaaagtaaaaacttttgtcctaaactattccaaaagagtttttgctgattcttgtgtctcgtcttgcaggttgattcatgttccaggatgcatcattgttgggattctaggattagtcattgatatccctcttttcactgcaatcgcggttattaaaagcccttaccttcttctcaaaggctggtaccgactagctcaagacgcgattaatcgagaaggaccatttcttgaaatagcttgtataccagttgctggtttgacagtactgttatggcctatagttgtcattggttttattttggtgaccatcttctccagcatctttgtaggactatatggagcagttgttgtatttcaggtacaccatgatcatattgaccgaatgattcgagaaaaatatcgggtttcttactcattgttgaatctctaatctgcaggaaaggtcattcagaagaggagtctcttatgtgattgcagtagttggagaatttgatgagtacacaaatgattggctttaccttagagaaggaaccatcttcccaaagtatgtctctctttgatttccatctttttacattccctttctttgcctccattatcctaacaccgcgaaactgtaatccgtgacacataggccaagatatcggatgggaagaggatcgttttcaagtgaagtatctgtgatcgttcacccttcagatgtaacaagagtcaatagttctggttctgtcgatgctccagcgatgctagtaccgagcctagttcactctgtatctgttagagaagcaatacaagaagtgagaatggttcaggtatatatcaaaagttttcattgtcgataccaaatctctcacgtttctactgagttttaaatatttgaaaatgtatttaatagatttgggagcatatgatggggtggtttgagatgcaaggcaaagagctactagatgcagaagtgttaacaccaactgatctctatgagtctttaaagggcagacacggaaacgaatcatcgattatcaatgtcgggcttccttcttacgctttgttgcatacattgcttagctctataaaagctggtgttcatggtgtgcttttgcttgatggctcggaagtgacacatttgaatagaccacaagacaagttcttggactgggtctttaatccaataatggtattgaaagatcagattcgagctcttaaacttggagaaagtgaagttaaatacttagagaaagttgttctctttggaaaccatgaacaaaggatggaagcttgggataatcacagtaacccgcctcaagaaaaccttcgaactgctcaaatccaaggaatcagcagaaggtaaagattgaaaaaacttctcttacaaagaaaagttcaatctgtatggcttctttggttctgcctgaaacttgtttgtgttaattaatctcattaagacaatgatggttttatttatcttgaatgttctaggatgatgggaatggtacggagcgtatcgaagcttccgacttatagaagaaggttcagacaagtggttaaggctctaattacttattattcagagaaacaaggcttaaatcgaaccggttccatgagctctggagatttcattgaagagggttaacctaggactaggagcaattgttgtagtctttctataatttttagatgtgtttttcatttcttgtagtacaaggtgtaaaaaagaatgtacagaagttgctaagtttgggactcaagaaaacagagcatttaaaaaaaaaaatgatttcaaagattgtgacaaagaaatataaaacaatagtctaatcttgatacgcgggccaaacaactcagaactatctcatctggcaaagaagaaaattcagacgtagacggataagacgacatcttcaatttcttcgtacacggtggcccttcgtcggcgccggaattcgacatcgggttttgttttaactctgttttgtttgagagagcataacgaaggcagactcaaactctgttttgttttaactctgtttttatttaaagttacggctcaagtaaaaaagcccatgtttgtttaagttttggcccattaatagcccaatatcacaaacggaagcttgtgaaattgtgtgagacgaagacggcgaagcggataacgaaaagctcgccgagaaagcacaaatg

SEQ ID NO: 6300 - DNA, 3000 bp, Unknown
  misc_feature (1)..( 3000): cDNA_ID_1399210_gDNA_ID_1621088_Annot_ID_170569 3000 nt of promoter + ATG
aatcttttcgacgtgaaaaatattattctaaattatttatcgcaaatatgtttccttttactcttatatataaaccatgagctttttaaacccaaaatatgttagatatccatctctatttccaacgtcggattataagtccatgttttcatattttacatgataattcgactctagacaagttaggctggtgacattggactacttcactaccatgacaaagaaatatatcccataattttgaacaccactaagaagataatgtcatcaatatcttctgttgtcatttaattttccactcttaatgaaaatatattcaaaatacacaattacaaacaactttacaaactaatgttgaaaggttttaactcattaataactacccaaaccaaaaagggtactataaatatagttaatcatctaatagtttctccaaaattcttatacgatcatatatgatatctatagatagatgtaataaatatattagatgacacataattgtcacctctgatcatctagcctcttcccatcacatgccattaatggacctatgcggtgctgatagtaacgtataaccatgacgacgtctgagactcagaggatcttactctaacataattaaaaacataaacttgcactagtgaatttgtaatttcatataaggaaacattttggagcaataaacattatatccttttttcctttccctgtatattgccacatttatgcacataaaatcagctcatatccatcgatcggtccccaatttttcaatgattagtcaattttttcttccttttgataaccgctgtggtccaataagacaagtgaatagggtccatttagggctagcgtacgtggtacatcgcatgttcactatcacttatgagcgcatgcaagtgaaattacatgtcaaaaaaccttacgctatatataagtgtatatggtatctgtcaacattactatacaaaacaaatcttttatttttattgatcacatattttgtcaaaaagtatttgttttgtatcattaggcccaaagaatgtttttgtgtcagttttcttttcctaataaaacagaagaaataaacaataagattcaacttttcacagttaatacagtatttgtaaaaattctgaacaacagattttcaaaactacgacatttaaaattagaacgaagattaacacgcattagtgagtatcaaacgaattcaaaaacttatgtaaatataccaagaatatgtaattataattaactaaacatttttaatttttaaattaaaatgttaaatttcaatgctatttagaacattttggttatgattattaaaatcgtgacacgatggatagtaactaaatgaaagaacaaataggttgaaagctatagggaaataaataaatgaacggtttatagtaacatctttatcataaagctggactgtctcgttgtgatataaaacaacgaagataagtaaggagatttagtactgttgtcattcgccaacgtcaacttcactaatgatcactagtccttttagtttttagagagtttccatcagaatttgcaaacgtaattacaaatattgggccttaatttgaaacctacatagagggccgagtatttgatgaagcccaatcgtctaaagtcgaaaaacatgtaaatagtcaacacacagtgaaaatataaacatatgtaaatacgtttgtgatccaaattaaattacgatgataagatggaacaacagaagctaaccctgagatcatcttctatgacaggtgttacttagaactagtctggatagggagggagatatgtgtcctagaaacttcaaataattcaaactctattatcaaaaaaagtcagaaataaatatagtcttgaatcagttatgcagatctcgtttgttatgtttttggacagtcgacgaaagaactcctagttaattaatattatctattacaatatattctcgcaaaattaagcttatatgtgacagctagagctcagcgttgatattgcctccacacttacattatataattctaacgggaattatatacataaactataatcatgattagcacgaaatgtacgaagaaaagtctgaccaattagttttatcctacacgtgaagacttgaagttgatatgtattaccaatatatcatcaaattattgatataataataagttgttgtttggtcgagaaagcgtgcttgcatgctataatgctaattcatatttaaatgctttgttgctttgattcgctaattaacccaaaattttgaaaatgactcaaaacaaacatacagtttttacatatactattctgttgatcgtgcatgcagagataccacagtttttctgaaaacttcaatattccgctgacaaaactaatatttcacgtgttagtttttagttttttactaattaagacactagactaactgattcctactaataggttttctaatgtaaacaacataagagactctagctagaaaagagaggaaaaacaataaaagcaaatcttgagatcttctcagtcaattgacagatgtctttagaacaagtctaaatagtggattgagaagggaaatgtgtcacagcaaatccaaaaaatccaaactcatcagtttttgaaacttttggacgcaaaactcgcttggctgtgttattcattatttcaaagtccacgaaagaaaataattgtctcgtaaattaattaattaagcttatgacagctcaaggtcgacgacataattgattttgttccttactataaattatctattcaaaggaaaatatatactagctatatatataatccttattcgtacgaaatgtatgaagaaaagtctaaccaaatatttttttcgtttttttaattaaatctatacgaaattgtgcatttatatatcttgacctctatatccaaaactttaccaaaatctcgatttataatcttaactcaaaagaagatcgatcaactatt

SEQ ID NO: 6301 - DNA, 3000 bp, Unknown
  misc_feature (1)..( 3000): cDNA_ID_2155710_gDNA_ID_1621088_Annot_ID_170567 3000 nt of promoter + ATG
tttacatgcataaaatatatggagaaccaataatatataaacaagtacagctaaaaaatacatgcatatgccattagttgttgttttgttttcatctatgtaattatgaatcaagtatttcgaaattcttttgatataaaaagaaataaatttgtatcactagaatgtaaatgacatggaagaaaggtgtattccgtaactaagtactaaagtcatgaatacaaagatcatgttttaaagggtccactagagagaaacgcaaagcatgagttagtaaaaagcaaatgttgctaaagctttgtcacgtgctaatgcttattagaatctgccaaagtatcatttaattcccattcatttatttattacctaatccaccgtttgttttttaaatttcattaattaagactactatatgaggccatgttagttgatttaaataatcaaattattgatggtataatattaccacgcttagcctcggaatatgcaactatctctcccatatatcaaaaatttgtcattgttgatatataataattgtaatcacttttttcatatttccctttttccgtggtatgacattactacttttaatgagtttcctttttaatctcaggacccaacatgttccatctatttctggtttctcatgattttgttttttatgagttttgtttatactacggtttataaaacttaataataacgtcattaattgacacaaaatacgacattagttcattaaaacgaattaatctatttcattacacagaaagtagatttgaataagtgcatatataaacatgttacgtaaataggagaaacatatcaatattcacctttattttcttaattaattacttcctttttattgtggatcacccgatttgacagcaaaaaaggagaaatgaaaatcaaatgttaaaaagttaagactatagtgagatgtcagcatctttcgagttttaacttttctctctaatttttttctttcctttagcatcataattaattagcacgttatctttgctttatgaaaaatgtatcagaagttaactctgcaaaacgcttctgtttaagtacagcctgcataattgattacacaacaattactactagagtactagttaggcttagtataatcgctaatcaattctctaatcaattggttatttatatatataaagccacttaacctaatcaacaagacgtaagatttacttgatatgatgtgttttcatacacaaaattatagatttagaattgcaactagaaattatttaatatagaatagtcgaatgacagcttaaaactgatattattagagtagactgaatagtagttaccattgacaacaacaacaacataaaacagcagtgagtgaccaataattttggattttccatctaaattgcacgaaatattgtcactcactatgagaaatatcgaaacaaaaaggctggaaaccaccaaactctctttttttttttttttttaataaaaaaatcacgttcaaatcttaccaactatacgaataacattgtaaaaatataaaaatattttaattttttgatctattaattaactgatcacacataattggattaatatactattttaaaatttcgaagtataaaagtgtatacttcataaaaatattactaaatataataacaatatttttgtactattttgggacaatttttactctaataacattctgagcataattaattagtaatattaatttttgaaaaataaaagaagtgacaaaaaagattgagagaaaatgaaagcaccaagccactaaataccaaatcacaattaataaaaagatagaaaaaaaaggagagaaaaaagttgtcctcatctctcacaattctactccagctcgaaagagcgctcgtcactcagatctcccatcttctccgatatccataatcattccacttttcaatctccaatttacattactttataaaattgaattatagagataacagaaatggcgattaaacgttgttttctgctacttcgtcagctccaataagagagagagattctgtagttttcttccattgctctctgttcgagattatctgaccaaagtaatcttcctatacaaaatattggattaaatataatcaaaattgtggatctttgggaaacataagcttgaatgaaacacacatgccagcctttttctgcttctggttcgctttaacttcacgttttcccgctctgtcttcatagaatcaacaaggtacttaatttctatcaacacccattatctctttctcaggaaagtttaaatcttttttattttccaagtgttcttaattgtccttatacttatacatgtaactgtatctttctttctttttacttctgttttgtttttcttttatgttttatcttgatgggtctctctttctctctcttgggtttatatcagttagagtggagagaaagcaaaagttgaagacagacagagagagagagagaagcgcgatgaacacaagtgttcgagctgttctttcctccatgaaagctccttcaaagcatgacactactcatcatcaagtagctttctttttctctctctctcatatcactttttccacttttattaactcaattttgattgcttttctctttggggaaatctttcttggtggattatgcttagtctctgataaaaagtttgttcctttagattgataaaaattggatttcagatatttcttaagattcttggcttcaacattggactatttaccaaccgtatctttgcttttttgttttgttttctgaataatagttattccatagtgatggtcacagtgaaagtgatcgatactcaattcttatcctcattctggaagtgtgtgttgttttccactatcaaaggctcacaactattgtttctttattattagctccagttctgtttccttcattctgtttgtgagtgtgtttttttggtctatatgagtaatg

SEQ ID NO: 6302 - DNA, 3000 bp, Unknown
  misc_feature (1)..( 3000): cDNA_ID_1814016_gDNA_ID_1621088_Annot_ID_170561 3000 nt of promoter + ATG
attccttcctggagattacgcattaatatatttagatcttaggtcttattagcttctttattcgcacttttttttttcctctactcgaagcttaacgatcgtaacaatcatggcgacggcttcaggtaccatgattccttcaatttcttcttctaatactttaacctaattctcgatttctctgttaattcccgttgatgattaagaatctcgcttctgatatcttcttctttctttaaatctatatattagtaaattagggtttttactagttttgctattggctagattcattttggctaaattctggcaaaattgattttatttttaatgtttgaatgttgttctgatatatgttttctatgggatctgcagttgcttttaagtctagggaagatcacaggaagaaattagaattagaggaagctcgtaaagctggtctcgctcctgctgaggtagacgaagatggcaaagaaatcaatcctcacatacctgagtatatgtcaaaagctccatggtatctcaagtctgaacagccggtatatgcgaaaattcttctttctcttgcttctctgcattgtcttggttgagaacattcacactcatactctgtgatttttttttgtacagagtttgaagcatcaaaaaaattggaaaattgaacccgaacccaaaaagatatggtatgatagaggtaaaaagatctatcaagctgaacaataccgcaagggagcgtgtataaactgtggtgcaatgactcacagttctaaagcatgtatggatagacctcgtaagattggagctaaatacacaaacatgaacattgctgctgatgagaaaatcgagagttttgaacttgactatgatgggaagagggacagatggaacggttatgatacttcaacctaccgtcatgtggtagatcgttatgatgctaaagaggaggcacgaaagaagtatctcaaggagcagcaacttaagaaactagaggagaagaacaataatgaaaacggtgatgatgcaaccagtgatggggaggaagaccttgacgacttgagggtcgatgaagctaaggttgatgagagtaggcaaatggattttgcaaaggttgagaaacgtgttcgaacaactggtggtggtagcacaggaactgttaggtatggactactcttcatcaaacatgataacataagtttaaattggtgtttctacttgatgcactaatggtgttaccttttcttaatttcaggaatctgcgtatcagagaagacactgctaaatacctgttgaatcttgatgtaaactcagctcattatgaccctaaaactcggtccatgcgtgaagatccacttccagatgcagatccaaatgaaaaattctatttggttagtttgtgatcatcgtgaatcatgtagttgtatcttatattttgatgatatgagaatactaactttttttttcttcttatcatctatccagggagataatcaatatagaaacagtggccaagctctggagttcaaacagataaacatccattcatgtgaagcatttgacaagggacatgacatgcatatgcaagcggctccatcccaagctgaattgctctataagaactttaaagttgcaaaggaaaaactgaaaactcagacaaaggacaccattatggaaaagtatgggaatgcagctacagaaggtgaaattccgatggagcttttgcttggccaaagtgaaagacaaattgagtatgacagggcagggaggattatgaagggacaggtatagtttttgatggttctttcttgagtcgagtgatagctgttgcgatatgaacagcttgagataagtttgcttaatacgtgttgtttattgtgtacaggaggtgataattccaaagagcaaatatgaagaagatgttcatgctaacaatcacacaagtgtttggggatcatggtggaaagatcaccaatggggatataaatgttgccagcagacaattcgcaacagctattgcacaggttctgctggaattgaagctgcagaggcgtccattgatctgatgaaggctaatattgctcgcaaagaagcttctaaaggtttgtgttgttgactctgtttgttcttctagtctcttatttgttctcattgtattgtaacatttcggaatatgttttgtaacattggtttgtattttggtgatcagagagtccgaagaaggttgaagagaagaaaatggcgacatggggaactgatattcctgaagatttggaattgaacgaggaggcacttgcaaatgctcttaaaaaggtaagaaagacgccacagtttcagttcatattttctcttgccaagactcttgtttctctgccctgcaaggtttatctgacgtgttgttgtttgtgtgcaggaggatctaagtaggagggaagaaaaagatgagaggaaacgcaaatacaatgtcaattacaccaacgatgtgacctccgaggagatggaagcttacagaatgaagagagttcaccacgaggacccaatgagaaatttccccggctgataaatgtcttttccctttcaccatattaagctgaagaaaccttgtttttaagtttcatgtctttaaataagacccttgttattcatgtcattatttgttactgtcttcatgtccacccaaagattcattatataacgtatgaaactagaataaattttcttagccaaatcaaattaaccatgttgtatataaaccacgaccaagctttatatgaattttggtccaatcaaaccgaaatcctttattaagacaaaactgataatgtattgtttgcaaaagagccctccaaatttgttaaaatgtgaaagaaagctaattaaatatcaatttatctgtgtttaaagttttaacgagagggggcttttgaatttttttgctcaacttccaaatcgtcgccggcgatagaaaccctagatttgattctccgtcggttatatccagcaatg

SEQ ID NO: 6303 - DNA, 3000 bp, Unknown
  misc_feature (1)..( 3000): cDNA_ID_1808511_gDNA_ID_1621088_Annot_ID_170559 3000 nt of promoter + ATG
tggttaatgcagaagacccatatatgttctacacttggactgttacttatggtacaagatctcctttaggtgttcctcaacaggtatgaatacatacactctttgctctttttaagtatgttaattgtcgttatgaaatttttgatattatatactttggtacgaacgatgtaggtcattcttatcaatggacagttccctggtccagcgattgaagcggtcacaaacaacaacattgttgttaatctcattaacaagctggacgagccattcctcatcacctggtatgtaactatataactgattgtatttgtgcgcttagacaaatatgaaaaaaaacctttaacacggttttgtaatatatgtgtaggaatggagtgaagcagaggaggacatcgtggcaagatggagtattgggaacaaactgtccgatccaaccaaactcgaactggacttaccagtttcaacttaaagatcaaatcggtacttacacttacttcgcttccacgtcactgcaccgagccagtggtgcttttggtgctctcaacattaaccagagatctgttattacgactccttatccaacacccgatggagatttcaccctcctcgtctctgactggttctcaaatatgacccacaaggtacataccagtacaaagcctagatatacactcaagatcgtttcaaaagtcctatgtgaatgaataaaaagcaaatttgatgtttttaaaaaagtaaggatttggtttatatgttttcaaatgtttttctttaactattcttgtgatctctaggacttgcgaaaatcgctcgacgcaggctctgctcttcctcttcctgatgctcttctcatcaatggagtctctaaaggtttaatctttaccggtcaacaaggtaatgtcatcataacaaatctttaatattacatcgtgcatggtcttgttctagtctttgatatgtctttaatttcattgtctatcttcaggtaaaacatacaagttccgggtatccaatgtcggtatagctacatcgataaattttaggattcaaaatcacacaatgagcctcattgaagtagaaggcgctcacactcttcaggagagttatgagtcgcttgacgtccacgttggtcagtccatgaccgtcctggtcactttaaaagcttctgtgagggactatttcatcgtggcctcaacccggtttacaaaaccggtactaaccacaaccgcgagtctccgttaccaaggctccaaaaacgctgcatatgggcctctccccattggtcctacttaccatatccattggtccatgaaacaagcaagaaccattaggtattaataccaaaccgaacataaccgaactaaatcgaaccgtacaagtctagattggttctgcttaatttgactttaactttttctgattcttaggatgaatttgacggcaaatgctgcaaggccaaacccacaaggatcatttcattacgggaccataccaataaaccgaactctagtcctagccaatgcagccacattgatctacgggaagcttcggtacacagtaaaccgaatatcatacatcaacccaacaacaccattgaaactcgctgattggtacaacatctcgggcgtgttcgatttcaagacaatcattagcactccaacaaccggaccggctcatattggtacatcggttatcgacgttgaacttcatgagttcgtcgaaatcgttttccaaaacgacgaaagatcaattcaatcttggcacatggacggtactagcgcctatgctgtcgggtaagcaaacacattgccctctgttatctaaaccggttccggttattcataacttaaaccgtacgtaattgattaccttttacagatacgggtcagggacatggaacgtgaccatgaggaaacgttacaacttggttgatgctgttccaagacacacttttcaggtaataatcttatttagaaacaatatgattgaatctaaatatctaataagtaatcaacgatgattgtgtgtatgaaggtgtatccgttatcgtggacaaccatattggtgtcgttggataacaaaggaatgtggaatctaaggtcacaaatatggtcgaggaggtatttaggacaagagctctatgttcgtgtttggaacgatgagaagtctctctacactgaagctgagcctcctcttaacgttctttattgcggcaaagccaaacgtcccctttagatttatcattgttatcttttctactgaattaggtcacaattacgtggagtggaacaaaaaatacaaacgtagtccaaacggaaagctaattgatttttcaataaagagacaaaataaaaatgaaggaaaaaactttcttttgtcttatgatttgattctgtttttttttttttgctctcttaaattcagattgtgttcatgtatctaaagcagaattggaaaccaaaatttggatactagaattgtcagtttgacataaaattttatgtaaatgaattgaaaccaatcctaagcagtcatcacttatcaatatgctttttcaaataattttgcaaaatgtcatagatttttatgtgtgtaattcaaaccatagaaatttatttgaaaatataatattaaaatctttatctttatctcaagttattttcccaatctcatcaatcaaatcacccacttcagtggacaataatctttaatatttcattaatcattgatatctttctcattttcacatttgagaaaaacgttttgtcggtaaaagaaaatgtatcattgaaaattctaaaaatagatataatggagagagagatccacctcaagattatcgccacaaaacagagtagttgactgatatcgattgtgagatttcaaagcgataacgtggagaccccctcaccattataataaatcatcatatcgtcactttagccacatcacataccaaaaaaaggcaaaacactcacgaaagaagaaacggagagg

SEQ ID NO: 6304 - DNA, 3000 bp, Unknown
  misc_feature (1)..( 3000): cDNA_ID_1814023_gDNA_ID_1621088_Annot_ID_170558 3000 nt of promoter + ATG
actgaaaaagatagttattcgtggacggctatggttacgggttatgttaagaaggatcagcctgaagaggcattggtgttgtatagtttgatgcaacgggtaccgaattcaagaccaaacatttttacagtttctattgcagtagctgctgctgctgcggttaaatgtatccgtagagggaaagagattcatgggcatatcgttcgagctggtttggattcagatgaagtgctttggagttcattgatggatatgtatggaaaatgtggctgtatcgatgaagcaagaaacatatttgataagattgttgagaaagatgttgtctcgtggacatcaatgatagatagatatttcaagtctagtagatggcgggaagggttttctttgttttccgagttggtaggttcttgtgaacggcccaatgaatacacttttgctggagtcttgaatgcttgtgctgatctcacaacagaagagctagggaagcaagttcatggatatatgacaagagttgggtttgatccttactcttttgcatcaagctctcttgtagatatgtacaccaaatgtggaaatattgaaagtgcaaaacacgttgtcgatggatgtcctaaacccgatttagtttcttggacttctttgatcggagggtgtgctcagaatgggcaacctgatgaagccttgaaatatttcgacttgctcctcaaatccggcactaaacctgaccatgttacctttgtaaacgtcctctccgcttgtactcatgccggattggtcgaaaaaggactcgaattcttctattctataactgagaaacacaggttatctcatacttctgatcattacacttgtcttgttgatcttttagctcggtctggaagattcgaacagttaaagagcgtcattagtgaaatgccgatgaaaccgagtaagtttctgtgggcttctgtgctcggtgggtgtagcacttacggaaacattgacctagcagaggaagcggctcaagaactgttcaagatagaacccgaaaatcctgttacttatgttacaatggctaacatctatgctgcagcaggtaaatgggaggaagaagggaaaatgagaaagagaatgcaagaaatcggagtcaccaaaaggcctggttcaagctggaccgagataaaacggaagcgtcatgtattcatagcagcggatacttcgcatccaatgtataaccaaatagttgagttcttgagggaattgaggaagaagatgaaagaagaagggtatgttccggctacgagtcttgtattgcacgatgtagaagatgaacaaaaagaagagaatcttgtgtatcatagcgagaaacttgctgttgcatttgcaattctatcgacagaagaaggaacggcgattaaggtgtttaagaacttgaggtcttgtgtggattgtcacggtgctattaagttcatatcgaacatcacaaagaggaagataaccgtaagggactctactcggtttcattgctttgagaatggacaatgttcttgtggagattattggtaacgataaaaactatttgtgatacatccactttaagccactatgatttatttctactacaattgcaaattagtcactgagtcataggaattgtacattgtttaaagagttttgttttgtagaaccttaatgtacataaaatcaacatttgagagattaaggaataaaggcatgaaacttcttaaactccaaattaaaaggatgaatccattaatggctctgaaatcgatttgctagtttcaagacaagcttcgtaagatgaggacggaggaagcatacatacacatgcatgttagtacacattttacgtataaatacattttatgtcatataaatacattaggatatacagattcacatgatacaagcgagcttaattagtgataaagaattcatgtgtgattaatttgagtttctttctgttcccaatatgtgatctcttctagggatgcatcaccttgtttctcatggtttggagtaaatatcatttggtttgacttcacttacttttaactttagtttacaaaaactagttaatgctaattggaatcttgtgaggtataacttagaagcacactccttatgttttagttagtttaagaaatcaattatgtgctcgtgattgttggttttcttaattatagattctattgccatacaccaaattttaaagtcaacctatatatttatactattttacgtatgagggaacaaagaatttaatcatagatcaagatctacttttctatactgatttattttattttaatgtattttggaacttccatagtcaaatctgaaaaaattgtgtgcactactaccaagtcatttgctaccttactaatactaagtcaccctatcaacctagttctgatttttaaaaaatctaaacttgaattgcatatataagctattagtgtatagatcaactactggatcaataacacttctacaacacacattattgtatttaagaatataaattttgtattgcatgggtttatttttctcttcttttgactaattaaacgtttggttataatagtgaccgacactacttagtagggccaaatataactaatactcttgccgacaaagaaaaacttggtaatttgagaaattatagtagtacacacacatatataattacaaatctcatcatgtctactaaatcgcgtaaaatttaaattaaaaagttgtcaaggcaagcattttgcatgaagtacgccgcaaaagagcaattgaggcttttttgtgatgcatggggattcacgtcgtcctcgctgacaaaacttaataatatactaaaacacttacttagtcccatctctagcttcgtacatgtatataagatcgtcctgaggtggaacccataacacatacaaacaagtctaattcttgatcttgaatcttgtattaagagagatcaagattatatattctattcgtcttacaaaa

SEQ ID NO: 6305 - DNA, 3000 bp, Unknown
  misc_feature (1)..( 3000): cDNA_ID_1814031_gDNA_ID_1621088_Annot_ID_170555 3000 nt of promoter + ATG
gtgtttgtaaaatattatagattcttcagaatcctctttttaagactaatttgggaaaatattaaatacaggataacaggaatatgagaatcttgaatgagaagagcactaaaaacaaaataaataacaagtttcccaaaactgaaaattgtaatataattaatagccgaattaaaaggaaaaaaatccttaaagaaaaatataaaaaaagagaagaataaatatatataagtgagtgtaacgattcgccgcgtgtgtacgggcatcacaaaaagattctttcttccatttaaagataaatctaattttaatattgacaaaaacaccctcaagtctccacttatttacagcggctacggttcaccgcgtccttcttcttcttccctaatctcattttttttttgttctcatttatcttcttcagcatcttcatcatcttcttctatatatacctctttaagcttgcttctctttgtctttatcttgtccgatggttcaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaaggtatcttttattaaaattctctccttttcttttttttatcttctctaatcgattcgtgtttttgtttaaagagattgtttttctctgtgtagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcggtacgatcaaaaagcaaccctttttatgttttgtgaagaatcatatgttgtgtgattgatcttgttgaccttatgatcatgttttgacagacaaatgaagaagaagaagatcggtgtgtgagtcagaacccatttcagacatgtaattaccctaatcaaggaggggtatttatgccatttaaccgtcccccacctcctccaccaccagctcctctgtctctcatgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaaggttagtccttaaccttagtaaaggatcaaactttgctttagatttgattgattgattatactgagattgttttgtattgttgttgttgttgttgttgttgttgttgtgagacagttgctacaccaaagcagattagagatttgatgaaagttgatggtttaaccaatgatgaagtcaagagccatttacaagtaaaagttctcatcttttacagtaacttaaactttgatgtgtggatgaatgaatgattttgacagtgcggtgaaatgaaattgttattgcagaaatatagaatgcatatccgtaagcatccgctgcatccgacaaagactttgtcatcgtcggatcagccaggtgtgttagagagagaatcgcagagcttaataagtttgtcgaggtcggattcgccacaaagcccacttgttgcaagagggttgttcagtagtaatgttggtcatagctcagaggaagatgaggaggaggaggatgaagaggaggagaagtctgatggacgtagtagctgtagaaatgatgaaacaaagaagaagagacaagtgttggatcttgagctttgaaagtctgcatagtgaatgatataatctttaccaacttatgttatatatgctcaaaactttgagtttgttcgggagtttttgtagatgtaaacatgagagttgaaataaggaagaggattttgagcaaaaagtagggtttgtttttgcaagaggaaatagatagagaagagtgttcgaaatcctctgtgttttttttttttttttttttttacttcataagtaagataaactcatatatcaaagattttgtttttatacttattacagtctcaaccatgtgaatgaaggagtcatttgtttagttttaccagctcgtcatactaattaccttttaccttcgaaaacagaggatgaagaaacatcacaatctttgtctctttctgtaactcatcgttttctacaaatctacgtaatctgagagaataagtaaggggaaaaaaaataagaatcttttattgcataaaatcgtacgaaaagataagatttttcgtctgaaaaacgacaagatttattttcactattgaaggaattgacaatgtatatagaaaaaatctactcactgattagtgatttgatgaatagtttacttccacgagatttgcatgttttgtggataaagcttcttgcaccatgtaacatacattagccaatagtatagggtagatatttatcttttgacataattttcttcaaatttgttatttttattcaaaaattcaaatagttactctctgcttttcacaattaatgagtgtatatactaaagacatttaagcggcaatggaatatttgttcaaattggttcggtcgattcagtttctaaacccaaccggtttattcacccggttatttcgagtcaatttatgtggttttgtggtctctgggcctcacggggccgcctctccgtcttcatcaacattctcaaactcttttacaaatctaggctcgacgagggtttaagcaatcaccggagctcttagtctcttacgctgtgagctaagaaccgaccttttgcttagtttctttcaagtctccaatcaaacaaccatg

SEQ ID NO: 6306 - DNA, 980 bp, Unknown
  misc_feature (1)..( 980): cDNA_ID_3048168_gDNA_ID_1621088_Annot_ID_170536 3000 nt of promoter + ATG
caagcttgttgaacaatcctgaggtgctgaacaaggccagagacgagatcgacagaatgatcggtgtagacaggcttttggaggaatcagacatcccaaatcttccttatctacagaacattgtatctgaaacgttacgtctgtaccctgcagcccctatgctgcttcctcacgtagcctcgaaagattgtaaagttgggggatacgatatgccgcgtgggacgatgctattgactaatgcatgggctatacacagggatcccctgctatgggatgatccaacgagcttcaagccagagaggttcgagaaagaaggagaggctaagaagctaatgccgttcgggctaggaagaagggcatgtcctggatccggtttggctcagcggctagtgaccttgagtctcgggtctttgattcaatgttttgaatgggagaggattggagaagaagaggtcgatatgactgaaggtccaggactcacaatgccgaaagctagaccgttggaagctatgtgcagagcacgtgactttgttggtaaaatcttacccgactcctcttgagtttttgtatgtaaaatgctaatacgttgcttagcaacggtaacgaattaaatgaaacgtattagcataataaaaatcagagacaaaaatcatattctaatttccaataacccattgttaattatgttacagtcttacaaatatgaatgttcagtgttatcaatcaaacaaaattctaggtgtgaaaaaaaaataaaaaaatctaggtgtggcattgctatgctaaatgtcatataattagctaaaataaataaataataatgattaggtatctaaacgactaatgggcacatgtgatttggccgaaataagattctgttttcgaagtcaacgtctatggagtagttcaagcagattttgcaccacatcatcctctgttacaacccctgaagatccttgaggaagaagaagtcaaatatg

SEQ ID NO: 6307 - DNA, 3000 bp, Unknown; identical to SEQ ID NO: 6283
  misc_feature (1)..( 3000): cDNA_ID_1814035_gDNA_ID_1621088_Annot_ID_55420 3000 nt of promoter + ATG

SEQ ID NO: 6308 - DNA, 3000 bp, Unknown; identical to SEQ ID NO: 6281
  misc_feature (1)..( 3000): cDNA_ID_1807333_gDNA_ID_1621088_Annot_ID_55422 3000 nt of promoter + ATG

SEQ ID NO: 6309 - DNA, 3000 bp, Unknown; identical to SEQ ID NO: 6305
  misc_feature (1)..( 3000): cDNA_ID_1814031_gDNA_ID_1621088_Annot_ID_55423 3000 nt of promoter + ATG

SEQ ID NO: 6310 - DNA, 3000 bp, Unknown; identical to SEQ ID NO: 6304
  misc_feature (1)..( 3000): cDNA_ID_1814023_gDNA_ID_1621088_Annot_ID_55426 3000 nt of promoter + ATG

SEQ ID NO: 6311 - DNA, 3000 bp, Unknown; identical to SEQ ID NO: 6303
  misc_feature (1)..( 3000): cDNA_ID_1808511_gDNA_ID_1621088_Annot_ID_55427 3000 nt of promoter + ATG

SEQ ID NO: 6312 - DNA, 3000 bp, Unknown; identical to SEQ ID NO: 6302
  misc_feature (1)..( 3000): cDNA_ID_1814016_gDNA_ID_1621088_Annot_ID_55429 3000 nt of promoter + ATG

SEQ ID NO: 6313 - DNA, 3000 bp, Unknown
  misc_feature (1)..( 3000): cDNA_ID_1839029_gDNA_ID_1621088_Annot_ID_55430 3000 nt of promoter + ATG
gttactttgtacctgaaggttgatgtagtcatgtaacacaaattttgcatacattaaagtgtaaaactaattcaaagaaattgactaatttcatccacaaatttctttctcgattaggctttttggatattgaaaagataaaaccaaataatcttgaggtgtagaaagattgactcgattttcagatcggtttggttttggtttaggcaaattctttaaccgttcaactggaatccattacatcagatcaccaacagcaacaaaacacaaaatttgaaaagccgtcaagttcttacatgatccatgcctactccgatagaaaaatggaaaagaaaaaaaagatcttccatttgtttagccttagagtacgtacatgcagcaaaagcatagtttctcttctgaaacttcttctctcactcaagcttgaatcttacgacgctgtctcagtcttccaccaatactatttgggtttggttcagcagacatctttcgcttgcttcttgtttctcggttctctttgtttgcagagttagccatcctctcagtttcactgcactgagcctcaagatcgatgatcacaggagttgctggatccacctctttcacatctaatggcttgagatcaccatcagtcactgaagtttggttgttcccagacgacaagaagcataatgactttctagctgaatccggattcttgtttgagccatcatcatcatcgagattttcgtcaatttgattgtcctgaatcccatcagttatgagaaggagatgatctccttctgaagcttgactatctgcaggagcatcagtttcatcatcctcacttgtttctgactgttggttggtttgaatcagataatgtgcaacagacttatacccgagtttatgtatctgagaacaaaagaaattcaaagggaaagccattaacttttgaatctatccaaggactcaaaatcagaattttcaccatggatcatactaatcgaaatagctaccttcctgtaagctgcaccagttgggagccaccctttttttgtacgacagaaactgcagttgcagatatcgcgacagactggacaaatccagtccggattttccagagcttcaagaacatgttctccatatctgttcaatcaccaaaacataacctaaaacattcagttccaatcctcattttgctgagcaaagcaagctactcaattcccagttgattctcacaaaaggaattactcaaaaacacagaaacaaagaaggttggaggctaatgtacctcatgtataaacaatctccacagaattgacctcgaacagaatggttacactggctgcattgggtatgataacctagcgtcttctgcctgtaaaatccacagtaaccattaaacacattagcctcaatcctaaccgaatcaaactacatcttcagagataaagccaagtgtacaaacctgcactggtggcaacactttcctctaacagggtcataaatccgtttcccatttttgtcacaaccatcaacaaaaagctcccaagttcgttctgtgttacctaacagtttctcatgctcctcagtgtaaatctctggccttacgccttctcctacccacaaaacaatctcttctttagacactttacccttcttcagttcaggttcctctgcgtaggaaactggtgtagcgttcttcaatctaaagaccacaacagagaaggcaataaaaatcattactttctattaaaaatcctagcttcctgttaaacccttgattttgaacagaatccaaagaacgaaacgagaaccacagagattgaatacgaagagattacctcgaggatctccgagaaactggcggctcctgcttcaatctgattataaaacagcgaaatgatttctctaaaaaccctagatttctctaaaacccctaattttggaagattgaagcaatgtgaacaaaatcgagagaagtcagtgactgaaaacgaagagattaccttgaggatcgtctagaggagacggaaagctgaataggagatgtttctcgacccggattggcattagagttaccgtaacgccttttggcgggtcggatctcggatttgagtttgagagagagatccatgattccgagattcttcatcctctgaagattctccttgatcctgtcttctctgcatttctcgtagatcgagacgtttgagtttcctcctccgactgttggattagggtttgtgacgggaatcgaacatttcgctctcgttctcaccacaggcattgtgagagattgatgaactgattttggattcaaagttccaatctttccctctttctctctttggatctctggataagaagaagaaatgaaagatttttttttaactttttaagtgagtgaagcggaacagcaacggtctggtttttttactctttttaaaattcaaaacatttttcacctttttaggtaaatgtgcttaatttgccaactaatgaaaacgttgattggtttgtcaaatggaaatcatatttattatctatcatacatctgtaaatttatttttcttaaagggcctttaggctttaataacggcccataaaaaatcccaaattgtactacgaagaagaataagccgccattctttatctttccattccttcctggagattacgcattaatatatttagatcttaggtcttattagcttctttattcgcacttttttttttcctctactcgaagcttaacgatcgtaacaatcatggcgacggcttcaggtaccatgattccttcaatttcttcttctaatactttaacctaattctcgatttctctgttaattcccgttgatgattaagaatctcgcttctgatatcttcttctttctttaaatctatatattagtaaattagggtttttactagttttgctattggctagattcattttggctaaattctggcaaaattgattttatttttaatgtttgaatgttgttctgatatatg

SEQ ID NO: 6314 - DNA, 3000 bp, Unknown
  misc_feature (1)..( 3000): cDNA_ID_2155710_gDNA_ID_1621088_Annot_ID_55434 3000 nt of promoter + ATG
acatgcataaaatatatggagaaccaataatatataaacaagtacagctaaaaaatacatgcatatgccattagttgttgttttgttttcatctatgtaattatgaatcaagtatttcgaaattcttttgatataaaaagaaataaatttgtatcactagaatgtaaatgacatggaagaaaggtgtattccgtaactaagtactaaagtcatgaatacaaagatcatgttttaaagggtccactagagagaaacgcaaagcatgagttagtaaaaagcaaatgttgctaaagctttgtcacgtgctaatgcttattagaatctgccaaagtatcatttaattcccattcatttatttattacctaatccaccgtttgttttttaaatttcattaattaagactactatatgaggccatgttagttgatttaaataatcaaattattgatggtataatattaccacgcttagcctcggaatatgcaactatctctcccatatatcaaaaatttgtcattgttgatatataataattgtaatcacttttttcatatttccctttttccgtggtatgacattactacttttaatgagtttcctttttaatctcaggacccaacatgttccatctatttctggtttctcatgattttgttttttatgagttttgtttatactacggtttataaaacttaataataacgtcattaattgacacaaaatacgacattagttcattaaaacgaattaatctatttcattacacagaaagtagatttgaataagtgcatatataaacatgttacgtaaataggagaaacatatcaatattcacctttattttcttaattaattacttcctttttattgtggatcacccgatttgacagcaaaaaaggagaaatgaaaatcaaatgttaaaaagttaagactatagtgagatgtcagcatctttcgagttttaacttttctctctaatttttttctttcctttagcatcataattaattagcacgttatctttgctttatgaaaaatgtatcagaagttaactctgcaaaacgcttctgtttaagtacagcctgcataattgattacacaacaattactactagagtactagttaggcttagtataatcgctaatcaattctctaatcaattggttatttatatatataaagccacttaacctaatcaacaagacgtaagatttacttgatatgatgtgttttcatacacaaaattatagatttagaattgcaactagaaattatttaatatagaatagtcgaatgacagcttaaaactgatattattagagtagactgaatagtagttaccattgacaacaacaacaacataaaacagcagtgagtgaccaataattttggattttccatctaaattgcacgaaatattgtcactcactatgagaaatatcgaaacaaaaaggctggaaaccaccaaactctctttttttttttttttttaataaaaaaatcacgttcaaatcttaccaactatacgaataacattgtaaaaatataaaaatattttaattttttgatctattaattaactgatcacacataattggattaatatactattttaaaatttcgaagtataaaagtgtatacttcataaaaatattactaaatataataacaatatttttgtactattttgggacaatttttactctaataacattctgagcataattaattagtaatattaatttttgaaaaataaaagaagtgacaaaaaagattgagagaaaatgaaagcaccaagccactaaataccaaatcacaattaataaaaagatagaaaaaaaaggagagaaaaaagttgtcctcatctctcacaattctactccagctcgaaagagcgctcgtcactcagatctcccatcttctccgatatccataatcattccacttttcaatctccaatttacattactttataaaattgaattatagagataacagaaatggcgattaaacgttgttttctgctacttcgtcagctccaataagagagagagattctgtagttttcttccattgctctctgttcgagattatctgaccaaagtaatcttcctatacaaaatattggattaaatataatcaaaattgtggatctttgggaaacataagcttgaatgaaacacacatgccagcctttttctgcttctggttcgctttaacttcacgttttcccgctctgtcttcatagaatcaacaaggtacttaatttctatcaacacccattatctctttctcaggaaagtttaaatcttttttattttccaagtgttcttaattgtccttatacttatacatgtaactgtatctttctttctttttacttctgttttgtttttcttttatgttttatcttgatgggtctctctttctctctcttgggtttatatcagttagagtggagagaaagcaaaagttgaagacagacagagagagagagagaagcgcgatgaacacaagtgttcgagctgttctttcctccatgaaagctccttcaaagcatgacactactcatcatcaagtagctttctttttctctctctctcatatcactttttccacttttattaactcaattttgattgcttttctctttggggaaatctttcttggtggattatgcttagtctctgataaaaagtttgttcctttagattgataaaaattggatttcagatatttcttaagattcttggcttcaacattggactatttaccaaccgtatctttgcttttttgttttgttttctgaataatagttattccatagtgatggtcacagtgaaagtgatcgatactcaattcttatcctcattctggaagtgtgtgttgttttccactatcaaaggctcacaactattgtttctttattattagctccagttctgtttccttcattctgtttgtgagtgtgtttttttggtctatatgagtaatgatg

SEQ ID NO: 6315 - DNA, 3000 bp, Unknown
  misc_feature (1)..( 3000): cDNA_ID_1807955_gDNA_ID_1621088_Annot_ID_55437 3000 nt of promoter + ATG
ctaatttacaagttgttgattagttcactttttgtttgaaggcgttgactgatcctagcttggacgtcaaggtatcggacatatgcatcggcacatcagctgctcccacttactttcctccttattacttttccaacgaagacagtcaaggcaagactaggcattttaacctcgttgatggcggggttactgctaataacccggtactgtcaagaccgaagagaaattgattaaaaaaccttagttttagtttttccgaaaactatatataaacagaaataactctgttatgtttggttttgttatagactttggtggccatgactgctgtgacgaagcagattgtgaataataaccctgatatgggtactctcaatccgttaggttacgaccagtttctcgttatatcgataggaacaggatctgcaaaaaaagaagagaggtacagcgcaaagaaggctgcaaaatggggaatcatatcttggttatatgaagatggaactactccgatattagacattacctttgaatcaagccgcgacatagtccattatcacagctctgttgtgtttaaagccctacaatctgaagacaagtacctcagaatcgatgtacgtaagagctacatataaatatatatatgtgtgtctcctaatttctgattgatcgtttgattgattggattgttttatgtatgaaaatccattgcaggatgatacattggaaggagatgcaagcactctggatctatcgacaaagtctaatttagaaaatcttataaaacttggagagaagatgctgacaaacagagtcatgcaaatgaacatcgacactggtacatatgaacctgctgctgaaaatattaacaatgatgaacaactcaagaggtgattaataagtttcaaatgtttttatccataaatgggtttcttggatcacaagtaatctcgttctttgatatttgtaaatttaggtttgcgaaaatcctctccgaggaaaggaaattaaggagaaagaggagcgacaaaatgactaaagattcatcaatcggatcacaagagatcaagtaaaaggaaatacagccggaaaatcactctcgtgcttttgtgtgaaattattttttttgcaagatgatattgttattttgttaaagctgaggattttgtgtgtgttggtcagcaaattctcttaacgtctttttttgtttttgtttttttctgggtgtttctgattcaattcttttccgaattgaacaaaaataaataaaattttacaaatcaaccctttaaataggaactaggctccctgtcatgtgggttaaactgggaacggtcgagttatgcaattcttcacgtatcaacttatattgaacctctctataaattaaatcaagttagtcaatcactatagcatcatgatgttggaaaaaataaaatctctatcctcattatatgtaaaaaaatgtggtcaaatgaagaaccaagtaaagtggacaacctttaaaatgatattatctaatagttttgtcaaatttgatgattatatatatacaattgtaacgttctcaagaggacgtttagtgtttacaagttcttgactctttcaagaaccgttgacaaaaataatcgtataaacaaactcatatgtatgttacacgccaaagtatattatccatcttattacagaattaggtgattaaacataaattttgttctctaacaataaaaatataaattttgtaaaaggttaagccaagaaacgagatacgtgaagaattgcataagaggtgtgaaggggtaagatgatattggaggattacaattgtatgttttttaaataacacgaaaaacatttgacagatttaacaatctcgcaaaagtggaccatagatagattctgtactacttgtcacggcatgggcataaaataaatattgtagcttgttttatttcctaggtttaaaagttggtggaacttcatataatcaatgaacaatgagcaaatttatgcgaaagttacacaaaattaaatgtagtaaatagtaatagagtatggttagtacaatgataaaatatacagtatattgtatccttgactccttgtagagactaaccgtaaccatttcaaatccataatttaggccacatttttggttcgagtaacggttatatttgcttggaagtatgattctcgttgtccctaacggaaatatttttattggacaacctcatatacttttcagcaaagttccctagttctgcgatttcagttctattagtagtttaagaagccgggtttaaacctccaaccaaaaacattgtaccaaaaaccaaaaacattgtaccaaaaaaagtttacgcatcttcaggatggtaacctaaaaaactcggaaaaaagcaatgaaaaggagctaaaatattactcttcaaaaatttctgaacactgagttataaatagatctcacaattagaagatgaaaatgttcaaaagtagcggtcttatcttctactaatttttataaactaagaacatttaaaatatatatacttatatgttcaggtgacttctgctactaaattttgtgcatttatgtctattaattgtttattttggaaagaacagctgtcatctagacctttgtttttaaatatagaagtatgtgtgtaacatgacatgctctaaagcaaccacaagtgtaatggggcgtgagagtgatgaacacgacatcccaaccaagaaactggttcaaaaaacatccaaacactatgtgatggatatgtgtatgggcatgcataacatagtgttgtatatagactccctaatctacatatatctctttctataaatatgtaacggtagttctaatgggttcatcacatttatcaccatctctatcttgaaaaggagaaataaataattaatcactaagcgaaagagatttgatctaaagtaatacaaataaaccttgattgagattgtaaaggagaagagtttaaaagc

SEQ ID NO: 6316 - DNA, 3000 bp, Unknown; identical to SEQ ID NO: 6298
  misc_feature (1)..( 3000): cDNA_ID_1813991_gDNA_ID_1621088_Annot_ID_55439 3000 nt of promoter + ATG

SEQ ID NO: 6317 - DNA, 3000 bp, Unknown
  misc_feature (1)..( 3000): cDNA_ID_1813988_gDNA_ID_1621088_Annot_ID_55440 3000 nt of promoter + ATG
ttctccggtacttgcgacgattaactctgtttttcagttatgagatcgaaattgactgttttgcatgcttgttttagagctcaattgcttgattttaagtagaaacagacttcaatttcgatgtaaatcataaccctaaaaaaaaactttttagagaatcttaaagtttgttttgttttgcagattgattttgttataggaagttggatacattgcaagatcccaacaggagtatctttgaatataacaagcatctctggattcttaaactcatcaacaaaagctccaaactttgtggtcgaactaatacagagcagttccaagtcgcttgtgctaatccttgacctcccacatcgtaaagatcttgttcttaacccggattatctcaaggagtattaccaagacactgctcttgattctcatcgacaatctctccttaagctacctgaagttaacccttatgtgtctccttctctctttgtccgttctgctttctctcctactgcttcgatgcttaagattgatgcggaggaagaggataagttggaggagatattgagagatcatgttagtccagctgctaaggaggttctcgaggtttggttggagcggtgtgtgaaggaagaagaagagaagattgtggttggggaagaagagagaatggagttggagagaagagataaaagctttagaaggaagagcatagaggacgatttggatttgcagtttccgagaatgtttggtgaagaagtttcctcccgtgttgtacacgctattaaagaagctttcggtgttctctagattatgtaactatatatatacatcagttaatgttcattgtactaaacatttactttcatcaatgtcacaagaacgcaagatgaccatcaaacaagtcctgttttctcctaagaacgtctttgttgtgaatcatctctgaatcggattccttctgattcattttaatactatgggattgtaaatttatcaatcaagtttctaatttatctgtaaaaaaaagtcttgaattattgtttttctcatggattttaaagtttttttttcactattttacatggatgttttgttaaatttctcgttctctagatcatgtcattttacattagcaaaaccaatataatatatagattaatattaacgaaggaacataaacgtgcaaaactaaaagttttaaagctaaatcgctttcaaaagagttagtaaccagacaaaaaagagacagatcatcggcaactaatctcgtcatcgcatgcatcataaaccaaattaactaaatcatccatttaatccatttgttcttatcagatcatccttttccttcctacacaagaaatggttagtgttttcttttctcgattgtctcttagtttagattctttatccgactactttgttcatcggttttgtttttctttttgtcttccggaaggcgaattacatgtcggaagcagcacagctcagaagaggtctaaagcctaaagggaagacttatgggttgaccaatcagaagagacgagagatcagagagatctttgatcttttcgacatagacggttcaggtaaactattaaaccgattctttatccgatttacaaagttattgctcacatgatttagtgcatcatttcatatgtaggtagcatcgatgctagcgagctcaacgttgctatgaggtcaacggcaatttttctttctttttcaaagttattttcttcaagttctagttaagtatagtactaaaaaattatcagctgattacaggtctcttggatttgagatgaataatcaggtttgtttgttttccttccttttttcttctttgttttaatttcatggtttagatcattgtacgtagaaccaacttgtatttagtttggtcatgttcattgttgcagcaaataaacgaattgatggcagaagtagataaaaaccaaagtggagccatagatttcgacgaatttgtgcatatgatgacaaccaaattcggagaacgagactccatagacgaattgtctaaggcgtttaagatcattgaccacgacaataatgtgaataaatctaaacctgtcattatttcattctttttaatattatctttttttgtttggattgatttcattgtgtttgactggacaacttttggaatgttttaggggaagatttcacctcgtgatataaagatgattgctaaagaattgggagaaaatttcacagataatgatatagaagaaatgatcgaagaagcagaccgtgacagtaagcaaaaacacataataattttgcgttttatctataatcggtccctcaagttcatgtttttgccttaacctacgcagaagatggagaagttaacttggaggagttcatgaagatgatgaagagaacctcttacggctaagtataaatcaattagtaatggttgtgaataatatttgttaatcaccttgatttataataataaagaagtttgatttgtggcttggtcgaataaaaatgtattgttgtataaaaataataatgtaattcacatccattattttgaatatgtaaatgtccttgaacgaacatttgttttatcattttttatgtataaatgtctttgaccaaaaaataaattatgtaaaatatgaaccagaaacgatgttgtttagatctgatacttacatataaccaaacgacgacgttgctagagtaataaatctcaaaagactggaaacgactgcgtataagtccgtgacctggttaccggagcgtaacttctccggcgaattggacaattttgagaaagacggattatggactccatggaagctccatctctaccatttcaatctccctctcgttccaggttttaattttgagtttataaggattatctcataccttctaacaaaaaccctaaaaacccaatttgtttttttggtttgcagtcaacaattgcatttctacctcgccgtggatcgtccccaattcaaaatg

SEQ ID NO: 6318 - DNA, 3000 bp, Unknown; identical to SEQ ID NO: 6296
  misc_feature (1)..( 3000): cDNA_ID_2999338_gDNA_ID_1621088_Annot_ID_55442 3000 nt of promoter + ATG

SEQ ID NO: 6319 - DNA, 3000 bp, Unknown; identical to SEQ ID NO: 6295
  misc_feature (1)..( 3000): cDNA_ID_1813986_gDNA_ID_1621088_Annot_ID_55443 3000 nt of promoter + ATG

SEQ ID NO: 6320 - DNA, 3000 bp, Unknown; identical to SEQ ID NO: 6294
  misc_feature (1)..( 3000): cDNA_ID_1813982_gDNA_ID_1621088_Annot_ID_55444 3000 nt of promoter + ATG

SEQ ID NO: 6321 - DNA, 3000 bp, Unknown; identical to SEQ ID NO: 6293
  misc_feature (1)..( 3000): cDNA_ID_1808519_gDNA_ID_1621088_Annot_ID_55445 3000 nt of promoter + ATG

SEQ ID NO: 6322 - DNA, 3000 bp, Unknown
  misc_feature (1)..( 3000): cDNA_ID_1813974_gDNA_ID_1621088_Annot_ID_55447 3000 nt of promoter + ATG
ttttgccggtaagcccataagaatcaatgggccataagaatcaatgggcttatcttaattgggtttaattaggccttataatataacaactcagccctcataatgggcttgaatctttttaacaaacataaaactaaatcatatagcttaaggtatatggagttttaaaaccaaaatacatagtgaatataaattgattgtgtacaaattttttatttggatactagcaaacaatagctgtaagtatatcatatattctattctgtttattttaggaggaaaaatgtcatttaaatcaccactttgccattcgtggtgatttatcatgaactttgctttttatgattaaaatcatcaattaggtgttgacttcaaataaaatcagtaactttcgttgacaaagccaaattagtcataacgttaactgaataatacgaagattgagataaagattgtgatgaaattggatacgaagctgctggcgaggaagacggtgaagatgaagacggaaatcttgatgacttgcacgaaaaagttagtgtcgatgaagaagttgtgggtacggatgtgactaatttggctttgtcaactaaagttattaattttatttgaagtcaacacatcattttaatcacaaaaaacaaagtttatgatttaaatcaccacaaatggcgaaatggtgatttaaatgacctttttcccatttattttatctcattaaattattcatcttgtgtttactttaccacgtgaagcctgaataaaatttgaaattcgaattaatgttcgtaacttcttaatttatcattcacttccataataatataattttatattttttattctttattaaattattcaattttgtcttgtttattcttcttttgtttaccacgtgaaatctgagaagaagatttgaaattctaattactgttcgtaacttcttttccccctagattaattttgtttatctttgtcccatgtatttttattttattttgtcattcactccaataacttaacttattctatatattatttttactttttgtatttgttagtttctttcaacattcatcttaattaaccttatgtattactcttgtgtttaccacgtgaagcctttgatcaaaatttaaattctaagtaacgttcgtatttttagaaaatagttttaaccatttcactctaataactacttccacatgttatatatagttttcacaattgttagttaaaaaagaaggatttattgtgcttttttacattcctctattaatctatatgactatatgtcaattatccttcatttataagtttttgtgcatataaacaactcatactaatcataatgaaaatgaaggttggtgcatctaataatggtaaacggtcaatttttaagtaataaaagagagagagaagtcgccatgcaattgttgttatcgtttaatcattgaccatacttcactactccttatggtggaaatttcaattggttacgtcaaagtttatataacgtccgtgtgaataaatttgacatgtttcaatcgtctacgagtctttcttttattcacacgccattttatgttttttattttattttattttgtggcgaccacttcagagttcacaccattttgtcttaccaaaatttgtaataattaagtataaatttgggtcatttctttttgttttaattcagatcattgtaggactactttaagcatatatggatttaaaataaataaaaactgtgagagttcgattaacattgttggcaagtcacaaagtctttaactacaaggcattgtgggatttctggtactttgattaaatgtcttttaaatttttatcaagctataattaccgatgtggacttatcatacaaagtgttataggtttgctaattattgttaatcagatttcttgccatagaagtgatatattgagatccgtacgtatgttattagtttctctaacaaccaaaagatttagaaacatttatgagtttcatgaatattccttatcttacgtataacaaattctcaagggaaatcaatctaagtttattctatatccggagaacactaaacttgaaaatggtctaaactaaaaccaaaatcaagatattatttgcaacaaataattcagcaatgagtagagattttgagcatgcatgcacatgttttttaatgacatgtgtgggtgagattttcacaattgttttctaaaatcaacactgtttctacaagagaaaatcacgcatcaccatcaccccatcaataaataataaccaatattcacagccatataaatactacttcacacggtagggaaaaagaatctcaaagaaaaatttgacagaatcttccatccgatttttacgctactaagaaaaacgcgaatcacatggtagatcttgaaacaaacgtgtacaactacaaatctaatttatcaaatcaataaaatagaaaaacatcaaacaattataaatatacatctttaaatattcattaaatttacaggataacaatatatctctatcttttatagctaaaaatcatatttaagaaacactatcttatcaaagtacaatttagtaatcaaattacttaattttatatttttatagtgctatactgctatagtttatttttaattaatgattttttttttgttattctacagtgggcaacaacaagaatcttctcacaccacccacgtttcctttatggaccgctatttcttctcttggccaagagcaaattcttataaattggtaaaatatttttttagataaatccatatacttatataatcacgtgcattaattacataaatacacttgtttacaacaaactattaactttttttcttcttaagaaaataaatatctcaagagtatatatataaaaacagaggtagagttggagaagaagaaagtgtagagaaactgtttcataagacttttttttcttcttcttcttctctgttaaacta

SEQ ID NO: 6323 - DNA, 3000 bp, Unknown; identical to SEQ ID NO: 6292
  misc_feature (1)..( 3000): cDNA_ID_1807145_gDNA_ID_1621088_Annot_ID_55448 3000 nt of promoter + ATG

SEQ ID NO: 6324 - DNA, 3000 bp, Unknown
  misc_feature (1)..( 3000): cDNA_ID_1813970_gDNA_ID_1621088_Annot_ID_55449 3000 nt of promoter + ATG
tgttttttttttggttttgattaccattggttaaagcagagattcaacgttagacggatttatctcgacacaactctaattcagtttgaccggactgaacacttttatcaatattaatgttgagttgttgacctatatattattgtaataatgaataaacaacgccatgattgcgtactatctatcagactttatagagtaactactttgattaaccattacattttgtttttatgagaatgttttcagttatatatctttatcaacacagttgaaacctgttcttctatgttaaagcctttgaatttgagtaattttacttttgatagctagcctttttaaaatgaatgattatattgttaggttccaagtggggagttgtcttggggatctcatttgacgtgtgatcttgaatttttgatagagatcctaatgatctcgtggtccctctcgcagagtttatgtaaccatctaatatataacttcatgtctggatatggagaatccaaaacttaagaaatgcacgtattagcattcgtagttgtatatatgttatgtattttgcgtcaaatgcagaacaaaataaagcaagaagagaccaacaatcttcatatggagaattgtaaattgtccaaatcagcaatatatagatgtcttgaacaataaaaagataaccgagtttaacattagaccaaaaaaaaagaaagataaccgctacagaatttgtgacgaaaagaaaaaagctttggagaaaaaaacagagtaagaactgtttttgttgtgtgagaagagtttgtccttaggtcgcataatcttttaggatgtagttatatgtgttaagtgtaacacatgcatatcatttacttctgcaatatatctcttctggagtttcgtaaggtacttatggttggtttgtcttcgaaactaccaacgaacaacttaaaaaacattgatctttttaatagcgtgagtttgatttatgttatccttgttatggtgcatatgtattacggaaactttggtctgttttagatgggtaaatagttgtatatgagtaaatatgatattgccagtgttttatataaagaaaaagggaaacgatgataaaaggtgaaaaagaagtttaggatcatctttgttttttattttgttttccgactttcaaatcagacaagacaacgaggtatgggtcttttaacatacagagactcaacttgaaaattctatcaaaccaccaattaaaaaaccagagaaaacattcaactatcttcttagaatctagacaaaataaaaagtgtatcatgctgattttgaacaaattattaaagagatctcaaccatcgtttcattaatatctttgacaattctagaagccgtagtaaatcttgtctttttatgtgtatatcttgttgaatttgataaggatattcaaaataatgagatatgtatgttgagtaattgagtaaaatcagatcccttgtttaatttgacgattaaacgcttttttcattattttttttcgcattttgttgtgtatgttctcaattacaaattccactataagcatttggactctacaatgtcactttctaattctgatatttaataaaacaattattttgtatatgtataaatagtaccagaaaaacgaacttaataaaataattgaatcaaaagcagatgctgaacaaatagctgcagcttttagcaattgtctcccatatgcttttcctttgtttcaaaaattgtatatacgaggttaagtgaatgttgcaatgaaataaatgatgcagtttgtgcattcatcaagcgaacaagtacgattgatgttttcagtgcaaaaactaaaataaaatactactaacaactatatagtgtaaatatatataactttaacttctttttttttaagtcttcatacgctgcgaacgatcaaaatatatttacaaatttacgaccaatattttaaaaatacttcattaaagaattgatgctgctgtctgcacagttgagaacgcaattggaaactttcgtgcattcactttgttcgccgcaaattggatatgtgaacgtggtcatcattatttatagaattattctataaaacttactataaaacactagatataaagctggatcatataaaatgaatttactaaaaattcgatagttaattatagcagatgttatgttccaatttgaaagcatacgaacgaggtatatagttgaaaacacacaccgtaaagttaataattttcacaacacaagaacaaatcaaagtcgcaagtaatttaacgcatgtcagtagcatgggcttcttatatactagtcaatagaataaactagcaaacaagcaactaatgtattcttgtttatcacgccacgggttacaatatcatacaaaatttgaatactaattaatggtaacaagtaaaaaaacaaattactagaaatggaaatacttttgtcaaacaaccaagacgtataacttttgttttctatagattaatggacttcttaaaaatctctccatcagattaaactttgagatatacaaatacagtttttgttttcttctaaatgatatgaatattaactttatcgatttcatccgtagcagatttccattttaaataataaactatgagaaaacagataaaggttgtatattatttgttaccccaaaaaaaaaaaaaactaactacgagtagtagtttagtgtgtctcacgtgcgacgaggaaaagttttgggagagtaaaaacatttaatatttacgactagtttgaaaaaccgtgagctgacacaagctcattgctaatgctacagtaacagctaccttcacttttaactaaatgacagaccaatcattttaacctctgttttcttagctggcgcgtgacagacactctccctctctccatgcccataaaatctcaaagactgtttaaaaaaaaaaatgttttagctttaactgctttttttttgttgttggtgtaatg

SEQ ID NO: 6325 - DNA, 3000 bp, Unknown; identical to SEQ ID NO: 6291
  misc_feature (1)..( 3000): cDNA_ID_1807542_gDNA_ID_1621088_Annot_ID_55450 3000 nt of promoter + ATG

SEQ ID NO: 6326 - DNA, 3000 bp, Unknown; identical to SEQ ID NO: 6290
  misc_feature (1)..( 3000): cDNA_ID_1383434_gDNA_ID_1621088_Annot_ID_55451 3000 nt of promoter + ATG

SEQ ID NO: 6327 - DNA, 3000 bp, Unknown; identical to SEQ ID NO: 6289
  misc_feature (1)..( 3000): cDNA_ID_1813961_gDNA_ID_1621088_Annot_ID_55454 3000 nt of promoter + ATG

SEQ ID NO: 6328 - DNA, 3000 bp, Unknown; identical to SEQ ID NO: 6297
  misc_feature (1)..( 3000): cDNA_ID_1813957_gDNA_ID_1621088_Annot_ID_55455 3000 nt of promoter + ATG

SEQ ID NO: 6329 - DNA, 3000 bp, Unknown
  misc_feature (1)..( 3000): cDNA_ID_1814123_gDNA_ID_1621089_Annot_ID_55458 3000 nt of promoter + ATG
ttatatagtatatctaaaggggaaacattcaagcagaccaattattcttttgaactaccaaccaatgtcattcaataatatctgaagacaaagcaaaccaattcaaagtaacaatacttaaagatgtttgagaattatactcaattactcattgtggatcaagagcattggagtatctttttgtcaaatatgcatcattattactttgaaaactatgcattgacttagattgagtaccttcttacacttgttattaatgttgtattctgaagaattggtgcaactcatcacctatgaagcttttttacttacccaacttcagcttggaccatacctaatcacatgcacttactccttacacaatttttcttcttcttcgtcgtcacattcacaatatatctgtttcacaattactaggctatcatcatcgtactctagtatttggcatctcacatagtttaaatatatttatatcaagtattcagctgatagaaagttataagttagatactgtatttaacgttttcactaaaacagaaaatgagccattgatggtaatcagtaaagcccaaatgggccttcaaacccatattatagttgaggtttcagaagctcttccacggaagagacagagaatgaccgacaaacagagagacgaccaaaagaagaatctgtgttctctctcaaagaaataaacaaaagaaatgtcaataacttcacgtgtcggtattgtgacgtggaagcattcgttttgacatcatcagagaacacatcaatccaacaaagaagatcgatattttcagattcaagaaatcaaatcttgttaaactaaaggacaaataatgaagaaagatttcaatatatacacactttttttttggtatcaatgttaagtttaaaaaaaagaagacgcaaacatgcaaagaagggaatcgaactcaacacccaaaacttgcatggggtgttgtactattttacaacatataccataagataagatgtcaatatattagttatgaatgttttcgttaatgacaaaatgcaaaaactgaatcaagaagatgaagagtaataagagttaaagaagacaaagtaagcaataacagcacaaagaagagccacaaagtttccttctttaagaagaaccttaaacacataaccagcaatttctttcgtcactttccttccttcaatcaccactttcttcctcgactttacggggaacgctattgtcaccactaccgatatccagatcacaacgatcgctggcacagcgatgaacagagctgccgccatagatagaactccgaacaccgcaccaagaagaaccgacgcgtaaatagcaggcaaaccagatgatgtctgatgattctctccgtaccaattcactatcgaattcaacgaatttcttgaagaagacaaaaggaccgcgtagactacaagaaacagacagacccatgttctcctcttgcttatgactctcaaaaacagcttgtacgaggtcatcgtctcttgttcttccttatccgccatatttgagaacaccagattttcttatgattctgtgttggaattgaaactttgattaaacctgaaaaagagaaaagcttcaagtgggaagaagatgaagaaaagagaagaaccaaaagcaaagcaaaaggagaagaagaagttgtcgaagaagaagagtcaacagaagagatgagaaagtcaaagatgaggctattgggctagagtgaagcccacatagtaaattagtaattgtgtgttttggttagtaaatgggctattattagagttgagcccagattttgtgcatatggtgtgcttataattaagctaagctagagtagctaaagagtagttgttaagaggagttgtggtgtaaggtttagtagtttaacgttacttgtggttttagtctagtccttaggaataatcatgtctaagtgggagtagttttaaagctagaatgttaagtgtgtgaatgtgtatcttgtggtgaaataccactataagtatgtgtattgtgtcttgtagagttatccttgtgatccattagtacaatgtagacaactaaaagaaaaaaaagaaaaaatcgtttcttgtgtttctctctaaacaataacaaaaacagagagtgtaacaatgagagagagacataaagaatgagagttctaacctagtgtaaaagggaggtaacattcggtgtctggtttggtaaagttatggtaaatagtaaaacaatatttgcaatgttgcacactgtcaacatctcccaaacgcaccgtttcataaaccaaagtgattagtgattgattagtaatacttgcactgttgcacatagtaataagagaatatcaacttcaatgtttttgaattgaacaatgaacctaccaaaaaagtagttactgttaggcatttgacatgatgattttaggattaatatatactaggtcctattaatactatgatgcttacaggtgacgaataatttgagttatgtgcgatatgtttgaaagaattaaagaggagaatcaagaagaagatgaatatttgacatttcaaagctgacttttttgacgaataagttcatcattattcacacctataaatgtggacagcgaaataccaagtccaacaatttcacgattaattccaagtggcttggatcaagaaatatacaaaaacaaaattccaaatgcttaggaaaataaataaacgagagatcaaattatcacggcggatattatttcgtccacatttgttgttcaaacagatttctaacacatataattagcatatatacattaaacaacattatctccttaataattttgactctggaacagatctttccagtttcagacaatatatttgaacaatcggttcgttgaatcgagaacaaaccaatcaaatctcttttgacaaagctcttcttcttcttcccataaaacttcacaacggcacacgtctacgaaaaaacctctctcagtcatc

SEQ ID NO: 6330 - DNA, 3000 bp, Unknown
  misc_feature (1)..( 3000): cDNA_ID_1814119_gDNA_ID_1621089_Annot_ID_55459 3000 nt of promoter + ATG
aaataagatactgcttacaaagtttccgtttcagtaatctgtctcttggagattcttgaaacacttgagaggagaaaattccaagctgtacaacaacagaaagttgacactagtaagctcttggaacattttaacacatcaaacaagccattagcagaagaaagcactatcgttgtcttaaggactaccagatgatagggatttgagagaagattattgtcttcttgccctgaatcactctccttgccgctgtttaggtcaagtgatgtacagaccttggagttaagactcaataataaatcttaagagcagttaaataaatcaaaagttagtacctgttagccacaaggcggagttgtctaaagggccatatatatacaccttccagatttatttgggcaccacccacattttgttcattgtcaaatacgtcatggaaaacaactacaccctgtttcattaacgttgtataagttcaaaacattgcattctacaacatcaacggtgatcctatgatacagagcttagaagctgaactctttacctgaacataatgcacaccagttatcttcgttggaactgctactaactcaaccacagaattaccattttctttttgaaagtcttgaaacttcgaagagctatttaaggaattcagaaacttccaagttcctgaaaatacccgctttacatttgataagtagtctaaaacattaagctacagacatatacccacaacatcgtagacaatcctgaagtgtaaaagacgtaaaaaaaatggagaagggcatgcggcaaacctctataagttcctgttatattccaagcagaaaagggtccaacttcagcttcttgtttcctaccaaagagccactgcaagatcacaaagacctcacgtattaaaccattacccaaacattgcctggtcagtctaacgtacatgagttccctttgcacagtctacttaaaagtcactagctacaaacccaaactgtaaaatgtcatcgaagattccccactatcacgcgttctacttctgtaacaactaaccggtctctatgtaccttagactccattattgtagtctcatcacaccacactactaacgacagattcattcttattcatctcaaagtattcgccggcagaacaaagcttagataccgatgagctcaatcgagctaatgtaaatagtttatatacattttcagctttgctcaatcaaatcaaaagataaaacttagatcagagctgctctactccgggattttcattcaatatggtccattttcttcgaaactcagaaaatctcagacttagaaaaaaaatcatcaattatgaccagttctcgttcagcaaatcatgagcagaaacaagtcaataaaaaaaacatttgacagcaaactgctcgaattcttagttggaaaggcacatcaaaattacgaacaaaacataaaaatatgtttctgggaaacatcgaaatgaagaaactttcgaacaatcatcaataaagtaaaaacacacacacatacctcgtcactccatgatcgaggtttctccctaataggtctcaatcccagcgcttgttgcgaaatcgccaaccaaatcgataaccataagataatctgccactcgaagaaccctaatcccaaatgttcccgcttcttcatatcactcacaacccccaaaaatcccttctttatgactcaatacaaaatccgactggatcagaactgattcgagtctagctcaaaaacccacataactgaagaaagaaagaggtttgcttcaaatgaagtcaaaacaaaactaggctttggttttggttgtgtaagaaaacccaaaagacagcataagattcgtagatgtatcagacagcagatagaaagatgattacagacagataaacaacaacaacaataacaaccttaagatgcaatttgttttataaaaaactccaattgatgaatttgggcaattgcggtcgttgaagcttctcaatcaaacgtattcttcaataactcaattgttgaacaagtcgaaacttctttttggtctctctgatttttatttttatttttatttattagctttttctgttataaacgaaggaaggttcaattgataaattagttagttgaggtttcatattctcaggtcttttctttacgccttaaaacttcttttttcctcaaaaaggatttgtaccaatctattacgtttttttttggactaaaacataagtagaaatttgtatatttcgatctcacagtttaggaacgatcatcaaatatttaattagatccttcacccccactaaatcctcattatagaaagtaaacaatttctaatattgtccaactacagtagttgatgttttaaaagtagaggagaaagagtataaaattaggagaaagattgtgtacattgtgtaaactacaagacaatcaaaaaggattcagtcttctactaatagttgggctttaaaggtagaggagaagaaactgcaaagcctttcttacaacatacccaatccatttgaaaggcccactaaaattttattattgtatcactgggatatttatcgatttgtaaattgaaatataaaataaaacaatatgtaacgtaagttttaaataataataaatactaaaggattacaattttatatttgatggctaaataattacaagatctgagtgagaaatgtttgtttgtgagaaagaaagtgaaaaattaaaggtagatagccgttaagtccactgcatgtcgagacgtgttcaaaagaagacaggagcaaaaccaaaacgcttctacttaattcgcatttctttaggtaatcgatgcacagcccaaaaagcttgacctaacggctatgttttctttactttcaccataaataagcacctcttgaggttgcaaacacacacacacacacacactcacttcaaaagagttagtaagaagttggggtttgattaacgttttgcatcggagatg

SEQ ID NO: 6331 - DNA, 3000 bp, Unknown
  misc_feature (1)..( 3000): cDNA_ID_1814115_gDNA_ID_1621089_Annot_ID_55460 3000 nt of promoter + ATG
ttcggtgtaccggtttaatatattgattaaagttaaattgttcaaaccattcttatatgtacaaaaagtgtataagatctatttatatgtttcaacaagattttagtttgtgtggagaagttttattgcatgagctatgtgaactctacatattcgtcgtatatattcatattagtgtgatcataattaaaacacaaaataaaaacattcgcatctaatcaatacaaaaaaacatcttaaatattttctttagtaagaacaaaaacgagacagcggaaacattaaaaatgggttacaagatgcttcaaacatacaaataaaaaggcacataaatatgaaactcaatggtagagtaattaataccctcacaaatttaatgactagcgacaatatataaacccctcaaaacagagaacttatcataatcacaagaaccaccatccccggaccaaccaaaccggccgaattgggagctgtagccggtcctggagctggaacacgagagtttgaatcagatgatggttccactcctggagaaggccccggcgaagacaactcctgatggaccggagacggggagggagaggtatgacgaggagagtggctgtggtggacggtggacaagaccttgacggctagcttctgacctttaagacagttttgagagttgccactaatgaaaaagtaggaacctgagtggctaagtaggaagagagagtctccgtctgagagggaagtcagggggtgtgtcgtgttgcatgtgttgtactcttgttcagtcacctccaacactgaatcttttcccttggcgtacttaaaatcttgtaaaaatcaaaattactatgcattaatattgacacattgtgtatatatagtagagaagaggaaatagacttacgaagagtgtcgttgacttgaaaccggtttcggtgagaccaatgagaataatcttcggaaggagtcgggacccaaccatctttcccaccaacatagaacttgtatccatttgatatcgtaaaccctaaacccatcaacatcacaaacataaggtaaagatcaaacctcatgaccaaacccatctccgatgcaaaacgttaatcaaaccccaacttcttactaactcttttgaagtgagtgtgtgtgtgtgtgtgtgtttgcaacctcaagaggtgcttatttatggtgaaagtaaagaaaacatagccgttaggtcaagctttttgggctgtgcatcgattacctaaagaaatgcgaattaagtagaagcgttttggttttgctcctgtcttcttttgaacacgtctcgacatgcagtggacttaacggctatctacctttaatttttcactttctttctcacaaacaaacatttctcactcagatcttgtaattatttagccatcaaatataaaattgtaatcctttagtatttattattatttaaaacttacgttacatattgttttattttatatttcaatttacaaatcgataaatatcccagtgatacaataataaaattttagtgggcctttcaaatggattgggtatgttgtaagaaaggctttgcagtttcttctcctctacctttaaagcccaactattagtagaagactgaatcctttttgattgtcttgtagtttacacaatgtacacaatctttctcctaattttatactctttctcctctacttttaaaacatcaactactgtagttggacaatattagaaattgtttactttctataatgaggatttagtgggggtgaaggatctaattaaatatttgatgatcgttcctaaactgtgagatcgaaatatacaaatttctacttatgttttagtccaaaaaaaaacgtaatagattggtacaaatcctttttgaggaaaaaagaagttttaaggcgtaaagaaaagacctgagaatatgaaacctcaactaactaatttatcaattgaaccttccttcgtttataacagaaaaagctaataaataaaaataaaaataaaaatcagagagaccaaaaagaagtttcgacttgttcaacaattgagttattgaagaatacgtttgattgagaagcttcaacgaccgcaattgcccaaattcatcaattggagttttttataaaacaaattgcatcttaaggttgttattgttgttgttgtttatctgtctgtaatcatctttctatctgctgtctgatacatctacgaatcttatgctgtcttttgggttttcttacacaaccaaaaccaaagcctagttttgttttgacttcatttgaagcaaacctctttctttcttcagttatgtgggtttttgagctagactcgaatcagttctgatccagtcggattttgtattgagtcataaagaagggatttttgggggttgtgagtgatatgaagaagcgggaacatttgggattagggttcttcgagtggcagattatcttatggttatcgatttggttggcgatttcgcaacaagcgctgggattgagacctattagggagaaacctcgatcatggagtgacgaggtatgtgtgtgtgtttttactttattgatgattgttcgaaagtttcttcatttcgatgtttcccagaaacatatttttatgttttgttcgtaattttgatgtgcctttccaactaagaattcgagcagtttgctgtcaaatgttttttttattgacttgtttctgctcatgatttgctgaacgagaactggtcataattgatgattttttttctaagtctgagattttctgagtttcgaagaaaatggaccatattgaatgaaaatcccggagtagagcagctctgatctaagttttatcttttgatttgattgagcaaagctgaaaatgtatataaactatttacattagctcgattgagctcatcggtatctaagctttgttctgccggcgaatactttgagatgaataagaatgaatctgtcgttagtagtgtggtgtgatgagactacaata

SEQ ID NO: 6332 - DNA, 3000 bp, Unknown
  misc_feature (1)..( 3000): cDNA_ID_1814105_gDNA_ID_1621089_Annot_ID_55464 3000 nt of promoter + ATG
agagaatgctataaggaatgcctacagatcaacagatgccgtgatattgcagcagtcccttaagcttggtaaaggcggatcaacagctgtaacgggaattctaattgatggtaaaaagctagttgttgctaatgttggagactccagagcagtgatgtctaagaatggtgttgcgcatcagctatctgtcgatcatgaaccaagcaaggagaaaaaagaaatagagagccgaggtggctttgtgtcaaatattccaggtaaagctacataatttgttctaactagttatgcttttggtcttcttggattaagtattaacgttcctaaaatgttgcaggggatgttccacgagtggatggacagttagcggttgcaagagcatttggagataagagcttaaagttacatctgagctcagaaccggacataacacaccagacaattgatgatcacactgaattcatccttttcgcaagcgatggtatttggaaagtaagtttaatgactcagtatcttactctgtttctaaccgtggtttagccagtttctggtctacttcttctaacatgatggacgatctttaactgcaggtattatcaaaccaagaagcggttgatgctatcaagagtatcaaagatcctcatgcagctgcaaagcacttgatagaggaagctatatctaggaagagcaaagatgacatctcatgtatcgttgtaaagttccactaatcttctcttcttcttatcaaaagctattttgtctataagttaccatcaagttgcaagatagagaaatatatgctcaagctgtgtctgtaaaaacccagtaatgaggtttcccagaagatgtaatatattatcgaaatcgcaacagccttaagatacaaaagaaagaactgaaattaaaaaaatgaaataaaacaaatcgcaacagccttaagatacaaaagaaagatgttcttcgtagttgttgtcatcttcgaatctcctcttctctgcagaaatagaaaaacaaaggacaaagtatattgtcagctttaacatacaagcaaaaaaattgtggtggatcaaaggaattaatggaacttacaagcgcatgtgtggtctctagacatggggaagtcagaactgaaatgacactggtcggaaagagccaaaacgtctggcttgagtgattcgatggatgtggtcagaaactccatacaccggcaaagcctgcgcctctccttcccatgcttacggcggcactgaaccaacggcaacactctgcggtgggcggagactcctgatggacgaagaacatcttgcactgttctagcatcacgttcgccacgtctacacactccggtggccaaggacggtacactgcgtcggtagttgtggctgcaacaagaagacacatcattgcaaacgctactttcatcatcatcctagccaaaatgtagcaattgttgttgttttgtttttgtgttggtcttattttatctctacctaacgtaatcgtgacactatcttaacagaaaattcaacttagtaacgcatgcgagattttaatgctttcggccgcgtgggaactatctaaaatttaaatataggcgtttctcgtatttgaaattttaaatggaccattaatggccatgttagtgtatgtgtgtggtgaaattgcgaactacatacagataacaaaaaaaaaagaaaaaaaatctaactttcttacatatgttagttttggaaatgcgtaagaccatatatcacaaacttgaacaattgtgttttatgtataaaaaaaaaacatgaataaatgtgttattctaaactcccatttccaagacgattaaagaaaattgggttttcaatatcgaattttatgttaagttatgaaggatttaaataagttttagagtattttaattagtactgtatctgtatgtaagtaaaactacaattaaaactttgagaaaaaaaaatcaattatacagaaaaaaaaacattcagaatacgttagaagtgggaacctcaatgttactcgtaaccttaaatggtcaccgaccattgcgcggatctagttgtttttatcgtggacgtcaaaaaacccttttttaaaattacctctctaatcttttgacgggaactacacttcgttccaatggccattgttttctcttaatttttgtttaggctaaacaacaacttcaaactgacctcaaatatctgttacaaaagttctgaatccacagaggatttaacttaactaggcgggatagaatataatttaggatcatagttaacaaatgaaagagacacctttgtctttctatccgaaagctcatttaaacctcggtatatatgtaaacattactttgacctccttcacaatgttgagcagattacgtgtgttttgaaggattggttttagggctggccattcttcatctgcatttagcatcgttacaaagctcattggaattcgaggatgactttttgtgttgaagttggctacggttcccacttgccttttttctctcttattaaattgcccattcacgaggtattgtagttttttttgtttttaacaataattttaaaagactctttataaaaagaaagaataactaaaagacaactataaaattagacacctctcgtgaatgcctgaatgacccatttcgtattgatcaataacatgaagatataaagacgtaccaataatcatgtatattttacggattaatctgtgcttatatatatctaagtgataatctaatttatgtttgtgcttgtcgctagtggcttatgggtagcatttaagtatgggttagtgcttgtctgagttgtgtctatgaactcgagtgatcgagcgcacattccaaactgaacacacaaaaaaagcaaaaaaaacatctaatttatgtttcatgcttatatatatgattccactttcacaaaagaataagcacacaaaagaaaaaacaaaccaagaggaagaagttcactcggagca

SEQ ID NO: 6333 - DNA, 3000 bp, Unknown
  misc_feature (1)..( 3000): cDNA_ID_2104909_gDNA_ID_1621089_Annot_ID_55467 3000 nt of promoter + ATG
gagtcatgcacttacttattggtaccaccaccaacgtctcttatactctttcatgattctagatcaatttggatgattcttatttcttaacaacaattaaactgcagacgaagctgaagcttccattgttggaggacatagaagacgacatggatttctgtatgaagctagccaaagaagaaaacctcgtcttactaccaggagtggctttgggattgaagaactggataaggataacaattggagtagaagctcagatgctggaagatgcacttgagaggctcaatggcttctgcaaacgccatctcaagaaaacagaatcttcttttcaagctctgagcaatggcaaaatctaaaccactcatctatagagagactatacacaaccaaataaaaaatctgcaatttttgtggtgtaaaaaacaataatcatgtcattttcatataagaaactctatgtttcttaatcttatttctttgtttgagtcaagtagaaaaagacatgaataatgttgaatcaagactttatctttaccgttaaaagagacggacccactttgccgccgtcaaatttaaaaaatgcaaaagatttgtcttttactttctttcttcatcaacggctctctgatccacagtagccggagaaaaagcagagagctcaaattgtcggaattaagaatccccaaatcacatcttcaagaaccctaataaattcccagagattcctctcatttaatcacttcagattcgaaaaaagttctctctttttcccaaaaaaaactttctcatacaatggactctactaccacacctccttctctccgttcgaatactagatccgctttgcgtctagctcgaaacaacaaaactctcgtaaaatctcacattccatctctcgatttggttttattgtctccgaagaacaacaacggtactccttacccatcacctgtttctctcagttcaccatcttctcctgttactcttcgtgagattctccttttatctccttcccctcttcgtaaatcgagaacccgtttaagcaatcggttcgatatggaagctgcggaggctgctgtgacggcacgacggagtaagacgaagggagggcaaaatggtcttttggcctcgccgtcgccgaggaatttccggaggtcgagactaaggtcggaggcgatggtagatacaaaggaaaatacggagccaattgttgtcgtgaccgatgaaaagaaacaaaaccagaggaaacagaagaagttgggtcgatctaagaaggagaagcacagttctgttcctctgttagcttctcctagtccatcttcagatcaacgtatgtccttcctctgtctattagctcattcgatttcactttcgtgctctaataattgctcaatgatttgtgtaattcagctcaagatgtttgtcaaggtgatttagagcggattagagagaatataagcgatttgattatgtggagagatgttgcgaaatcaacactttggtttggttttggctgtatatgtttcctatctacttgctttgctgctaaaggatttaactttaggtaacattgatttctctgtcaaggtttatctttctagctttaatcatttttcacattcatgagttgataatgaaactttgtgtggtttgaagtgttttctcagcgatctcctatcttggacttttgtttcttggggtatcgttcttgtcaaatactcttcgccaaaggtacaaacttttaaggtcccagtacataaatatcagcttgaactgcagttgactgaagttttgatccatttgttaccataaagggttactgaagaagcgcggagagagcttaaattgagtgaagatgatgtattacgaatagctagacgaatgcttcccatcaccaatttagcaatttcaaagacgagtgagcttttctctggtgaaccagcaatgacactcaaagtagaatttacaaaactttgccattctcataaaacttctctccaatgaatgtgactctcacgttgattttgtccttcttacactgtttttactttgatttcaggtggcaccttttgttctaatgggagctgagtatggttacctcataacattgtggagattatgtgcttttggtatgattgttgaaacactatatgtcaacattactccaaagaaagctaaactgttttctttagttgtatctagtagaattgacacagagtatgcattgtttctttaaacaggtttcttccttagcttcactattccaaagctatattcatgttacgcaagtcagcttaaccaaaaaggtaaactctattaacagactgcgtagctctttgatggttccaatgattgacactaaggattctttgatctttgcttatgtgtagttgagtgtgcacaaaggagatttgttgaagcttggggagtttgcacacacaagaaattcgtagcaggctctgcagttactgcattctggaatctaacttctctcaagacccgttttattgcagtgtttatcatagtagtagtaatcagatacagacgacagaatctacagttagattccgaggatgaggaggagaagaagcaacaagaaaaaactcacccggagcaacaaaaatcgccggaggataagtcaacttcaccgcggtcagcagaagaagagcaagcgttggtgctagttgcagaaaccaaagcaccaaagaagctttattagtctagtcactagtgtcttttcagtatccacctgtgtaataatatttcacatttacgtaataataaataaagagcagtcattaatatcaaataataaattgacacgtgacaagctcatgaaactgtgagaagcaggtgataaaaactctcgtccgtcttgggagagagcacatcgtcgtcttttctttataaaccctaaattcccatttctcttctccaaaagttttatcgattccaccaaattagggcgaacgcgaaatctgggtattgtaatttgaagcg

SEQ ID NO: 6334 - DNA, 3000 bp, Unknown
  misc_feature (1)..( 3000): cDNA_ID_1814093_gDNA_ID_1621089_Annot_ID_55468 3000 nt of promoter + ATG
tcggtgccagtgcgggtaggacaagcggttgatgtggttggacaggcaggccgacctaagacaatcactgggttccaaacgcactcaacacctgttctccttgctgctggggagagagctgaactcgcaaccgagaagtatgttgttcctctaatccccttgttacattatcctactcgaaataaaactctgttttacatattggaatctaaaaaaactctgcttctttttgggtcacaggtacattccgttgtcgcccatattagaaggtttcgtcatattgaaggaaaatccagactacagagaggagtaaatccaaagttgcaagcatttgaagaaagagagagagcctttgaatactttcactacggttgtcaaaagttttttagtttattcccgtctgttcccaggaaatggttcacaatctctccttttaaaagaaaaaatagcttcattgcaatatataggaacttcttgtgcactactttaatatcgcattctaaaagctggataagtttccaaatccaattctcttaacctgcaactccttcaaatcaactcgttcgacgtttctataaacttggcttattgattatgggctctttggtttgctgccctggaacttcaagttcttggtttgtacgcactccaacttcaatttgtgacatgcaaaggctcctctcgttgtttccggatttggccaaaactatgtaatattattaaaatgttgaaagggtgacccagctagcccggctacatatttacaattttacatagatggcgtgcacgactcacttgtttcctcggtgtatcttttttttttttttttgaataagttcgttcccaaacataaaccagaagtataaaatcttattaaaattagcaaccagcaaaagcaaaaatcatgtacatgtatattgagggttttagtttctgtcactaactatatgaactttgcctaaagaaaaaaaaaacaaataatgaaataaatgaatggaatacagttttcaccgtttgttctggtatacatatggggtatatcgagattaattaatctcctccggccaggaaaaaaaaagtaaaaaaggaaaatttaatggccgcgacctcttggacttggacccgacgccaaacgctgaaaccaagaatccaccgtcgatttcatcttctccaccgtcatagtcgcacttccatctcccgatttttcagtaagaaccctccccgccgcagccggaaccaccacgtgttctacgaaaaacaacgacaccatcacaaccacaatcaaaacagtagaccaactaactcttctcatcgtattttactttctcttctttatgttgtaccgacaagtaataaaataaaacagaagccttttttttgtttgatatcaaagaaaattaagagatatggttatgtgggaaatcaaataaatgagagggaatatttatagttatttgacgaggaagcggtcatgacttgagagagttcatcacttaggtcgggttttcccggcgctagctcacgattttgcgtgttgaccaagtattatgacttgaacgggtcgctcttatgacactttacgatgtgccaaattacatttatacccattttggtggtttttagttttttagaggtaaaaaataatcaatgagaattttgttaacgaaattatatttacacataaattttttaaaaacaagtgttttattcgaaaaactaattgatgcaattttatcaagatgtttacgcggtaccaatgattaatttatactagatcatttgatagcaattgtatctttcaaagatacaattcttatttaagctatttattttaatagaatcacatatcaataaaatatttcaagaaatttcgcaatatatcataggcataatttcgttctgaaaagtcttatatgaaatttgaaacttaacgcgtaagttaccattgactaaataaaagtaccgtaggaggaccaattcacagtttcacttaaataattctcttgtcagtgtagtttgagtggacaataatccattatgagttaatgaaaaaggttgaaatgtaagataaaattacgtatcaactgcgttagtaggtatataagtagttagagaacaaagtaaagtgtttggtaggtggttttttcctatttgaatacttgaaaagcttgtgtgagtttgttgctaaatagtataaaatgtatacaagcatatgagtgttctttgaattcaactatattttaaaggactgtttaattataagaaaccttaaaattcaaaacacgagaatcttgacttgtccaaatttgaagaatagtcttgtattaaccaactttactagtaaaagtccaacggtaatgatattgtattcaaagtcatgcattttaggtaaccagagaattcttcagagttttgtttacaataacatcttcggattggatcaaaacagatttaaatagtttgaatcaattatttgttatcggccgtactcgaattcatgattttaaagaactcaactccttgataaattattaaacactaaccttgtaaatgtcccgcattttgtaacagaaaaacttaaactcgagcaagttttgcaatagtaacttttgggccaattataataaattataaaaagcccattaaggactaaatatttttaagttaggcccatctcagattcgtcacctctcccaaaacctctcatctagggtttttctgtctggagaacttagctcacttttgactctgtatctctctgtgtctctcttccccgttagtcttcgtcgtgacctttttgtagtattaagcaatgaagattaagacgttatcaagatcggttgatgaatacactcgagaaagaagtcaggatcttcaggtaatttttgcatatccaattcgtttcccatatcacaaaatttagctttagactatcaataacattatcaattcgtttccagaggggtctttcacaacttcgacccaagtcttcgacctatg

SEQ ID NO: 6335 - DNA, 3000 bp, Unknown
  misc_feature (1)..( 3000): cDNA_ID_1814087_gDNA_ID_1621089_Annot_ID_55470 3000 nt of promoter + ATG
tcatggcatcggatctccccttaccaaagaataatttcatactctagacaagaactgaaaaacttttgtataacaaaaagatttgtgatcttcaatttttgtttatggaggacatgtaccaaatcttgaaaaaactattctttaaaaagaagacttgtttaacaacacgaaatttaatgaagagggagataattccctataaattgtatattaccaaatttatcccaatctccacacatcacaagacagagatgctttaatcatcacccaataagcttcttaaacccagctttctgttccgcagttaatctcgctggaaacttgatattgaacttgatccttaagttccctttctttgtctgatctttctggagtggcattccctctttaggaaccacctcttcatactctggatggatcacatttgtgatcgggattgtaagtgtacggccatcaagggtcgctatgtttgcggtgtagcctgttaaggcatcagctagtgagactttctgtgtgacaatcaggtcgttgccctcacgggtaaacactggatggggtttctcgtcaatgatgaagactagatccgctggaatcacacctggatgctcattgcctttctctgggaatgtgatctttgtgcctttcttccacccgggtttcactccaatcgttagaatctcttccacttgcattgccttactgcatttaccagaagacagatattagatattgttaagacaacaactagggtcagctcaaatcaacaattaaccatatggaagctggggaatgttgcagaatctaaaagcttgaaactttgtttcatatatgttcatcatacttgggacttgggaggttgtatatttctaaaaccatgctctaggttgactagtagataagcctaataacaaaatgttataagtgtgatcgaaatggtatctgagttcaatcacttacccgctgacatctacaatctccctggagatcttcatcttcttggtggttcctttgtagagatcttcaaggctacaaggcaacttgttctcgataggagccactttcctagctgcagcgtgatgatgatgatggtgatgatgatgcatagctcctcctccacctgctccttcaccaaacgaggcatacatatcatcaccaaacatgcggctagcgaatctctgccctccagtgccaccaccaccgccaccaaacggggtcgagaacccgaaaaactcagcgaatatatcatctgcacttctcgggttgaatctgaaagacgaagatccatctcctgttgagaagtaggatgctccactagtagcagcattgggaggtggcacattcccttttaacccttcctcaccgtattgatcatatacagctctcttttgaggatcgctaagaacctaatcatctcacaacaaaaaccaacattagcctcataaaagcctgagtcaaatcaaacaatcttagtatgttcctcataatcctaagctacacattgacaagtacagagtgcctaagaggttctcaataatcaatcacagagttaagaaaacggataaatcatgactcagaagatcagcaaagaaagcacaaattaagagctttggagataacctagcttgcccaaatataaagcaatcatcttttactatatactatgattcgaattactcagggacacgaaatctaaaaaccccacgaaccaacacaacatcaaatcgtgaaatcagactaattgcatctcatatcaaaaatcagaaacaagttcgtgaccaccgacagtatcaagggaatgaaaatttctcaatagaaataaaaatcaaaactttagggacgatttcaataaagcaaaagcagtggaggaatcaaacacatacatcgtaggcctcagagatctgcttgaacttagcctcagcgtcttttttgttgttagggttcttatcaggatgccatttcatagcgagttttctataagctttcttaaggtcatcgtcgttagcgcttctatcaacctgtaaaaccttgtaataatcaactcccatctcaccttcttcttctttgtcttctctctttcgtttcttcacttttcctgaattcgattaaacaaaaaaaaggaattggtaatttctggatttcttgttcgtctcaggtctcttcttcttctttggcttagtatatctcgtggaaggttcgagaaaacacgatctttgtttgtctccgttgacggggaggtgacggtgttttaaatcacagctttgccatcttgcctcttcccttctccatttcttttccttttcttcttttattatcgctcaagtaattcagattctcccatttatattattaattataaaaacaattaaatgttatttcctctttcattatgtgaaggtatatgtttgagttcgactaatattgctaactttaccataaaagaacatgtcgactaagacatgtaacgtatttatataaatgttgctattattatgttgttcgaatttaaatccgatcgaattagttgcttcgaatttaaattgatcaaatgtaaatccgataaaatagatgtttttggagtcctttattttgtgattggctatatcgcccaaataaaataaattttaaagtgttgattatatatagagatgtttgccaaagacaaggtgttttatatagagaccatagtagaatactatggcccaatgaatagcccaatttattatgggctgagcccacaatggaattcttgatcgaggggtaatcttcttccgtataagtacttttttttatctgatagtatttattttttacagttgaacctttttgctacagttcctgaagaaaagcatagttcttctctaacgagccattccagagagacttagggtttacgcgagagctcataagatagaagctgctcgattcttccgagttttacgaatttcgatactcattgtttggattcgttgatttgatcaggtgatagtctgacttacaatg

SEQ ID NO: 6336 - DNA, 3000 bp, Unknown
  misc_feature (1)..( 3000): cDNA_ID_1814083_gDNA_ID_1621089_Annot_ID_55471 3000 nt of promoter + ATG
atatgaagattagaaccatacctgcatgttatcaagaaataatgcaatttgcagcgcgtttggatattctgcaaacttaatgtagatcatgtaagcaatatctagaaccaacatgtcatctggtcctggaagatacctggaaaaaaacatacaatatcaacgggactgataatgtgcaagataaccaagcaaagctcatgagagcttgtctcatatgaaaataacataattaagggtgaaacgccagtcgaatgaataagctaaacatattgaaattactttgctgcactcgtgagatagttgcacgtcctcctgaaatttgtattgtcaacatgctcaagtaagagatcaagatcctcaacatccattaaaaggtcaacagcttcggtttcggcattatgctgcaaagaacaaaagggaatccttcaaaaatgtgaacaaaacaagaggcgcaaatttcacgcctatcaatgaaacttatattaatatacaatggaccccttgttattacaagaaaagtaagaatgacaaggatctcaccttcatgtgaaaagaaacaatttgctgcacaagatccattaagtcttcaatagaggactcttcaccctgatataacaaaaagaatgagcattataaccatattcagtaacgagcccattgtcataatattcattaacaaaccataatatccatgacgttgccagaatatgagtgaaactcctcgagctaaagaacattgccaaagaccaaattgtttactaacctgacgtattgtatactcttttgcaatctctccagccaaattcctgacatactcgtgaccccacgatccgatgtcactctctgatccattcaacctatagtttaagctttcctgaaagagtattgcataacaaaggatcagcaacaaatagcttaagtcaaattctaccaagaaccacaaaacacaaatctggtaaggcatatcataagaggaaaacaaaagggaatctagttaaatgaatgtgaagcaaatagcaataggcaagaaactcctacaacagtagcaagaaagcataccctttcaccttcagcagacatggtcagtgccaggacagaaagtatatcagccaacattttctgcaaaaacgagtgcgatcttataatccagactcagtagaacgactaagacggtgttgatgagaaatgacttaaaatgtttgaaatcgtactttgagatcagactctgccatttttgcatgaaattctttaagaactccataatgagggcggagaaacttgaggggttttggaactgatgtcatggagcttgttgagtcacgaatttccttcctacataccaaaagagatcgatcaagattagactatgaaaacagtgaaagcactaaaagcagcaaaagaagtgtcataagcccattaaagaaactccaatagaaaattatcagaatatttgcatctaatcaaatcaaggatgggtttaagagatacaaaaactacctcatgctttcaagagcaatcttctgtaactcaggattggggtcctgaactctctcaacatagagctccagattctgctttagttgcaagtcctcttcagactacaataacatcatatgcaaattgagtcagctgccaatcaaaccagctaaaaccatagccatagtacaaaagattcctattaatttaactccatgtgacttaaaccctaacaagaattgtatcttcccagaacgagttataatgtggatttaaccaacttcttaacctcgctttctaaatagcaatgcgacattcacaatatatcagctaaaccgtacatctcggaaaatctacagcttaatcgtgagttttttccgatctccctggattctttctaactcagctaagcacgattccaactaataatcgaaatcgatataaagaaaactcaccagatcctcttcctttttatcatctttcttcttggaatccttagaaggaatcttcgtcgtagcttcgtcccgcttcgcaccaccgccaacactgttcggatccggaactggagccattgtaagtcagactatcacctgatcaaatcaacgaatccaaacaatgagtatcgaaattcgtaaaactcggaagaatcgagcagcttctatcttatgagctctcgcgtaaaccctaagtctctctggaatggctcgttagagaagaactatgcttttcttcaggaactgtagcaaaaaggttcaactgtaaaaaataaatactatcagataaaaaaaagtacttatacggaagaagattacccctcgatcaagaattccattgtgggctcagcccataataaattgggctattcattgggccatagtattctactatggtctctatataaaacaccttgtctttggcaaacatctctatatataatcaacactttaaaatttattttatttgggcgatatagccaatcacaaaataaaggactccaaaaacatctattttatcggatttacatttgatcaatttaaattcgaagcaactaattcgatcggatttaaattcgaacaacataataatagcaacatttatataaatacgttacatgtcttagtcgacatgttcttttatggtaaagttagcaatattagtcgaactcaaacatataccttcacataatgaaagaggaaataacatttaattgtttttataattaataatataaatgggagaatctgaattacttgagcgataataaaagaagaaaaggaaaagaaatggagaagggaagaggcaagatggcaaagctgtgatttaaaacaccgtcacctccccgtcaacggagacaaacaaagatcgtgttttctcgaaccttccacgagatatactaagccaaagaagaagaagagacctgagacgaacaagaaatccagaaattaccaattccttttttttgtttaatcgaattcaggaaaagtgaagaaacgaaagagagaagacaaagaagaagaaggtgag

SEQ ID NO: 6337 - DNA, 3000 bp, Unknown; identical to SEQ ID NO: 6335
  misc_feature (1)..( 3000): cDNA_ID_2132684_gDNA_ID_1621089_Annot_ID_170634 3000 nt of promoter + ATG

SEQ ID NO: 6338 - DNA, 3000 bp, Unknown
  misc_feature (1)..( 3000): cDNA_ID_3048184_gDNA_ID_1621089_Annot_ID_170632 3000 nt of promoter + ATG
tgaaatccattatactggggaaatatcactatgtgctctacttccttgttttggcgatgcaggtgagtgcaattttctgtctgatgactttttttttaatgaactaagtttatctactaacacaatacggtttgagtgtgtagccaaggatgatgctgacggtggatcagagcctgaagcccatctcggtgccagtgcgggtaggacaagcggttgatgtggttggacaggcaggccgacctaagacaatcactgggttccaaacgcactcaacacctgttctccttgctgctggggagagagctgaactcgcaaccgagaagtatgttgttcctctaatccccttgttacattatcctactcgaaataaaactctgttttacatattggaatctaaaaaaactctgcttctttttgggtcacaggtacattccgttgtcgcccatattagaaggtttcgtcatattgaaggaaaatccagactacagagaggagtaaatccaaagttgcaagcatttgaagaaagagagagagcctttgaatactttcactacggttgtcaaaagttttttagtttattcccgtctgttcccaggaaatggttcacaatctctccttttaaaagaaaaaatagcttcattgcaatatataggaacttcttgtgcactactttaatatcgcattctaaaagctggataagtttccaaatccaattctcttaacctgcaactccttcaaatcaactcgttcgacgtttctataaacttggcttattgattatgggctctttggtttgctgccctggaacttcaagttcttggtttgtacgcactccaacttcaatttgtgacatgcaaaggctcctctcgttgtttccggatttggccaaaactatgtaatattattaaaatgttgaaagggtgacccagctagcccggctacatatttacaattttacatagatggcgtgcacgactcacttgtttcctcggtgtatcttttttttttttttttgaataagttcgttcccaaacataaaccagaagtataaaatcttattaaaattagcaaccagcaaaagcaaaaatcatgtacatgtatattgagggttttagtttctgtcactaactatatgaactttgcctaaagaaaaaaaaaacaaataatgaaataaatgaatggaatacagttttcaccgtttgttctggtatacatatggggtatatcgagattaattaatctcctccggccaggaaaaaaaaagtaaaaaaggaaaatttaatggccgcgacctcttggacttggacccgacgccaaacgctgaaaccaagaatccaccgtcgatttcatcttctccaccgtcatagtcgcacttccatctcccgatttttcagtaagaaccctccccgccgcagccggaaccaccacgtgttctacgaaaaacaacgacaccatcacaaccacaatcaaaacagtagaccaactaactcttctcatcgtattttactttctcttctttatgttgtaccgacaagtaataaaataaaacagaagccttttttttgtttgatatcaaagaaaattaagagatatggttatgtgggaaatcaaataaatgagagggaatatttatagttatttgacgaggaagcggtcatgacttgagagagttcatcacttaggtcgggttttcccggcgctagctcacgattttgcgtgttgaccaagtattatgacttgaacgggtcgctcttatgacactttacgatgtgccaaattacatttatacccattttggtggtttttagttttttagaggtaaaaaataatcaatgagaattttgttaacgaaattatatttacacataaattttttaaaaacaagtgttttattcgaaaaactaattgatgcaattttatcaagatgtttacgcggtaccaatgattaatttatactagatcatttgatagcaattgtatctttcaaagatacaattcttatttaagctatttattttaatagaatcacatatcaataaaatatttcaagaaatttcgcaatatatcataggcataatttcgttctgaaaagtcttatatgaaatttgaaacttaacgcgtaagttaccattgactaaataaaagtaccgtaggaggaccaattcacagtttcacttaaataattctcttgtcagtgtagtttgagtggacaataatccattatgagttaatgaaaaaggttgaaatgtaagataaaattacgtatcaactgcgttagtaggtatataagtagttagagaacaaagtaaagtgtttggtaggtggttttttcctatttgaatacttgaaaagcttgtgtgagtttgttgctaaatagtataaaatgtatacaagcatatgagtgttctttgaattcaactatattttaaaggactgtttaattataagaaaccttaaaattcaaaacacgagaatcttgacttgtccaaatttgaagaatagtcttgtattaaccaactttactagtaaaagtccaacggtaatgatattgtattcaaagtcatgcattttaggtaaccagagaattcttcagagttttgtttacaataacatcttcggattggatcaaaacagatttaaatagtttgaatcaattatttgttatcggccgtactcgaattcatgattttaaagaactcaactccttgataaattattaaacactaaccttgtaaatgtcccgcattttgtaacagaaaaacttaaactcgagcaagttttgcaatagtaacttttgggccaattataataaattataaaaagcccattaaggactaaatatttttaagttaggcccatctcagattcgtcacctctcccaaaacctctcatctagggtttttctgtctggagaacttagctcacttttgactctgtatctctctgtgtctctcttccccgttagtcttcgtcgtgacctttttgtagtattaagcaatg

SEQ ID NO: 6339 - DNA, 3000 bp, Unknown; identical to SEQ ID NO: 6333
  misc_feature (1)..( 3000): cDNA_ID_2104909_gDNA_ID_1621089_Annot_ID_170631 3000 nt of promoter + ATG

SEQ ID NO: 6340 - DNA, 3000 bp, Unknown; identical to SEQ ID NO: 6332
  misc_feature (1)..( 3000): cDNA_ID_3092078_gDNA_ID_1621089_Annot_ID_170628 3000 nt of promoter + ATG

SEQ ID NO: 6341 - DNA, 3000 bp, Unknown
  misc_feature (1)..( 3000): cDNA_ID_3048192_gDNA_ID_1621089_Annot_ID_170624 3000 nt of
tgacacatttgaagaccaaatcttagtgttggacttagatcactcattcgcttacaacccaaggaaaccgaatctgaattatacaaactttcgcataaccatacatttaaagttcttttgatctctcagcttatgttgactttttaactgataatattcactaaaactgttttaactacaaaaaacataaacatggtattggttttctttgtatttattcttttgtcaacaaaagtcatagaagtatagaactaagacaaagggccacaacttgacagagacactctatattctaaaagcaacatttatacgaacggacacactgctttattcattcacagacctcaagggctattctttcatcatcctcatcgtttagccaccaccagagccatacttcttacccaacacaatgagctggagcttgtcatagccggccagtacaccagcgcctgcaaccgcacgaaggatgttggcacctgcacccttgaagagtgacttggccccttcgttcttgacgatctgagagaaggcctgaagagagctcttgtacttcactgcttcacctgacgtcatcatcattcttctgcgaaccgtgtcaattgggtaagacgccaatccagctccaatggtgattccccatcccagtaagaaactagcaaggaagctatcctgtacagattatagcaatgagtaaacagtaacagaggactcaatatgttgaagtgaggagttttctttgttttttacctggagaccatcaactagaaccacaggcttcaaggaatcatacaatccaaagtaaagcccccggtacacgacaattccaacgcatgagatgttgaaaccacggtaaagcccgacaatgccatcagaggctatagtcttcttgtacacgtcgaccatgccattaaactgccgctgaccacctttcttggccgccttcgcatcattggctaaacgggtacgagcgtaatccaaagagtacacaaaaagcagagatgatgcaccagctgcaccaccagacgccaggttccctgcaaaccacttccagtagccatctttttctttcttgaagttaaacagcctcttgaagtaatctttgaacgcaaagtttaaagcctgcaaaacaaaactatttgcttagcatacccatctcgacgtctatacaaataccacgtcaaagaagagaaaacaaacctgagtggggaagtatctgataacattggcagtgtttcctctccaaagagcaagcattccttcgtctttgactgttcgagcaaaacaatcactgattcctttatatggctcagagagacgcccagctttgatcatttcatcttgattctgaatcaagagcttcacacgctctataggcgcggctgccgtcttcgaaacagcagctgagactcctcccataaggaaatcgatcaagaaaccagtaccagttttctcactaggagcgtgagctaatacaggaaatgaaccatgaggtataagagacgagccaacgccatggctagttggctgcaatagactctgcaaacctccattgacataagcaccagagacacagtaaccacgagcttgcacactcggagaaagtctattgatcaagtaagattgtccatgtagcttctgaaagactgatggatgctttgatccatccattttttgtacaaatcagtaaaagctgactctgaaaaacaaaacaaaacaaaacaaaacaaaaatacaaattaaacaccacaaaatcttgctttctcgaaaatttctatatttgcatgcttaaaaaagaatgatcataaccaaaactggaacaaaaacagagaagacatcatcaacacatttcatacgatcctagttagcttcgttaaagacaccatttcaatctgtcaactataatgcgacctaattagcacaaattaaaacctagttgcagcagctcaattaaatcctctgtttctaaaagatcaagcaacgagtggcgtcgagaaaacagaattcacgagaagcagaacaaaaaaacagagagagctaggagagaagcattaatgataaagctagaacttctggagtcgagagcttaccgtggatttttcgccgaagcgttaacgagagagagagagagagctgtggaaaattgcgagaagagtaggtttctacatgattctcgacttctggtcctaaactaaaagacgaaactgagcagaagagaaggtacaattacgaaaatgctactggactcctttgacccgtttctttctgggcccaattttaagggacccgagtcttgacttcttctaaatggacccaaaatttattttcctaggaagataaaattcatacctaatgaaagtgagagacctctttatcattatgtgatatatgtctcatctacctgaaaattaaatatagaaaaatagaacaataatcaagacttttttggtttgccggaaaaatataatagaggcttgttaactaggtcttaaaaaattggatgttacttaagaagcaagaaagaaagttgaatcttttttttcttcttcagccggacagaactttacagatgcaaggaaggtgatgtggttcgaatttagtgatccaaaactagttagagaaatgttctacaaacaatgaaacaaaccgatacgtattgagagtaccagaatataggcaatgatatcggctcatgtattagataacaagacacatcatacatgtcatgcgatataaaataaactcgaattacatgcaataaccttaatatgtgtaggtagattatttcaaaagattcaagaaaactaaaagagaactcagctggaattcatccgagtaagaaggaaacatgagaactacatgtgttcattaaactaagccatgcataataaactccaccttagaaacgaattgattactatatatataatatatagatatagatttctcttcgtacacgaatcatatatatcaccttcgctagctagtgtactgagttca

SEQ ID NO: 6342 - DNA, 3000 bp, Unknown; identical to SEQ ID NO: 6331
  misc_feature (1)..( 3000): cDNA_ID_2132651_gDNA_ID_1621089_Annot_ID_170621 3000 nt of promoter + ATG

SEQ ID NO: 6343 - DNA, 3000 bp, Unknown; identical to SEQ ID NO: 6330
  misc_feature (1)..( 3000): cDNA_ID_3048196_gDNA_ID_1621089_Annot_ID_170620 3000 nt of promoter + ATG

SEQ ID NO: 6344 - DNA, 3000 bp, Unknown
  misc_feature (1)..( 3000): cDNA_ID_3092093_gDNA_ID_1621089_Annot_ID_170619 3000 nt of promoter + ATG
ctgcatgtcgagacgtgttcaaaagaagacaggagcaaaaccaaaacgcttctacttaattcgcatttctttaggtaatcgatgcacagcccaaaaagcttgacctaacggctatgttttctttactttcaccataaataagcacctcttgaggttgcaaacacacacacacacacacactcacttcaaaagagttagtaagaagttggggtttgattaacgttttgcatcggagatgggtttggtcatgaggtttgatctttaccttatgtttgtgatgttgatgggtttagggtttacgatatcaaatggatacaagttctatgttggtgggaaagatggttgggtcccgactccttccgaagattattctcattggtctcaccgaaaccggtttcaagtcaacgacactcttcgtaagtctatttcctcttctctactatatatacacaatgtgtcaatattaatgcatagtaattttgatttttacaagattttaagtacgccaagggaaaagattcagtgttggaggtgactgaacaagagtacaacacatgcaacacgacacaccccctgacttccctctcagacggagactctctcttcctacttagccactcaggttcctactttttcattagtggcaactctcaaaactgtcttaaaggtcagaagctagccgtcaaggtcttgtccaccgtccaccacagccactctcctcgtcatacctctccctccccgtctccggtccatcaggagttgtcttcgccggggccttctccaggagtggaaccatcatctgattcaaactctcgtgttccagctccaggaccggctacagctcccaattcggccggtttggttggtccggggatggtggttcttgtgattatgataagttctctgttttgaggggtttatatattgtcgctagtcattaaatttgtgagggtattaattactctaccattgagtttcatatttatgtgcctttttatttgtatgtttgaagcatcttgtaacccatttttaatgtttccgctgtctcgtttttgttcttactaaagaaaatatttaagatgtttttttgtattgattagatgcgaatgtttttattttgtgttttaattatgatcacactaatatgaatatatacgacgaatatgtagagttcacatagctcatgcaataaaacttctccacacaaactaaaatcttgttgaaacatataaatagatcttatacactttttgtacatataagaatggtttgaacaatttaactttaatcaatatattaaaccggtacaccgaaatccaatagagagaatatgtcaaggagttaacaaaaaaaatatactaccgccgtctgtggggatcgaacccacggcctcgtgggtaaaagccacgcgctctaccactgagctaagacggctatatgacaaaaaatttaaattatgttaattattgtatgtttttgcagatcaaattaccaatgaaatagttggtatttaggttgttaactcaatcataaagccgattgactcttttttgttgaagagcttgcctcttgttgtggatgtggctgttgtaagactaataccagcccttgggtcgaaagttgaaagtttgattctggatctctaatgtctctagtatggacgctcctgtttggaagtcttttgtttggaatatgatatagattcataaaaatgcgggtatctactaccatttgctattgaccatcaaaaaaacaacaaagtctcttaactatcttaaaattttattaggagattttcatgcgactagaacaagattttcaagcagtggatgataagacaaaactgataggccaacaacttgatgaaatgggcaatattatgaaataatacacaagtatagcttccacctccaaccacctaaggacctctaataaatttacccaccaaaggtggtgggactccgtcacagagccgtgcctcaaggcaaaagaaagaaacattcgcctacgtcctcaaatttttgaaaaaaacttaggagcatatatttttacaagataactttagtttcataggtttaatattgacaaatcacttacatttacctaaataataaaaatatagaattaaaaatagaaaaatattcacagaataaataaataaaacagaacaaagcattataaatttaggttaaagcattcgatatagaattggttaaaaaaattaactttgaatcttttgtcatatgacaatttatttttgtaaacacttttacttctattattataagcatctttgcttgtgaattggggcaaatttcatttggccgcctccggcaaccattgaccttggcacggctctgctccgtcacctcttatatttgctgcaatggcacagagaagagaaattagttgctggtgttgatccctaatatgtgctagttcatcatctacatgtccaaatctaaatctcatcccttctcctatcgcacggacctgcaagtgtagaaagcaaaaacatcaacatattttaataataattacaaaacacattaggttcttaaacttatcaaaactaattacttcaaaaaatatctttctaaaagttaatataccggaatttaatgcatttaaactagaattttttttctataaattaaatgtataataaaatccataaaataaattttaataagctcttactaattaaacataagataaaacaatattattaatttctcaacaatcaaatgtggatagaaaccaaaaagataaaataaactcggatgtcataggcccataatccagccttttctcaaagcttaaacgtaacgggctcggcccaaatttggtgtgttcatcatcttccccacaaaacctaattttgtttcttcagtagtactgtagcttcagatgcaactcctcgaaaacccgtagaaccggcattgagccaatcgtttacattctctgattcatatccttagcgttttcagaaacaaaatg

SEQ ID NO: 6345 - DNA, 3000 bp, Unknown
  misc_feature (1)..( 3000): cDNA_ID_2105819_gDNA_ID_1621089_Annot_ID_170644 3000 nt of promoter + ATG
aatcagtataagttttatttcatatatttgtatatatttgcaaacacataagtagagttatttttaataataccatctttctagttccttatttcaaaactatatataacagggttttagaaactaacaagaaaatagatttaggttaagttcttgatttttattttatttttttcctaaagtattttatatctttttttcttaagcatattggtagagagagacaacagtgttgataaaagaggggcagtttgattggaggaggttgaagaagcgtgtgaccgagaactttgagcttatgattaattattttttattttatttttaattttgccgccgtaatgttagtggactcattcatagtttcctttacgataacaaaataaatattgttggtcaattttaaaatttcaggtttctcaatttagccaaataattgcacatgtattataaatatatactcttacatatgcgggactctgacactaattataataggttgtgttaaatttgtaggtcaagccaaaattaaaaaaaactatcacgttatttcatgcgttcattatatatatatatatatatatatatatactttaccatattgatcaagtacgcgaaataaattcgtgttatatgcaggcccggcttagaggcagtgctggcagtgctttagcactgggtccaccatttttttctaatttttacaaagtttttagatctaaattttttgatatttttgcaataagggtccaaaattttaaaagtttgtaactaacatcttaaattttctgaaaaaaaaaatttgagcacaaggtccaaaaataatatgagccggccctgattatatgcgacaatttttttaagtctggaatatattatattattaaagtgaaatatgtgacaattacatatcaatactttattaaaaacaaatgacaattacatatcaataattagcttatgtttgcctagtatttgcattcaactacaaaaagatgaatttcatataaatcatctaaagagggagagaacgtggatggcataagatccacgggatcaataggcctaagcatctaaaaattatagagctagccctagctataagatcataatatacacaagtcacaactactctatatataatgtgtattatttatgtatattttgtgtgtgtcttactcctaaggccctgatcctacaatagcttttgaaagctatagaccaaccgaagagaggtaaaggagaagaagaaatctaatcaatttaaaaagaatcaagaaaagaaaaaagagagagacatgacttctaaaaatcttattattcgctttaagaacttcaacctcatgggaccactaaagaatcttttgttgttttaaagttttttttttttttttttcactttttaacttttcttaattgagaaatctactcaatctatcggggtcgggttacttttatcaatatgtacaatgattttctttctgtgtttgtgtccaaccaagccttattacaatcaatggtaacggacctttttttctatgatgtccctaaccatatttagaatcgtgtcaataagatttaaaatctccaaataagaaaatatgcatttaagattctaaatgagtcaaatacaaatacaaaagacctaagattctgaactcttgttaaccaaaacaaaaaaatgcagtaacaaaatatatagtaaagtataaaaatacataattaatttgcttaccaccaaccaacagaatgacaaacgaatcttaagcacacaaggaaacacaataaactaatgagaacaataactttattacatgattatgacataaccgtgtcctgatccaactgaaatccctctgaaaaaataattacttttaagttataaataaactggcgactaaatgttactactaaacgacgatcaaggagaaaaaatgagtcaaagatcttaaaaattaagcatattccttagttgaaactaaataaagataccattgcgaaaagtttgtccgcaaaaaataaaaataatgatgagtaatttacaagcttcattcattgatatgaaaaatctcaatctagacgtttcgggtttattgactacgtggactcactagacttgccattgacgcttcttcatgacttcatcactgaccaatagcaatagccaatagcctttctctctcgacacattcatgtgtgcagcagcagaaagaaatatcctctacatattccacgttgcaaagtgggcctaagacaggtggatcaggcccaatgactccaacgtcgcttctatgataaagacaagacaacatatccataagcgtgaattattagcattaatgattggtataaatgtcatagataataattctcaaaagctactctctagtctgtttatataaactgtttttgttttaggaccttgattgttacccgtgtagaccaatatgtccttgatagagactcccaagaacgcataccaactagtcttgcgagttgcgtgtttctaaatgcacaaagcctcaaccacaactagtccgagcacaatttggtgtgcaacccacaaagaaatgtttgggccgattagttgaaacagttgggccgggcctattaatagaagtgttaggcccatttattattctctttctctgtactgggtcaacttttctttcgccaaagaaatatcaatcaattcgtcacctttttgatttggggaatgtgacaaagcaatctgggttgtctgattatttccaatgacttccttctctgtctgattcgtttgtttcggcgattcaactcttcttcaacgccctgagagtcacgcacgagaattggattgatggtttttcacacgcaggagaggcgattcgttgtcttcttcttgtcccgttgacctgtttcgatctcagatggtgattatgcagcagctgattctaaattagggcatttaaatccgccttccaggtgaatttttgaaaagtaattaaagggtgttcttga

SEQ ID NO: 6346 - DNA, 3000 bp, Unknown
  misc_feature (1)..( 3000): cDNA_ID_2132692_gDNA_ID_1621089_Annot_ID_170641 3000 nt of promoter + ATG
tgagcgattgattttttccaatatttttttgtaaaaataaagtcacaaattaacgagaatgaagttaggacttaagatcgtcgcgttgtctttattgtgtatgtattgacaaaagaaacaaaaaagatgtgtgtgtacagcttccaataattacgagaaacataggaaacataatgacaaaattgagttttgtctacacctcaattattgtggcaggctctgaaataaatccaagattttccgaaacaccaagaaaatgagtttggttcaaagttcacagtgtcttcggtttttcatgttcatcattaatgggccccttactcggttactcccatcaattgtgtctagtttcaaaaatgatagtatcgatttttttgacattttttagtgggatgatagtatctggctatctctttatatatattccttctgtcgcattttatgaaatgttttaagttttttttttgttagtttcaatttattagacacttcataagtttttatttaaaattcaaatatatttaatattttatgatcatttatattatgcattatctcttatgattgcttgtactattttaaattgaaatactttttgtgataaaaaatttcttacgtgtgcatctcattataaataaatgagacaaagagaatataacataaagacataatacatatgctatcaaaacttttaacaaaattaggaaaataatttctttaaacaaattttattttagttttttacgaatatctatatattatctaagggtagctaacaaattaaagaaaaaatgattttaaacacttaatttataaaactaattcaaaggtaacgtcttgcctgtctttaaccatggactccccatttataggtttacgatcgctttgtaaagtttactcccctcttatggctagcttgctattttgaaaaagttgcaaaattgatcgatggactatgttactttttgtcctcattcgaatgctattgaaaaccacttgagcatgtaattaactcatattaaaattagtctaaattaagaatgtttatcataaattcttttatttttttgaatagacccccacaaaaaaattaactatgtatagagtgtatataaaagtaaaattaattgttttacattttctcactttataccacaatattattatttctgttaaagaataccacaatattttcagaaattaaaatatcagtatcagtatcactaccactcaaagcgtgcaacattgttgacagacaaagctattaccccgacaacgttattaagcttagattgatcctcactcatctggttttactctatcgtctctaggtgtagtctgtggttatatatgtgctaactaatatcttcagaaagtagagatggcgatagagtcaaacagactgagggaaatatatttgtgaatcctgagaaagtgagaagatattatacgatttttgttttgggctctcaaatctagaagtcatataaccgagcaatttggatagcggttaccatgagtacatatatacatagttacataccattatatatgtaatcgtacatattatatatagttgacctggtaattattgattgatatttggtacgtatacattcttacatattggaagtatattgtctctaacgatttaaataaaattggcctctcgtcacatatgccacattagcatgttaggcgtaaattaattgtggaagaattaatgtcaacttattaatcaaaatgaatcagtgtatctagtcttctctaattaaggaaaaactaatccagtattaaatcgaccaacccacggagttcaaaaagaaaactaattaaagaaaaaaaaaaaaggagttcagtataaagtatggtttctattgtttctcttattgaaaaaaatcaagataaaaacaaaataaattccgtaactaatttttccttgtagtaaaagttatatatgtatactcttgcatgctcgtttacaactttacatcatgctttgccaaccccttttgaatttgatatcaaatcagaaaaaaaatatttgacatattaaattaggtccatattatttttttcctaaatatatggccaagaataatcgatttaacacagttaacgtatgttacccattaattgtcaatactaattgttggcagcaaaaaaaaaacacattattgtaggtattataaataaaagtatgctaattaactttcttctgactttcttactaatatttttgatttaaaaaaaaaaattcaagcttaacttcatactaattaatcttagagtactattgtatctccaaattaaatcgtaccaccaagttttgtttaggtaacaatccttaaacggaaaactatgattgactttcttattaattttgagataccaaaagaaaatacggactaatctagactagcgatcgtagacattcataatttacctactattcacaaaaaaaaaatagtatctaaatgaaacggttattcgaacaagaagaaaaagaagggaaaagtttggtttgttttccctaagtggataacaatgaaaccaaaagagaatatttgataatagtgtcccatgagacacctcacaactaagatttcttgtaactttggtttttcttgaaacttcccaccataactaactacatatattacacaaccatggacccaattaatcttacaatattgtaagaaactctaacttgccatcttacatccttagctacatgcatgatttatattattgtatttccatatatcatataagctaatttcccactaactataaatatatacataattaaacctatatatgtatctacacacaccgatctccctctccctctccctctccctctttatctttctcttcctcctttgctaataaacttttctttgaaccttacacgccttgttgatattactctcttaaatatatattttcgtacattaacacagacatatataaagctaaagatttcttcacgtaatg

SEQ ID NO: 6347 - DNA, 3000 bp, Unknown
  misc_feature (1)..( 3000): cDNA_ID_1012673_gDNA_ID_1621089_Annot_ID_170639 3000 nt of promoter + ATG
atgcgaacccttgtgggatgaccacgagctgtcccttctgcacctgttggtccaacacgttctgtccgttgtcgttgaccacttggatccttccttgtcctccagtgcagtacaagatctcgttagcgttcatgttgtatttaggaagcaccatcgcattctgtaacatttgacaaaacatgtgaacacgtcatccgtcatatagaacttccaattttaatatgttttgctaaagaaaaaaaaaaggaataaatatctatcaaattcatttttaaaacatttgtatacgttcttaaataatttaggatatgactaatttttctttttggtaaaaatgttaatatctatatttaatttattaagaaaaatgtacttacaccctggagaacgccacgagtggcactgagcctgacatactccaagatgggcaaggtatagctgttgacgctggtcacgcgacctaggctgggcttgtacacgtcagcacgagcagggtcgtcaatgttctcgtgggacctcatgctgcagatagtctcctcaaggccgttgccctgtgggctacgtgggtgtctccactcctcgctctcgtagggctgtcttagaggtggcctcacgacctggaaaggtcccttaacacgaacgatgtttcctctgctgtcttgttggttctgaagctgctgagccaactgaacgtcaattttcaatgcttgagctatgacctgtgcgtcgaacccgctccacaagtttttctgttcttgttgttgctgtgaaccgccaaagcctccctgctggttgtttccggccaaatggaacacctatagcaaagaatcaacaaatgcaatacataaatgaattagttaaactgatatggtagatcttctaatagcggatgtgcgtctttgtatatagtatgagattactctagggttgcggtcgagttggttttggtagttggcgatgtcgagaagagcgatgatgacaagtggctgttctcctgagttgtagatccagtgggcagagcctggagtgttggcaaagacgtctccgcgtctcacatgttccaccttctggtgcatgtcacggaacccttgttgtccctgctgtccctgtccttcccatggttggccttgttgtccctgtcgtccttgttgtccctgttgtccctgtccttcccatggttggccttgtcttccttgttgtccctgttgtccctgtccttcccatggttggccttgttgtccctgtcgtccttgccatggttggccttgttgttgtccttgcatcggctgcgagtccatgaaggtctcggcacatccagggaccactcttccgctgatacccgttcctgtaaattaattttaggtagagaggaaaaaaaagagttatcatatggtgaatcgattatatcttcattaattagacatgatatatacattaattttattggaagggtaattatcatgtatgaaccttgaacgacgtaggaaatttttggggaagtgaagaaggtgggcaagtaaagaccgccttgttcaattacataacgagcaacggaaacaccaacacatcggagctgagggtggttgtggtcccagtactcgatctgaccggcttcactcttgatagtttcggtggcttggagaacatctaggttgtcgaggttacactcgttctgtagctgaggaggaaccccaagtgactgcctcgcaaggcagccgttaaggacgaggagaaccccgaaggttgcaacgaggagattgctgagcttaaccattttctttttgtttgttgtgagagatggatgaagagaacgggacttaggaggagtttatatattgtcaagtgagctcgtggtttgagccacgtaggattaggtttgcatggggacttcagtctaagctttttacacgtcactctgtgagctcgagcaagtgtctcttgatcttcatgcgcgtagctcactctccgcatatgtcaaaatacgacaaaatcaaatgtatctatctcattttttgcttcacgttatccatcaactaaatttatcattttattatcatcttacttacaatgttttaaccatgatacatataattcacttttaaaccggagaatagaatctaaatttaacaattaacacaacaaattagatcaccagtgttcacgtatattggcgatatgatcgaagagtttgcaagatacagccaaaaatttgtattgaagataaaacaaaagaacttatgaaaaattaaaaaaaaacgaggaaacaaggtgacacatgagcgagacgcggcgacactaggcgtgtttgatccattgtatatgctgcgacttgtctcgacaactgttcggttgcatgtttagcactagtagccaagacatgtgtcaaatatttccaacatgggcttatttaaactaagcccaataacttatattgtatttactagaaagcccatcaaatatctaatagcccataacgtgagcccaaagttcatttccaaaacggaaaatgtgacaccgtcccatttactccaatagaagtctgagcttaaaccctaaacccctttctccacgatcttccttttcctctctctgcgacttgaagcaaagtttccaggtacgattctcgccattttgattatgtattttgtgtaatgggttggtattgatcgattcctttcgaaaattttagtgaagacgtgaatttcggaggtgggtgagagttttctgctcggattttgctaattactcgttgttactgttttgattaggaagtattttgcgcagcttagcatgagcgttcgttaaattttctatctttactggctttgtgtgctgaatctgacttgattttgttactttgactgtttttgatgttttcatgatgaagttgcataattgagtagatgtgagtctggattttgagtgtatgtttgtgtagtttttccaccacacatgggttttgattaatcatgtattgggattgtttcagaaaaagagatg

SEQ ID NO: 6348 - DNA, 3000 bp, Unknown
  misc_feature (1)..( 3000): cDNA_ID_1814079_gDNA_ID_1621089_Annot_ID_170637 3000 nt of promoter + ATG
acccttgatggccgtacacttacaatcccgatcacaaatgtgatccatccagagtatgaagaggtggttcctaaagagggaatgccactccagaaagatcagacaaagaaagggaacttaaggatcaagttcaatatcaagtttccagcgagattaactgcggaacagaaagctgggtttaagaagcttattgggtgatgattaaagcatctctgtcttgtgatgtgtggagattgggataaatttggtaatatacaatttatagggaattatctccctcttcattaaatttcgtgttgttaaacaagtcttctttttaaagaatagttttttcaagatttggtacatgtcctccataaacaaaaattgaagatcacaaatctttttgttatacaaaagtttttcagttcttgtctagagtatgaaattattctttggtaaggggagatccgatgccatgacggcgtgtagggaacgctaggaagaaggcaccacaaatgacgccgatgacaaaaggtaaactggtaagaatctccttggtttcctcggaaggaacggggaataaacaacgggttacgttctgatcaaacatggagactgcgaagaagacgagcattgacatgattgcgtgaataaaatcaagaatcttgagcttatacttttccttctcctcctccgttaaagtaatcgatccatccatcactaatagcccactccacgttgccaacccgtacctaacctgcaacattaagtttggtgcttatgtcaacaagttgttatgaatggtacaaaacagcggaaaatgtgacagagatatgtatatataccttgccgtttgggtctctaatggagtcggtaaaggagaagaggaagcaggagatggcgcataaggagacgaggaagcaggtgagccagcgactggtgatggtgggacactgaccttgatgggttaggaccggacacattatttgaaaactcattacagaaccggttgggagcagatttgatagatgagctgttcctttgaatgttttcctcacaactctctctactttcgactttggttttcttggtgccgacggcaacgatgctatcaatgactgcttcgtctcctccatcttcaattgttttttcgttaatcactctgcaaattcgaatgattatatatgtttcttttttttgtctctatggttaattctgatttgaaagaattgcacaagattttatgggtttcgatttctttcttttttggtgtttgcttccgttgagttgtttgttcaggtttcaaggttgatattctgttcttccatttttatgtttctgttgcatgtcaggattagcaataaaaaacgtaaaaaccaaataacatttgagtaacgaaacaagaaataggagttttgtaacagaaaggattaaactaaaactctgtcaccgtttcctaagaagatatatcattatcaaagttacttttattatattgatatagtaaaactttgctaaactagtaaaaactagtttttcgaaaataatctagattagaattctccaaagacgtggcttaattctaatctgtctaacgtatggaccataaagaattgtattaaattggtctttgaacgaatttattcttcggctaaaagaggttatcggttgtgaagtggacctgcaatttcatttgtttgttcataagaatatatgaacgagaacttaggtgacctctatttcatataacttttacatactgcatactggtaaatcatatgaaatatggacttttaaaacgaaacaaaaatcacgtataaccctattagtgtatatagagtctctgttgtgttgagactctgttgtgttgagactctatatacactaataaaccctttttacttctttgttccatacgaattaagcttcagaataacagaatttaagagaatatcgttattaacagcaaaagtccaaaacaattaaaaggcagagtgcttgtggagacgtaaagggaatgcaaactaagaagaagaaaagtcattatcgttagaggaccaaagacttaaacattattggattaaggtgacatcatagtgcatagtgcgttgtaccatcgcgcaaactcgtgatattcgatcacggattaaagccatgatctatcattttctcttctttccccccttaaatctcgttgttttttcaaatcatagtgactgttgcttttcccatcgaaatgaaagtaatctaacaaaatctactgttagatcatgtttctccgaccaaccaaatttgaccttgtctacatatacacgtggcttcacaaatgcgcatcaagcaattggaacttggaagcatcactatagttctaaacttccaattaaaagattgttagtcaatctagggttgggatcataggtggctaagttttcggtttaacaaattttcgagatcatcgatataaaatcataggatatgtcctcatcacaatacagtatacacacacacataagtgattaagttatgcattcataacattaatccagaagctttatatgcagactcgaaaagtcaacataaatccagcattacatggcccatttgtctccatcattttgaccatcatagcatttcagttgacttggagagtgaccattggtccattctgtttcttttcaaatgaacaattaaatgtttgttcatttatcaaaaaaatattttttataaaattaccttatgtaattattcataatccgatttttttttaatatcactttacaaatttgtttatgatttatatgtacagtagtactttgctccgtaatcgatttcacatggatgtatactattgcctcctaattcttccaatatcggaaaacatgtctcacccatgtcttgtcacagtgctcgtttccctttttgcttctacaattccttataattaccaatccataatttcgttttattcacaaatccaaagcatgaaaaaagaagaataacgattccttttccaaaaaa

SEQ ID NO: 6349 - DNA, 3000 bp, Unknown; identical to SEQ ID NO: 6336
  misc_feature (1)..( 3000): cDNA_ID_1814083_gDNA_ID_1621089_Annot_ID_170635 3000 nt of promoter + ATG

SEQ ID NO: 6350 - DNA, 3000 bp, Unknown; identical to SEQ ID NO: 6329
  misc_feature (1)..( 3000): cDNA_ID_1814123_gDNA_ID_1621089_Annot_ID_170618 3000 nt of promoter + ATG

SEQ ID NO: 6351 - DNA, 3000 bp, Unknown; identical to SEQ ID NO: 6348
  misc_feature (1)..( 3000): cDNA_ID_1814079_gDNA_ID_1621089_Annot_ID_55472 3000 nt of promoter + ATG

SEQ ID NO: 6352 - DNA, 3000 bp, Unknown; identical to SEQ ID NO: 6347
  misc_feature (1)..( 3000): cDNA_ID_1012673_gDNA_ID_1621089_Annot_ID_55474 3000 nt of promoter + ATG

SEQ ID NO: 6353 - DNA, 3000 bp, Unknown; identical to SEQ ID NO: 6346
  misc_feature (1)..( 3000): cDNA_ID_1814072_gDNA_ID_1621089_Annot_ID_55476 3000 nt of promoter + ATG

SEQ ID NO: 6354 - DNA, 3000 bp, Unknown
  misc_feature (1)..( 3000): cDNA_ID_1814064_gDNA_ID_1621089_Annot_ID_55478 3000 nt of promoter + ATG
tactatggttatgaacatgagttcttgcttttttttttctttccatcgaatatttgttcatttggatgtctaatagtgtaagaaacagaatttcttagctgacctggatactaaattatgttctgaataatgtgtatctaggtgtatatcattgattttgggcttgcaaagaagtatagggatctccaaacacataggcatatcccctataggtgatttatggtgctttcatgttcctgtttatctacttcttttattttgttttaacttaaattcttacagatactcatgttgttttctttgcagagaaaacaagaaccttacgggcacagctcggtatgctagtgtcaacactcacctaggagttggtaagcaatacatagaaccactcgagaatttgctccaaagtcatatatacaattcctaaaatgtgtggatgtttgcatatctgttggcagagcaaagtaggagggatgatctggagtctcttggttacgtactcatgtatttcctgagaggaaggtttgtgcatacagatccgtttttgtctgactaaatctttggacatgtttgttctggtctaacttttctggattttcgggttcagcttaccgtggcagggactaaaagctggcacaaagaagcaaaagtatgacagaattagcgagaagaaagtatcaactcctatagaggtaaagacataatatggcttagataccattgactgaagttagatcagccatctcattgtcacataaatgaagggttaattgttctaccatactttaacaggtcttgtgcaagtcatatccacccgaattcgtatcatactttcaatactgcagatctctgcgattcgaagacaaaccagactactcatatctaaagagacttttccgagacttgtttatccgtgaaggtttgcatttgctctgttttggttattttttccctaagggacttcacagtacagttctgtgttgtgacattttgttataccaatgctttttttttatgcctggaattgctttttatctttgattgccctcactagttactgtcaaattttctagatattgaaatcttccttgatatttctataaatgtttcactcttttaacgaatggattcgcggtatcaggttatcagtttgattatgtattcgactggactgcattgaaacaccctcagagtagtgccaggtcccattccagtacacatgaaagggtgagtacacatgtctgtagatttttctatcgagtatgactatacatactcactttcgtttcgtattgatctcttcttcagcatcgtaccggtaaaccagggatgggtgcgggaccgtctgctgaaaaacctgaaaggatttcaggtaacccttgacttttttctacagttaagaatcatataactcttcttcgctaaacggtggtcggttctgattttgtgatcctgtctatgtcttacagtagggaacatccgcgataaattctcaggtgcggtcgaagcatttgcgagaaggaacgttagaggacccagtccccatcaaaaccataccagacatcgaactcttgacgaaattccttcaatgaaacctgctgtggtaaaaaataatatcatcatcttatatatatcaaaattttgatatattgttattacattatagaacgtgcttagtgattttaacacttttcaagaaatcaatcttgctcgttcttgatatatcaatttatttgatattgtcagaatatggtatctgagaaaggaagaaacacttccagatacggcagtgcttcgaggagagcagtagcctcaggaagtagaccaagctcatcaggtgaacaaagggagagccgggactcgagccgcgtagcctcaagcggtggcggtgtccgaccatcagtcttccaaagaacccaagcagcagctgctgtgagtggatacgagtcaaagacagcatctgcctttaaccgcgaccgagtagccgcttcaagaacagcacgagacgaggctctcagaagcttcgagcttctttcgatccgcaaatgaagccttcatcaattggctctttgctgtaaattggattcttctttacatatgttgtttggtcctttgtttccacgaaactcccaatttttcatgtattatcaaattctctggattttgtatcaatttttacacactttattgtaatcatgacaatttgttgagtttaattcaatgttacagttttaattttgtgttacatatgaatttatacctttaaattcgacgacgtcgtttccaagtgtataacgtgtacgccaactatcgtcgtttgaaaccgtcaagtttaacggcagcctccgtcggtgaccttgtcgtgacgcagggccttttcctcgctccaacatttaaattctctgaatttcgattgatcaatacggagtacgaagcacgaagatcgatttagcattctagttcatgatgttgaatccgacaaggtacaaacttgattgcttaaaggttatgtttttgccggaactgggacaatgtttagattgtattctcataagtctggtacttcctttaaaattggagtttttgtttgttggagaaacttgacttttagctacataagatttttaagggtcaattttgattgttgttagttgttttgatgaatttgtacagggatgatagtctataataggtttgctctgaatctggattgacccagagaaaaaaaagtgaagctttgtatgatttgttgtggatttatgtggaaatccggaggtgaagatttgcaaggtttctatccagttagagaagaatgtgtagcagatgttcccaggactcgatttaaatcaagggtttgtctttttcttagaccatctatgttcttgatcaatcaaatttgtttcaaagtttgagtatttcattttgggatatgatcaggctggtaaaactcttagtgctagaaaatggcacgctgcgtttactggagatggacatttggat

SEQ ID NO: 6355 - DNA, 3000 bp, Unknown
  misc_feature (1)..( 3000): cDNA_ID_1814174_gDNA_ID_1621090_Annot_ID_55484 3000 nt of promoter + ATG
ttcttttgaagtcaaatcccgagcttttgttcagttctgggtcatcaccgcggttttggatgaatcaaccagttcctggttcgagtatttacgatcgagtcaatggctctatgagcgaggccctgaagtctgttgttgtcaaggaaagtgaaagactctatggagaagaattagcagtaactgttcttgttactggtaatgtggagaaattgaataggttagatgttgggaacaattgggattttctagatgtgtggttgcatataggtgcatactcgcctttaggcccgttaggtgttggagaaaatgccgcgagtttggctttggttggtcgtggacgagatgtagctgctgctaaatactcagactgggttaggtattgtgcttgttgtgctcatttagctgattcttgaggatactgatagctcaatttttcagggatttagcttgtggattacttgagttttgttgtttctttcttaatctcggtatggtttatgatttaggcaggcttaggaagcctctggagaagtttagacctcctttgaccactgaacttcttttgtcaaacgatggtgatcatttgcttgagggctgcatcacaaactttttcgtagtttgccgcagggtactaacaaaaatttgatttttttttgttcaagcacaagtcacctatgttgtgattaggatgtttattgtcttcatttatgttgcattttagaagtttgaatttcattttaccactgcatgatttactgtttgatctcattttaggtgaagtcatcagagaatctctacggcgggagtttgagcgagtttgaggtgcagaccgcgcctataactgatggtgtgctagcaggagttataagagaccttgtcatcgagtaatatgttagaccattaagaatgttgattatattcgtctgtgtttatggcctgatcaaccaataagatttgcttttctgtcagagtgtgtttaagcgaggggattccataccgcgagagagcaccttcgtggtctgagcgtgagctttgggaagaagccttcattacaagtagatctttccatatccataatctgttttttcatcttctcgcatatatattggcctgaacactttcaatgtgttgtgtgatgtttgtatattttaacatcccaagaactcactgggttcaggtagtctgaggattttgcagcatgtagggacgatcaaagtacccgttggttcaatggagggattggcttgtaacaaacctgaggagattcaatggaaggagaaaaggtttaaggaaagacctgggatgatcactgaattaatcaaggtaaagcttgttacttttattacccttagaatcattggttttgttcttgtcttttgagtcaaatcaaagatagaaatcactttaaagtttttgtttgtcactgttatgttggagtagaaagcgataatggagagaggtattaaagaagggttcccgttgaaggccttttagtgctcttcatgattttgccaaatagctgaaatgttgattcgtctatggtttgtaattgtattgacgccaatatcttcccaaatcatcactcattataattttaacgatctgatgtttaaaaggttctcagttatatatatctgtataattgatcagtagaacatattatttaacggattttatggagatactccggtaacttattaaacagatctcatgaaagtaatcagtgtcaagaaatgtcaagactgtatacatatgttaatatgctaaaccacaacgactatcacttcccaaaacatggttatgatgttgatatgaccctccaaatccacaagtgtgtatgtgtatcaacgtcaaagtattgaatataaagagttgtgagtactaaaaataaaagcaaactaaaaatatagtccgtatggaatgcctttaaaactgcttgtagtggaggaaaatagaaatttggaggacaccaaattttccccctttttttttcttttttttttctagtaaatcaaattaattaatatcataaaaaagattagatgatatataagcatcttttttttttccgtaaatcaaattaattgatattataaaaaagataatggggtgattgacatcgcattgtcaagactttaaaactatttaacaaatgataaatcacattaattgacaccatgtatgttttggatatgtttgataaaaatagtttactagtgaaaaaaaaaatatgatccacacccgagggagtagatttaatttttttttttcttcagaaaatcagctatacattaattatgtattctgacttaataattggtcgggtttgcaaatcttttatttttttggtaaacatgtgaagaaaaaaatagaaggtttgtaaatctttcaatattgtttgtacattttccataaatctttcaatattgtttgtgcttcatcaacatatagtcaacacaaacaatgctacgctcttatgaggttctgcaatatgagtagcttggacgaggtttctgatcaatagatctgttataatattataaaacatatcgattctaacagattttcaatggatatataatccgataactttttagacacatctgatgagtgatcactgtaaaaaaaaatacaaaaaaatcaaaaccatgtgtatatatgctaaactacaaatataaaattaccacacttgtacaatatataataaaaataaacatcataatactaataattacgacactattggtcttggtttggtttatatgcacgactccggctttaaacaataaatccaggagcatgacacttccacgtccttggctagatctaagtttaagtcaacgatgactcatagtggacacgtgtcactcgttcattcgagttatccacgtgacttcttattacagtcttcttgactctttttttttttttttttttttgctgaaaattataaaaacccaaaatccaacaaactttgattacacacacttacatacaaca

SEQ ID NO: 6356 - DNA, 3000 bp, Unknown
  misc_feature (1)..( 3000): cDNA_ID_3048244_gDNA_ID_1621090_Annot_ID_55485 3000 nt of promoter + ATG
gttcactatatcaaacagtgttttgaaaacctgcaaatatttttacttgagtactgaaattgttttaactgtctcttgtaaaccaaaaaaaaacagatcgctgtggatgttgaccgtacagtagtggaactgtacaaattcctgaagaagcacgcatcaatcccatttaaacttgagaaaccggcgacacctgaaccggtgatctcgaccatgaaatctgatgagaagatcgagggtgatagttccaaggatgagttgtgatgatcggaacagagtgtgtaacaaggctatagatgatgactcttctataaatgatagaaaatgttttgccctttgtttttttccattgttgtatgctatgaaatgaataattaaagaagttttggtttctcaagtttttggatgtaactggaggtttgatccacacattgagtgttgatttaatgcgacttgtggttcataacaactagcacaaaagatttcttacgaagcgtagagaaaccacacaatttctgccaaaaccattgttatcatagatcttatggtttacaaaaatatgcaccttcaaagttcatatagaatagacgtaaataaaaatccataagagatgtacgagtttcatatggaagagacactgtttattagtctagatccaacgtgttctctcgtactatggattagtagagaataattcgttctcttttaacgagatatggttgttatataagatatagaaattgaaaaaagcatggtaaacaattaaatccatgtttttctattatgtgtcactgcggtccataggctggtgaacacctaatagtgtagcattgtcaatatttttctttaccattggttttaaagcttccccaccaaaactcgtcatttttacaaaaaagttgcacaacatgtaggcatctgctttattacaagttcatggcggcactagtctgcttcgaaccccttaacattgcttacaatgaggcaaagtttctttttttcccccttgtttttcctaatatgacaaaattgatcaataaaaaagtagttacaattgttacaactttttattgcaacttttagttaaaatagttataatttttattgcaattaaaatagttacaatttttttattttggttatgtttttttatcgcatattttcgttaaactaccgcatagtttggtaaattttttgtaatgattcaaatatttaaatatataattataataatttagtacataaatactaggccagagcattcatttatattcggtttgcttctttcggttctaaactctgaagatccataagaaaccgaaaaagttatggttcaactcgattcggttctaattattttatccaaaatattttctaaaaggactgtatctaaatatcggaaactttttttgacaaaattataataaaccaaaatatcagaaaaattaacaaaaattaattagattagaggtaaaaaaaaaatgtattggacttagttttgtaaagggttgaccaaacatttttttgttctattcgggtatctaaaacagaaccagaatccttttttggtttggtttagtttggtttttcaatttcggtttttgttcctagctcaatatgcaaaatcaatattattttgtagtttaatatataaatacaaaaatttgtcgaaaatgagtttcagggtggagttcatatcctagttccacataatagtagagaacacgaaagaactttgacttatcaaactttacatcaacatataaatctaatatcatataatatactattaaaaattctataatttatttctagagtccatccacacacgtttctgatatttgttttttgtttgtaaaagaaaaaaggaaaaaagaaaagtactagacatctcttttccgtaaaatatatactaaaaatataaatattttattagcatttcattatcttacctgcatttcaactatggcaaaagaaaaaataacagatttgaaaagaaaaaaaaaaggaaaagcattcaacgttgatagtatgtaaactaattgatgctctaaattagcgttacatttgttatgtaaaataagaaagtcaaagaagcagagtaaagattaggtgatacttgcaaagttacctttcttttccaaatgtaagtaacgtctcaagtttatcaaactaatagtttatgctttacatattttcccaatctataaattttatttgtaaacagaaacaaatgccttcgaaactcttgtatggaaaaattaaatccaaaaagttagtatattattagagtaaacactcataacagaaagatctttttcatactccaatatggaaaattttagcatcaaaaataacatttttttgttgttgttgccaatatatcagcatttaaaaaaaaaataaccattcgcaagtatagaaataataaagtctcagtaaaagtgaatgcaactacaagtctctgggatggcaaaattgttagcaataattctgtgtttgtagtacataaaataaaattgattaattgctcgttcttcttttattaataatccgtgttttgttttgtcctttctcttcaatctgggtttggtggggaggttttaagtcaagcgtgcgatatatatatcatcaaaacagacatcctctgttcttgcctcttcttcttcttcttcttcttcatcttcttctatatattggtgtttcatttgttctgctttaaaagtacacaaagattcatcttttttcggtcctctgattgggcaaaagactagctcggtcgtgttttgaacaagagatacatgttttgaaaaattcctcgcaaaagaagagaaagaaagactcaaacttttgtttgaatttgataccattttttatatatataccaaaagtccaagactggtttcatttttgggtttggtctgaaacctctcttcgtgttgtttgttcatggtatgtcttaattagggtaaaaaaatacttgattgttttctctcaatcatc

SEQ ID NO: 6357 - DNA, 3000 bp, Unknown
  misc_feature (1)..( 3000): cDNA_ID_1814170_gDNA_ID_1621090_Annot_ID_55486 3000 nt of promoter + ATG
tctcttatcaacaattacactatataagccaaaacaatgtattcacttaggttttgaaataacgaacctggaagtgtgcactattaagacatttcccaatctgtgtaaacagaggaacaacacattgctgaaactcagagggctctgtagcatccaagacttcttccaactctcccaagaagagaacctccttttgacaattggtaagcggccaaaacttcaacaacccgcggatcacagtatcagccaacttataatctttctcaacaaactgtgtcacgcaatacgccaactgctggtggtaaatcgagatacctttagacttgtgtagtggcaaaatagctttcacaagatacagcctatgctcctctctcataggtactgtaaaaccattgatcacacttcctaagatctccaataactctccaatgccaatacacctttcagtctcatacaagaacttgtagaaaatgttataaatcgaacatctgataaacggtcggtgaaatataaacttgccatagattctatgaagaacagttttcaaatactccctctccctaggatcctcagagtcaaacaaatcaagtaacctcgagacaaaggtgtgattgatgaactttttcgcagttttaggttcgatttcggaagagactacataccgcaaaagaagctcgtaaacgagctgcaaatgaggccaccatggctcaagataaggctcttcttcttcaggatcattcccttcaggaggagcaccagtgttctcatggtaagccggtgggagacaccggaaaatgttagcagaaaccatacgtataagctcactctgcatcgtctcattgactttaccagaagaagagtgaaggaaatcaaccaattcaaggagtgtctgtcttttgatctctttctcgcgtggcattatcaaagtatcagagaaatcgcagtggcaagaacacatgtgagctttcttcatgaagagaagaggtcgatctgaggaagacacgtcttttaacaatggaagtacttcgaggatcggtgttgttgtgaacattgggtggtttggtgtctgtgaaggagattgagctgttgtctgagattctccatttgaaacagaggatggagcgggtgtggtggtacggctgccgcgaacgacggtgttggtggaggtattgttgttgttgttgttgttatcttggtgatgttgatctgatttgttgaatttcttctgacccagttttatgattttgttgaacatcttcgattccgaatcaaaatgtaatcttttcttgaaatgaaaggaaaaaaaaagattcttctgtgagagaaaacgaggttaatctgtaaagaggaattgaaacgaagaagatttgatatatgtgattacctctaaagcgatgaatggagggagaaactgagatcggagaaatgcattattaggccaatgggattgtggaagaatgttcttcaggcgaaaccagaaaccgatacaagattgatgtaagaagaatgaaggaggaggaggagatcaaattttttggggagatgtatttttaaccaaacgatagataatttgttgttaaatcattgttttatccgagtaaaatgtatattattgttttgaattttctcatcattaaccggaaaactttttaagaaaatgtatatatttaaattgcataatcgaataatagttaaatataaaatgcaatttcataaaacaaaaattatgattgttaaaattttgagaaacttcaaaaccattttctcataccctttacattgtagaatctaattctctaagagcattattaaagggggatattagggagatattaggagattcttagattgtaaatgattaaatttaaatgttaattaagcaatttagaggctctctaagctaagaggtcctcttaaataaaatgtagtggtgatgtgacatgatttggttggttgggaataatattaaagccgaattttttttcttgccattaattcttctactatgtataatacttcataatatgatagtaaaaaacgaacgagatggttacacttactttgatgtctctgaattcttacaaccagaatcaactagaagtgcacaagtggatttcacctattctacatatatgccttcaaatctcgagaatatattggaaactcgaactcgaattcgtaatcgacaagcacatcaataattaaaatttgatttggttcaatatatatagaaattttttagcagaaatcaatagttaaattttatgttttcatgtatgtttttttttttatatgtcatctatgtatcgaatattatgaattgaataataattaagtttttaaaaaataaaatatttatatattttatcttttaaatatattttttttaagaatcccaatttaatatattaccattgagcttgccaaaaaattaaaatcttaccaaaattcttaataataaaatttcacaaatttattcattaaaaaaaaataaaaaccttagctaatagactaccattaaggatggtctaacattcttcttgttaaatcccttaactaaatatatataggccgaagcctctttgttgggccaagaattttgaccatctgaccaatatggtccaacaaagagaaacatctatggtgctgtagtgtctgatttgtaacattacaaaacaatggaacaaggaataaggtttttttttttttttaatccagtacttttatgatctatgagtttaaaactaaaccaaactctagtttttttctagactcaaagactaaaagtctcattgataactttcaacacgcgtcatgcagcttcattgtctagctctacatgcaaacatcccacgtgtttccactctgcatgtatctccaacactttcgttacctcaaacttatgtaattcatctttataaattacacacaaagccagcgattctctagggactcagtaaggccacctcaaaacaagacccatcgataacagcgatcatg

SEQ ID NO: 6358 - DNA, 3000 bp, Unknown
  misc_feature (1)..( 3000): cDNA_ID_1814140_gDNA_ID_1621090_Annot_ID_170679 3000 nt of
cctgtatacaatctcttctcagctgtaatttctataatctcgtcaattatcatctattcaggggtaagctatgggatgtgcttcttctcttccaggcaagttttgttttctctctcaattttgttgaatttgttgtcgttgttcgaataaaactgaggatttatagagaccctcgagcaatttcaccacccattttccgaaggtgtaatcatcggggttgaattagaagcttttaaaaattggggattttgatgattggttagggttttctggtggagaattggagaaaccgaattgattgttggtgatttgtgtgttttgtgaagcagataggaactctggaactttaagtggtcttagcaattcagagaatgctgttccagctgatgccaaaaatctacgtgtgaaggttttttttttttagtttttagtctcgtttaagaatgttgatctcgttgagattgctttgtttcttcactgattcctgcaatttctaatagcttattagaaagttcatgcttttgtgatctgtggtcttgcattatatatgattgttcacattttaatccacgcatgttgtaagatgtgataagcctagtgaagcgcttttgaagaaacatacactctttatagaatggtagtagcaaaacctcaactttgttcttaataattgacggttttgctttgcaagctacttttgaaactctttttctattgttaaggagatgattccttttctttcaccttttattttcttgttgctcagcagtattttgccaagtgtggtataattggtttcaactttgcgtaagacataccactaacttttggattcacttgattgcagttagttctattaggagactctggtgttggtaaaagttgtattgtccttcgatttgtacgtggtcagtttgacgctacatctaaggtaagtaaagccttgttatctaattgtctttattgaccatctgacacctttttagaacaccatgctctgatgtgagtgaatattagactattagagtatacttatctgccactagatctcaagactactagctatgtatcaggtaactgttggagcctcgttcttgtcccaaactatagcattgcaagactctaccacagtgaagtttgaaatatgggatacagcaggacaggagaggtattaaacccttcatgcagatttgtattgcttattttattagataaacgctttgcaaacttactaggatttaacctgcattcactttatttttaggtattctgctcttgcaccactatactaccgtggagctggagttgctgttattgtgtatgatataacaagccctgaatcgttcaagaaagcacagtattgggttaaggtatgttttcagggggttcaaaaggttccatttcgttcatgtttctaggattcgtgcaatagcttccgagctatatctttaccaggactgaaaattagagttacagacagtcatatagccaacagcactcctgtctgtgtatataatgggtatcatttagttgggcaactggtttacttctctgacatttttgttccattaatttgcactcgttgctaccatgaagccatttggcacaactccgtgcaggaaagatatcaacattatattgaatctagtgctattgttttacccctgcccataaatctaacaggaactgcaaaagcatggaagcccagatattgttatggctctggttggtaacaaagctgatctacatgaaaaaagagaagtacctactgaggtgagtttgcgtaaacgtcttcatctagattccgtagcgcattttgttgtcactttcattgtccttgcttcttcagtggtatcacattttcaatttcttaacaggatggaatggagcttgcagagaagaacggcatgttcttcattgagacgtcagccaagacagccgataacataaatcaactgtttgaggtgtgcacttctttcttgcctctgatttatgatcgattttcttgtcctctgcatttattgagatcttattatccgtttctttcattgctttggaattggaggatggaaaagtgataggcagtgatatgcagctagatatgagatttaatttcttgtagtttgtggaggataatagttttggatgcagaaagatggattaatacgaagtatatgagattttaacttgttgtagtgtacacatgtctgataggaaattggcaagaggctacctcgtcctgctccttcgtcatgattggagtgttgaatcatctcatcttcagccatgtcttcagactactaatctttccatactttttaatgtaatgtttcaaaacaatatttctctatctgttaagtcaagtgtgttgtataatgtgaagatttgagtttgaaactggggatattacgaacctcaaaagtggaaacccaagttatatcaagcaatggatcatcagtacatattttagtgggattcatcagaagtagagaagagtaaagcttcattcaaatgattcaatgcatgtatagtttgtgggagagactattgcagccaattctaacaaaacctaaatcaagaaattatttgacaatttcaaagagactaacaaacaggtagagaaatccattatacaaaggatttgacttttgatgatttcagatgcaaatacaaacttaaaaactttatatatttgtattggtcaaccttaatatcataaatttatagttgaggcaataaataaatatgaaaatctaaatgcaatgtttaaatattaaaatttaacggcaaaataaaatagaaaaaattatgattggtctgaaaatggacaaaatgagacttttcatgtccaaataggtgtttattgtcacgttgatgagaagactatttcgttccatagcatttctgttcctcctcttggttttttgggtttcttcttcctcgtcttggtttcgttaaaacccttttgaagccctctggaacagtaaaatctgagggatg

SEQ ID NO: 6359 - DNA, 3000 bp, Unknown
  misc_feature (1)..( 3000): cDNA_ID_3048229_gDNA_ID_1621090_Annot_ID_170678 3000 nt of promoter + ATG
gcctatttcagagtttatttaactaggaagatatgacaaaatgtatagacactgaagtaagccacgcttatgagttctatatctagagaggctaggaaatgttttggtcaactaacccccaaaagaatcacgcagaagccttgttagcttagaatctcttgttggtatatgagaactgccttcagctaacgcatttatgcattttcccagggatgtcagtgaaagattgatgaattttgcttcttcaatcatgtggccgtcagttccttcaggaaaacagcatataactcacaatgaaactacttgatataacatgaatggttattatatgaacaggtaaggagttcaaaccagatttattaattctttcggaaccagcaagatcaacaattagtagtttgctctttctaactctaggaatggctttatctcccaatgattccggttttgccttctcagttttttcattcatagcacgtctaacgtaaacctgcaaagaatatacatttcattaatcggcaggtagaacacatggattttgttgatgaacaagaaaccatagagaccaaaatatcctaaggaagcacaccgtaagaattgcatgactacgagaggattctgtattcatctttgtatttgctgcatgacggtttgtctcaccgacttgcaaaacctgcaagaaatggtctaaatcttgaatgttaactactgtagcgcctggtactgatacttccccagtctttgcatcctcattgattgaaatgttgtttttctcaggtgcaagaagatcttgtatagtttccatatatagctgtgaattacaagaacaagtaaagatattagaaatggttcttatatatgctctagaaccatttccatcttctgtctatgaatgttcaacaagaagacaaacatctaagcactagagtgacacctgcaaataggagatctcgacggaaatcgaagcagaagatgcgttgagaagtatatcctccagagctctaaccataataccacgctcagctgcatcatctttaccaatttttccaaccgtgtaagttttacctgtgccggtttgaccataagccataatggtaccattgtatccactcagaacaccctgtaaattcaatgtagtagatatcaataaccaaaagtattacttcttaacattccaataagttatataaacatcagacactttctaacctcgacgacaggttttgctactccttcatagacacgcttttgcgaagctgtgtctgtaaagacttcatcaaatttgtatgactcagagttccagttgttcttcctcaacttaagcctctttatctgtacacacagaaacaaaacaaaactttgtaagaatataactaacacagagttgaaagagagaagatgtgattagtgagcatctaataactcacttctggttgtaactcaacaagatcagcaaaatcagcatccgagataagctcctctccgtttcgaggtcgaactcttacagagactcttaccctcccaggatcttcatagaaaagtatgaaactttaaaaacagattatgccaattagtgcattttatgaaagtctaacaatgcaccaattcgaatcaacaatctctgaatcgaatgtagaaaaagtcaaatactttaagaaattgaaaaaaaaagctcatctttcaattgtggaatcatacgggtgaatatgaagagagaaggagaaaaaggacagaccattgtcgtcgtcgaagtctttcgattgagatcggcgaacgggagtgccggagcggcgtgtggagggagaagaggcggagacagaggacgaagaggaggaggaggaagcggagggtcgatctttaaggcgagaagagtgtgctattccgggagcgacgatagaggttctagcaggcaaattcaaggaagaagaagagagagataccgcgtgattgctgttgggaggcaagtgctgctgaattcgctccgccgcgtgtttcgccgacgatctgacggcggaggaggaatttgacgaactcattagctggagtcttcacgaagcacgaaagggcaccgagaagagaagagaaagagagtatgagacaacaaagatagagagagctaagagaatgtttcaaagaagtagaagaagaagagaagagggaggcacgactgtgatgaaaatggttcccgcgttcgtggattttattcggtttggtttctccatttggtttggtttggttaaggtcggtttcgatattagcggttagcggacaagaataaattttaagaacattacaagtgaaagtataaacgtttagcgggtccaaaatgtgtatggaccatatcgataacaacgatacaaaatctagtaaagtggatcccctattaatatatgggctcatctacggtatcaacatctctaaacatagtgatttgtcccctgatgacagaataaggctccgaatggtgattgtgttttatggtacgagagaagtgcggtgcggttaaaatagtaacaaaaatacatagatacatatgtatgagtagagattttgatactattacagcactgttgcggtgcggttttgggtgcggttttggtcaccattcacagcctaagaatcattaaaatcattaaaatagtgtaagagattttgataatcgtggtctggtcggcttcaacttgcataaactccatatttgtaccagcgacacatatgttcgtatcgttttcttgctatcatgttggtacatacactcttgatttctttaatgcaacccaaaaaaaaaaatctgactttatatcgttgcaattttttttcatatgaaaacaatgtttaaaaatgaggcccatttctaagcccatttatacagaatgaggcccattaggtgatttaataatcttctccgccgtgttcttccactgcggtggactatcgtcgctatcacacggtgcaggaaaaacaaacggagaaaggtcgatcatctcttgatcatcgtcc

SEQ ID NO: 6360 - DNA, 3000 bp, Unknown
  misc_feature (1)..( 3000): cDNA_ID_1814148_gDNA_ID_1621090_Annot_ID_170676 3000 nt of promoter + ATG
gaaataacatcctcatctagtggaaccatatacaagggaaactctttcactgtaaccaggttatgcactttttcttgctcaagaatctgaaaatagcagaatgattttttttatcacccttattcaaaaaagtaataaaacaagcaaacgaaagcaacaatagtattagaggacgcaaataaccacataccttctcacacgcaacagacctacgaggaacaaagtaaacatagtagtctctctgaatcgcttttgcaatatcattctgaatgtgagacgctatgaatttcataaagctaagttgagagcgaacaagataaaccacttttgtgcattcagtctgaactggttccgcagtaagatgtcgtaactccaaaccaagttcctgttaagcaaagaacaacaaaaaatcaaatcaccactaatgttaaaaccaaactcaacctttaaaagaaaaacgaaattaccttaagcttagaggtcgggatgatcaatgagactgaaccactgagctttggatcaataaccaaacacttagttccacgaacctacaaccaaagacaccaaaaagaagagaaaacaaaaaagtcttgagaaatcggtaaatcatctccgaagtctattcatcctaatgattctcaatcatacgacattggtgaagtaattgcatagaaaagagaagaattcatagtaaaagagagacaaagcattggtttttattttcacattctcaaaagagatatgtttgatcaaatataatccgcgaaatttcctaactttcgtctcccaacccaaaaaaaaaaaaaaagatagagtaatgagacttacgtctttaagcaagtttacgagctccctctcagacttgtccctgaataagaaacgagaaacatatgatgtgagaggaaagaagaagaaacgatcaatcaatctctaagtaatgaaaatagagtcacctaatggatttcagattgagaggagcattctccaagctggggatctgcgccatggacgatgatcaagagatgatcgacctttctccgtttgtttttcctgcaccgtgtgatagcgacgatagtccaccgcagtggaagaacacggcggagaagattattaaatcacctaatgggcctcattctgtataaatgggcttagaaatgggcctcatttttaaacattgttttcatatgaaaaaaaattgcaacgatataaagtcagatttttttttttgggttgcattaaagaaatcaagagtgtatgtaccaacatgatagcaagaaaacgatacgaacatatgtgtcgctggtacaaatatggagtttatgcaagttgaagccgaccagaccacgattatcaaaatctcttacactattttaatgattttaatgattcttaggctgtgaatggtgaccaaaaccgcacccaaaaccgcaccgcaacagtgctgtaatagtatcaaaatctctactcatacatatgtatctatgtatttttgttactattttaaccgcaccgcacttctctcgtaccataaaacacaatcaccattcggagccttattctgtcatcaggggacaaatcactatgtttagagatgttgataccgtagatgagcccatatattaataggggatccactttactagattttgtatcgttgttatcgatatggtccatacacattttggacccgctaaacgtttatactttcacttgtaatgttcttaaaatttattcttgtccgctaaccgctaatatcgaaaccgaccttaaccaaaccaaaccaaatggagaaaccaaaccgaataaaatccacgaacgcgggaaccattttcatcacagtcgtgcctccctcttctcttcttcttctacttctttgaaacattctcttagctctctctatctttgttgtctcatactctctttctcttctcttctcggtgccctttcgtgcttcgtgaagactccagctaatgagttcgtcaaattcctcctccgccgtcagatcgtcggcgaaacacgcggcggagcgaattcagcagcacttgcctcccaacagcaatcacgcggtatctctctcttcttcttccttgaatttgcctgctagaacctctatcgtcgctcccggaatagcacactcttctcgccttaaagatcgaccctccgcttcctcctcctcctcttcgtcctctgtctccgcctcttctccctccacacgccgctccggcactcccgttcgccgatctcaatcgaaagacttcgacgacgacaatggtctgtcctttttctccttctctcttcatattcacccgtatgattccacaattgaaagatgagctttttttttcaatttcttaaagtatttgactttttctacattcgattcagagattgttgattcgaattggtgcattgttagactttcataaaatgcactaattggcataatctgtttttaaagtttcatacttttctatgaagatcctgggagggtaagagtctctgtaagagttcgacctcgaaacggagaggagcttatctcggatgctgattttgctgatcttgttgagttacaaccagaagtgagttattagatgctcactaatcacatcttctctctttcaactctgtgttagttatattcttacaaagttttgttttgtttctgtgtgtacagataaagaggcttaagttgaggaagaacaactggaactctgagtcatacaaatttgatgaagtctttacagacacagcttcgcaaaagcgtgtctatgaaggagtagcaaaacctgtcgtcgaggttagaaagtgtctgatgtttatataacttattggaatgttaagaagtaatacttttggttattgatatctactacattgaatttacagggtgttctgagtggatacaatggtaccattatggcttatggtcaaaccggcacaggtaaaacttacacggttggaaaaattggtaaagatgatgcagctgagcgtggtattatg

SEQ ID NO: 6361 - DNA, 3000 bp, Unknown
  misc_feature (1)..( 3000): cDNA_ID_1974108_gDNA_ID_1621090_Annot_ID_170674 3000 nt of promoter + ATG
acagcgtgagatacctcaatgaagactctcttcatcggcttctatctaactgccctgttcttgaagatctattggtggatttacttttgtcagacagcatggaaaagctaactgttgttgtcccatctttgcagattttatcactctttatacctcattcttatgagatcgatgggattgtgatagaaactccttctttaaagtattttaaacttatagaccataacagtaagagtcactactgtttggttaagaatatgcctaacctgatagaggcagatatagatgttgaattacatagcatcaagagtcttattggatcaatcacatctgtcaagcgtctttcaatatgttcacaggtatcattttctcaactcattgtttagatatgcatttgctgataatttttaatattgcgcaggctatgtatgatggaggttttgtcttcaaccagcttaaacatctgaagctatgtagatgcaaagggcattcgtcggatttacttgtccgactgctcaaagattcttctaacttacaagcactagacctttccgaaatggatgtaagtttgttcgtcaaactcttttttcttgtctgatgcacattatggttttagtgtaattcttcttctgtttgatctgtaattcttcttctgtttgatctgtaattcttcttctgtttgatctcagtatcatgagaatcatgatatcctttactggcatcaaccaagtactgtccctgaatgtatgttgttgagtctccaaactctcaacttgtcggcatatagaggaacaccagaagagagagatcttgcagtgtatttcttgaagaacgctgttcacttgaagaccacaacaatcaagtcatgtgtttttgatgatgaaagatttgacatgttaaaggagttggcactttcttctagagcttcaacaacatgccaactcgtgtttgattgagagtatttgatcaccaaaacaaagcttgttcttcagttcttccatgtccccgggctcgtatggtttgtcttcaacctgaaaatttgttttcgtcaaccatctttttctatgttttccgttttttttgtatgtgataaaaactttattctatatgttgtccaccaaaaaacaaattatgttgattggagaagttatatgataagttttaatcgtttatggggttttataggtgtgtagagatatatacataccttgtgaatgaagaaaagagaactagctctgtgttgaaaaactgaaaagcatttgatgccctgataatttctctaaaattattaaaccgaaatactaatacgatccaagtggaaccaaccaatttcttaatatctaaaataccggaatctaaagagtcgaaccaaaccgaaccggaatgtcctctaatttttatttttaaacccatgattatgacatgcactaccggcttagtggtgatgtttggcaacatggtttattcaattctcactcgcactgagtgtctgtggctcataaatcatttaccttttcaatttctcaattccaaatctaaaagtcgtcaaaaatggctctccgatctgtcaaaacgccgaccttgataacttcggtcgccgtcgtctcctcctccgttaccaacaagcctcactctatcagattctctcttaaaccaacgtcggcactcgtcgtccataaccatcagctatcgttctacggttcgaatctcaagctgaaaccaactaaattccgatgctcagcgtcggctcttacgccgcaacttaaagacacgctggagaaactggtgaattcggagaaagtggttctgtttatgaaaggaacgagagacttcccgatgtgtggattctccaacactgtggttcagattttgaagaatctgaatgttcctttcgaagatgtgaatattctggagaatgagatgttgaggcaaggacttaaagagtattcgaattggccgacgtttcctcagctttatatcggcggtgagtttttcggtggttgtgatattactcttgaggcgtttaagactggagaattgcaggaagaggtggagaaagctatgtgctcttgatcctgatttcaatacttggtttttgtgatgatggaatttgatcttatctatctatctatcacctgggaaaaaaaatgtgattttgatgtttcagagtttgtggttgtaacattaagagacatatattgtatgatggatttaggtatacaacagttggagttgcttggaatttgagtttcctttgtcatatgtgttggcctgcaaatttgtgttgtttgttgaaaggtttatgtgtgaagtagtgctagtagaatctaagtttgtttctgactaagagacatgaagtcatgggttgttatgctcattcatatcctgattgagatacaatttaaagaaacttagttccaaagattctgaacattcaccggtacagtgtgtctgcaaatggtattctgtctcacttcaatgtctaaacacgttgtctcaaaatgtatcgtttgttagatactcctttcaagacatatgatttagcctcgcatgtgttcgttgatccaagttttaccggtttgataagtctccagtcttagcaataaatccagaccggattcatgaccaatcgcagatttaccggtccgggtcaagttttaaaacattagtagaaatgtgtttcaccgaacaggaagacttatctgatagcatctcgttgcagtggataaatggcaaaatagtaatatacgtagattctgcttttatctgaaccacatagtgcagatggatatcgaacagaagaacatgatatcgagaagacacgtggcccaatgaaaaagccacgcaggctctgtatagccaattgcaatctggttttagattctcatctcacaaatcttacttatacgatcagtctcccacattcacacttccaccaaacacctctcgtccacatctttctcctttggtggcaaacacaacgacagatagagagaaacg

SEQ ID NO: 6362 - DNA, 3000 bp, Unknown
  misc_feature (1)..( 3000): cDNA_ID_2175376_gDNA_ID_1621090_Annot_ID_170670 3000 nt of promoter + ATG
aggagacgacggcgaccgaagttatcaaggtcggcgttttgacagatcggagagccatttttgacgacttttagatttggaattgagaaattgaaaaggtaaatgatttatgagccacagacactcagtgcgagtgagaattgaataaaccatgttgccaaacatcaccactaagccggtagtgcatgtcataatcatgggtttaaaaataaaaattagaggacattccggttcggtttggttcgactctttagattccggtattttagatattaagaaattggttggttccacttggatcgtattagtatttcggtttaataattttagagaaattatcagggcatcaaatgcttttcagtttttcaacacagagctagttctcttttcttcattcacaaggtatgtatatatctctacacacctataaaaccccataaacgattaaaacttatcatataacttctccaatcaacataatttgttttttggtggacaacatatagaataaagtttttatcacatacaaaaaaaacggaaaacatagaaaaagatggttgacgaaaacaaattttcaggttgaagacaaaccatacgagcccggggacatggaagaactgaagaacaagctttgttttggtgatcaaatactctcaatcaaacacgagttggcatgttgttgaagctctagaagaaagtgccaactcctttaacatgtcaaatctttcatcatcaaaaacacatgacttgattgttgtggtcttcaagtgaacagcgttcttcaagaaatacactgcaagatctctctcttctggtgttcctctatatgccgacaagttgagagtttggagactcaacaacatacattcagggacagtacttggttgatgccagtaaaggatatcatgattctcatgatactgagatcaaacagaagaagaattacagatcaaacagaagaagaattacagatcaaacagaagaagaattacactaaaaccataatgtgcatcagacaagaaaaaagagtttgacgaacaaacttacatccatttcggaaaggtctagtgcttgtaagttagaagaatctttgagcagtcggacaagtaaatccgacgaatgccctttgcatctacatagcttcagatgtttaagctggttgaagacaaaacctccatcatacatagcctgcgcaatattaaaaattatcagcaaatgcatatctaaacaatgagttgagaaaatgatacctgtgaacatattgaaagacgcttgacagatgtgattgatccaataagactcttgatgctatgtaattcaacatctatatctgcctctatcaggttaggcatattcttaaccaaacagtagtgactcttactgttatggtctataagtttaaaatactttaaagaaggagtttctatcacaatcccatcgatctcataagaatgaggtataaagagtgataaaatctgcaaagatgggacaacaacagttagcttttccatgctgtctgacaaaagtaaatccaccaatagatcttcaagaacagggcagttagatagaagccgatgaagagagtcttcattgaggtatctcacgctgtgaagttgcaaagttttcagagagggaagaaatgccattcgaggaacatccaagcgaatctcgccacagagttccaagatcacaagcgatttgcaggtatacaagttactcggcaatatgtttggcttctccggatatgaagaataaataacctccagctcacgcaggcagtgagaaactgctataacaacccacatcttgatattctcaggtgtgcattttgaatcaattaagtaaagacggaagctttctataaccggagctctatgtaatggcagatttttgtcaagaaaacactccaacctcttgcattcagaagaatctctatgaccatacttaagtttaggcaaccacatccaaagatactcccatcttttcgacaaaatgctagtggatacagcaattttgttggaacaaacaataatatcttaataagcacttcatcagataactcactgaatctatccatatcttgaaacccgaaaccccaagttactgttgttactgtcgacagaacttgggaccctaataagaaagaagataacatctttcaggctcataaagctaaagaagccaattagtaaacaagtgaaaactcggacacaaagaggaacagtactaaaccttagaaacaagctagattgttaggtgaagctgagaaattttcagtgcccaaagaactgtatatccttttcaaatctagtagaatggtagtctgaactaggaatcaagaaagggtaaatgtaaacgaagcttgaatggtacatagcaaggaaaaaggaatatgaacaagttggtttatcagaagataccacaatcgctgagcatcggaacgacaaagtgttgtcctcaccgttgatactcacactggccactgacccactcatcaaagcgttcggcgtccatttaatttaggtgtttaattaccataaacgatgggcctggttatgggcctaacttttatgttatacgcccatttaacttgggtgtttaattacaaacttgctttagcgacgactttgacgagaaatgagaggcccaatataaaatacgagcttgcttaccaaaatttgagacccaaatagtaaaccaatctcctccagaatgcaagtggacacaaatccccaagagaaacagaatcaaaatctcaagaaaacctattagccctgtttccagcaagagggcagagaagcagagagagagagagtgtgagagagaaagcagcttcttcttcttctcctcctcttctcccttatgtggatttcaaatccttctctgctactctctcttcacatttctctaccaacattcttcttctgacactcaacacacacactgcaacttccacagctaaatctagcaacaccaagtcaaaatccgccactaacgatg

SEQ ID NO: 6363 - DNA, 3000 bp, Unknown; identical to SEQ ID NO: 6357
  misc_feature (1)..( 3000): cDNA_ID_1814170_gDNA_ID_1621090_Annot_ID_170667 3000 nt of promoter + ATG

SEQ ID NO: 6364 - DNA, 3000 bp, Unknown; identical to SEQ ID NO: 6356
  misc_feature (1)..( 3000): cDNA_ID_3048244_gDNA_ID_1621090_Annot_ID_170666 3000 nt of promoter + ATG

SEQ ID NO: 6365 - DNA, 3000 bp, Unknown
  misc_feature (1)..( 3000): cDNA_ID_3048256_gDNA_ID_1621090_Annot_ID_170659 3000 nt of promoter + ATG
atttgttcattcgttttctgagattctatatcaaataatagtcagtcatcactagaaaatgctcaaacaactaatatgattcatacacatttcatatcatatgcttggcaatattggaccgaacttcatgatttttctgtccatgaatgcaaatgtgttgtgatctctgagttacatctcaaaatgtgaacttgacatcatattctcgttcaaaaaaggaagataagacaaaacatttaagaaacatttcacaatcatagggggcaaaagatcaaaatttaaaatttcggacgagagtggaaactatcaatctttaaggggatgatttggcaaaagtgttgtttttatttttcttttactgttttcgttttatcatctttcaacgtctttctctcccgacggccaaaaaccccaattttgccaaatccaattttacacccagaaaccctaattttccttactttgatttgattttgtgatggacgattatacaagagagatgatggatctcaagactttggtcactcgaaccctagagaagaaaggtgtcctcgctaagatccgggtaaattccctctacttctctaccatacattattcgcagaaatttttgagtggaaatgagaacagagaagtgattcgtttgaaatacatacattactctttttctagggttcctgctattcagatcgaaatgctcgatattgttaattgcctatgcatctggaatcttgctgatagtttatttgtgtttgtaggctgagctccgtgcaagtgtgtttgaagcaattgaagaagaggatagagtgatagagaacaatgaaggaccgcctccagctctgttgggaagctgtaatgatcgtgcaaggaagcttcatgcttctccttcaggttttttcttcacaagtttttgcttttatccttttaaatctttcctctatgaatggtttggttctaaatggcatctcttggtttgaaatttttgttgaaatgcaggaaggttactatctgcgttgatttgtgaatacttggactgggcacaacttaatcacacgctcatagtttatcaacctgaaagcaatttggtaatcaatataatcccgttttcttttgctatgtttcattaagaagattgttgatgaatttttctcactaatctggtgaactcctgcaaaacctattcaaagccaaaagattcgtggaagtctgagttacgcgactttaatagcaacaatggttttgagctcaatagaaatggagatagtggaccactccttctcgatgttcttgaagggttcttgaagtttgaggtatttctttctttttttcccctgaagatgtttgcagccaagtgtgaaacagaactttactatctataacttcttctcttagtttacaatctttacaaccatactctaaacaaattacaatagtccacctgtagtatgtgtgatttatgagttgtagtgttaacagttcctattatgtaagtgaagatgatcaatactttacacccaagctttacaaacaccaacttacataaaatcttggtactctgtcctcgcaaccaagagaagaagttatagatagtaaaattcagttttccaagaaaaataaagtctcttagtagagattagagttcttcagagatttgaaaaacacgtttagcaaatttcctagcctcaagttctcttcacatctaagaatcatgtttccatcctatcatagttaaaaccattatcatctgtttttgccgtatgctcctcagatgtagtgatcaacttttttttgtaatgaattttttcttcagagcatgacgcagggcatgggtagtagttcaaggagagattcagaaacagagtcgtcatcaagccttgagtccagaaatcctcctcgcagatcatctgcttctgatagcttacctcctcaacgaaggtacacatatcttcaacttcttattattatgccaaatcaaagatcgttactcttcgacatgattgctttatttaccttcaaataaatgggcaggccggtttctgcatctcaagcatcgggtgagtcatcatttccctagtttcttgaagtattggttgaaatacgtatgcttcattattttttgataccaaataaatatgacaagatgttacagatagaagagccgggttgtctacatctgggtacagaaaagatgaattcaactggagacaaggtaaccaagatacacatgaagaggtaacaagagcttcagcggcgctggaaaatctacagcttgataggaaaactcggaacttaacatcgtcttggaggtaagctttcaaggaagtctcattgaatcccacattgaaatgaaaacaaagcaagttgtggtaaatctgatccatcgggcttgcttgtgttgtaggaatgtgagggatggaacaaatgaagaagaagggagagattgatttaggctttggataaacatttcagcttctggattagtagagtaatggtttgtgtacgtgatatatgtatgtttctcctttatttgcaactgcgttttcaattagccttttttttaacgcacgaacctctgtctccttgagaacaaaaaacatgaaacagtaaaatgttttcttttgagatttgttatgggaagagaagagttcagaaagaagaatcaaagaaagcacaatgtggttgaatattttcattcacttgcttcttattttagtgtctccaaaattattatgtctctagtaataaacaaggtttttgaatgatgtgttcactgtttgttttactcgtactttttttttgttttccctttagtcttctctctctctctcgcttcttcgtttaaaactttaaactaaagtatcgaagaagccaactctggatgacgcaaaagcttctctcagaacggcattgtagaattctccggtgaccaaataatccgattgcattagtagggaatctgttattttgatctgatccgtcaaattggcggtaagaacaatg

SEQ ID NO: 6366 - DNA, 3000 bp, Unknown
  misc_feature (1)..( 3000): cDNA_ID_2105807_gDNA_ID_1621090_Annot_ID_170686 3000 nt of promoter + ATG
acaatatgaacgaatgattttagtatttaactttcgtcctcatgtagccatgttgttattttcaaaccataaagaggacttaagagtcgtcagataaaacaatgatattttcgtattcgtcgatgcactaataaccaactcgattggacaacatatcttacttcattcacgattttgatgatttcaccgaacaattttttctttctttctcttttgtcttttaattatgtcattttcttactggatatgttcactggtcgagttgggtcttggcctaacacataagatatatttatgatagacatatcttttttttttatctttttttgagttcaaagtagacttacatatgtcaaaatccgagactcccctaactcatgaaaaaagtgagacgaattcaactactttgccgaatttacctgtcttagaaaatcaatcaaacccttgagttgtttgcttgatcataccttctcttctccttgtcactttcactcaatacaattgacacaaatcatcactcgggaatcaagacccaacacttttgtcttggttgtcaggggctgggttaaatactactaggcccagtatcagcccacgtaatgttcttctttactgttttgtctatgctctagtttttgtttatacattttctttgtattcctcattctcctaacaaccctattgcctgcctattggtatcagaatagaccaccactgcacgagaaaaaacctaaacttgatcgcgaggaaaaaattgtgtaactaaagtggtcgtggagcggtggaggtaaaacattactacatagtactgttacaaaacaatatcttgtaataattaaaataaaagataaagtagtaaaaatattatttttttgtcacatcattacaattttcctaatttatgtttagaccattgctgtttggcatactaaaggtataagaaagacacgccacagagatccagtggtatacaatttttatgctttggaatcaacttatttgctacaatgacaaactaccaaagtttatttaattactttacaaaaagaattatttggataatccaaaatcaaagaggggaaagttggatttacatttccgattaacattttaacgtaaaaaggaaaaatgtgaaacataaagtgggcaactggacattcacggcaacagatcaaaaacccttttttaaatcaactacttagtaaaagaggaataaattaacagattatcacacacactgattgataaattaggagcaaattggttttaacaattcaaaagaaataaacaaagcactaagttagttttggtgctgacgagagtggacggcaaaaaaaacagaagatcactattaagaaagttaaagttaatagtgcaaaatattaatgtagggaaaaaaatgactacaataatgttcaaagttaaaataaaggacattttgttggcaagaagaaaaacattagaaacaaaaacagaacaaggcaaagctgcaaagtcaagttgagtcggtgaaagagaacaacaaccaacctttaccccactgccatcctccctagttttgaacatgtgcactttcttcgttatttaccatcacttttgtgttgtcatattcatcttcttctattcagagaagacatttagccaaaatttatgtaatttccgagattaagaactggttttcctttgtttgtcacttcaaaccagtgatcaacaatgaaaacagtaaatgttacagtggtctataccaagattctaaaagttgaaaagtggaagagggcatgctaatttgaatgaatacccaatatttaagattctagaagctcctttttatctatatatatcaactaaatagtcggcatgaagctctcaaatacttggtccacctatttatagagtacacaacttttttggaaacagctaattggaaaactctgtattatttagggtttggtactagttccttttgttgtgcaactatcaataaataacatataccttctattgataaatccaaatccaaactctaaagtgagtcgctgaaaatgaaagtagtaaaattttgtggcctctcatctcactgtattcatatttcgtttgttgagtgccgactctactatccacctattatgagattcttatgttaaaacttacaaaatatatttacctagattttgtctttgtccatactcttccatgtctcgggatcagaacaaaacaactagtttacgtgcttttttggaaggtcttatagtagtaataccaacagagctacagataatggattaaatacatgtaaccaacaaatgttatattacttttataaaataattataaatcaatgaaaaaaattccttatgaatcgctaaattttcaagaactcaaaaccttattcggttttcataatgagcaatgatgaatacatgttatacgtcgaattattattttggattctcaagccggccctttgctatcttattttctcctttacaacattttttaaccccattgtcaaagagtcggctttgagcccatgattgtaatgaatggatagcttgaatattgcgaccacactaataattcccgtcaaatatttgtttaacttaatgtatgacacatgtattttacgagcaaataaattcaaaaaatttaagcattagcgaaaacattgtttctccgctccacaagacactaaaacataaataatgaattaaatcagtcattctacagaaaattaatcaccgtagtcggttgccatcattccaaaaccttaaaaaaaacccatgtaaaatgatcattaacaacaacaacaacaacaaccaaaccaacaaaaattaaagtaaaaacagagtccaaagcctcgtcacatctgcccataaatacccttcaccgactcaccatcttaccacatcaattctctcatatctctctctcactttcgaatatatcttaagataacagagacacatactcttaagtttggtgaagaataagaagacaatg

SEQ ID NO: 6367 - DNA, 3000 bp, Unknown
  misc_feature (1)..( 3000): cDNA_ID_2175403_gDNA_ID_1621090_Annot_ID_170684 3000 nt of promoter + ATG
gcctcaagatttggttgcatctaagattgctttgtggactacagtaagtttttttttttcacccttcctctgcttattacatgaaagttgggatgattttcactaaatttggtagctagccaggtgaggtcatctaagagtttttttccttgccttttttgcaggttgttaatccatttaccaaatatcctttatcaagaaatattcagagacttttcatttatctctgtaattttgtcataagcttattcataatataaactgaaaattgtgtggccttaatagaaagaaagcacatatgctttgacattatctccagttgcaatgagtcttgaggagttaataccatcaaactatgggaagtcacgtttctacgcaatcgccattagaagtgcattagccatctctactctgctcgttggtcttgcgattcccttcttcggtaaggacaaacgaaaaatatacatgtaaagaaaataagtgtcacttcttttgacactcagaattcttgcaggccttgtcatgtcactgattggatcattcttgacaatgctcattgtaagttacacatttgtttcatccttttctggttatgtaaagcaaattctcatattgcagtttcatagtgaatttgcttagcctgacaaagtttctggacacagacgctgatactaccgccagcttgtttcttgagcatcttaaggaaaaaagtaacccctactcaggtatggcctgctcacttactgataaccaaaccgaatatcgaaattcctcaaactgaaatcgatataacaatctgtggtttgtttgcaggtgacaatctgtatcttaattatgacagtaggagcagtatgttcagtcattggcacatattcagcccttgcaaagatcattgagaagttgaacacctaaaactgatcaatcttgagattcttattttgtttctcttgagattttgtttctgtcttaaatcaatggaacatctcaacctatatggaacattccaaacacataattgtattaaacatcttctgcatttaaatgttaccaaacagtgaactacaagaaacaattataatactggaacataaggtgaagttctgttccataatggttaagtagcaaaagcaaagaagatcactccttattcagtagaaatctttcctccagctaaatcttcaggagttaggttaagagaatccatggatcctttcttgaattcttccccttgagaagcaaggaagtcctccacgcttcctggttctccaaaccaaccacgacggtctgcaatcaaatgtagattatcacaccctccacatcgtaccaccacaacgccgttttcatatgattctcggctcgccatcttcatagatcttgtatcacagaccttgcaagtgaagaccatcatgaagtcatgcctcgggtttatttttaactgggacttgtacttcaccatcatttcctcagagggcgtcgcaggggagggaactttggccgattcagtagcagagtttgacgagttgcagacattggttacagaagcttcatttgcctcacggattacagataactgtctctgaaataatcttccataaacatgacttctgctgaagagtgagtttgatagcgacaactgctctgttgagactattttcaaaaaaaaaaagataatcaagaaagatcaatttaacagtagttgtagttgcacgaagctaaaacagtctgtaccataacaggacatcataggaacctcctaggataatgtttgcatcaaaccgtagactaatgctaacacatcttagtcaggaaatatataaccaaacttgaaaacttaaccagcgtctagctgaaatgccaatgttcacagctactgcttaatgcatagagatatgttgaagacaaagcacttatgtgagcattcataacttcaggtttcgtagaagcacttctctaactccaaaatgtaacagagcaaagacgatattagatgatatacacatgagaatacgagtactcatcatcactaatgccccaaatctctaaaagctacaaaaacaaccctaaaaccaaaatctccccaaaatcctcttctagtgtaaattcaaacataaaaaccacaaatttacatgaatctcaaccaaattcatcaaaagaaacatcaaggcaagtataaattacacagattaagagaccagtttaactctagtgcccgattttcaataactctttaatttttcttaaagatgacaaagttgagaaggagagagatgaaaccttgagacaaaggaaaacgatgttgttggttgctgaaaagagacaaagcgcgtctcaaagcaagtaacctagcggccattgacaacctgagggagaggaggaactcgacgcttctattttccgtgaaattttggaatcggagcacaataaaagaagcctttttaatcattagagttagttttcgttatggtcaagtcaaaatctaaacccaggttcgaaccactgagtgagccacaagtagaccgacctttttcttcttttttttacgtgaggaaaaagaaatttgtgaattgaaatcttatctagaaaagaaaaaagaaaaaaaaaatcagaacaagcaggagaataatgtgtgtgatacaggatattgagtaaggccacgtggacggctgtgattagaagatcaatggacggctgtgattcaaattaagtgtgcgtagagctgaagctaataaatatcaagtgtcatcgtattttcatgttatcgttgaagttgttgttattcctttctctctgaaaacattccgagattcatcctctgcatagaacgtcgattcttgcgaggtgaatccagaaatcccttgttttatgaacattggatttcatttgttatttacatcgtaataataagtaatcggagttgttgatgattgctttggttgattgattgtgttgtggtgtggttttactgtattaaaggtatcagagcaaagacgtttctcggag

SEQ ID NO: 6368 - DNA, 3000 bp, Unknown
  misc_feature (1)..( 3000): cDNA_ID_2106795_gDNA_ID_1621090_Annot_ID_170683 3000 nt of promoter + ATG
agttactccgtttggcaaataatttatgctccctcattacttccaataccagttttaagtgctgcaaatgctccttctttgatttgctatagataaggatatcatcaaaaaacaccaagacaaacttccttagaaacttttgaaacactgaattcatcaacccttgaaaagtagctagtgcattggtcaatccaaagggcatcaccaaatactcgaaatgaccactatgagtcttgaaagcagtcttgggaatatccttctccaccattctcacttgatgataacccgctcttagatcaaacttcgagaagatcactgccccacccaactcatccataagatcttcaataagaggaatagggaaacaattcttcactgtaattccattcacctttcggtagtccacacacaatctccaagagccgtctttcttcttcactaaaaccacaggggaggcaaatgaacttgaactaggctggatgataccgctctctaacatatctttgacaatcttatcaatctcatctttttgatgattagcataacgatatggtcgcatgttcaccggattagtgccctcaatcaaaggaattggatgatcatgatgtgtccgagaaggaggcagccctttaggttcagcaaacacatccttatactcatcaagtaattgagaaatagcagaagtagtacttggtggtgacacctctgttgttaaagaagacaactgcaacacctctccctcatcctcatcagcgtctgcaacacacaacatagacagctgaacttcggagtctctcagtttgttcaatttgtcagccttgatagcacgcaccgacgaaggctgaataccatgtatcatcacccgtttcttatcccatttaaactgcattgtcaacaatgtgaaatcccatgtaataggacctagaggtttcaaccaatgtacacccaaaactgcatcaattcctttcaaaggaattaccataaagtcagctacaaaagtcgtgttatgaatctcccacttaaaattctgtattctcgctatcaccttcagattgtaaccatcagccacccgtactcttgcattatcactaggtaggagtgagcaacccaacttctttgccatttgaggatccataaaattgtgagtggaacccgaatcaaccaacataaaaatggatctcttctgacttgtacccttaactcgcatagtgttgtaagttgagataccctccatagcatgagttgagatatgagctacttccccaactaactccttatgctcttcttctgcatccaagaacacttcctcagcatcttccatttccaaaacaaacaattgtgttttcttgtgaatcttataatgttcagatgtgtattgttcatcacaaaaataacacaatcctttagctctcctagcactcatctcttcagtagataagaaccgccttggctgattttgttgtgtgtctcttggtttttcctgaaacgctggtttattgccctgctgctccatgtctttcttaaaggagaactggccctttgaagtagccttattgttcttccaagaagtcgcattgttctgcacaggatgagcagtttcatagagacgtcccaacatcaaacactgccgcaccgtttggggttgaaacattcggatatgcatctgtgtctcaatccttaacccaaccaaatacgcactcactaaataatcctccgtcatccttactcgagtccggatcgcctcaaactttgcgtgatagtcatcaatgctagcagctgtttcctgcaacttcttcagctcagcaataggatcctctccaaccatctcaaacctctccctgatcctagctttgtacacaccccactcaggaacctgcacttcatcctcaatcatattctggtgccaagtagcagccagaccatccaaatgaatagaaactacagacactcgcatctcttcaggtataggatccaccgcaaaaaattgatcaaccttaaacaaccattccttaaccttctcaccactgaatctgggaaaatccaacttccctaaccttgttactcccgaatgattgttagcgtgaccttgccttctcatgtaatccacgtctgttgctgaagcggatgaagcacgagctgtttgatgagtctcacccagatttgactgcttagatggagacagcatgtggatcgcctcaaacatctccgagatatggcgctcgatcttcagattttgagcatcgatcttgctctcgatcttctccatctgtgactccatcgattcctctgcttctaacgccttctctcgacgagcttgagctaactcctgagctcgagtctcgatcaccatctccgagaaacgtctttgctctgatacctttaatacagtaaaaccacaccacaacacaatcaatcaaccaaagcaatcatcaacaactccgattacttattattacgatgtaaataacaaatgaaatccaatgttcataaaacaagggatttctggattcacctcgcaagaatcgacgttctatgcagaggatgaatctcggaatgttttcagagagaaaggaataacaacaacttcaacgataacatgaaaatacgatgacacttgatatttattagcttcagctctacgcacacttaatttgaatcacagccgtccattgatcttctaatcacagccgtccacgtggccttactcaatatcctgtatcacacacattattctcctgcttgttctgattttttttttcttttttcttttctagataagatttcaattcacaaatttctttttcctcacgtaaaaaaaagaagaaaaaggtcggtctacttgtggctcactcagtggttcgaacctgggtttagattttgacttgaccataacgaaaactaactctaatgattaaaaaggcttcttttattgtgctccgattccaaaatttcacggaaaatagaagcgtcgagttcctcctctccctcaggttgtcaatg

SEQ ID NO: 6369 - DNA, 3000 bp, Unknown
  misc_feature (1)..( 3000): cDNA_ID_3048227_gDNA_ID_1621090_Annot_ID_170680 3000 nt of promoter + ATG
aaataaatctattagttttaaattttacaaaaaatatatcataaaaaataatcaataaattatcattttattctctatatgaaagagcagaaatggtagtacataaaatgtccaaatttcttcccaaataacttattattataataatgaaatgaaacattatatactattattaactattaagttttgaaaagtaaaaattaaataaaaacattatattttttattttgttataatttgtttctttcactagaggtagttatactaagaaacttgtacttataaaagattcacacataaagtagagcttcatatttttagtatacacatgaactcaattttcacatccactttaaaacatgacttcttataagacttagacattcatattttaaatcttttatgttaaaaagaaaagaaaaaagggctttatgttcatcaagaaaatgtacatgtgttattttaagaaactaaatgtcataggagaggtttctcacctcttgactcggagacggaagtttgaatacggactatgaagaatattttctcaaaaagataaactgtaaaattttcgaaatcgattgtatagagttagtctccatgatgaaatctccagagaattgataacatgttttttccaactttctcgatgaatttgatttttttccgagttaagctttcaaatatttttcgctcttgtaatctctatgccaattagtttgccaaaatttctagatttttaagttataaaatttttgatttaaaatttatttttcctgattggtagcgcaatcaaagaataaatttctatttaatatgtggttaaaaagaaagaaaagaaaacaatttagtgaaaggaaactctatcggagagggaagaaccacgtccacatggtgtgtggatctgtttttctgatcatttggaattttgctatgttagaatggcaatgcatcaaccgcatcaggaaaccacgactcaagaacatgcccacatttactctttatattcgccgcttccagctatatataaattattctcacatgcatgctttcttatttccctatggtattttgaattattttttgaatagatttatcatgtgcttaattgtttgagagtatgaattcacacttgcatgatctatgatggttcatgtttacctgttaatagaagataagaagcttgacacatgcaaaaacaaacaccgatcactaaatttttattattactcatcatgaagtacttctttgtattatagtgtcgttagtataaacctgaggaatgtaagacttaacggattccggttgtacgtagactgaatcgttactatgaaaatttgtcattagtaaaatttgattttaaggtcatgcactttcaatcatttggatgcaaatttgaaatagattttcttatagattttttctcgagcaaaatatctcaaaagcactacgatcaaaagcttgtcagcgagacattgggacacgttggcacatagcaggacaactcactcatctaaccggtaaacggaccaacatcagacatgagattacaatcgttgacgtgtcattattatccacatggtcttctcttattggtatacattgttagatctcagattatgcagttgtagcgccagagagaagatctaattgcatgagggttaacttaacacgtgtcgactgttgcttcgttcaactttagatcagcatttaggatccaagtaggtgtacaattagattctcccaggccaagattcttcttcccatctgtagttctattatccacgtcggattatttttaattttactctattactattaattatatacgtatccaattccaagtgtattagattaagctaaagtatttatccctcacacagacaaattttattgttctgttagcaagtaatattgcactaaaccatctctaagctaatttcaggtcttcatttgttaatgtaatatttttgttgtcaactttaaatgtaaatagttttcttattttcttatgtcatatctttcctatttcatctaaaaaagaatatgttgaaataaattgaatagtggaattatgacttggaaaatcaaaatttggagaaggtttggcgtaatgagaagcacgagcatgatcgaaaaagtgttctatgtgagttgttctatttcaaagctcaccacgcaaggatacacatacgtaacttggtcaatacaatgatcacaagcaaacacacccactcatatataaatagagcatatattcctcacaagaatacaagatattatagagcaaagattgatagctaacttcagtaaatgtcgagctacatttccttcttcatgttactctttttgttccttatttctcctcgaacaaacgttgtctgtgcatcaagacctttattggaatccaataatccgggtcacatgagcacgaatacaatttacataaaaggtagcgaacaaggcgcatttcgcggtggagcgatgaacgattgtcttccaaaggggtttcacttcaactcagctcctagccgctacattaacaatcttcctttagattcaactctttgttctacaacagagaaagctattcctaatccataaaagtaataatcccctaaaatattacccgctaaattaagtatgtgcaaagattgatagctaaatcacctatttgttttttttttgctctatgcttgggttatttcttgaataaaacccatgtatgtattctttaattaattgtgtttgtatacttgtgtataatatttaagcaattttattatagatgaaaaaagtaattttatataaaaatgttgtttagtaaattaatcaacacaaatcagtttttgctaaatatgagaatttttctcttcaccacggttaaaacttaaaactaaaactgtatttattgagataatatatgttaataatatatgttcatacttcatagctttgtggaaattgagaataaccatatgtaaaatattttgagaaatg

SEQ ID NO: 6370 - DNA, 3000 bp, Unknown; identical to SEQ ID NO: 6362
  misc_feature (1)..( 3000): cDNA_ID_1814162_gDNA_ID_1621090_Annot_ID_55488 3000 nt of promoter + ATG

SEQ ID NO: 6371 - DNA, 3000 bp, Unknown; identical to SEQ ID NO: 6361
  misc_feature (1)..( 3000): cDNA_ID_1974108_gDNA_ID_1621090_Annot_ID_55491 3000 nt of promoter + ATG

SEQ ID NO: 6372 - DNA, 3000 bp, Unknown
  misc_feature (1)..( 3000): cDNA_ID_1814148_gDNA_ID_1621090_Annot_ID_55493 3000 nt of promoter + ATG
aaacactcaacataattactagtaaaagtatgatacatgaagtcagtgtcacttcctcagagagtaaaaagtccaccagttgcagtgactgcaaaatctacttaagctacttctagtcaaaactgcagtatccaaaatttgtgacaattacctcgtctattagtccctcataagttaactgggaacacataggagtaaccatgtcaacctgaaacagaaacgtaaaatttgaaactaatagcgccatgtcaagtaaaaggtaaccaccgcctaacaaggtatcagccagtcccaattccagattaagtgggattttaaccactttctatatctcttaacctttatatgcacatttccaaatccatcgtttgtgtcatataaaacataattcagacttcccaatgattacatcacaccaactctttaacattcaatccttgaaggatatctttgtatttaaggattacaaataacaggaaacacacattgtaatcttacctctctatccaatagaatgagtgtatccacttcaggccttcccacctgaaatagaacaaacatcatttagaatagtgaaaaaaggatacaaaaacaagatagcgaaataactggtgattatgacattcaaactattgcaggtattttacatcattcgaattgacaggttcctccacttgcatgcggtttagaatgtctgcaacacgaactgatgctttgccctttgccctcatttttgatataactccaaaagagaactataggaagagttagtaatgagatgatagttgtgatgacgagatgtaaagaataacgaaaatgtttaaacctcaagttcatgtatggcttttgcgatatgccaaagggagctaacatcaccatccacaaggcaatcctatcattaaaaaatcatgaacaagataattaggaaagctgtgattttaaggcctcacggaaaatggcacataaagttacaagaattggactcatgagagttctacacaccttttcagagagctcgagctcaaatgaaataacatcctcatctagtggaaccatatacaagggaaactctttcactgtaaccaggttatgcactttttcttgctcaagaatctgaaaatagcagaatgattttttttatcacccttattcaaaaaagtaataaaacaagcaaacgaaagcaacaatagtattagaggacgcaaataaccacataccttctcacacgcaacagacctacgaggaacaaagtaaacatagtagtctctctgaatcgcttttgcaatatcattctgaatgtgagacgctatgaatttcataaagctaagttgagagcgaacaagataaaccacttttgtgcattcagtctgaactggttccgcagtaagatgtcgtaactccaaaccaagttcctgttaagcaaagaacaacaaaaaatcaaatcaccactaatgttaaaaccaaactcaacctttaaaagaaaaacgaaattaccttaagcttagaggtcgggatgatcaatgagactgaaccactgagctttggatcaataaccaaacacttagttccacgaacctacaaccaaagacaccaaaaagaagagaaaacaaaaaagtcttgagaaatcggtaaatcatctccgaagtctattcatcctaatgattctcaatcatacgacattggtgaagtaattgcatagaaaagagaagaattcatagtaaaagagagacaaagcattggtttttattttcacattctcaaaagagatatgtttgatcaaatataatccgcgaaatttcctaactttcgtctcccaacccaaaaaaaaaaaaaaagatagagtaatgagacttacgtctttaagcaagtttacgagctccctctcagacttgtccctgaataagaaacgagaaacatatgatgtgagaggaaagaagaagaaacgatcaatcaatctctaagtaatgaaaatagagtcacctaatggatttcagattgagaggagcattctccaagctggggatctgcgccatggacgatgatcaagagatgatcgacctttctccgtttgtttttcctgcaccgtgtgatagcgacgatagtccaccgcagtggaagaacacggcggagaagattattaaatcacctaatgggcctcattctgtataaatgggcttagaaatgggcctcatttttaaacattgttttcatatgaaaaaaaattgcaacgatataaagtcagatttttttttttgggttgcattaaagaaatcaagagtgtatgtaccaacatgatagcaagaaaacgatacgaacatatgtgtcgctggtacaaatatggagtttatgcaagttgaagccgaccagaccacgattatcaaaatctcttacactattttaatgattttaatgattcttaggctgtgaatggtgaccaaaaccgcacccaaaaccgcaccgcaacagtgctgtaatagtatcaaaatctctactcatacatatgtatctatgtatttttgttactattttaaccgcaccgcacttctctcgtaccataaaacacaatcaccattcggagccttattctgtcatcaggggacaaatcactatgtttagagatgttgataccgtagatgagcccatatattaataggggatccactttactagattttgtatcgttgttatcgatatggtccatacacattttggacccgctaaacgtttatactttcacttgtaatgttcttaaaatttattcttgtccgctaaccgctaatatcgaaaccgaccttaaccaaaccaaaccaaatggagaaaccaaaccgaataaaatccacgaacgcgggaaccattttcatcacagtcgtgcctccctcttctcttcttcttctacttctttgaaacattctcttagctctctctatctttgttgtctcatactctctttctcttctcttctcggtgccctttcgtgcttcgtgaagactccagctaatg

SEQ ID NO: 6373 - DNA, 3000 bp, Unknown; identical to SEQ ID NO: 6359
  misc_feature (1)..( 3000): cDNA_ID_1814144_gDNA_ID_1621090_Annot_ID_55494 3000 nt of promoter + ATG

SEQ ID NO: 6374 - DNA, 3000 bp, Unknown; identical to SEQ ID NO: 6358
  misc_feature (1)..( 3000): cDNA_ID_1814140_gDNA_ID_1621090_Annot_ID_55495 3000 nt of promoter + ATG

SEQ ID NO: 6375 - DNA, 3000 bp, Unknown
  misc_feature (1)..( 3000): cDNA_ID_1814134_gDNA_ID_1621090_Annot_ID_55497 3000 nt of promoter + ATG
aacccaagcatagagcaaaaaaaaaacaaataggtgatttagctatcaatctttgcacatacttaatttagcgggtaatattttaggggattattacttttatggattaggaatagctttctctgttgtagaacaaagagttgaatctaaaggaagattgttaatgtagcggctaggagctgagttgaagtgaaacccctttggaagacaatcgttcatcgctccaccgcgaaatgcgccttgttcgctaccttttatgtaaattgtattcgtgctcatgtgacccggattattggattccaataaaggtcttgatgcacagacaacgtttgttcgaggagaaataaggaacaaaaagagtaacatgaagaaggaaatgtagctcgacatttactgaagttagctatcaatctttgctctataatatcttgtattcttgtgaggaatatatgctctatttatatatgagtgggtgtgtttgcttgtgatcattgtattgaccaagttacgtatgtgtatccttgcgtggtgagctttgaaatagaacaactcacatagaacactttttcgatcatgctcgtgcttctcattacgccaaaccttctccaaattttgattttccaagtcataattccactattcaatttatttcaacatattcttttttagatgaaataggaaagatatgacataagaaaataagaaaactatttacatttaaagttgacaacaaaaatattacattaacaaatgaagacctgaaattagcttagagatggtttagtgcaatattacttgctaacagaacaataaaatttgtctgtgtgagggataaatactttagcttaatctaatacacttggaattggatacgtatataattaatagtaatagagtaaaattaaaaataatccgacgtggataatagaactacagatgggaagaagaatcttggcctgggagaatctaattgtacacctacttggatcctaaatgctgatctaaagttgaacgaagcaacagtcgacacgtgttaagttaaccctcatgcaattagatcttctctctggcgctacaactgcataatctgagatctaacaatgtataccaataagagaagaccatgtggataataatgacacgtcaacgattgtaatctcatgtctgatgttggtccgtttaccggttagatgagtgagttgtcctgctatgtgccaacgtgtcccaatgtctcgctgacaagcttttgatcgtagtgcttttgagatattttgctcgagaaaaaatctataagaaaatctatttcaaatttgcatccaaatgattgaaagtgcatgaccttaaaatcaaattttactaatgacaaattttcatagtaacgattcagtctacgtacaaccggaatccgttaagtcttacattcctcaggtttatactaacgacactataatacaaagaagtacttcatgatgagtaataataaaaatttagtgatcggtgtttgtttttgcatgtgtcaagcttcttatcttctattaacaggtaaacatgaaccatcatagatcatgcaagtgtgaattcatactctcaaacaattaagcacatgataaatctattcaaaaaataattcaaaataccatagggaaataagaaagcatgcatgtgagaataatttatatatagctggaagcggcgaatataaagagtaaatgtgggcatgttcttgagtcgtggtttcctgatgcggttgatgcattgccattctaacatagcaaaattccaaatgatcagaaaaacagatccacacaccatgtggacgtggttcttccctctccgatagagtttcctttcactaaattgttttcttttctttctttttaaccacatattaaatagaaatttattctttgattgcgctaccaatcaggaaaaataaattttaaatcaaaaattttataacttaaaaatctagaaattttggcaaactaattggcatagagattacaagagcgaaaaatatttgaaagcttaactcggaaaaaaatcaaattcatcgagaaagttggaaaaaacatgttatcaattctctggagatttcatcatggagactaactctatacaatcgatttcgaaaattttacagtttatctttttgagaaaatattcttcatagtccgtattcaaacttccgtctccgagtcaagaggtgagaaacctctcctatgacatttagtttcttaaaataacacatgtacattttcttgatgaacataaagcccttttttcttttctttttaacataaaagatttaaaatatgaatgtctaagtcttataagaagtcatgttttaaagtggatgtgaaaattgagttcatgtgtatactaaaaatatgaagctctactttatgtgtgaatcttttataagtacaagtttcttagtataactacctctagtgaaagaaacaaattataacaaaataaaaaatataatgtttttatttaatttttacttttcaaaacttaatagttaataatagtatataatgtttcatttcattattataataataagttatttgggaagaaatttggacattttatgtactaccatttctgctctttcatatagagaataaaatgataatttattgattattttttatgatatattttttgtaaaatttaaaactaatagatttattttaatacatatcaaaatctccattatttctcatattttcaattagtttataaaaggataatgaatcgattcattgtactatagttacaaacttgacctaaccatggttaactctggtatatatgaatgactcacgttttaacggctctttactcatctagttgtcctctgttttgccctttcactcccctagactcctactttctctgatacaattttttgtttgtttcttgtgtaatttaaagattctctataaccttaatagcattcataaaccggattggatccattgtgagaga

SEQ ID NO: 6376 - DNA, 3000 bp, Unknown; identical to SEQ ID NO: 6366
  misc_feature (1)..( 3000): cDNA_ID_2105807_gDNA_ID_1621090_Annot_ID_55498 3000 nt of promoter + ATG

SEQ ID NO: 6377 - DNA, 3000 bp, Unknown
  misc_feature (1)..( 3000): cDNA_ID_1814266_gDNA_ID_1621091_Annot_ID_55502 3000 nt of promoter + ATG
aagcattaatggactattggtagatctatcgctaatatcaggttattggaacagtaacagctttgatttaacgtttgttatgagcttcagttctggtggttgctcttaatgaaagcaaagatttggacatttaccccaagaatatgtcggtgatcaggatgatgagaaatgcctttcccgtgtctgaaatgttgtttatgattttatatcctgtaaatttcaacaaggctacctgaaaaaagttcatgaagtaacccaaaaaggtacatgttaacaacatagcagcttgaaaggaaacttagaatgccattttaggtgggcttaatcacggttggaaacggaaacttactctaccctgattggcgtacaaaagaacaaacaaggagatcccaaacaccatatcagaccatatgttggcaaatgctttccggttctctagtctccactcatcacgcagttccaaactgttgaagaaaccaatgggaggaacacaaaaagaaacacagtgaggctatcaaaagaaactatctggtacacgatcaagatgggtttacgacctttgacatcaaaagaaactaaaaatgtggagtcgagtcttacgctttaccccgcatctcccaccataaatcatcgtcagaaagcggcggagatttgccaatctcaacttcaagacggtacctagctttttctctattaagttccttaaccatttctagcttctgatttcgtctcacatcaagcgtctgggcagcaagtggtacagtcttcacatatctttaagtaaaggcacagactaaataatcaaactggggactaacacaacgtaaatagagacataacctggggaattaacagcaaaaatgaagaaaatcacctgtctaagaagggcataagtagataatcatgagccaaaaagtctaatgcccatggaatgagaattaagaccgccaaaaactttgcctgtaaagagttacaacgtcaatgagcattgatcaatcatctggaagaacattacaatcactaacaaatgaactaagaatcacacatatcatcaattaaggaacaagatcaacagagagagctatgtagcataactcaccgattttgaagaagcgtaacgaaaaatacggtcttcgtaaagaatatcttcctcttctgcacctaaaaccatatccctcaccattttaaccaaccctccatctggaattgtcaattcatcaagctctaaattgtcgtcactaccagcagagtctcgggtccaagactcaacaaaactatcatctgaatccacaatccaatcctcccatttcttggtcacatcagcaacaacaccactatccccaatctcctcctgaccttcccgtagctcgacaatcgcctctgctcgtctcttccaagtctcgaatttctcttcatcagacatctcatcatcctttgcaagctcagtagtctcatcaacaatgtcgtcgtctctcaaaccaagccaattcccatcatcatcaaagaaaaacctctgccaccagcttcttctcctcttattattattacccgtatgactgttattcttctccgcactgggaacaaatctccaaagcttcttccttctcttaccccacaacgaaatcgaatcacaaggcttataacgaagaagagaagatgatgatgattcaggatctgggttttgactactgaatgataagcagtggcataagaccattgacgagctcatcaaggacatgaatcaaacccaacattgttcggactttaatctcaaagcaacaacacagattcttctacaaaacccagacaaaccagcatatctttctttgtaaattcaacaactttacaaagccctatacccggaatccggtgaagataagaattagggttcttcagctcagaaagttaccgagagagagaaccagaagctgaccccagttgtggatagtggataccagatgatagataaagccacgctcttttttttgttttgttatcttcttcttcaaattaagcttgtaaaatatctgttatccataaagattgcttttttggtttcaaataattaattacatttacatattattttgtagagtcaaaattgttgtttccgtcgtttttgattggctaaaaattgaatgactgtatatttacagaaataaattttaagtaaattccactttcttctttagtacagagttatggagttgctgaatggagtagaaactctagtttcgggaattcatcatcaccatcgtactaacgcgaagagaaacagattagttagatctgtcaagatcttaaactccgggaatcatgaaatccccagaaagtaaagtttccttttttgtgctctctattttctgtttgaggcattttaacgaacaccttccgtgcaatcactatcaattttgcaggtgcctgtgttttgatctttacgacaaattggttccatacaagaaagcttggtcatggcagaagagcattgtcgaggagaaaaagacattgattgatagaaaccaagactgcgctgatacagtgattttgttacaacactctcctgtttacacaatgggaactgctagtacagaggattatctcaatttcgatataaaggatgctcctttcaatgtttatcgaactgaacgtggtggcgaagtcacttaccatggccctggtcaggtaataatgtcaacaatgcattggaagtttctgtgtgttttctaatgagctcttcaagctgattataggaatgtttgaaaatgtagctagttatgtatcctataatcaatcttcgaaatcacgagatggatcttcattggtacctcaggatgcttgaagagattgtcatccgtgtgctttcctcaactttctccattaaagcttctcgtcttgacggtttaactggagtttgggttggtatgtctcatatttcaaatggatgattttgtaagtgatctaatatatattccgagattgatttctttttgtttgcaaatg

SEQ ID NO: 6378 - DNA, 3000 bp, Unknown
  misc_feature (1)..( 3000): cDNA_ID_3048294_gDNA_ID_1621091_Annot_ID_170723 3000 nt of promoter + ATG
aacgccatggtcctccaagctcaatgctcgtagctgcagccgctccaacatcaatgagaaccaggacagacgatcaggtgaacattccgacttcaagccagtgctcggtggggcgagaaagtgagaagcagagtaaagaagcattggacgttggtggagagaaagtgatggaatcagctaggactttgttgagcattggattcgaaatcaagcaatgctgattatatgtagtttatgagttttatagagttcatcgactcaattttcgcctccttgttcttgttatataataataataaaaaaccccatgaagattaccaactaaatacgttaacattcgtctgtgtaatgatggtatatgtttattgtgatattaaatcgctaattttagtgaatagcctctggttcgtctagagggtcttctgaaacttgaaagggactaaaagacgagaacaaaaaccctttctctctactctgtgtaaaccctagtgtgttcgtgctctccgatggcgagtcttcgatgctttcgtgagctgagccgccgcgctacgactgttttctccatcaaccagacgcgatcgatctcttcatttcatgggattgagttttccgggaccagcatttctcatgggaccgtaattccgaatcgatctctcactaggaatttgccatggtacagtcattggtatcgctctcaagatcgttgtttctcttcgaacacaaaggatactgatgaagatgaagaaagcagtgaaggagaggatgatgatgaggaggagggggaagactttgaggattcggcggatatggaagtagaaagggaatattcaccggcggagaaagtggaagaggcggaggagatagggtacaaggtgatgggtcctcttaaaccttcggagagacttttcaaaccctatgaaccagtgtttgccattgttcaggtctcgtctctgtgctatctcaattaatcctttagtttcatttctcactctcactgatgctgagtggttatttttatcctgtagattggttcgcatcagtttaaagttagcaatggggactccattttcaccgagaagttgaaattctgtgacatcaatgataaggtatgctagcttcaagctcttcttcgttaatctttgctattcttctctcaaagggctagactttaccgtatctctcgtaagaaggacgaacctttgcatttgtgtttatgatttatgattgttgctaaaacctttctctttatgtccctttgcagttggaactaaccaaggttcttctattgggctcggcaagccagacgattattggtaggcctattttgccagatgcgacagttcatgctgtagttgaagagcatgtaagtgtctcattgacttgcttggtgttttataatactagtgaagctgtgcttaagaataatttacaattgaaaagaggatagatgagagtttgcttgctgaatccggtgactgagagaaactaaatcaaactgtctgctgattagtttgtgaaagtcttgcaagtcattagattagtgttcatctatctctacatcatctgaatgtcttgatttaagatgggcttggaatgtagaaggatctactcatgtaccagcattactcaactagtttttccttgatgcgtgacaggctttggatgaaaaagtgctcattttcaaaaagaaacgaagaaagaattataggagaacgagaggacatcgacaggtatactttataactccttgtttagatagacagtgtgtttatttcatctttgccttcttctagttctttccactgtgttatgattgttgtttttgaccattcaacacttgtgtccaggaattgacgaagttgagaataaccgatatacaaggaattgaaaaaccagaaccgaagatcgtccataagccttcgaaagaagctgttacagaacagacgaaggctgagctagttgcttagagataaaatttgcttctttcttttttgctgatgccgatacatttgaagtaagttaaattatcacttgctgttcactaagaactagattttaaagtcgttgaaatgatgaaaaggccttcttggtagttagtggtaagtaactaggctcctgagatatgaaatgtgatttgcctttcactgtcttgttctccttgctcttcattttgtatttaaactggctcatgcttgtgggagctgtttgttgcttctgtttcagaaataaagatttgcggaaacatctctctccttatcttctctatgctttgtactttgtactgtactactgtggtttggttatggtttaatttacttcttcatgcaagtctcggtcacagatatgaaactggtggtaaattggtaataactgcaagtcacattacactcaaaatctcgattttttccactatgactctttagatcaggtgattattattgtaactatatatggcaaccacttcctcatcaacaaatgattcacagaattgatagtacttggaactgatttataatttcttttatcaacatcggaaaatcgtgtaagaatgccttgaaatatttgaatgtttgtaaatagtatcaaaaccattgtttgtataaatatgtataaagaacttaaacaaaagcaatttggagccaaagagaattataaagctacacgagtacgtaagtccatggttaagatcgggtcgggtggggacgggttggataaaagcaaacaatgagtcaagtaaaagaagaatcatcgtcaacaagagagagagagagataagcacaaacgcggcttttcttctccttataaataagagaagctcagtgcgttactcaaatggccgtcactttggtaacgtccttcgcttcttcgtcttctcgcttccatttccgctcattctcctcttctccgtcgtctctctcctcttgtttcgtccgattccagttcccctctcgccttagactcgcttttgccgtcacgcctctctactcttcttctagagcc

SEQ ID NO: 6379 - DNA, 3000 bp, Unknown
  misc_feature (1)..( 3000): cDNA_ID_2105518_gDNA_ID_1621091_Annot_ID_170722 3000 nt of promoter + ATG
gccattagaagccctgaagaaaatgaagaatacaaacaatttcgttttttccattgaaatattttgctattttcgtgctgagtcttatcatacattaaagtacgtatatgtttttcctctttcagtcactattttggaagaacgcaaaacaaactccacttttcttgcagttgtttcctctataaagtaagtaatttaccactgtactaatcttttcggggtcagtcatgatctaaactagatggatcaacacaacaaaaaattacctttgatatatcaaaattcgtagaacattgaccatattcattatgctatttatcaccacatcacatgataataaacaaacaaacatcctagatagtcttaagataaattttacatagtaaactaaacggaacacgtcaatgatttgacgtgacgcaggggtgattaacggagaaataaacggagttggtttaactatctacagtcaaacaaagactgaaagacattaatgccccttctttctctttcttttttggtatctttttttctttcttcttttgcttttaaagcagagaaggcataataaaggaccaaaacgcagcgttttcttccggagatcagtcggtcggaaagcggctacctttttgtctgcctagagaatttgttcgtttctttcttttactctcttcagacaaaacccacgagatacagaaaaagaggacaagagagaatcgtccatggaagaagacactggtatcgacgaagctaagacatacacggtggagaagagcgagaaagtggagccggagaaggacggactgagtcaattcagagacgaggaaaaatcacttggtgcggatatggaagatttacatgatgagactgtgcgagaaaccctaggcaaggatcaggttcaaggtaacggtttattctgcgcaaaattctttattggtttttatttatttattcgagactttattttttgacgaaatgatgtttgagtttaccaggtgttcgagaaaattcctctgtggaaccaaatgttgaagatgtattagaagtgaatgtgagtttgcttcagactcttctgctattcataaactttcttaacacttacaactttgattctctcattaacattgattgtgctagaacttgtaaagtttaactcatttcagtgtcttcgatgttactcgttcagtgattatacaataacatgggaataggattaatcgtaatggttttaacctttggccaagttcaatctgtatctgtatcagtttgatctgttacattttagtgtgtctgatttcttaggcaattctgaggacaagaatcactgttatcaaggcatgacatttaactgctttttgtatcacattggcaggagactgatagcgtcaaggaaactgttgtaagtgcgattgtgccggttgatgaagtggaagagaatcgtcaggtagaaacatctccttctctggctgcatcgtcagactcattgacagtgacgccatgtctatctttggatcctgcaactgcttcaaccgcacaagatttaccactggtttcagttccaactaaacaagagcaaagatcagattcgccggtggttaacagattgtcggttactcctgttcctaggacaccggctcgtgatggttataattggagaaaatatggacagaagcaggttaagagtcccaagggctcacggagttactacaggtgtacatacactgaatgttgtgctaaaaaaattgaatgctccaatgattcaggcaatgtggtagagattgttaacaaaggtttacatactcatgaacctccccggaagactagcttctccccgagagagattagagttacaacagctatccggcctgtttcagaggatgatacagtagtagaagagctatcaattgttcctagcggttcagatccgtctgcttctactaaagaatacatctgtgagtcgcaaacactcgttgaccggaaaagacactgtgagaacgaagctgtggaggaaccagagccaaaacgaaggcaagtttgtagaattttgcatttcggtgcttactcttcactttgaaagatgaaattaatagactttcttctctctatttttcagactgaaaaaagataactcacagagttcagattctgtctccaaacctggaaagaaaaacaaattcgtagtacacgcagctggtgatgttggtatctgtggtgatggatacaggtggcgtaaatacgggcagaaaatggtgaaaggaaatcctcatccaaggtctagaaaactaaacgcatgacccatctctttatccacatatgacatcttctaatacgcatggtgattgatttgttctgtttcaaacattcaggaactactaccgatgcacttcagcgggatgtccagttcgtaaacacattgagacagcagtcgagaacacaaaagcagtaataatcacatacaaaggagtacacaaccacgacatgccggtgcctaagaaacgccatggtcctccaagctcaatgctcgtagctgcagccgctccaacatcaatgagaaccaggacagacgatcaggtgaacattccgacttcaagccagtgctcggtggggcgagaaagtgagaagcagagtaaagaagcattggacgttggtggagagaaagtgatggaatcagctaggactttgttgagcattggattcgaaatcaagcaatgctgattatatgtagtttatgagttttatagagttcatcgactcaattttcgcctccttgttcttgttatataataataataaaaaaccccatgaagattaccaactaaatacgttaacattcgtctgtgtaatgatggtatatgtttattgtgatattaaatcgctaattttagtgaatagcctctggttcgtctagagggtcttctgaaacttgaaagggactaaaagacgagaacaaaaaccctttctctctactctgtgtaaaccctagtgtgttcgtgctctccg

SEQ ID NO: 6380 - DNA, 3000 bp, Unknown
  misc_feature (1)..( 3000): cDNA_ID_2134056_gDNA_ID_1621091_Annot_ID_170721 3000 nt of promoter + ATG
gctaaagcaaaattcttgggacttctttacggaaagtggaaagacaaagtcattcactgtccaacaaaagacactcacatgtccaaaataagggagcgaatcatcaaatctttagaaatctgagactgtggtcacagttcacaccaccatgaaaggagcttaaagctaaaggtcaaaagaggattaattctttacattgagaaagagtcatataaggacaaaacagaacacaacctgaaactggaaacttaaaatcgtattaatatcaatcctaacaaaagtctatgatcatgttctctatgtttatattctcttgactattgctatttctctcatcctatatattttctaacaaccctaaaacattaacaaaagaagcaaaccagaagcaacagaaacagaccagactaagctcaagatatcaaaatgtgaaatcagatgatgggaggaggaagagtctcccacacatcaaacacattctcctcactgtgcaatgcaaacaacctatccccaccaatagagaaatcacaaatggagccgccatagcttcttttcaacctagaagtcaaaacccagtctgatccacaaaacacagagatggaatcattcatagacgagaagagctggccttcatgcaaagcaagtttggggtaacaaggctcatcaggcatcttgcttttcatcaacctgctcctagaactccacctcacactactccctcctccatccatcctcagatcaataaaccctagatcttcaaactcattcaccacacatatcgaattgctctcttccattgctatcgcgtctctcactctcttctcttccgccattgtaagaaatccgatatcagaccaagaccagaccatgttcttctctcggaaatccaacaagctaatataacagttatctttccttggaaacaaagtagctacaagaagacaattcttaccactcaaccattgcaacttatcagcatctcctaaagaccaaccaggactctcgtaaaagaaatctacttgctttccagtactttgatcccaaactccaatcccatactcattacttcttcctttacagctcgtaaagatcttagaatcaggactaaaactcaaagctccagcactataactcttaacctgattatcatgactaacctgaaacttatacctaagctcaccagaagatgagctaaacaatcccattcctccatctcctcttcctaatctctcacaagcagagagtacaatgttaccagaatcaatccaaccaacatcgttcactctctggtaatcaagattaatcgttggatgctcctcaagcatccaatcaaagacatggacgacactcccatgagctatgcagcatccaccatccggaccagctcttatcgccgttccgtctccaggagctatgccggtgacggaacgagataggtggagtctgttaccgtcgaaaggtccccactttgcggttcgtaagtggtctattaagccgtagaacattgcttctttgtgaaggagacgctccgggatattaggcgggatgtttaagtctcctgttcggagaagatcgagaagaacagcgaagcaatctggattcctatcgatgaagagatccccgggttgtgaaagattccaattttcgtcgaataatgctccgaagaaggaatcgcgacctgcgttagcgagcgttgtcgctgtcgtttcgaagattctgccaccaacgttgaatttgatcctgtcatttgataaacccattatttctgatttctgaaaataggtgaaatcaatgatttttatggattcgaaccaaaagcattaatgacaagacaaggaagccatgaacgctcgaactcggattgaaaatattcgaaattcgatcggattcgaagaaattgaatcctgggaaaggataacgaaatgaaatctgatttatgattaatcaaattgaatacgatgatctggactctggatatttttttaaaaaaagctgagattcccagaagagaaaataaaacgatctgtcttggtctcggacatttttccgttgctcgggcatttaaaacgtaagaaacccaactggaacatggtgggacctactagagacaatactcgtgttactaccgtcagatgcttttagatattgtcgtctatcctgcggtcgagatttcgtgtaatttcaaagctaataccgtgatccatgataacgtttctaaagcccatatagatagatatcatcccattaacatatccttttttttgtatgctgaaatggggccattagaagccctgaagaaaatgaagaatacaaacaatttcgttttttccattgaaatattttgctattttcgtgctgagtcttatcatacattaaagtacgtatatgtttttcctctttcagtcactattttggaagaacgcaaaacaaactccacttttcttgcagttgtttcctctataaagtaagtaatttaccactgtactaatcttttcggggtcagtcatgatctaaactagatggatcaacacaacaaaaaattacctttgatatatcaaaattcgtagaacattgaccatattcattatgctatttatcaccacatcacatgataataaacaaacaaacatcctagatagtcttaagataaattttacatagtaaactaaacggaacacgtcaatgatttgacgtgacgcaggggtgattaacggagaaataaacggagttggtttaactatctacagtcaaacaaagactgaaagacattaatgccccttctttctctttcttttttggtatctttttttctttcttcttttgcttttaaagcagagaaggcataataaaggaccaaaacgcagcgttttcttccggagatcagtcggtcggaaagcggctacctttttgtctgcctagagaatttgttcgtttctttcttttactctcttcagacaaaacccacgagatacagaaaaagaggacaagagagaatcgtcc

SEQ ID NO: 6381 - DNA, 3000 bp, Unknown
  misc_feature (1)..( 3000): cDNA_ID_1012984_gDNA_ID_1621091_Annot_ID_170718 3000 nt of promoter + ATG
acattatcaacaccaacgtaccatcatcgtgtctgtgctatgattccaatttttgctctcttatgacgaacaaagacgtttcgactgtcactagacaaatgacaaacccgtagaaatttgtatattattaattactttataagtttagtattaaattaattggaaagataatatatatagtcctatagatactaaacaaataatttaaacaaaatatcgttaatgtaaatattataagttagacaaattgattgaaacatgtatttacctaaacgctcatcaaaagcttaaacgaatacgacatgtaactgcgattttgatatatgtctccattctatatggaacctcgatgtttgacctttctattgactactgtacatgttgatataccatggatcacgaatattcaagtaacatttagtcaattcttaatgtgtgcaaactgcaaagcctagcataatatacagataataaatttacgtaagaaaaaaagttaaagaacaatacaatgcatggtcgtctaagtaaaaatttatgttgaaatttctttacttctactcgtcattagttgaagagaaaaccttttttggtgatctaactcacatatgtacattaacctatttaaatccggttaataagatgatagcgaaactttatacaagttgtggatctctagactattatcttcgaaaattatatattttaaatgcatatatcaatgtgtgtttatacctatatgaatcatgcatgtcattcatattcaaagtttggtctcggtgggtttcgttagttatatactgattatggaaagcaagtgccgattcgtggatgaaggagtttcgtcttgtggtgaacgtggcaaagtaaaataaattgaaagtcttatcaagttttggtggacgaataaaattggaaggaaattgattgattgcaatggcaataacatcggtaactagcggacaagagagttcacatggaagctctgtaaacaatcaataatggtgtgtgttggttccaactagtatatcgatcattgattgcgaaaagacatcaaacacagacaatatttaacgaacttaactaataaaagtgaggctgttaaaaattaacttagttcttgcggcatatcaattattcaatatcattttcatgtactgttttggataaattttatatttttagtgtgtgatacttttgattggaaagtgtcacgcaattataagatgtagcacattttttacttaacggtaatcaaattggattggccaaccaagtgattggtcgctttttcaacctaggtctgcaaaaataatcttgattagacgcattttctcattggctactttgtaaattcacatatgtcttcaggatttgaaaaataatagtttcgtatattagagtctccaaatgctccaaagaaaactctagacctaattttagtttggtggactcagcacgaacctagctagactatcaagttaagggtaaaacataatttttaagacatgaacaacttcgtgagtcgtggcaagttatgttccaatcaagttgaatcacatcttatggacttttcgtgcattagtgtaccagggtaatgtgttgtcgcaactctattaatcgtcggatttttttttttcgtagatgtagttgggctcagcccatactgatttaaaagtcccattcttcaaattgcttttgaaggaaaacaagaagaaaaaaacttatcgttaggtatatgccaaggttagtttttgtggcgatcgtaaaagaagtcacctgaatctaaagaagcagacgatgaatgacgaacttggctttacacaattaagaggagcgaaagaaatcgccaagcaaacaaaataatgctattttcacgaacctaactaagaaatgtgaggctattaaaaagtgtttcatatatatgcgatcgacatctactagccgtaaaatgtcggtttcatatcatttatcaagctaatgagtaatgttaagtcctatcaatttggctcacacagttgcggacttttcatgtgaagcttagctaatgctaatttgttgcaatactttttttttgtcgacaagaatttgttgtgtatatagaaggatatacacgtatcactcgtaacgcatgttttcaataaaactcaaaacaaattagtgatctaaaaacacggcaatttgatgacataaactattacacgtcacttgtaacgtatcattctcttcattccgttttttaaaaggatagacatatttatacacgtcaaaaaacataatgttgtatctgaacttgaaactgaacttagtagaaatagaattttcgtataaaaggtcttattgtatttgtgaacaagctaattaatagacatagaaaaaatttagtggagaattgtattagtttataaatatttgtgaacaagctaaataatagacatagactccaattgatatttatcattacaatctaaaactctgaatttttttaaactaatacagttctccacaaaaaaaatactttgattttgagtatgaagatttaccaaaaatttcagtttttgcccaacttgccaacctgaaatttaggtttataaatataaatattagaaaggaccccatgaaattaggtttatatgagaacatattttaggaatattcgagttttggatttatcattttgaaatttataattatctttaacaaaaaattgataattatctaacccttttttttccccaataattcttaaccatttttgttattctgtattaaataaatattgactattaatcattgtttcgacttttctagtatgcaaaattttagtttctgacaaaaaaaaaaagactgaaaaaaacaaaaacccaactttaaaattgtggaagtccaatttgctgaagaaggtgaagaggtgagggctcttcacagccattcaatctcataagacatattgccggagaaactctctcggggggtcgcttcttctgcattttctgcttccca

SEQ ID NO: 6382 - DNA, 3000 bp, Unknown
  misc_feature (1)..( 3000): cDNA_ID_1814242_gDNA_ID_1621091_Annot_ID_170713 3000 nt of promoter + ATG
cagtggactctatgataggtgtagaggaagttttacaaaggaaaggaaaagacatgtgctatataattaaacaaacacgtaccacaaatctcttacgcccctcggaagtgttgagcgactttactgcccgagcatcagctgatgtcgccatgattcagagagccgtgtttcctaaacacatcaatctccaaaacagtcaatttcgattccaaaatccccaaactttacaattaaatccaggctaaaaaaaaaaaaagagaagcttctaagagcaactatgtatatcaatctaattgcttaattgcttaattgctaaagccttggaaattaaacaacaaaagtagagcttacgtttggaaacgaaatcacacagagggttgcgaaagcaaaattgcgtctttaaagagaaaaatcgaaaaggcttgagcttgagaattgagattgagcttgagcttgagaacgcggcggaggaagaaagggtttaagcttcttttttgttctcaaacaaggaggcggttgggtttaacgacccggttaggttttatcctggtttatcgtttaatcgaaccgaatgttcgggttttgacgtatatttctggttttccataaccgagatccataattttagacatttttatttccctttttagcccaatcttaacattcgaaaatcgtaacactggccaacaaaatattgagacgcgcgttaactcatcaacatcttcttctctcaaattaaaatagcatttcgagcacgtccagcactcagcttcatctacaatcacagcaagccaaattaagctttcatgtttctcaagtagagtttttttagtataatttaagagaatgaaattacatttaaggaaataagatatgtttatttatttgtattagactaatagagtaagaaccaagactttaatcagagtttgtcagattcatacaaggttaaataattcaatattttcccaaggcctagttaagcccaccttttgatatttacagattatatttatagttcattataggtgaataagtagaacttgggaaatcagacgtgattgtgtaccaaactaagatcgtaagagccagtttttcaatttgaacaaagccgtaatttttgagggagttcctcaaatttattgggttttgtcaggattgagtctacaatggttgtgcaccatatggtttattttcctgccttcctattgtaaacgtattgttttatataaacaatagaaaaaactactgataatatgaaataaaactaatgtatcagtatactagatgggaccaatagtttatttaacatagtagcatttttgtctttactatctgtttattttttctatatggaatttaaattatcattcgtaacttattttacacccccttagttaattattttggtatacattatgattattaagtaaaaacaaaaataattattgcattctcttgataatactaatacatgagatgatagatctctctttctgttgtgtagtacatcaatgcttaccaacatttgtaattaataaatgggaagtgtattaaagccgatctctacctcttgtgagtttgtgcaaaactcagaatgtcccatgtgcttaatcatgcatattgcataataatgttctttacttatctttgtcaatttaatattaatcttaatcaaatactatcaaacagctgaaaaactgtatacgatggtaaaaaagaatttttaaggtaaatgatgaatttattagaccaaaaaatatttaacaagtataaaaaatacatggtaacatgacatgatgatgatgacgatgttctgttatgttatgttctcgtttgagaggatcctctttcccaaatgttaatcagatcggttaaaacaacaatttcatcgatcggtatcatattaatcagaaaacaaaacaagaataatctataaaaagtgatcttattcttatcgaacacgagtatcgtctaaagggatagcatgtttgtaatcttggggacaaattgtaaacagtaatatatgaagagaacattatcatgaaccgttgatgaatgaatgaatgtacccaaatgaatagagtataattgtatgcatttatactgcatgtctaaatattatatgtctaaaatagttgtcacaagaaaaagtgttggctctggtgttatcttgtagactattgcatttttggactagcaaatatttatctcgtggtacgtagttgccgggacaagtttaaaactccgactgattttaataaaaaagatcaacaatagagatttgtattttattttatttttgtagttggcatccttaacataaatccaaagaattttattcagcattcaaataaaccaattttaatgttaccgaatgaaaatcttatacaattatcttaaacatgagttttcaaaaatgattaatagaaaaacctatgttatatatatagaaatttaataatatacggtattagaaccacattctgtcttaaataaaaaaaaaaagataattaaacatacgtaaatcatttgagtgaagttagtacaaccgaattttttttttttttttttttttttagtacaaccgaattttaagttagttttattactttaagcctgtcattcgatcgactatgatatttttagaaatatatgtttcacttactttttgtagttactacaaaattgtgaaaagtatattatcaacaaaggattataaaattgaagaaatcatgacttcagtgatcgaattcttttagtgattaaaaaaatcaagaaattatgaaaataacacgaaataattaatttgcaaggatgataaaaaaaatggtaaatttggtaaacgtatttaacatgtcaaagtcaaacccttcaaatctcaaatattacaatctccatccctcttttaaacaccataaagccttaaacctcaaaagacatttcaacaacattcattttcattctcactccccaccaaaaaaaaaaaaaacagaagcc

SEQ ID NO: 6383 - DNA, 3000 bp, Unknown
  misc_feature (1)..( 3000): cDNA_ID_2134041_gDNA_ID_1621091_Annot_ID_170711 3000 nt of promoter + ATG
ttggtggaggagtgtcgtcgagaacggatgagggccaaggagtggaggagaagatgtggtggaggaaatcatcgtggtcgaatgttgcaggagattgaagatgtggagaaggagatgatgaaggagttagaagagacgaggagttcatggcttctgttttttttttttttggtggggagtgagaatgaaaatgaatgttgttgaaatgtcttttgaggtttaaggctttatggtgtttaaaagagggatggagattgtaatatttgagatttgaagggtttgactttgacatgttaaatacgtttaccaaatttaccattttttttatcatccttgcaaattaattatttcgtgttattttcataatttcttgatttttttaatcactaaaagaattcgatcactgaagtcatgatttcttcaattttataatcctttgttgataatatacttttcacaattttgtagtaactacaaaaagtaagtgaaacatatatttctaaaaatatcatagtcgatcgaatgacaggcttaaagtaataaaactaacttaaaattcggttgtactaaaaaaaaaaaaaaaaaaaaaaaattcggttgtactaacttcactcaaatgatttacgtatgtttaattatctttttttttttatttaagacagaatgtggttctaataccgtatattattaaatttctatatatataacataggtttttctattaatcatttttgaaaactcatgtttaagataattgtataagattttcattcggtaacattaaaattggtttatttgaatgctgaataaaattctttggatttatgttaaggatgccaactacaaaaataaaataaaatacaaatctctattgttgatcttttttattaaaatcagtcggagttttaaacttgtcccggcaactacgtaccacgagataaatatttgctagtccaaaaatgcaatagtctacaagataacaccagagccaacactttttcttgtgacaactattttagacatataatatttagacatgcagtataaatgcatacaattatactctattcatttgggtacattcattcattcatcaacggttcatgataatgttctcttcatatattactgtttacaatttgtccccaagattacaaacatgctatccctttagacgatactcgtgttcgataagaataagatcactttttatagattattcttgttttgttttctgattaatatgataccgatcgatgaaattgttgttttaaccgatctgattaacatttgggaaagaggatcctctcaaacgagaacataacataacagaacatcgtcatcatcatcatgtcatgttaccatgtattttttatacttgttaaatattttttggtctaataaattcatcatttaccttaaaaattcttttttaccatcgtatacagtttttcagctgtttgatagtatttgattaagattaatattaaattgacaaagataagtaaagaacattattatgcaatatgcatgattaagcacatgggacattctgagttttgcacaaactcacaagaggtagagatcggctttaatacacttcccatttattaattacaaatgttggtaagcattgatgtactacacaacagaaagagagatctatcatctcatgtattagtattatcaagagaatgcaataattatttttgtttttacttaataatcataatgtataccaaaataattaactaagggggtgtaaaataagttacgaatgataatttaaattccatatagaaaaaataaacagatagtaaagacaaaaatgctactatgttaaataaactattggtcccatctagtatactgatacattagttttatttcatattatcagtagttttttctattgtttatataaaacaatacgtttacaataggaaggcaggaaaataaaccatatggtgcacaaccattgtagactcaatcctgacaaaacccaataaatttgaggaactccctcaaaaattacggctttgttcaaattgaaaaactggctcttacgatcttagtttggtacacaatcacgtctgatttcccaagttctacttattcacctataatgaactataaatataatctgtaaatatcaaaaggtgggcttaactaggccttgggaaaatattgaattatttaaccttgtatgaatctgacaaactctgattaaagtcttggttcttactctattagtctaatacaaataaataaacatatcttatttccttaaatgtaatttcattctcttaaattatactaaaaaaactctacttgagaaacatgaaagcttaatttggcttgctgtgattgtagatgaagctgagtgctggacgtgctcgaaatgctattttaatttgagagaagaagatgttgatgagttaacgcgcgtctcaatattttgttggccagtgttacgattttcgaatgttaagattgggctaaaaagggaaataaaaatgtctaaaattatggatctcggttatggaaaaccagaaatatacgtcaaaacccgaacattcggttcgattaaacgataaaccaggataaaacctaaccgggtcgttaaacccaaccgcctccttgtttgagaacaaaaaagaagcttaaaccctttcttcctccgccgcgttctcaagctcaagctcaatctcaattctcaagctcaagccttttcgatttttctctttaaagacgcaattttgctttcgcaaccctctgtgtgatttcgtttccaaacgtaagctctacttttgttgtttaatttccaaggctttagcaattaagcaattaagcaattagattgatatacatagttgctcttagaagcttctctttttttttttttagcctggatttaattgtaaagtttggggattttggaatcgaaattgactgttttggagattgatgtgtttaggaaacacggctctctgaatcatg

SEQ ID NO: 6384 - DNA, 3000 bp, Unknown
  misc_feature (1)..( 3000): cDNA_ID_3092701_gDNA_ID_1621091_Annot_ID_170706 3000 nt of promoter + ATG
ctcattccatgggcattagactttttggctcatgattatctacttatgcccttcttagacaggtgattttcttcatttttgctgttaattccccaggttatgtctctatttacgttgtgttagtccccagtttgattatttagtctgtgcctttacttaaagatatgtgaagactgtaccacttgctgcccagacgcttgatgtgagacgaaatcagaagctagaaatggttaaggaacttaatagagaaaaagctaggtaccgtcttgaagttgagattggcaaatctccgccgctttctgacgatgatttatggtgggagatgcggggtaaagcgtaagactcgactccacatttttagtttcttttgatgtcaaaggtcgtaaacccatcttgatcgtgtaccagatagtttcttttgatagcctcactgtgtttctttttgtgttcctcccattggtttcttcaacagtttggaactgcgtgatgagtggagactagagaaccggaaagcatttgccaacatatggtctgatatggtgtttgggatctccttgtttgttcttttgtacgccaatcagggtagagtaagtttccgtttccaaccgtgattaagcccacctaaaatggcattctaagtttcctttcaagctgctatgttgttaacatgtacctttttgggttacttcatgaacttttttcaggtagccttgttgaaatttacaggatataaaatcataaacaacatttcagacacgggaaaggcatttctcatcatcctgatcaccgacatattcttggggtaaatgtccaaatctttgctttcattaagagcaaccaccagaactgaagctcataacaaacgttaaatcaaagctgttactgttccaataacctgatattagcgatagatctaccaatagtccattaatgcttctctttataggtaccattctgaatctggatgggagacattgttagagataataatggaacattatggtcttgaagttgagcaatctactattaccatttttatctgcctagttcccgttattatggacgcttgtgttaagctctgggtatcttcttttctccttttttatgctcttttgatttctatgtctctgctttgtttcgtcttctttgctcattatctcgtctgcatttctcaactgtttttttctgcttcttatgtagctgtttaagttccttccaagactgtctccgcgagtttccaacatattccaggagatgaaacgtcactgagtagtacccaccattgaaaccctccacttgagttctgtgtctctatcacacaaaccattcttcagctttatttacgttcagatagacataagagaaacataggctatttttttggtcactcatcttgatcttaaaatatattttttggttgaatttttggtgaacgattgagagagcactaatctgttggctctctcaccagtacttggtcatgtacacaataaacaaacctacaaaagaagccctttcggatatgggctttgggccttggaatttgggctttgggtgtatgtttacttgtgaaatagtagtaatcttctttacggtaagttacaagtctcgtcactttttacttgtgtcttgggttatcttttttgcttttttatggttgatttgatgattaagatttaagagctcaaacttccacacaaagctctctcatgcctttgttgaatgaagacacttttctctcttttggaccaagctctcaatgtcttaaaagctgaccatgcaaataaatgtacaatgttttgattagcaaagacatttactaggttaccctctctctactagacctctaagcggatcagttagattcctttgtagaaaaagttatctacaatgaaaacgaactgtctgcaaatagtgttattaattgatataattgtaattgcccccatttaacatggcggattttacgggccattgcacagttaaaacctcaaataatcatcattttataagcaaaaccaataaattaaactgaatcatcattagtttaactttacaccatttgctaatagttttggtcaaaatctgaagctgacgaagtccaaagcacacagaatcgtgtcagaaattaaaagcatacttgtccaaacaagacaatgtctccttttttgttattgtacttaaaaaaaaaaggaattggaacaagaaattgcaaagtgaaaacgagaccaaattgaaaaaaacagagcaagtggtattaaagataatttaggtaaataagaaggaggaatgtctgacaagacttcccattaaaagccattccttgcagcctttgaccaaatcttagcccttcgttgtgtaactctcttttcaagacacaagcacaataaatatgaacatcatcacctaaagatgaacacaagtttttaaaaacttaacccaaatattttacttgttacatacaacagaatttcattttgaccaaaacaaaaggattttttttgtattacgccatcagaatttaccaaaccatggacgaggccattcaaatattgtgtgacattaccatttctatttgaaaaaaaatctagactggcttctttcttatttatcatcatagactcatagtcatatatattcaatcctaagaatctaaagattaattatgattctataaaaacccctttaataaaacatcaactctaaaaagaaagaagagaggtgtagaagttgtttttttataaaacagctcatatcttcttctttcccccgacaagttcggttcccttcttctctcctcctccaccttctctccattttcttacctctcaacaagtttacacaaacaaaaaaccaaaaaaaaacaaaaaaaaaaacaattttttaaaattcttttcttagacaaagacagagacagagagaggggaagattttgggtttggtgtttttctccttttcttcattgaaagttgtcttcttttttaatcttctttgattaaa

SEQ ID NO: 6385 - DNA, 3000 bp, Unknown
  misc_feature (1)..( 3000): cDNA_ID_3092693_gDNA_ID_1621091_Annot_ID_170703 3000 nt of promoter + ATG
gtgtcttcattcaacaaaggcatgagagagctttgtgtggaagtttgagctcttaaatcttaatcatcaaatcaaccataaaaaagcaaaaaagataacccaagacacaagtaaaaagtgacgagacttgtaacttaccgtaaagaagattactactatttcacaagtaaacatacacccaaagcccaaattccaaggcccaaagcccatatccgaaagggcttcttttgtaggtttgtttattgtgtacatgaccaagtactggtgagagagccaacagattagtgctctctcaatcgttcaccaaaaattcaaccaaaaaatatattttaagatcaagatgagtgaccaaaaaaatagcctatgtttctcttatgtctatctgaacgtaaataaagctgaagaatggtttgtgtgatagagacacagaactcaagtggagggtttcaatggtgggtactactcagtgacgtttcatctcctggaatatgttggaaactcgcggagacagtcttggaaggaacttaaacagctacataagaagcagaaaaaaacagttgagaaatgcagacgagataatgagcaaagaagacgaaacaaagcagagacatagaaatcaaaagagcataaaaaaggagaaaagaagatacccagagcttaacacaagcgtccataataacgggaactaggcagataaaaatggtaatagtagattgctcaacttcaagaccataatgttccattattatctctaacaatgtctcccatccagattcagaatggtacctataaagagaagcattaatggactattggtagatctatcgctaatatcaggttattggaacagtaacagctttgatttaacgtttgttatgagcttcagttctggtggttgctcttaatgaaagcaaagatttggacatttaccccaagaatatgtcggtgatcaggatgatgagaaatgcctttcccgtgtctgaaatgttgtttatgattttatatcctgtaaatttcaacaaggctacctgaaaaaagttcatgaagtaacccaaaaaggtacatgttaacaacatagcagcttgaaaggaaacttagaatgccattttaggtgggcttaatcacggttggaaacggaaacttactctaccctgattggcgtacaaaagaacaaacaaggagatcccaaacaccatatcagaccatatgttggcaaatgctttccggttctctagtctccactcatcacgcagttccaaactgttgaagaaaccaatgggaggaacacaaaaagaaacacagtgaggctatcaaaagaaactatctggtacacgatcaagatgggtttacgacctttgacatcaaaagaaactaaaaatgtggagtcgagtcttacgctttaccccgcatctcccaccataaatcatcgtcagaaagcggcggagatttgccaatctcaacttcaagacggtacctagctttttctctattaagttccttaaccatttctagcttctgatttcgtctcacatcaagcgtctgggcagcaagtggtacagtcttcacatatctttaagtaaaggcacagactaaataatcaaactggggactaacacaacgtaaatagagacataacctggggaattaacagcaaaaatgaagaaaatcacctgtctaagaagggcataagtagataatcatgagccaaaaagtctaatgcccatggaatgagaattaagaccgccaaaaactttgcctgtaaagagttacaacgtcaatgagcattgatcaatcatctggaagaacattacaatcactaacaaatgaactaagaatcacacatatcatcaattaaggaacaagatcaacagagagagctatgtagcataactcaccgattttgaagaagcgtaacgaaaaatacggtcttcgtaaagaatatcttcctcttctgcacctaaaaccatatccctcaccattttaaccaaccctccatctggaattgtcaattcatcaagctctaaattgtcgtcactaccagcagagtctcgggtccaagactcaacaaaactatcatctgaatccacaatccaatcctcccatttcttggtcacatcagcaacaacaccactatccccaatctcctcctgaccttcccgtagctcgacaatcgcctctgctcgtctcttccaagtctcgaatttctcttcatcagacatctcatcatcctttgcaagctcagtagtctcatcaacaatgtcgtcgtctctcaaaccaagccaattcccatcatcatcaaagaaaaacctctgccaccagcttcttctcctcttattattattacccgtatgactgttattcttctccgcactgggaacaaatctccaaagcttcttccttctcttaccccacaacgaaatcgaatcacaaggcttataacgaagaagagaagatgatgatgattcaggatctgggttttgactactgaatgataagcagtggcataagaccattgacgagctcatcaaggacatgaatcaaacccaacattgttcggactttaatctcaaagcaacaacacagattcttctacaaaacccagacaaaccagcatatctttctttgtaaattcaacaactttacaaagccctatacccggaatccggtgaagataagaattagggttcttcagctcagaaagttaccgagagagagaaccagaagctgaccccagttgtggatagtggataccagatgatagataaagccacgctcttttttttgttttgttatcttcttcttcaaattaagcttgtaaaatatctgttatccataaagattgcttttttggtttcaaataattaattacatttacatattattttgtagagtcaaaattgttgtttccgtcgtttttgattggctaaaaattgaatgactgtatatttacagaaataaattttaagtaaattccactttcttctttagtacagagttatg

SEQ ID NO: 6386 - DNA, 1432 bp, Unknown
  misc_feature (1)..( 1432): cDNA_ID_1808149_gDNA_ID_1621091_Annot_ID_170739 3000 nt of promoter + ATG
ttcggcaaatctgtaatcttctgtatatgccaaatatgtaattcttagacttaggaaaaaatggtcatctcttcaataataatacttctaattaaatggtcctcactaaaacaatgtttacttaataaaacgtataaacaaatagattttgttacatataaaagtataacctaaaatgcatgcagcaaatttctggattgttagcatatagctcagaacaatcggaaacaagatgtgctgccacctgaaacaaacatactaatatatgattattaagttgacatgacctaaggggaatctcgtgagattcgttttttgacaacttagctttggatccagaatcaaacatagcccacacaaatgaaaataggataacatggattccacaaactcttcacactttttatattatatatagtacttgtgattttataatataaaataaactatatcaatgatattagctagatatttaattcgcgttgaatgtggatactacaagagtttgatagattaaattgattcaagcaaatattttagtgggaatttgtaaaacactacatcttcgttatcgacttgggtatgagactaagagacaatatatatatattctattaaaaaaactcactgttacatgcgataaatggatgaataattcttgcttaattaagtttgagtatattactttgtttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaaccatg

SEQ ID NO: 6387 - DNA, 3000 bp, Unknown
  misc_feature (1)..( 3000): cDNA_ID_2134078_gDNA_ID_1621091_Annot_ID_170732 3000 nt of promoter + ATG
gcagccgcgaacagaacacgataagtcttcccccgggtacaccggcttatggcaaacaagacaatcaacctgacaccaaatcccatatagtcattatgtcaataaatctaataacttagtcactaattgacttgaagattcgaatgactttaaaagtaaactagtagtcaaacaatatctaaatgaatatgagatcttacacggacatcactaaagccaaaaaaaggtgatgaattcaattcacagatgcaatatacttcaaacaaacttcataactcaagatattatgtatatcctaaaatccaaatcccatgtagtctatatgtcaataaatctaaaaacttcacaagtcattaatttgacataacaaacaacataccattttcttggcaccaacaagaaaaggaaggaaacatgtcgactctgaaacaccagaagccactcttctcttgacccaatccttcacatgatcatccaagacaaaccctttcttgactctgtcagacggattctgtttccgggtaaaagcagtgactccattagcaattttaatgtccttgacctcttcctccggtggaatcattggtaaatgtttcccattgcattctccggctagattttccggggaattgatagatttggctaattcagggcctgaagccgccggaagaaaagaagggcaacaagtgagagcaacagatgcagacatagacatgtttcccagatctaacatcctaaactcgaaagtacaaaagatggaagagtaagaagaagaagacagttacgttttgtctttgttgggtaggcgaaaagcgaagagacatgaaaaaatatggagggaatttaaggcgggagatttgtcctaaaatattatacaaaaaggtccttgtattttaaatattgttttaattgcccccaaacattttttctgctagttaaatttctttaccaactaaaatcccccacattcatatctaccaataacagtgctacacgcaatgattaatgccggttcccaaaacggaactgaacaaatagctaaaattaatcaaatcatgatttgaaagtatatcgtattgatcagtgttcggtttgttagttataaacaagatatttcgttttcgtttttggatatgtttacatgtcattttaggttcgttatgtcacaacttaaatcaaattatatgctttctaggtatgttttaattaattactctcttttttttatcatacatctttacagactcacgaaaaatgatctatgatttcatctagtgaaagataaatggattaatcagtttgtataacatcttaatttcgtttttttttttcatttcgttagtgtctattgtctaaatttcgataattcagttttcatttgattactatactcaaacaaaatacctagcgtaaattgctttgttagaccatatttagcaacaaaatctaataaagtattgatctttgagtctaggtttccacagttcaccacgcaatactcacctttctttatacactttacaaagataatgagtaatcgttaaataatccaaagaatttactcatccatgtacacatagtttatacttaatcctcttagcaagaaattatggcgtctaagaatcgatttagatgaaaaacggaccaactaagcaaactagaatatatgttcacttcacgacaactttgtatataattatacacaaaacaatatacattcattttgtatgatatacaacaaatcttttgaaaatactacactcttttctttaatgtatttttaggctaatgttgaaatattcttgtatttatattatgaaatttgaattagaccggatcaaaccggatccacgttatcttgattttaaaatgaagaactccaaataaatctagattacaaactgattatcatttgctaaaaagatcctaaaggttatcatttgagattcagcaggcgaacaacaaaaattattactatattcgtacggttccattcgatttttgttcactcatttgttgttactacactttactactcaaaatttgttaccctcgtttagtccgattcgatggttcctcatcgttcattgcggtgaattactatgaaagtacaaattaaaaataatctgaaacattgatgataacaatgtagcaatgtagtcgtaacatgccaacatcgaattctgggccaactatattttgctttggtaagcgaaccattcattcagtttttaattattatatccaattgtttgacgcgttttaaataaatcaataacataatccatgttcataccaattaaatatagatatgtatgtacgtgttgtcttgtcttatgaatcaaccctccttggagaatcttatgccataaagccaataaaaagttacctactctttcaatttacctcgttcgtttaatctgttttgatcaacactccccatattatcaaatcatttaggaaacgtataaatgaaacgaaaatatatgttttagttactcaacaatgttattaagggtcaggcaacaaaaaaatcttgaggggtaaaaacaaagttctcgatttaataattatagactataggtttaaacagagacccacaaattctgcatttctcaccttccaactgtaactttaatatttgtttcaaattgacacggcgggtaaaaataatcaggtgtatcctccctcacactaaggcgaaactaacatactaataaggaagagacacgtgtaaaaaagaccggtcaaagacgctacgtagataaaagtcacgaagcttgctcgtttttaaaattcaaagaggtttcatctccgtataagtaggcgacgaagcataccacgaagatcgaaaaaaaacaaatcagattctcaaatactgaaaataaaaagaagaagagagaaatctacggtggtgggtgattcgccggagttcaatttcgtagctagatttctcctccttttccccccgacgagctgtgcgagagagggaggggaatc

SEQ ID NO: 6388 - DNA, 3000 bp, Unknown
  misc_feature (1)..( 3000): cDNA_ID_2106236_gDNA_ID_1621091_Annot_ID_170731 3000 nt of promoter + ATG
accatttagcactactgctaattgcaatcagcacacaacaaaaatgggatttgttatttgaaagcacttatgttgcatgtctactacttaaattagaataaacaatgtcacagaataaaaaaggaagaatctttacgtgatgcagagtttgatcgctggagaagtaaacatcttttgacattgccattgacggccatggccagcgaattgttgctctgtcattaggacccacaaatcccccaaaaagattgaaatttgtttaattttcctcaaaacaaaaaatgacgattttgacctcgagatttttcttacccggagagaaggctaacaaagccggcgaggccaagctccgtcgtctccattgaactcacaaccatcatccaagtaaatatcgcaaatccacacaaatgcctgccaaatttcaaaaccccgtttacaaattttcaaccaagggaaaaaaaaatcagaagaaaacgaaaacatacgtccagatgttgagagtctcattgtgccatgagaaagcgctgaggaaagtttctttgattgaccactcacatcgataatgattgtgtatgaactcgttatctttcaaatacctaggtaactcctcgaacttcatcaatctcttctcagatctcttcttttcgccggaatccatacctttaccatttcttatcttcgtagattccttcaccgttctccgtttctgcatgattcccctccctctctcgcacagctcgtcggggggaaaaggaggagaaatctagctacgaaattgaactccggcgaatcacccaccaccgtagatttctctcttcttctttttattttcagtatttgagaatctgatttgttttttttcgatcttcgtggtatgcttcgtcgcctacttatacggagatgaaacctctttgaattttaaaaacgagcaagcttcgtgacttttatctacgtagcgtctttgaccggtcttttttacacgtgtctcttccttattagtatgttagtttcgccttagtgtgagggaggatacacctgattatttttacccgccgtgtcaatttgaaacaaatattaaagttacagttggaaggtgagaaatgcagaatttgtgggtctctgtttaaacctatagtctataattattaaatcgagaactttgtttttacccctcaagatttttttgttgcctgacccttaataacattgttgagtaactaaaacatatattttcgtttcatttatacgtttcctaaatgatttgataatatggggagtgttgatcaaaacagattaaacgaacgaggtaaattgaaagagtaggtaactttttattggctttatggcataagattctccaaggagggttgattcataagacaagacaacacgtacatacatatctatatttaattggtatgaacatggattatgttattgatttatttaaaacgcgtcaaacaattggatataataattaaaaactgaatgaatggttcgcttaccaaagcaaaatatagttggcccagaattcgatgttggcatgttacgactacattgctacattgttatcatcaatgtttcagattatttttaatttgtactttcatagtaattcaccgcaatgaacgatgaggaaccatcgaatcggactaaacgagggtaacaaattttgagtagtaaagtgtagtaacaacaaatgagtgaacaaaaatcgaatggaaccgtacgaatatagtaataatttttgttgttcgcctgctgaatctcaaatgataacctttaggatctttttagcaaatgataatcagtttgtaatctagatttatttggagttcttcattttaaaatcaagataacgtggatccggtttgatccggtctaattcaaatttcataatataaatacaagaatatttcaacattagcctaaaaatacattaaagaaaagagtgtagtattttcaaaagatttgttgtatatcatacaaaatgaatgtatattgttttgtgtataattatatacaaagttgtcgtgaagtgaacatatattctagtttgcttagttggtccgtttttcatctaaatcgattcttagacgccataatttcttgctaagaggattaagtataaactatgtgtacatggatgagtaaattctttggattatttaacgattactcattatctttgtaaagtgtataaagaaaggtgagtattgcgtggtgaactgtggaaacctagactcaaagatcaatactttattagattttgttgctaaatatggtctaacaaagcaatttacgctaggtattttgtttgagtatagtaatcaaatgaaaactgaattatcgaaatttagacaatagacactaacgaaatgaaaaaaaaaaacgaaattaagatgttatacaaactgattaatccatttatctttcactagatgaaatcatagatcatttttcgtgagtctgtaaagatgtatgataaaaaaaagagagtaattaattaaaacatacctagaaagcatataatttgatttaagttgtgacataacgaacctaaaatgacatgtaaacatatccaaaaacgaaaacgaaatatcttgtttataactaacaaaccgaacactgatcaatacgatatactttcaaatcatgatttgattaattttagctatttgttcagttccgttttgggaaccggcattaatcattgcgtgtagcactgttattggtagatatgaatgtgggggattttagttggtaaagaaatttaactagcagaaaaaatgtttgggggcaattaaaacaatatttaaaatacaaggacctttttgtataatattttaggacaaatctcccgccttaaattccctccatattttttcatgtctcttcgcttttcgcctacccaacaaagacaaaacgtaactgtcttcttcttcttactcttccatcttttgtactttcgagtttaggatgttagatctgggaaacatg

SEQ ID NO: 6389 - DNA, 3000 bp, Unknown
  misc_feature (1)..( 3000): cDNA_ID_2134074_gDNA_ID_1621091_Annot_ID_170730 3000 nt of promoter + ATG
atagaatggagtatgcaggagtgctttgtctgcaagcaaagaacacaatggcggtgtgttaagtgtccaatggctgctcatgataaacattctccatggtcaaaagaaatacttcacttaaaagaccaaccaggaagagcagtttgttggaggcatccaactgattggcggctagacacaaaggttgattttttagtttaccgctttcataagatacttcttgaagcttcttacgatttgtactttcatagagttttactcacaggactgacaaaatctctgttgattgagcagcatgcagttgcacagagtgagattgaggtcagtgtttctttgccacgtgccaaatgtgactgtagtaaaggaaactaattcttacatagacttgccgctcgaaaatcaaaaagagggaagagatttgaaagctggatattttgtttttatcttacacaatttcaagagctaggcactgaatgtttatctactttcttattcaggaagtcttttgccagttgcctttgccatatgtggaagaggagtttaagattgacttagcatggaaagattctgttgtgaaggaagatccgccttcttatgtgcacattagacgcagtatcctttatagtttccacattcaatatttctgccttaaaagtacataattctcattttttcacaacattagtgtgtcttttccttgactgagttaagatatttacctcgttaagaaaaagcgtgataatgctaatgatggtgttgggtgcacaaattgtggccctaattgcgatagaagctgtgtttgcaggtatatttgttaattaaccaaacaaattttctctgttaacattcatttcgttttgaatagtttccgttttgaaaaatttctctcagggttcaatgcataagctgttcaaagggatgcagctgtcctgaaagttgtggaaacagaccattccgcaaagagaaaaagatcaaaattgttaaggtaaaactagtctctagtttatgattcttgcattacactcttcttgtgtttttttatcttgacatgtcatgttattggttttacagactgaacattgcggttggggagttgaggcagcagaatcaatcaacaaagaggacttcattgtcgaatacattggtgaaggtaaactatcttgatttggtctttgagccttatgtttgtggtggaaagcgacagagtttttagtgatttgttttcactctatccacagtgattagtgatgctcaatgtgagcaaaggctttgggatatgaaacacaaaggcatgaaagacttttacatgtgtgagattcaaaaagacttcacgattgatgctaccttcaaagggaacgcctctcggtttctgaaccacagttgcaacccaaactgtgtattggaaaagtggtaaagcatatattatttcatataaatatgtcgatgatgctcgagtaagagagcatgagtcagtttgattattttgttctaacaggcaagttgaaggtgagacccgtgtgggtgtctttgcagctcgtcaaatagaagcaggagagccacttacatatgactacaggtcaagttcttgaccatttgtttcttttatgtgcttataattagcctaagtaatctgagattctgatatattagcttctctctttgtgtaatggcagatttgtgcagtttggtcctgaagtaaagtgcaattgtggttctgaaaactgtcaaggttatcttgggacaaagaggaaagaaccaaactgtttggttgtatcttggggagcaaaacgcagaagattgtttcaccgacctatagcccgtaaaccgcagcaagattagctgcaaaatatctataaacaatgtgctttgatagtttgtctgttgtcgttatctagtaatctctgtggagatatagaaccaatcgtgcttgtaaccgaagcttaggcccacaattgtataactgctagctgaagccacgggatagaccggtcggttataccatacattctttcagttccattacaacacaattattatttaacccttgtcaaatttgaatctgatttaagaaaatacattcccttaaaaaaaactatctaaagatctcgcactatcatggcagaaaattcgacagaacaaattttttgatataaccaaacagaagaaaacaaattatataaagactacaatcatattacaaaatcgctatagcaatctaagtatcaagtttcatcatgtgactggtttcgctctgccttgagctcatcaggtgatcgagtttcagatcacgaccagttgattaagggtcggcctagtcccctttttttgtttttattacagaaaatacaaaagttacagagaatacaaggtcgggttgcagatcacgacgttacggatcatcgtggaatgtgggtagaaagactcataagactccatgaattcgatatgtacctcaatggtgcgaggatcaggtttcgggatacgtctttgttgttgttgaagtttctcgactttgttgtttgatgaaaatatgaaattaatgtattattgatagataagtaaacaacaaaatagtaaaacccaaagatgaaccaagtgacaaattgtgacaactacatggtagctatcctaattatcgaacataaatttttcatcaaaagtctttaacgaaccaagtgaatgacatgtttcaaagtcgaatactaattattgtactggtttaaaagatttgttccaaattgatatgatttaaaccagaagtctccgtatgaaacggagacttactcttcggcaagagaaggttttagtcaaaatccccattttttaaaaattctcaacaaaacgcctaaaaactgaaagtgcttattcctcttctccggcgaaccaaagatcaaacctttgcgagagaatttccctctttttcggcaacgagtatatccaatcagcaaggaattttatgatcgcttgataaattgaaactatttggagtgggtagtgatg

SEQ ID NO: 6390 - DNA, 3000 bp, Unknown
  misc_feature (1)..( 3000): cDNA_ID_3092513_gDNA_ID_1621091_Annot_ID_170726 3000 nt of promoter + ATG
acacaaactattaggagcacaagatgaaggatacaagtcgtcaatcttatgtttcagtggtcatcaataataacacaaactattaggagcaaacaaaacaatttatttaaatctcttttgaatatgttttagctcaaatcaataaataaaggcgccgagaaaaaaacagagctcatttgcacaacaatcagtatagtccaaagcttaagcaagtgaggacatgtgttctagctttcctcttgagcaggagcagaaacaggaggagtaggttcaagcattcttacagaacgaggaagcataaactcagcaaacacagggtagtgagatgaaggatacaagtcgtcaatcttatcatttacgatctcgcacattacaggaactatagatctacctctgtaaagtatccaatccgtgtgtagatcttgcgtctgtcggtcccagcagaggcataacgctctgaatatcagcttcaggaactcgaccgttccctgcttgtcacctgaacaaaggcccaacatgttatgatctagaagctttggagataaatgatttttatagctcatgagagggtggaatgtttcacacctttgaaatcatggtatgttcttatgagagcgacgttttttcttactcgggcacttggccatgcgtctctcatatctcctaccacaccatgctctctgcaagttgaatgatgcccaaaagccattcatcagcagtcaaataagtaaatatgctttgatttgaaactagttgatcagtgtgtgaagaatggtttagccattcttgcattaactaggagccctgaaagaaaactctaggagattggtaaaaagcacaaaacttgtgaatgtgatattaaggtacctagatctgcccaacagaaaccgccctgttgttgattccttctgtgtgttgaatcctccacagtacacaaccggcaaagtgggaggtaatgatgctatgtgttgccatgtgagtaaagcacttcgcctacgggcacgagggctgatttcatccaagtttgtgttgactatctgaaacgaaaaaccaggcggctccgctcctttaagttggaatgtgtaggcagcttgtcaaagaaaaccaaaatactgatatataggacaaaaacaccaaaatcataaactaatctaattatagtttaactaaaatgaacccaactagtaaaaaggatatagcccatgtcgctatacaaggaactgcggaaccccatgccgtgcttccagggaccgagggagactctgacaaccaaaaagttccaccctctagcagctctaccttcaattagtataaagtatagtatcaagcagcgtattaattatttagagcgtagttatgtattgtcttatcaaccgaattaatactttttccttgttgaagaagatggtgcagtgttcatcattagcatccccaggtcctgttcttgatatgccaaattgatcataggctgcaagcaaagagtactaccatctatttaagttcaaagaaacaatgcaaactgaagtattattaaggcatgtgaaactagaagctaagctccatggttcacagtaacaaaaaccagataaacaataccaccatcatttcaaagaaagcacctgtaaatgtgagaatatcatgcattccattgccataaaacagatgcattaagtgcactagactccggcttttgtagcctaaaaacactaacttgaacttgatgcaaaaaaggatacggattgacaaattggctatcagatttaagcaataccaacatatactaaaaatagaattaaatctagtagatcacaaatagatttacatagtagattgagaacaagaagagtggtctacgattgataacaagattcacactagtctgtgaacttaagaagaagcagactgctgtatacaaacagggttcaattagacctaactcacaccatttaagtagagattagacttccataaatcaaagagaattcaattatacctggcaacccctgctgaagataatccaactgcgacttcacacctaaccaatgtaaacatgataacaaaagatcaaaacgaaaatcctatctctgttcaatatttcagaaggcaagaaaaagcacaagaatcaatctccagcattcaggaaaaagaagccttcttggagaaccaatataaagaaggaagcaagatctaacaagcattgaatcaccaatacgaagaaggaatcaaagatctaacaagcattgatccattgtggctaaagattattaccttgttgggtacagagaacaatgggggagtaactagtgatgacagtgagacacaaatctttccttttgagccatgaattagggctttcttcaggtagatcatcgtgaagattgaatgacatcacactcaaagacacactcattgttttgtctcctttcttcttcttcttcttcctctagttttctctcttctttctttatggtttggtaagacgaataaaaacaaaggtctctctcacatcagcagcagctcatcgtcgtcgtgacctacatgattttcaataataagtcaaaagcttatcaatttttatgtgaaaaaacagctcaggattcgaagaaagaaaatcaatcaacataatttattatattatattattgaggaatccaatacgaaccttgttgtttcagactcttatcaacaacaacagtggagaaaatgagtcttggacatttgacgacttttgctggaaaatctgtgaaagtcatgccctttgatcaccaaaagtctcttaaagccatttcctgatacatgtataaatcagcaacttcagaaacaaatcaaatcggaaacgggggaagaagaagaagaagagtaactaatcggaggagggaccggtgaagtcacggtggagggaccggtggagtcacggtggactaatcgtcggctttttggtctctctctagatttttttaaggtttaaaattaatttcagacaagcttcgaacccgagac

SEQ ID NO: 6391 - DNA, 3000 bp, Unknown
  misc_feature (1)..( 3000): cDNA_ID_3048291_gDNA_ID_1621091_Annot_ID_170724 3000 nt of promoter + ATG
ggctttggctctggacctgaactagagaagaagcttaagtatgctgaacatgtttcttatggcgttattttcgggaaagaactcgttaattctccagccaatgttctcactcctggtgaggattgtttcttgagcatcagtcttagacttttcattttttttttttttaataatgtgagcatcatgtctgttgaagtttatttcaaacatttttctctaatctgctttgtatcttacagccgtactagctgaggaagccttgaatctggcttccatgtacagtgatgtcatgactgccaacatcttgaacgaggagcaatgcaaagagttgaagatgggttcatatcttgctgtagctgctgcttcagctaatccacctcatttcatacatcttatctacaaaccttctagtggccctgttaaaacaaaacttgctcttgttggaaaaggattgacatttgacaggtactagagctgttggcttctgtttgccgcatcaatctctttatttaatacttattagttattgaccagatggtttttgttcacagcggtggctacaacattaaaaccgggcctggctgcttaattgagctcatgaaattcgatatgggaggttcagctgctgttcttggcgctgcaaaagccattggtcaaattaagcctccaggtgttgaggtaagtttatcacacggagcttgcgtttctgagttaaatgaatgtacctaaacaaatgcttcgttgcacaatcaggtgcactttattgtcgcagcttgtgagaatatgataagtggtactggaatgagacctggagatgtcctcacagcctcaaacggaaagacgattgaggtatcataacaccgtttccatatgaattcagcttcaaaaggttcgagctttccattgttagttttacgccaaactaattgtgggtggtattgcaggtcaacaacaccgatgctgaaggtcgactaacacttgcagatgctttagtttatgcttgcaaccagggtgtcgataaggtattgtttcaaagattcttcgacttattaatacattctttctgttggtttttctctcaagtctcaacttgtgaattacaatatttgcaggttgttgaccttgcaacattgactggggcttgtattattgctcttggaacatcaatggcaggtacatagtcttgtgttttaaataagacagaataaaattctttcgtgatggttgactattggtttttctgcaggcatatatacacctagtgataagcttgcaaaggaggtgattgctgcatcagagaggagtggagagaagttatggagaatgcctatggaagagagttactgggagatgatgaagtcaggtgttgcagatatggttaacactggaggccgtgcaggtggatccattaccgcggctcttttcttgaaacaggtgagtatatcataagagtggaaacaaaagaacacatttcaatactgacgctattgttctctaacgaagaaccgggtttggttaatggttgcagtttgtgagcgaggatgttgagtggatgcacatagatatggctggaccagtgtggaacgagaagaagaaagctgcaactgggtttggagttgcgacactagttgagtgggtacagaaccattcttcttcttaagatgaagtctggtgatctctgactgatgtgaactagttgtgtttttgctttgtgtggtgggacaagttttttttttttgtgcaactaagtatgacaagttaaatcaatcagaagattagttttgttgttgtatgcttacctagtctaaacttaaattcaacaaccaccgtgagagacacagttgagccaccgttgttgctgtgtcccgtcatgttgttgtatttgaatgggtccgtgagttgttgagaaggagagatagtcgccgttcatcaccactacagccaccgtgtgtcaccggagagtgacaccacgagtcacaggatgtcaaccgctgtcaccggagtagtcgtagtccatcgccaaggccgttaagggtaaggaaaccctagatctattatgtaacttgctcaggaagtttttggctttctcttatgatctgtgctttgttttggttttgattgttgagctatgagaccttactgccgtgagcttaaaccgcctcatcgagccccgagcagatccaccgagagtaatcgccgagaaaggtaacggcgaaccttatctcccgtgtttgttgttgattattgaaccggatcttaaccagtctaaaccaatgactcttaatttagttaagaccagaaccgaaaccaatgacaatttgcgttgttggtgtattattacgtctgtgtggtgtaactagattataagaatttggtttggtttaattattaaaccaagtctaattaatttaattggaagaataccaaatcaattaatcgagatttctaaatttggtttggttattagattaaatcatgtatttttaattggatttcacctattgatccacaaatgagttacaaaagtgataatactgacgtgtttttcaatttcttttatcacttcgtgtaagaatgccttgaaatatttgaatttctataaatagtatcaaaactatgttttgtataaacaactttaaatttgaaggcaacaaataacagtagtaagtatttcagatatggttatcaagataagtttagtaatagtgaaacatgatcacattaaaatttgaaaagaagtctacagctaatcaagattgttaagatcgggtcggataatagcaatagtgagtgagtcaagtaaaagaataatcatcgtcaacaagacacgacggtcggacgcgggcggacgcaagaagagactgggccactctaattttctaagataactctaatttcatactatatatatatatatatatatatatgtctgcatcagccactctgttcttctccttataaataaatataaagaagctaagctcagtggagacttctcaa

SEQ ID NO: 6392 - DNA, 3000 bp, Unknown
  misc_feature (1)..( 3000): cDNA_ID_3092689_gDNA_ID_1621091_Annot_ID_170701 3000 nt of promoter + ATG
atcccataatcacttatattgatagtgaatatatcagtaagaaagatactgcatggtagtttatgctaatatcctcctgaaagaaagagataaacagcactgatgagctcaaggttctgatgaaaccacaaaaatacattacattaccttcaggcttcagaaattgcaggcttcacttatggtatctctttcagatccatatttagcgtagtagcacatcaacaaaacatcacttagaaaaggctcagatcagtttgagaaatggatccgtagcaaagcagagcacatcatatactcgtgaaatgatcacactggcatccctcagagataggtccaagcaataacaaaaagcatggattagaatctgtggccatgtaaaattaacaatcttctaaatcaagttcagcaaatatttacgaactattccttacttgagttgttggaacattctgcatcagtgatgctgcttttgaaatgcagaaagagaacagtgcttagatagaatcttcatataggactccacgattttccttggtaatcttcaatctgtaattcaggttcaattttactgaatccgtagcatttgttcagtttccgtctttgcataaccctccttacttcttctgcagcatggtagttaccagattctgtgtgaatcttgctaagcaatacataattggctggattatcgggttcagatttcattagctcgtttgcaataatttttcctgcaacatcaagcctgccatgagtctcgcaagcagatagcagagaactccatattctggcacttggtttcattggcatatttattgtgacctcaaaggcatcgtcaatcttcccaaacctgccaagaagattgatatagcaagcataatgctccaatgtgactggcatgtggtatttcccagcttgtgtgaatatggtttgagcttcttctaccaggccagcatggttgcaagccgataaaattgcaagaaacgccatatcatctacttcatgtccaccttttatcatccctttaaagatttctaaagcttctgaaccatgtccatgaagaccgtatgcgttaatcattgagctccatgacacaagatctttctcagtaagttcataaaatacttcacgcgctgcagaaagactgccacactttgcatacatatctatgagggcgtttcccaataagatatgtgacatgaagccacatttcaggatttgagaatggactgtagatgcaaaactcaacaatgtcgaattggtacaagctgagacaattgccaatagagtaaccgagttggcttcaattccttcttttctcatttgatttaacagattcataacttcagagcaatctccagtctccgcatagccgctaatcattgaactccacattacaacatctctcacttttgatgtttcgaaaagaaccctagagagacttacattaccacatctgcagtacatggtcataaaagcagctgttaaccgctcgtcagcatggcatccatgacgaaaagaaaatccatgaatctccttcaccagacttgagccataattcaattctacacatgcaggtaaaacagacaacagtgtgacacgattgggcctcaagttttctctctgcattgctcgaaacaaatcaacgcccatttcataattctgatttgcaacacaaccggagatcatggcagtccatgagacctcattcttcacctccatctgatcaaacacatggaaagccgccgcatgatcatcaaactttaagtacatatcaaccaaagccgttgataatagaactgattcctgcatcctctcatcaacaagaacaagagcatgaaacattcttgctaccttactgctgcttcccatgcgagtgcagagagccaatagagatgcaaccagctcggacttgggaataaaaccataaaaatacatctccttaatcaacttcatcgcttcatacaacaacccatcctggcaacaactattgatgatggaacaatagctaactgtatctctgtgaagcatttcatcgaataccttacgtacagcatattttctcgagaatttcgcatacatagagatgagagaattggaaacaactgtatcacaatctgcacctgctttgagacaaaggcaatgaagctgtgcgccaagtaagaaaggctcttgttgaaaagcgcaagctttgatgacagaaggaagaatagctgtgaagccattggtccctaaagaatgaatctttagcttgtacagtctcaatgcttcatcgtagaattggtccgacaccaaacccttcagcttattgccgagctccaagtttaagcgggaagacaacgcccttgacattataacacgacggcctagtttaacccatctcatcggacgggtaataatgacgtgcccactatgactgtattatctttgagaaatagtttgtgtttgattcagtaaacaaaaagcacccatggcctaatggataaggcgcttgacttctaatcaagcgattgtgggttcgagtcccactgggtgtgtatttaataaatacaatttaatctttttcaaccttattatattcaattttttgtttgttaatattcaatttaaagcccaataaagttggaagatggtgggctagtaatgggtcgaggtttttgaatacagaagcacgtggagatcacgtgcgttgacgtcaaggtgtggctgtaccggtggatctcgaattcctcccctttggcttctcgaaggagaagaaaagtgtcggagagaaagaagaagccaatcatcatcgccagttgttcttctcttcgagatattcaaatcctccgtctctagagaatttcatatcaagagaatcaggcaagtgggcgattctctgatcccgagtcaaaccatttctggcttctcaagtctcctcaggttctgatgaatagattgtttgattttgcagtggtttctgtagtttgtggtggtggtggttggaaggtaagataggatatg

SEQ ID NO: 6393 - DNA, 3000 bp, Unknown; identical to SEQ ID NO: 6385
  misc_feature (1)..( 3000): cDNA_ID_1814264_gDNA_ID_1621091_Annot_ID_55503 3000 nt of promoter + ATG

SEQ ID NO: 6394 - DNA, 3000 bp, Unknown; identical to SEQ ID NO: 6384
  misc_feature (1)..( 3000): cDNA_ID_1814257_gDNA_ID_1621091_Annot_ID_55506 3000 nt of promoter + ATG

SEQ ID NO: 6395 - DNA, 3000 bp, Unknown
  misc_feature (1)..( 3000): cDNA_ID_1814254_gDNA_ID_1621091_Annot_ID_55507 3000 nt of promoter + ATG
aaaactgtcttacagtgtcatagtggaagctgtcaaggtagatagtctgcagaggctatgctcgtctttggaaccattatttcgaagaattgtgagtatgatactattccgaagtttaacttccacatagaccaaatcttgagaagcctgtaagagcgataaacttggtaatgatgtcgatcaatggacaggtcagtgaagaggtggaacgtgccatatcaaggttggagaactcgaaatctacttcaaggtattttatctagctatatacgatatcattttctggactggttccatgatctttacatcaatttgagttttcagatctacagaaccgaataagattcaaggcctcgatggaagaaatctgcaacttcggttcagaacacgaatgcctcctcatttattcacaggtgggaaagtcgagggagagcaaggctcagccattcacgtggttcttatagatgcaaacaccggaaatgtaatccaaacaggagaagaatcaatgacaaagctgaatattgtcgtgttagatggagacttcaatgatgaagacgacaaagattggacgagagaacattttgagagctttgaagtgaaggaacgcgaaggaaaacgtcccatcttgactggtgacagacatgtgataattaaagaaggtgtaggaactcttggaaaacttactttcactgacaattcgagctggattaggagcagaaagtttagacttggtgttaagcctgcaacgggatttcacatccgtgaagctaaaacagaaccatttgctgttaaagatcacagaggagaacatgagtatcttaaaactttggactgacttgataagcagagagagatagagtttcttggattgtctaccttaatcttggattattttttggcggtgttttttgcagtatacaagaaacattatccaccggttttacatgatgaagtctggagattggataaaatagcgaaagatggagcgctacacaagaagctactaaaatctaacattgtgactgttgaagacttcctacagatactcatgaaggatccgcagaaactaagaagcgtatgtgcatctttaatattgtgagtatctacacaagaaaatgattgtttcttgcttatgttctttctttgtgtgtatttaacagttacttgggagtggaatgtcaaatagaatgtgggataacacggtagagcacgcaaagacttgtgtcttaggtgggaaactttacgcctattacacagatcaaacacaccagacagctgttgtctttaatcatatatatgaatttcaaggcctaattgccaatggccacttcttgtcttcggaatctcttaaccatgaccaaaaggtaactcatctctctgtaaagctagcttcttttttttattcttccctttagagtctgcagtctctaaggatcctactcaaaagtggtgaaaacttttgaacttttttggaattcaacagatttctgcagacactttggtgaagactgcttacgagaactggcataaagtggttgagtatggcggtaagctcttgaattgcttaccagttgctaagaagggaataaaaagcttgccagagccaaaaatggctcagaaccatcaaacgcagcagaaggctctgcaatgccaacagactgtgaatggctactcatcagatcctcagcatctgatagagtatccttttgtccaacaaccttgctatcagttacgagactacacatcgatggagagttcttcagtttcaggctcatataatggaggccttgaagatattttcacggaggaaattcgagcgaggagttctgagatgctcgagacggataacatgcagagattgctcaagacatttgggatatcaggcgggtttggtaacagggatgagtccatttacggtttcagtgatcagtacgaagctcagatagacaagggttatatgagagaaggaggtagaggcgcagggaaagctgtagtgggatggcttaagctcaaagctgcattgagatggggtatctttatacgcaagaaagctgcagagaggaggcctcaaattgtggagatcgactaagaaagtactacaaaaaaattccgagagcttttcttttgtataaataaacttgaagcaattacttttttaaagaggatcaaccagtatatccttccatatctaagcattggagaaaaaggttaaacgactggttatcagtcagacaaagagtcttaataccgaaagtctcagtattcgtcctctttaagataatctccacaccaaatacatacgaatggagtgaaggttcctatatatattgacaaagaaaaattaaggatttatgaacagaatgaatttaacattgcatcaacttacttagcttaccattaaattacggagtaaaatctgaagacgtggaaaatcgaggtgagatggctggactggactagaccatcatcgagatatctccagcactcatatcaagaacataggtttcggttataaaagcctcccatgcacttttttttagagatctttctttgtgattgcttgatcggccgtatcaaaagcggttgtggattgctcaatatcaacaagagaggtaggagttgtagatggccgccggagcacagcagtttcaggagcggttgtggattgctcatcttcagagatatcaacaagagaggttggggttgtagatggccggactccagcagtttcagagaagccagctccttcgttaggcaaactcattctcgcagacgtggccctagttagtagcgcgccaaggcactatataagtgacacggcagggataagtcaaacttaaaggccgacttgactaatgggccctataatgttaggcccatgttttgagagagcaagtagagagaagaaacaagcaacaagaagttccttcctcagcctctttccgatttcttcttcagtctctctccactggttcgtcgacttcgtagaagcaaaaaatg

SEQ ID NO: 6396 - DNA, 3000 bp, Unknown
  misc_feature (1)..( 3000): cDNA_ID_1814250_gDNA_ID_1621091_Annot_ID_55508 3000 nt of promoter + ATG
gtgtaatttctgaatcaaatgaaaaagtacatacagtgccatttaggaaaaaacaattaaaagggtcaaattgtaaatttaaacgaactgtgtgaaacaaaaagaaagtgtagcgcctttttggaaaggaaaaagattatggaacccaaaagtgtaaaatcgtaagagtgattacgtgagaaatgtaccaccgacatctgaaccggggggactcatcaaaacgtggtcgttttattgtagtttctccgcgtttggtacatcaacacttgtagctgtgtatctttctaattcttcctttctttcgctgacagtgcttgctcacacactaatcgcaattgttgctgcattgccgactctgattcgttcgatttcagcattttgttcttccgaagcgatgcctcgtcgatccggagattgcatgagatgtctggtgattttcgcggttgtatcagctttagttgtgtgtggacctgctctttattggaaattcaacaagggtttcgttggatccacacgtgccaactctctttgtcctccttgcgtttgtgattgtcctcctcctttgtctcttctccagattgctcctggtatgctttacctttattctgatttggatcttacatgttcctcgttttatgattagatccttttacaagtttttcttgtgaaatttagttccttttcgagtaatgatcataattttgaggtgcccttttcctcgaatttcgttttgctctagtttatttggatctttgctctgaagcatctgattttttcaatattggatctttcaatcaaagctgtctcttttaggtttaatttcagtaagaaagaatctcgacttgtatattgtttaacaagttgaatttttgttttgtttgcagggctcgcaaatctctctattacaggttagatctcgattctgagcttgactttgttttagctgctatgcttgtgttgtttcctttattggttttctatcatgttgcaatatggtttgacagttattgagaagcttttattttgtaagattggtttcccatttggtatttgataccggaaaatgaattctgtcttgtgttgtgaacagattgtggaagcgacgatccagagcttaaacaagagatggagaagcaatttgtggaccttctgactgaggagctgaagctgcaagaagcagttgcagatgagcatagccgtcatatgaatgttacccttgcagaagctaaaagggttgcatctcagtatcaaaaggaggctgagaagtgcaatgccgccactgagatttgtgaatcagctagagagagagctgaagctttgttgatcaaggagaggaagattacttctttgtgggagaagagagctcggcaatcaggttgggaaggtgagtaaactgattgcacttctcagtctaccttaaagtgtttctctctgagaaatcgaattgtcacagctctaaaaggaaattgtttagttgtcaaggcaaagtcctatcttccacgtttctctatatacagtatgtagttttttgttttgcccttgatcggaatgtagctaaagaaaggccttgtatcaacttttattcatatataattgtccatttctttactatgaagcttcacttccttctcttgttagataagaagtcgtcatgtattttatggttcatgttcattgaaatccccaaaccatcatattctcaataaccaagagctgaaacaaagagtgagcttaatatcccatctaaacaaatccgagttcagaaagcacaagaggatcaagaaagtcacttggactctgttttcttctttgcttaaaaacctaataaagactgttttcagacatcaagaaacaggagagtttgtgaacagagaggagacaaaaagtagaaagtcaaacgcacttaggttgacataattatgatctcaccaggtatcacgcggtttcgattttcaatattccttcattcacaaaaacagctgtatttttattttattttatttttagggttcgccattaaagtgctctgtttattctaatattcagagggacagaatctataaaagcgatctacggctaaaagaaacagatctcgtttcagtgactcctgcaaaccgtccactccatgtggattgcacaaaaagttctataaagaaaatatagcttttagactttggtcctagattcaactaatctctttttctatttcttctgtgttcttctctgaagcttccattgtgtaggacttatgctcttttctcctacttagggaaagtgcattaattcgtatctatctaggcacagagattgttgataacttatcgtactttaaatggaaaattctatgaacaacagaggacatggacacaatcaagaacatgcagacaacttgccagaatcaaagagacagaagcttcctgctttggcaaggtaactcatattttatatgttagtgtgtcgtaaattcgattgttttggctaattctgaagtctttttgtatcggaccttgttttgagttgttcattagttacactgtccaaagagcatagtactgtggaaatatcatacttttcaaattttcgatagtcttgcttagcctcgcaaggcctcaaattttctcagacgtcgttgtatgaaaaaaaaactgtcttacagtgtcatagtggaagctgtcaaggtagatagtctgcagaggctatgctcgtctttggaaccattatttcgaagaattgtgagtatgatactattccgaagtttaacttccacatagaccaaatcttgagaagcctgtaagagcgataaacttggtaatgatgtcgatcaatggacaggtcagtgaagaggtggaacgtgccatatcaaggttggagaactcgaaatctacttcaaggtattttatctagctatatacgatatcattttctggactggttccatgatctttacatcaatttgagttttcagatctacagaaccgaataagattcaaggcctcgatg

SEQ ID NO: 6397 - DNA, 3000 bp, Unknown
  misc_feature (1)..( 3000): cDNA_ID_1814246_gDNA_ID_1621091_Annot_ID_55509 3000 nt of promoter + ATG
atggtgtttaaaagagggatggagattgtaatatttgagatttgaagggtttgactttgacatgttaaatacgtttaccaaatttaccattttttttatcatccttgcaaattaattatttcgtgttattttcataatttcttgatttttttaatcactaaaagaattcgatcactgaagtcatgatttcttcaattttataatcctttgttgataatatacttttcacaattttgtagtaactacaaaaagtaagtgaaacatatatttctaaaaatatcatagtcgatcgaatgacaggcttaaagtaataaaactaacttaaaattcggttgtactaaaaaaaaaaaaaaaaaaaaaaaattcggttgtactaacttcactcaaatgatttacgtatgtttaattatctttttttttttatttaagacagaatgtggttctaataccgtatattattaaatttctatatatataacataggtttttctattaatcatttttgaaaactcatgtttaagataattgtataagattttcattcggtaacattaaaattggtttatttgaatgctgaataaaattctttggatttatgttaaggatgccaactacaaaaataaaataaaatacaaatctctattgttgatcttttttattaaaatcagtcggagttttaaacttgtcccggcaactacgtaccacgagataaatatttgctagtccaaaaatgcaatagtctacaagataacaccagagccaacactttttcttgtgacaactattttagacatataatatttagacatgcagtataaatgcatacaattatactctattcatttgggtacattcattcattcatcaacggttcatgataatgttctcttcatatattactgtttacaatttgtccccaagattacaaacatgctatccctttagacgatactcgtgttcgataagaataagatcactttttatagattattcttgttttgttttctgattaatatgataccgatcgatgaaattgttgttttaaccgatctgattaacatttgggaaagaggatcctctcaaacgagaacataacataacagaacatcgtcatcatcatcatgtcatgttaccatgtattttttatacttgttaaatattttttggtctaataaattcatcatttaccttaaaaattcttttttaccatcgtatacagtttttcagctgtttgatagtatttgattaagattaatattaaattgacaaagataagtaaagaacattattatgcaatatgcatgattaagcacatgggacattctgagttttgcacaaactcacaagaggtagagatcggctttaatacacttcccatttattaattacaaatgttggtaagcattgatgtactacacaacagaaagagagatctatcatctcatgtattagtattatcaagagaatgcaataattatttttgtttttacttaataatcataatgtataccaaaataattaactaagggggtgtaaaataagttacgaatgataatttaaattccatatagaaaaaataaacagatagtaaagacaaaaatgctactatgttaaataaactattggtcccatctagtatactgatacattagttttatttcatattatcagtagttttttctattgtttatataaaacaatacgtttacaataggaaggcaggaaaataaaccatatggtgcacaaccattgtagactcaatcctgacaaaacccaataaatttgaggaactccctcaaaaattacggctttgttcaaattgaaaaactggctcttacgatcttagtttggtacacaatcacgtctgatttcccaagttctacttattcacctataatgaactataaatataatctgtaaatatcaaaaggtgggcttaactaggccttgggaaaatattgaattatttaaccttgtatgaatctgacaaactctgattaaagtcttggttcttactctattagtctaatacaaataaataaacatatcttatttccttaaatgtaatttcattctcttaaattatactaaaaaaactctacttgagaaacatgaaagcttaatttggcttgctgtgattgtagatgaagctgagtgctggacgtgctcgaaatgctattttaatttgagagaagaagatgttgatgagttaacgcgcgtctcaatattttgttggccagtgttacgattttcgaatgttaagattgggctaaaaagggaaataaaaatgtctaaaattatggatctcggttatggaaaaccagaaatatacgtcaaaacccgaacattcggttcgattaaacgataaaccaggataaaacctaaccgggtcgttaaacccaaccgcctccttgtttgagaacaaaaaagaagcttaaaccctttcttcctccgccgcgttctcaagctcaagctcaatctcaattctcaagctcaagccttttcgatttttctctttaaagacgcaattttgctttcgcaaccctctgtgtgatttcgtttccaaacgtaagctctacttttgttgtttaatttccaaggctttagcaattaagcaattaagcaattagattgatatacatagttgctcttagaagcttctctttttttttttttagcctggatttaattgtaaagtttggggattttggaatcgaaattgactgttttggagattgatgtgtttaggaaacacggctctctgaatcatggcgacatcagctgatgctcgggcagtaaagtcgctcaacacttccgaggggcgtaagagatttgtggtacgtgtttgtttaattatatagcacatgtcttttcctttcctttgtaaaacttcctctacacctatcatagagtccactgtttctcctcattagtaagctcacttatctgttttcgttgtgctctctaatatggctgtttgtgctttattatttctggatg

SEQ ID NO: 6398 - DNA, 3000 bp, Unknown
  misc_feature (1)..( 3000): cDNA_ID_1814242_gDNA_ID_1621091_Annot_ID_55510 3000 nt of promoter + ATG
ttctgaaggctcagccttcaccttatccaagttcctatagttgctgatgttgtcaatgtcatttgttcgttgagaagcagacttgaactgcatccagaaataataaagcacaaacagccatattagagagcacaacgaaaacagataagtgagcttactaatgaggagaaacagtggactctatgataggtgtagaggaagttttacaaaggaaaggaaaagacatgtgctatataattaaacaaacacgtaccacaaatctcttacgcccctcggaagtgttgagcgactttactgcccgagcatcagctgatgtcgccatgattcagagagccgtgtttcctaaacacatcaatctccaaaacagtcaatttcgattccaaaatccccaaactttacaattaaatccaggctaaaaaaaaaaaaagagaagcttctaagagcaactatgtatatcaatctaattgcttaattgcttaattgctaaagccttggaaattaaacaacaaaagtagagcttacgtttggaaacgaaatcacacagagggttgcgaaagcaaaattgcgtctttaaagagaaaaatcgaaaaggcttgagcttgagaattgagattgagcttgagcttgagaacgcggcggaggaagaaagggtttaagcttcttttttgttctcaaacaaggaggcggttgggtttaacgacccggttaggttttatcctggtttatcgtttaatcgaaccgaatgttcgggttttgacgtatatttctggttttccataaccgagatccataattttagacatttttatttccctttttagcccaatcttaacattcgaaaatcgtaacactggccaacaaaatattgagacgcgcgttaactcatcaacatcttcttctctcaaattaaaatagcatttcgagcacgtccagcactcagcttcatctacaatcacagcaagccaaattaagctttcatgtttctcaagtagagtttttttagtataatttaagagaatgaaattacatttaaggaaataagatatgtttatttatttgtattagactaatagagtaagaaccaagactttaatcagagtttgtcagattcatacaaggttaaataattcaatattttcccaaggcctagttaagcccaccttttgatatttacagattatatttatagttcattataggtgaataagtagaacttgggaaatcagacgtgattgtgtaccaaactaagatcgtaagagccagtttttcaatttgaacaaagccgtaatttttgagggagttcctcaaatttattgggttttgtcaggattgagtctacaatggttgtgcaccatatggtttattttcctgccttcctattgtaaacgtattgttttatataaacaatagaaaaaactactgataatatgaaataaaactaatgtatcagtatactagatgggaccaatagtttatttaacatagtagcatttttgtctttactatctgtttattttttctatatggaatttaaattatcattcgtaacttattttacacccccttagttaattattttggtatacattatgattattaagtaaaaacaaaaataattattgcattctcttgataatactaatacatgagatgatagatctctctttctgttgtgtagtacatcaatgcttaccaacatttgtaattaataaatgggaagtgtattaaagccgatctctacctcttgtgagtttgtgcaaaactcagaatgtcccatgtgcttaatcatgcatattgcataataatgttctttacttatctttgtcaatttaatattaatcttaatcaaatactatcaaacagctgaaaaactgtatacgatggtaaaaaagaatttttaaggtaaatgatgaatttattagaccaaaaaatatttaacaagtataaaaaatacatggtaacatgacatgatgatgatgacgatgttctgttatgttatgttctcgtttgagaggatcctctttcccaaatgttaatcagatcggttaaaacaacaatttcatcgatcggtatcatattaatcagaaaacaaaacaagaataatctataaaaagtgatcttattcttatcgaacacgagtatcgtctaaagggatagcatgtttgtaatcttggggacaaattgtaaacagtaatatatgaagagaacattatcatgaaccgttgatgaatgaatgaatgtacccaaatgaatagagtataattgtatgcatttatactgcatgtctaaatattatatgtctaaaatagttgtcacaagaaaaagtgttggctctggtgttatcttgtagactattgcatttttggactagcaaatatttatctcgtggtacgtagttgccgggacaagtttaaaactccgactgattttaataaaaaagatcaacaatagagatttgtattttattttatttttgtagttggcatccttaacataaatccaaagaattttattcagcattcaaataaaccaattttaatgttaccgaatgaaaatcttatacaattatcttaaacatgagttttcaaaaatgattaatagaaaaacctatgttatatatatagaaatttaataatatacggtattagaaccacattctgtcttaaataaaaaaaaaaagataattaaacatacgtaaatcatttgagtgaagttagtacaaccgaattttttttttttttttttttttttagtacaaccgaattttaagttagttttattactttaagcctgtcattcgatcgactatgatatttttagaaatatatgtttcacttactttttgtagttactacaaaattgtgaaaagtatattatcaacaaaggattataaaattgaagaaatcatgacttcagtgatcgaattcttttagtgattaaaaaaatcaagaaattatgaaaataacacgaaataattaatttgcaaggatgataaaaaaa

SEQ ID NO: 6399 - DNA, 3000 bp, Unknown; identical to SEQ ID NO: 6381
  misc_feature (1)..( 3000): cDNA_ID_1012984_gDNA_ID_1621091_Annot_ID_55513 3000 nt of promoter + ATG

SEQ ID NO: 6400 - DNA, 3000 bp, Unknown
  misc_feature (1)..( 3000): cDNA_ID_1814227_gDNA_ID_1621091_Annot_ID_55515 3000 nt of promoter + ATG
gagctacaatctccgtgcagctcatgagtctatacaagagaactggggaaaggtactaaccactttcttatctcgtaaatttgttgtgaataacatgacagtaatttgaaccacaacataataagtgttcctttgggaagttaataagacactaaaagtttcctgggctacttcttttggggtgttgttgcagtatacaaacttggctacatggaactggcgattgatgaagacgataatgactgtgtgtcatgtctatgacaaagaggagaactacattccttttgaccggttagcccctgaagaatctcagccaataaccttcctcaagaaagcaatgcctaactacacagcctgattcgccatggtctcaaactagtcttttgaaatctcaatatctttttgcagtcgccgatgttatatgtaagctttccaagcgatgagcttctctaacacttcaccaacgctttatactgttatcttctttccaatcttatcagaagagagaaactggtcaaattatctcagcgattgcaattcttttatcagtttcttagctataagaagattgaacagtctatatagtttgcaatgtactgtaatgtgatgaaaatttagttgatgagaatctttgaagatataaacatcatcttcttactgtgtctgcaatatttccgagaaagtcgtgggaaaaaagccaaaagaaaaagtgaagagagaaaagaaagctaaagcaaaattcttgggacttctttacggaaagtggaaagacaaagtcattcactgtccaacaaaagacactcacatgtccaaaataagggagcgaatcatcaaatctttagaaatctgagactgtggtcacagttcacaccaccatgaaaggagcttaaagctaaaggtcaaaagaggattaattctttacattgagaaagagtcatataaggacaaaacagaacacaacctgaaactggaaacttaaaatcgtattaatatcaatcctaacaaaagtctatgatcatgttctctatgtttatattctcttgactattgctatttctctcatcctatatattttctaacaaccctaaaacattaacaaaagaagcaaaccagaagcaacagaaacagaccagactaagctcaagatatcaaaatgtgaaatcagatgatgggaggaggaagagtctcccacacatcaaacacattctcctcactgtgcaatgcaaacaacctatccccaccaatagagaaatcacaaatggagccgccatagcttcttttcaacctagaagtcaaaacccagtctgatccacaaaacacagagatggaatcattcatagacgagaagagctggccttcatgcaaagcaagtttggggtaacaaggctcatcaggcatcttgcttttcatcaacctgctcctagaactccacctcacactactccctcctccatccatcctcagatcaataaaccctagatcttcaaactcattcaccacacatatcgaattgctctcttccattgctatcgcgtctctcactctcttctcttccgccattgtaagaaatccgatatcagaccaagaccagaccatgttcttctctcggaaatccaacaagctaatataacagttatctttccttggaaacaaagtagctacaagaagacaattcttaccactcaaccattgcaacttatcagcatctcctaaagaccaaccaggactctcgtaaaagaaatctacttgctttccagtactttgatcccaaactccaatcccatactcattacttcttcctttacagctcgtaaagatcttagaatcaggactaaaactcaaagctccagcactataactcttaacctgattatcatgactaacctgaaacttatacctaagctcaccagaagatgagctaaacaatcccattcctccatctcctcttcctaatctctcacaagcagagagtacaatgttaccagaatcaatccaaccaacatcgttcactctctggtaatcaagattaatcgttggatgctcctcaagcatccaatcaaagacatggacgacactcccatgagctatgcagcatccaccatccggaccagctcttatcgccgttccgtctccaggagctatgccggtgacggaacgagataggtggagtctgttaccgtcgaaaggtccccactttgcggttcgtaagtggtctattaagccgtagaacattgcttctttgtgaaggagacgctccgggatattaggcgggatgtttaagtctcctgttcggagaagatcgagaagaacagcgaagcaatctggattcctatcgatgaagagatccccgggttgtgaaagattccaattttcgtcgaataatgctccgaagaaggaatcgcgacctgcgttagcgagcgttgtcgctgtcgtttcgaagattctgccaccaacgttgaatttgatcctgtcatttgataaacccattatttctgatttctgaaaataggtgaaatcaatgatttttatggattcgaaccaaaagcattaatgacaagacaaggaagccatgaacgctcgaactcggattgaaaatattcgaaattcgatcggattcgaagaaattgaatcctgggaaaggataacgaaatgaaatctgatttatgattaatcaaattgaatacgatgatctggactctggatatttttttaaaaaaagctgagattcccagaagagaaaataaaacgatctgtcttggtctcggacatttttccgttgctcgggcatttaaaacgtaagaaacccaactggaacatggtgggacctactagagacaatactcgtgttactaccgtcagatgcttttagatattgtcgtctatcctgcggtcgagatttcgtgtaatttcaaagctaataccgtgatccatgataacgtttctaaagcccatatagatagatatcatcccattaacatatccttttttttgtatgctgaa

SEQ ID NO: 6401 - DNA, 3000 bp, Unknown; identical to SEQ ID NO: 6378
  misc_feature (1)..( 3000): cDNA_ID_1807277_gDNA_ID_1621091_Annot_ID_55516 3000 nt of promoter + ATG

SEQ ID NO: 6402 - DNA, 3000 bp, Unknown
  misc_feature (1)..( 3000): cDNA_ID_1814221_gDNA_ID_1621091_Annot_ID_55519 3000 nt of promoter + ATG
cttatgagagcgacgttttttcttactcgggcacttggccatgcgtctctcatatctcctaccacaccatgctctctgcaagttgaatgatgcccaaaagccattcatcagcagtcaaataagtaaatatgctttgatttgaaactagttgatcagtgtgtgaagaatggtttagccattcttgcattaactaggagccctgaaagaaaactctaggagattggtaaaaagcacaaaacttgtgaatgtgatattaaggtacctagatctgcccaacagaaaccgccctgttgttgattccttctgtgtgttgaatcctccacagtacacaaccggcaaagtgggaggtaatgatgctatgtgttgccatgtgagtaaagcacttcgcctacgggcacgagggctgatttcatccaagtttgtgttgactatctgaaacgaaaaaccaggcggctccgctcctttaagttggaatgtgtaggcagcttgtcaaagaaaaccaaaatactgatatataggacaaaaacaccaaaatcataaactaatctaattatagtttaactaaaatgaacccaactagtaaaaaggatatagcccatgtcgctatacaaggaactgcggaaccccatgccgtgcttccagggaccgagggagactctgacaaccaaaaagttccaccctctagcagctctaccttcaattagtataaagtatagtatcaagcagcgtattaattatttagagcgtagttatgtattgtcttatcaaccgaattaatactttttccttgttgaagaagatggtgcagtgttcatcattagcatccccaggtcctgttcttgatatgccaaattgatcataggctgcaagcaaagagtactaccatctatttaagttcaaagaaacaatgcaaactgaagtattattaaggcatgtgaaactagaagctaagctccatggttcacagtaacaaaaaccagataaacaataccaccatcatttcaaagaaagcacctgtaaatgtgagaatatcatgcattccattgccataaaacagatgcattaagtgcactagactccggcttttgtagcctaaaaacactaacttgaacttgatgcaaaaaaggatacggattgacaaattggctatcagatttaagcaataccaacatatactaaaaatagaattaaatctagtagatcacaaatagatttacatagtagattgagaacaagaagagtggtctacgattgataacaagattcacactagtctgtgaacttaagaagaagcagactgctgtatacaaacagggttcaattagacctaactcacaccatttaagtagagattagacttccataaatcaaagagaattcaattatacctggcaacccctgctgaagataatccaactgcgacttcacacctaaccaatgtaaacatgataacaaaagatcaaaacgaaaatcctatctctgttcaatatttcagaaggcaagaaaaagcacaagaatcaatctccagcattcaggaaaaagaagccttcttggagaaccaatataaagaaggaagcaagatctaacaagcattgaatcaccaatacgaagaaggaatcaaagatctaacaagcattgatccattgtggctaaagattattaccttgttgggtacagagaacaatgggggagtaactagtgatgacagtgagacacaaatctttccttttgagccatgaattagggctttcttcaggtagatcatcgtgaagattgaatgacatcacactcaaagacacactcattgttttgtctcctttcttcttcttcttcttcctctagttttctctcttctttctttatggtttggtaagacgaataaaaacaaaggtctctctcacatcagcagcagctcatcgtcgtcgtgacctacatgattttcaataataagtcaaaagcttatcaatttttatgtgaaaaaacagctcaggattcgaagaaagaaaatcaatcaacataatttattatattatattattgaggaatccaatacgaaccttgttgtttcagactcttatcaacaacaacagtggagaaaatgagtcttggacatttgacgacttttgctggaaaatctgtgaaagtcatgccctttgatcaccaaaagtctcttaaagccatttcctgatacatgtataaatcagcaacttcagaaacaaatcaaatcggaaacgggggaagaagaagaagaagagtaactaatcggaggagggaccggtgaagtcacggtggagggaccggtggagtcacggtggactaatcgtcggctttttggtctctctctagatttttttaaggtttaaaattaatttcagacaagcttcgaacccgagacatggaacccctacagacacgtgagtttttaataaccgttcagaccaaacaggagtaacaacaactgtttgagatagttttgttgaataaccgaattaaaccaaagtgaatacaaaaccgaaccgagatttatatttgtaaagatacgacgacgcctttgacgaaaaaggagacgaagaagatccaaacacggcgctaagctaagctccgttctcctcctcaaaactatccgacaaaagacagaagcagaaacctaaccctaatttccttttctcaaaatccccgaaaggtccgtctctctctctatctatctctctaacttagctctcctccaaattcggatgattacccattacgaatttgcagagaagaacaaatcctctctttcttcttcctccgtctctctacccctttcatgtcttctcaagtctacgactctcatccagggttgttggtgcatcaaaccctagtttttgatttcgcttttgagatttctcatgcttctttcgtttcggatctctctctgaatcagattacgtcttttgggctcttgttgttgttgtgctgctcttcaatctcttctccgttgcgttctatgtgccaaat

SEQ ID NO: 6403 - DNA, 3000 bp, Unknown; identical to SEQ ID NO: 6389
  misc_feature (1)..( 3000): cDNA_ID_1814213_gDNA_ID_1621091_Annot_ID_55521 3000 nt of promoter + ATG

SEQ ID NO: 6404 - DNA, 3000 bp, Unknown
  misc_feature (1)..( 3000): cDNA_ID_1814209_gDNA_ID_1621091_Annot_ID_55522 3000 nt of promoter + ATG
ggtgattggtcaagaataggtgtgatctccaaagaaacagaggaattgttgaagattgctgcttttcttgttgttcctctctgtatcttcctcgccctttcattttccaatgattcaactgattagaggttccttgattccttctatatatagctctgctttatctttcagaaagaatcaattagattagatctttgtatcatgaagcttgaacaatacttgtaggaaattgagtttttgtttacttttgaatatcttggatggtacattgcgtcttctatggggacaaacatacattgatacattgaatgaagtattactaaatgttttacaatgtgttttcgagttaaaaggcacaagaaggagaagcccgtcgaaaatccatgataagaagactggcaacactatgagcaagagctcctaagactacaaacacatggaatatctgatggctatgtcctgcaatatcaaaagccccaggcttccatctttcaggtatgcgggtaacataaaacgctgctcctgttgcatacaacacagccatcgcaagttcatatacgagagctataagcacgtttgggtgatccttatgaaggtaaagcacatgtgtggctggtattacgccagaaaatcccattgttaggaacagagctgctctgaaagatctgaaacgtggagctgagagtgatggagagaggagagtgaagatggcgaggagaccgaggattgagatcgatgagaggtagaagagtcgccagtaagtgtggcatgagaatgcatagtagataggtgcgaagaatgaacagacgatcatgagggagattccagcgtagtctagacgccagaagaagaggttgaaccgtctggagtgacaggcgaagaggtgtgacatggaactgcagatcaagcagcccattgctccggtcaagaacacaagccatggccatttcggaatggcttcgtagttaacatctccttgagaattcaggagcgagcgagtgtgtgtcacgtttaagtcctgccagtagacaccaccaaatcataagtttatgttgacaaaaaaacagcctttcttttcttaaacccgttgaaaaaatcatgttagttggaaagttaggtgagcacaaagaaaatctacagaaaactaaagtgagagaaacatcaaatagttggggcaggttacaagatttatgctaaactaaacaaatccaatcataaagtttgttccttaatttcggtaggaaatcacgtgatttcaaagtaggtgagcataaagagcaagtctagagaaactgaagtatccataaaaaccaaagttaaaaacagaaagatagaaaaaatccaaagagaacatgacatggtgggtgaaagttaccatttagcactactgctaattgcaatcagcacacaacaaaaatgggatttgttatttgaaagcacttatgttgcatgtctactacttaaattagaataaacaatgtcacagaataaaaaaggaagaatctttacgtgatgcagagtttgatcgctggagaagtaaacatcttttgacattgccattgacggccatggccagcgaattgttgctctgtcattaggacccacaaatcccccaaaaagattgaaatttgtttaattttcctcaaaacaaaaaatgacgattttgacctcgagatttttcttacccggagagaaggctaacaaagccggcgaggccaagctccgtcgtctccattgaactcacaaccatcatccaagtaaatatcgcaaatccacacaaatgcctgccaaatttcaaaaccccgtttacaaattttcaaccaagggaaaaaaaaatcagaagaaaacgaaaacatacgtccagatgttgagagtctcattgtgccatgagaaagcgctgaggaaagtttctttgattgaccactcacatcgataatgattgtgtatgaactcgttatctttcaaatacctaggtaactcctcgaacttcatcaatctcttctcagatctcttcttttcgccggaatccatacctttaccatttcttatcttcgtagattccttcaccgttctccgtttctgcatgattcccctccctctctcgcacagctcgtcggggggaaaaggaggagaaatctagctacgaaattgaactccggcgaatcacccaccaccgtagatttctctcttcttctttttattttcagtatttgagaatctgatttgttttttttcgatcttcgtggtatgcttcgtcgcctacttatacggagatgaaacctctttgaattttaaaaacgagcaagcttcgtgacttttatctacgtagcgtctttgaccggtcttttttacacgtgtctcttccttattagtatgttagtttcgccttagtgtgagggaggatacacctgattatttttacccgccgtgtcaatttgaaacaaatattaaagttacagttggaaggtgagaaatgcagaatttgtgggtctctgtttaaacctatagtctataattattaaatcgagaactttgtttttacccctcaagatttttttgttgcctgacccttaataacattgttgagtaactaaaacatatattttcgtttcatttatacgtttcctaaatgatttgataatatggggagtgttgatcaaaacagattaaacgaacgaggtaaattgaaagagtaggtaactttttattggctttatggcataagattctccaaggagggttgattcataagacaagacaacacgtacatacatatctatatttaattggtatgaacatggattatgttattgatttatttaaaacgcgtcaaacaattggatataataattaaaaactgaatgaatggttcgcttaccaaagcaaaatatagttggcccagaattcgatgttggcatgttacgactacattgctacattgttatcatcaatgtttcagattatttttaatttgtactttcatagtaattcaccgcaatg

SEQ ID NO: 6405 - DNA, 3000 bp, Unknown
  misc_feature (1)..( 3000): cDNA_ID_2134086_gDNA_ID_1621091_Annot_ID_55526 3000 nt of promoter + ATG
ctgccaatatgttgtttgattcctaaaatggaatcttttttaggatttattcagttcttttcatagtaatgtggtatcgattagtctgcgtctaagatgaaggttcttactttgtctctctataggaccaggatgttcatctgttgcatatggtgaagcagaagagataggaccatttcacattaaggcagatgggaagactctttaccttaatcaatattcttggaaccaaggtaatgaagtaatatgtgctgtgtatgttggcaagagagctatgattcaaaaaaagcttaaaactttcgaacaacttttttgtttgcagctgcaaatattttgttccttgatgcacctgttggagttggttattcatactcaaacacctcgtctgatttgaagagcaatggtgataaaagaactggtaatgatttagctgcttaagctcatgtcttttagatcctcatgtttgctgggtggatttatagtttcagtgttatgaaattcacagccgaagattcactgaaatttctgctgaaatgggttgagcggtttccggaatacaaaggaagggacttttatatagtaggggagagctatgcaggtaaattcaaagctcatctcattttttaatccattcattttgaccataaatactcatgtgtttcttctggtttgttttaggacattacattcctcagctgagtgaagccattgtaaaacataaccaaggttctgacaaaaacagtataaatctgaagggttacatggtgagcctgtcctcttattgatccccctatgattcattttctaaaaggttataaaactctaaaacaatgttgatgaatgtgtggatgcaggtaggaaatgggctgatggacgatttccatgacaggcttggtcttttccaatatatttggtcgttgggttttatatctgaccaaacatacagcttactgcaacttcaatgcggtttcgaatcgtttattcactcctccaaacagtgtaacaagattctggagatagcggacaaagaaataggtaacatagaccaatacagtgtcttcaccccagcttgtgttgccaatgcttcccagtcaaatatgttgctaaagaaaagacctgtaagtggccttaaaacttctcttttcaatgttacactctttagtgtcctaatttctctgtttattttacttagatgactagccgcgtgagcgaacagtatgatccttgtacggagaaacacactacagtttatttcaatcttccagaggttcaaaaagccctccatgtcccaccaggacttgcaccatcaaaatgggatacttgcaggtaaaattgccttgcaatatcttagaaacttggttttggaggaaatgagcctatttaagtattgtaacaattctgatcccgacagctttggttatgcagtgatgtcgtgagtgaacactggaatgactctccttcctcggttctaaacatttaccacgagcttatagctgctgggcttcgtatctgggttttcaggtctctttctctaaatatatccactgaaagcactttaacgatatcttttcttcaagtgttttggcgttttggtggtaaaaagaaaaggttttgttctttggtaacagtggggacgcagatgccgttgtaccagtcacatcaacccggtacagtatcgatgcactaaaccttcgtcctttgagtgcctatggtccttggtacttagatggacaggtacaaaacaaaactcaagatgagaaaatgagaatccttttcttatgttataagaaaaacttataaacagtcatgatttgaaacaggtgggagggtggagtcagcagtatgctggtctgaactttgtgacagtgagaggtgcaggccatgaagttcctttgcacagaccgaagcaagctcttgcgctcttcaaggcttttatatctggaactccattgtccacacatgagaacagcatcagccgcgacatgtctgaactcgttagtgactcataatgagttctgatttgatgtaatgtgtgatttggattctcaatcaaaaactttccacataggccgttgaaataagaagagggaaagagaataaatcagtgttttaagtgatacgttcaatgcttcttcttcttctggttgtttgtttgtttggataaacatttgctgcttggaatctaataaaagaagtttctaccatttgtcagccatacgatccttgaataacaacaacatattcttgtgtaatgagaaagtgaagtctgatctgtgatgtataggactgggtattaatctggtaacggatataatactggggtagaaaatagaatttagactagtattgggggtctaaacgaaattatacagaagcattgggcttgacttggcccatgagacctaagcccatattttaaagaattaggggtttcttcttcctttgtctgttcaaattgaagaaacctgtttttttttttttttttctggaagtgaattgtcttgagttgaacattgaacttcaattggtcggaatctgcaatttctgaggtaaaggtttcatttttaacctttatttgtttgggttaagatgagatctacgacgttttgaatgaggattcggacggttgggtgtttcaggtttgggctcagtgtcttctctcgcgcgtccctcttcaccttcttatttctacctgtgagtctcacttttcttctctccggtctttagcattctattgaatagaagaattggcatatagctattagctattttcctcagatcgtgttttaggcgactttctgttctcgcttgcttaacattgtacttcagtgtcgaattcatatcctacacatgagtctacataaacattgtgctttatgcttgcttccttagttcctcagaaatccttggaaaatccgcagatttatcttcttcgctatctggaattgttttcttcgtaggtttcttctcgttcatgtgtttttccctattgggataatg

SEQ ID NO: 6406 - DNA, 1432 bp, Unknown; identical to SEQ ID NO: 6386
  misc_feature (1)..( 1432): cDNA_ID_1808149_gDNA_ID_1621091_Annot_ID_55528 3000 nt of promoter + ATG

SEQ ID NO: 6407 - DNA, 3000 bp, Unknown
  misc_feature (1)..( 3000): cDNA_ID_2123319_gDNA_ID_1621093_Annot_ID_55546 3000 nt of promoter + ATG
gttatgagctttcgagggttatcagcagctgtttcccatttaacatagatatctagctgaccgttttccctttgatcgactgagatattgttttcctttgcttcttctactgctagtgcttcggccttattcgtaatagaaaagaactgattgtctttcttatcaggtgatgcaatattggcttgatcctcctcctgtccactgtgttgagacagctctctctgattgccacaaagggtgaaaatgttttgaattctcaaccttctagacgaggctgattccttgtcatctgcaccgttgaagcagttctctttacccaaaccttcagagttcaaactaggcattggtgttgttatcaagcagatgcttttatcctcgactatcactttttcttcctcttcttcaacttcttcttcttcaaagacagtgctcaagcatacccggtcaggatacatctgtgtaagcatattctctgaaggcttcggttgcaaaaggttagtgaagttgctactaatagtgttgcttgattggtgtgaaacagctccccacacttgcttgacaggttctggatcacccatgtcaaggtccattgacttcaccataccaggatcatcatcagagtaaagactcctgagtcttttggcaaacccactagtttcatcaacacttcctccatttgagcggcggaactcaacctcgatttcctctaaccgtctcctcatcatctccagttcctcttgctgctgaactatcctttcctccattctccttctctccatctcaacaaattcctcagccattcttcggcattcttcaagtttcttatctagttccgacttcaaaagctgggttctctcgtttactttctcttttatctcctcttcattggtagcacaagcttccctctgtgttaaaagagatcttaaagcagcaacttcctcttccttcttcttcagctgcttttgtgcctcattcctttctttttctttttgcttcttctcagactggagtttgataatgaactcatccatggcagctattcttgatcccaaaatcacagcagaagcagactcatcacccccatacttatctttgtttggagtatgagacccacgaactatgcactttgcttttgccccatactctagagtacagagagtcttgtgcatttcctttggatccgggctcgcacacaggatcattagaatctttgacttgtcatcttcaaaagagtcctgcattcagagaatagaaacaacactaaatatcttcaagaaaaccaagcaacacgtaaaacattttccagaagataaaacaatggaacaagaatttcacctggagaagcatggtcagcttgctgtctctaaagggtacatgagaatctccatttgctatagattccacaactcgcttcagtgcaatatttccctggttgatcttagcagtctgttgaataatgagagatataagtcagttgatatccataactacaataactttagtagaatcaaacaaattgagagaggaaacattacttgcatcttagcttcaaatccagtctgcccagcttggtctatattttcagaaccagccatgtcaacaagcatcaatcttcccccaacagttggcacatcaagtatgatctacaaaaagaaacaaccacactagtaagttaaaacagagataagctgcataaagctatgcatacacatcaatcaagaagatcgttcttacaatgcagtgactccgagaacttctttcgttacaaagtgtactcttcacaattctccgtttctccactttgacaatttctttagaaatcttcccagcctctgtcccagaaataaaacttgcgtttttcgcctttttccccattacttcaagcctcacctgtaacaaaacaacaaagtacacacctttaaagccaattcaatgtatactaaagttatcaatcaagaaactttaccttagtgcttgctcctttaggccaaccaatacctaaattgttactactattagtcgaaagaagatcataaatctcctcattataaacctcaagaacagtaacttgaacaaaagtaacaccatcttgatcagaatctcccaatatatctctcaaagaacgatacacaatcccaggctctttcccacaaccaaacatagtatgactctttccagcaccagtaggtccatacatcataatcgtgcatttattcccaactttcactcctttaatcctctcttctataaacttcttgtagaactcttcaagaccttcttgctccgagaaagaaacaccgtcgagtgtgaagtctctgtacccaacatcagctctgactcgtaccgtttgattatctgtgttgacttgtaagatcgaaggtgatttctctttccggtcagggtaatctcggatccggccgattacttcaactggatgctccggtggagatggatctttagatccgtctgggtttggggtttttgagtggaaattgagacgttgttttgtttgtggagttctgattaaggtgtattgagtttgatttgatcttgaagaagatggtgtcggtgccattgttgaagaagtttcgaaagagtgaaattgaaattgagattcagagagcgttagagagagagaaaataaaaaaggggattagggtttgtgagtgattcacgaggtttgaagtttgaaacaaagaaacaaacataaccgttgtgttgtatctctaaacggctagtttttgtccacgggccactgattattaacaatttttattttcggcaactagaatatatttactttcttttaaaaaagggaagtgagatgggcctgactttttgattaagttaatgggctttttgtgtttatagaggcccaatgtttgtagtattagggttttctcaaatgtctctcttataagctctgttactttaggtttttattaaaggttttgcggcagtggaagacgacggcacgagcttcaccgaagagcgaaaatg

SEQ ID NO: 6408 - DNA, 3000 bp, Unknown
  misc_feature (1)..( 3000): cDNA_ID_2024882_gDNA_ID_1621093_Annot_ID_170812 3000 nt of promoter + ATG
tatttttttcttaaaggtttttaaattatatattgttgactttattatgatgtgctttaaaaaaaaacaatattgtgattttgtaattgaccatgaatatgagaggttttggaatataacatataggtgaactactagccaattgttagtcggattactggtttaataagatgatcagaacaactaaacttgtaaacttccatcgattacaacaatcttgtgaggctaacttgaagtagttcaccattttggttggtgaacactatatatgtcaatttatgttctctaatatatattttcttgtttggttttctcaatatgtgttgtcgagtcgaaagtgattaattgatcgagctcaagatcttgctattaaggcgaagtaaagattgcaattcatattgctgtatcctaacaaatgtgatggtctcttatcgttctaacatctctctttcagatttatataaaaatatatatattgtctacaaaactcattcatccacatccaaaatttaaaatttggattattacacaaaagtagataaaccactagacaaataatatctagtcgaattaattaaattactcgtctaaattattagctttttagatatatatatctaaactaaggactaaagctagttagtgtaaatttgacttttttttgttctttgaaactatgtgtaatatctatttttttgtaaatgcaaagataatcgagtaatgaacatgaaaactactatattataaggaaaaaaatggtatttaaataaaaaaatatgaatagtgattgaagaaccgtacaggttatgtttgtgcagggagaggggtcgcgagtgcgtgggtcgggtacagaggatgagtcagtgagtcaggacctgtttccccctttgtagggacacttttaccatcctttaatgggcctattcttttcataggcccatttaaatcatatcagtcagtctttttcttgggcctcatctttgttttgtggttcttgcgatttgaactatctgatggtgactacaattggacgaccgcagaacaacccaaccgtatatgctgtcttttgtgggcaaatcttttttattgatatggattgtctcaaaataagtgatagaagtccgatataaagcataaaacaatctctcatgatcaaccattaaaagaaataaactagcaacaacccatgttcctcttactgacatacatacacatatagtcaaagatttatgcaataatttggactttattaaaaatatttacaaaccatatagacatatatatagtcatttttgatatcttggtttcaaaatctttctagatctttagttccaataaactttcaatttaaaagcggttttctaaaaatccgaagttggccaagtgatatattagtcctgtccaaactgacacaactcacgaatgtggtacgggttgaaaagccttaggccatgttcgtgaggtaaagatactcgcggtcgatcaactttggggaacgaattcgttcttggaacttttgttgattgattacgggcgtcatacgtgacgcccctgttcttttttatttttaggacggtttgggggtgttacaagagtggtaccaaaagacgacgaatatattgactcatatcttttatatcttagcatagtttgctttttcacttttaatgtgagaattctaacatgcacatttgagataatgaatcattttcactcatcgttttggatcgaacctcgttttgtttttggtttggtcataactttttaacttgaaaaccacttgagagtgagtcgactgatttatatactccttatattttactttatatcccatatttttttatgatgtaagattcttaacatagtcaagtactcataatgatctagtagttgaatgatttacgatgattcgaatcattctacttcgattgagggtgtacactaattagatcctattatatatgatataaactgatatatataagaattattatataatgcaaaaaatgatcataagacggacggtgtatatttattttgaatataatacaaaattatcatatgtccaactccagattcgtgtgcatgtctctacgtatctccggatacgatcatgctataagagtcaagacccctacacgatatgacaaaacgagtaggaaaaacgtgacaccaaaagatattaaaaagctgaaactaatatatagaaatgaaaatgagagatacatatcaacattatacaagaaagaaaatgaataaaataattgtaatgtaggactgaaaacctaaaaagaaaaagaaacatcaaaaggttgccaaaataaaaaagtaacatgaaaataaaacctgaccagaaatttccataaagcccaacctatttattttgcctacactctgagccccactcattagttgctcaactattttaattccttgtcataattgttatttaagaacctttataactttcactttcagggtatataatctctatggatttaaatggagaaaaccccagtgaccatagtttgatttaaggaagggaaagttataggaatggattatgaaatattataaattttgcatattaatgcaaaatatctatctttataaaacatacttttaaaaatatataatgttaagaaacaaaaggaggttaatattaagtgaagactctcactaaagtatacaaatgaagagatataaaaagcaggataaaaatagagtcaaaaagaaagaaaacaaaaacaagacatagcaatttgaatttaatatttggattccaaatccaagctcatgggtctattctactgttcacagtcacacacacactctctatctaagcttcttttgacttaagaccaaaatgaataaccccaaacctcaaacactcaaacataaacccaaaaaatctctctcacagagaaaaataaaacacacaattttaaccacaacacttgtctctctgctaacatacgcatcctctccggttcttgacta

SEQ ID NO: 6409 - DNA, 3000 bp, Unknown
  misc_feature (1)..( 3000): cDNA_ID_2105089_gDNA_ID_1621093_Annot_ID_170811 3000 nt of promoter + ATG
taaataccatttttttccttataatatagtagttttcatgttcattactcgattatctttgcatttacaaaaaaatagatattacacatagtttcaaagaacaaaaaaaagtcaaatttacactaactagctttagtccttagtttagatatatatatctaaaaagctaataatttagacgagtaatttaattaattcgactagatattatttgtctagtggtttatctacttttgtgtaataatccaaattttaaattttggatgtggatgaatgagttttgtagacaatatatatatttttatataaatctgaaagagagatgttagaacgataagagaccatcacatttgttaggatacagcaatatgaattgcaatctttacttcgccttaatagcaagatcttgagctcgatcaattaatcactttcgactcgacaacacatattgagaaaaccaaacaagaaaatatatattagagaacataaattgacatatatagtgttcaccaaccaaaatggtgaactacttcaagttagcctcacaagattgttgtaatcgatggaagtttacaagtttagttgttctgatcatcttattaaaccagtaatccgactaacaattggctagtagttcacctatatgttatattccaaaacctctcatattcatggtcaattacaaaatcacaatattgtttttttttaaagcacatcataataaagtcaacaatatataatttaaaaacctttaagaaaaaaataaatttgggtagggtttggtgagtggtgtcgatagaaatggcggatgcatcctttagattaaaggtatggtaccaacttggatccatttcttcgataacgactcttcctatttccactctgttttttttttgtttccctcttctatatctcatatcttccactactctcaatagtcaattctatatcccaatttttatgttaagtttttacgatttacaagttattggcaaattgaaaattgctgtcaacttgctagagggtattgtaacagtactaccaaatatgaggtcgagtcttaagtgctatatatggagagagatgatttacgtttgtggaatcgcaataagtatatattatcaaatgctagtccatggacataaaactatgagccaaaaattagaaatttctggttaacaataacaataaagaaaaaaaaaatggtatatgcatatacagtataaggtagatagttttgatttttgaagaccattgattaatattatatatttcaatatcaattgttggtaagttataaaaaccttcaaacgagagtgaattaacttcaaagtcacaaagttcgactttcgatgttaaaaaaaataaaatgtttacacgttccattctcttgttcaaaaaaattatggatcagtattccaaatttcatagtaatctaaaaagaaaaagttgcattaatatggtttgcttatctaatcatttttcgggacatcaccgtatgtatggatgacgaaactatattttaaaaagaagttttcaactgttcgtttattcatgcatgtatatcttgacaattacgacattggatgaattgagtgatgaatccttatcgtacatcacgagtataattacatgtatcatgcattgttatcaattatcactttatatattggataatgagaagggatgtcacgcaagaccaagcaaggtttaagggagaatcgatattggtcagactcatgtgaaaatatatttctcctccttcgtcttgtcaatttattactctatctcttgtatttttcaattgttttggtattcacttcagaaaatgactagtcttcgtttttatgtgttgagccattttcatttacatgcatctaaatgatctactgaatatggatatcgaagagattttttagtataatggtttgtgctagatcctttaacaaaaaagtaaatggtttgtgctagtgtttttgttgtattgctaatttgctatccaattcatagcacacatgttgttgccaaacaaatgctaaatccattttaaaagtatcaactagtaaattagcttaacaaattttttgttaacatgtttatgagatgtttttttaagaaaaaaaaaactcatttaacatgattacatttagggtttgattggttgttttaaactgaaaattgtctgtttgcaaaaatgtttggaatgattatctttttgcaaaaattgcgtgacatgttgaagtgttgcaatgctggaggttctgctaactaacaagtaataatcgtataagtgacatgatcttccattttttagagatactaaccaagaattgtaaaaccaggaaaaaaacactaaccaagaattgatgattgtccatctagactaaagtagtatacaaacaaaacacaaaagatattttgttctatttttggaataactcttatccatttatagaaataattagttgtttaatcaaaatatcacatgcaaattgatcgtatgcgattttagataaattgacatccactcagtaataaacaaacaagatactctctgattacaaaataatctctgttttctttcgtgtcatttttctttatcactcatgctattattatatttaaatttaatataaaactgttaccatttactattttatttcactgtttgacgcgaaaaaaataatcagcataagatttacccaaaaaataaaaaataattgggatacttaagcaatgcatgattaggctataatctagagagactaataggatgcttacgtggcagtctagggagcttcgctgctccaaaaaccattcccctaaaattgaagcccatagactattagcgacttcactctttctctttctttctctctctctctctctctcgctcttctaattttgccctcaaaaccctccaattattacgaaaacgccactgctctctcgtcgggactccggtgaggccgttttggccggaatctgacaagggatatg

SEQ ID NO: 6410 - DNA, 3000 bp, Unknown
  misc_feature (1)..( 3000): cDNA_ID_3593510_gDNA_ID_1621093_Annot_ID_170807 3000 nt of promoter + ATG
acgtgaacattttttcgtcctgaactcaaaagtatcaattacacacttcacactactaatggtcaagttttttcgtatttgaaactacaaatgtaagtaatatatgcgataaatttattatcctctgctagtaaaatccattaaaaaaaactaccaatgtgggtgtatgttttctttcagtatatataaagagttttcgcagagagcacatatcgatggtggtacatcaaatctgatcattcatatctaaataattgttgttgagttttctatatgtgtggaacgttagattgcttaagctagaaattgacacaagagtttgatcaccgagttcctgcctcctggcctctaaccggtacgtctcgggtgggaactgtctcccacaacttttcactatcaagcaaaaagtattacaagcactaatagaggtttctcttctccttgttacaaatttagaaattaactcacacacaaaagacaatagaaaaggagactataccgacacgaagactatgcccatatcttcacaattgtgctattatttaccgttctaatctggaaaaaaaaacagcgcacgtaggagaattgggcacgaagacatgaatgggacacataaaggatcaaaagagtcatcatgggtctgccatgatgaaagttaagaaagttccaatacgcgcgaaacaagattgaatgcgacttctctctataccaaaaacgaatctcccaagtcccaagtgaatattgtgagccactaacttgttattaacattttgagacaaaaaaaaaatttgtacgtgtttttgccaaacccacttggccatgaccaatcagaaaaagacaaggaagatgtgtatctatgtgtaatgaggaggccacgccatcagtttacttgcacttttccaactagacgtggcctctcaccgatctcaacctcactttcctctcatttctcaaattttattggctacgtgtttttgtgtttagcgttcaacccaaatatcgatatattcttctttttttttcacatttttaacgatttcgagcaaaataattcgatttatttgtataattttaatatggtagttttacaaataatgaaacgaatgaccaactgatttgttaggtgttacaataaatatggaaaaaatctcataagtttgaaaacatttattctgaggaaactttttcttccccaaaagaaaaaaaaagtttaaagtggaaaaaagaaaaaaaaggaataaaaagtttgaattcagtttttttcttttctttgatagatttctttctacttatttattactctactacacaccacacaaaaacaaaaataaaataagtaatcatagtatcccataaatcagtaaagataaataaaatccagaaaatactgggcctatcattttccttcaccaactctataaatgaagagataatcctacagttacacctcaaaccaactccatctcacttctcaagtcttataatttattcatttctctcttcttcatcgatcttcggcttttagaaaacctaatcagaaatggcaacggcgtcgtttaacatgcagtcagtgttcgctgctccttccggtgtattgactacacgcaacatcagaaacacaaaccaactcttcttcaagaggattgctccggtaggagtcagatgcatggctcaggtatatatacactaacctcatagtccttccacttccctacgttacttatttgacttttaatcctgaccgttccttacattgactatttttttagggcgatcctatcaaggaagatccttctgtgccctcgacctcgacttcggccactccaccacaaatgccacagtctcctcctccaccagttagcaagcctaaggtatgatctaatgatcaaagtcattaatatatatcactagctaaaaaaatgaagctaatgaataattttcttattgtctaggtgagtacgaagtttggagatttgctagcgtttagcggtccagcacccgagaggatcaacgggagactagcaatggttggattcgtggcggccatcgccatggagttatcaaagggagaaaacgtgtttgctcagatctctgacggtggtgtcgggtggtttctaggaacaacagcgttgttgacgttggcatcgatggttccgttgttcaagggaataagggcagaggcaaagtcaaaagggttcatgacttcagacgccgagctatggaacggtcggtttgcgatgctcggtctcgttgcgttggccttcaccgagtacgtcactggtgggactctagtctaaagctaaagctttttgtttgctagtttaaggacaaatttggagaatgattatgtaacgcatagattgatttaatactatgagttttaaacagtgtgtcaacatgaatcaaaatttaaaaccatgaaaaaaacattataaaaatttatttgaaaaagtacttcaaaagttttcttataagataatgtgaatggagaagaagaagtaaaaaataaattttagcttctatccaaggtttgagagtttatgcattcttttgaaatgaatcaagagccaagaataattaattatgctcttccttgttattatcgaccaatagagtcatcatgtgtctgccataatgaaagtaaagcaagttccaagacgaaacgaaattgaatgcgatttctctctaacaaatcacctcatctcaattctcaagcccatgggttagtctcatcaaagcccaatcaaagcgtcaatgcttcccaagaacaaaaaaaaatatattaagatgaacaaacaaaaaaacacttaaaagaggaaagatctggccactacaacactacacgatagtacgatcgatgaatataatcggaaagatttgagtggctcaattacatattgcttatacgacgtcgttttgagtagcatcatttcgttaatatttatgtaggagactgaaacaagacagagaaaagagaatctccgaggaaaacaaaagttg

SEQ ID NO: 6411 - DNA, 3000 bp, Unknown
  misc_feature (1)..( 3000): cDNA_ID_3594344_gDNA_ID_1621093_Annot_ID_170806 3000 nt of promoter + ATG
agagaatgagaatcttcgaaagttcgaattttgaagtggaagatgaagtgtgagtgggcttttatagaccaatgtgattagtttcgtaagaatattgatattagaattaggaccagttcaaaaatcgaacattatccaagaatacgtcgatgttcgaccagcactttgctcatgagtcatgacgatatcaacttggcaaattaatattgtaatcacgtgaaggaccatgcgacatcatcatcatcatttgtggggtaataacataaaactaatgccggcttaagaaaagtgtgttcatttcttaaacttaaatcacatttggaggactcattatagagctcatcacctttgacctgactttatcttgacctgaagctaccaggaatttatatctgaacttttgtttcctttttgacggcgaaataatttgtttagtataagttttgtccattctttacaggtcaaaaacataattaatactaataacgacgatattttaatgtttcctcttgcatgaaaaagcattgaaaatgacggagttgattcactttattggtggctgctttgggctcacattcaacatgtgccaattaagaattctgagggtcgacctacccatcctcattcactcatagcgacaattcaaaacagatctactggggctttaaataagggtaaggccttgttccgaactgggctttagtaagatattataacatttctgttccaaatacagtacatcaaaacttgaatctaacttatatcaacttcaataatcatcaattcatcagttaaaaaaactccttctttcatggtttagtttatcaaagatatgcatttgatttataagaaaacccaaagagtatttgttacctagtcgtccccgggtttcacggggttacaataagagaaacaaaatgggccacataatatttatttatttagtgattctgtcgtttaaaaaaaaattagtttaacacattgtcaaagtttgaactaaggaacttgtaactcaaatactgaaactttaaccattagactacatttttatgcaaattcggccaaaactaaataataatatgattagcggccgcaagcttatgttttgcttgcttggccttgtggccggctaaataacctaagtatataatcaataaattacataaacgaccggataaatcagaacttaattataatgttaaaagtaattaaatgaatgatgaccctcgtcgtctctcctcttaaaacacaataatctcataaatacaatttttatatgaagtcttcacaaactactataaatttcccaaagttgttctctctctttgtccactcgaagactcatggggataagaaggcactcgtgttatgggcttcggggctttttattgttcgccctttcgaggaccttctcacatgtttggacttttgagtctaaatgccttatttcctcacgaatgacgtgaacattttttcgtcctgaactcaaaagtatcaattacacacttcacactactaatggtcaagttttttcgtatttgaaactacaaatgtaagtaatatatgcgataaatttattatcctctgctagtaaaatccattaaaaaaaactaccaatgtgggtgtatgttttctttcagtatatataaagagttttcgcagagagcacatatcgatggtggtacatcaaatctgatcattcatatctaaataattgttgttgagttttctatatgtgtggaacgttagattgcttaagctagaaattgacacaagagtttgatcaccgagttcctgcctcctggcctctaaccggtacgtctcgggtgggaactgtctcccacaacttttcactatcaagcaaaaagtattacaagcactaatagaggtttctcttctccttgttacaaatttagaaattaactcacacacaaaagacaatagaaaaggagactataccgacacgaagactatgcccatatcttcacaattgtgctattatttaccgttctaatctggaaaaaaaaacagcgcacgtaggagaattgggcacgaagacatgaatgggacacataaaggatcaaaagagtcatcatgggtctgccatgatgaaagttaagaaagttccaatacgcgcgaaacaagattgaatgcgacttctctctataccaaaaacgaatctcccaagtcccaagtgaatattgtgagccactaacttgttattaacattttgagacaaaaaaaaaatttgtacgtgtttttgccaaacccacttggccatgaccaatcagaaaaagacaaggaagatgtgtatctatgtgtaatgaggaggccacgccatcagtttacttgcacttttccaactagacgtggcctctcaccgatctcaacctcactttcctctcatttctcaaattttattggctacgtgtttttgtgtttagcgttcaacccaaatatcgatatattcttctttttttttcacatttttaacgatttcgagcaaaataattcgatttatttgtataattttaatatggtagttttacaaataatgaaacgaatgaccaactgatttgttaggtgttacaataaatatggaaaaaatctcataagtttgaaaacatttattctgaggaaactttttcttccccaaaagaaaaaaaaagtttaaagtggaaaaaagaaaaaaaaggaataaaaagtttgaattcagtttttttcttttctttgatagatttctttctacttatttattactctactacacaccacacaaaaacaaaaataaaataagtaatcatagtatcccataaatcagtaaagataaataaaatccagaaaatactgggcctatcattttccttcaccaactctataaatgaagagataatcctacagttacacctcaaaccaactccatctcacttctcaagtcttataatttattcatttctctcttcttcatcgatcttcggcttttagaaaacctaatcagaa

SEQ ID NO: 6412 - DNA, 3000 bp, Unknown
  misc_feature (1)..( 3000): cDNA_ID_3090079_gDNA_ID_1621093_Annot_ID_170805 3000 nt of promoter + ATG
cttgagaagtgagatggagttggtttgaggtgtaactgtaggattatctcttcatttatagagttggtgaaggaaaatgataggcccagtattttctggattttatttatctttactgatttatgggatactatgattacttattttatttttgtttttgtgtggtgtgtagtagagtaataaataagtagaaagaaatctatcaaagaaaagaaaaaaactgaattcaaactttttattccttttttttcttttttccactttaaactttttttttcttttggggaagaaaaagtttcctcagaataaatgttttcaaacttatgagattttttccatatttattgtaacacctaacaaatcagttggtcattcgtttcattatttgtaaaactaccatattaaaattatacaaataaatcgaattattttgctcgaaatcgttaaaaatgtgaaaaaaaaagaagaatatatcgatatttgggttgaacgctaaacacaaaaacacgtagccaataaaatttgagaaatgagaggaaagtgaggttgagatcggtgagaggccacgtctagttggaaaagtgcaagtaaactgatggcgtggcctcctcattacacatagatacacatcttccttgtctttttctgattggtcatggccaagtgggtttggcaaaaacacgtacaaattttttttttgtctcaaaatgttaataacaagttagtggctcacaatattcacttgggacttgggagattcgtttttggtatagagagaagtcgcattcaatcttgtttcgcgcgtattggaactttcttaactttcatcatggcagacccatgatgactcttttgatcctttatgtgtcccattcatgtcttcgtgcccaattctcctacgtgcgctgtttttttttccagattagaacggtaaataatagcacaattgtgaagatatgggcatagtcttcgtgtcggtatagtctccttttctattgtcttttgtgtgtgagttaatttctaaatttgtaacaaggagaagagaaacctctattagtgcttgtaatactttttgcttgatagtgaaaagttgtgggagacagttcccacccgagacgtaccggttagaggccaggaggcaggaactcggtgatcaaactcttgtgtcaatttctagcttaagcaatctaacgttccacacatatagaaaactcaacaacaattatttagatatgaatgatcagatttgatgtaccaccatcgatatgtgctctctgcgaaaactctttatatatactgaaagaaaacatacacccacattggtagttttttttaatggattttactagcagaggataataaatttatcgcatatattacttacatttgtagtttcaaatacgaaaaaacttgaccattagtagtgtgaagtgtgtaattgatacttttgagttcaggacgaaaaaatgttcacgtcattcgtgaggaaataaggcatttagactcaaaagtccaaacatgtgagaaggtcctcgaaagggcgaacaataaaaagccccgaagcccataacacgagtgccttcttatccccatgagtcttcgagtggacaaagagagagaacaactttgggaaatttatagtagtttgtgaagacttcatataaaaattgtatttatgagattattgtgttttaagaggagagacgacgagggtcatcattcatttaattacttttaacattataattaagttctgatttatccggtcgtttatgtaatttattgattatatacttaggttatttagccggccacaaggccaagcaagcaaaacataagcttgcggccgctaatcatattattatttagttttggccgaatttgcataaaaatgtagtctaatggttaaagtttcagtatttgagttacaagttccttagttcaaactttgacaatgtgttaaactaatttttttttaaacgacagaatcactaaataaataaatattatgtggcccattttgtttctcttattgtaaccccgtgaaacccggggacgactaggtaacaaatactctttgggttttcttataaatcaaatgcatatctttgataaactaaaccatgaaagaaggagtttttttaactgatgaattgatgattattgaagttgatataagttagattcaagttttgatgtactgtatttggaacagaaatgttataatatcttactaaagcccagttcggaacaaggccttacccttatttaaagccccagtagatctgttttgaattgtcgctatgagtgaatgaggatgggtaggtcgaccctcagaattcttaattggcacatgttgaatgtgagcccaaagcagccaccaataaagtgaatcaactccgtcattttcaatgctttttcatgcaagaggaaacattaaaatatcgtcgttattagtattaattatgtttttgacctgtaaagaatggacaaaacttatactaaacaaattatttcgccgtcaaaaaggaaacaaaagttcagatataaattcctggtagcttcaggtcaagataaagtcaggtcaaaggtgatgagctctataatgagtcctccaaatgtgatttaagtttaagaaatgaacacacttttcttaagccggcattagttttatgttattaccccacaaatgatgatgatgatgtcgcatggtccttcacgtgattacaatattaatttgccaagttgatatcgtcatgactcatgagcaaagtgctggtcgaacatcgacgtattcttggataatgttcgatttttgaactggtcctaattctaatatcaatattcttacgaaactaatcacattggtctataaaagcccactcacacttcatcttccacttcaaaattcgaactttcgaagattctcattctctccactacagcaacaaattcacattcctctctgttttttttgttttcgattctccttcttcaatg

SEQ ID NO: 6413 - DNA, 3000 bp, Unknown
  misc_feature (1)..( 3000): cDNA_ID_2123057_gDNA_ID_1621093_Annot_ID_170788 3000 nt of promoter + ATG
ttttgattaataatagttcaataatatgagtactaattattaatttaaaacacaaatgttgtatggaaaaacaaaaacaacaactaaaatgacaaaaaattgttcaaccatcttataaactttaaacgtagggagcattactttatacttgttgtaaaaacgataatgcttattggtaaaataacccatatacattttgatttgtcaatatgttcatatatgatctagtttttgttctcgttgtcgctagatagacaataaaatttcttagtggacagtgattgtggaatgaatatacgcccaacacaaatataaacatcaaattaaggtgcatgcggtatgggaattgcaagttaaatgaacatagttatgcgtaatttcgagaagggattaattgtattaccttgctcgaaataccacatgggccgtgtccccaaaagcccatttaaaatggtttttttttttttttaaatcatctctttagatatttttttcaactctttttcaacaaaatatatagtttcatatagatatttgtatttataataaatgttaaaatgaaattttacacaataattaaaataaaataaatagaaaaaatgttatttgagacagcatatcacatggccttaccatacttcctgcatccattattccattaagaacactcttcaccctcatccacatgcatctccctccccaatttatttactattgatcataattgtacaaacctatacttacaatttatatatgtgtctacgagaaaataaataatattttacagtgttttgtctattattttgttctatagtttcttgcaaacaaaacattacttttcacgcaaaaactgtcgaaatatttataaaaggaaattgttaattcttcgatacaaattgaccattaatatttgatcatctattctagacatctactctaccatataccaaacctttacacaaaaatgaaatattttcatgaaaactaccccacaactggggtgatcgaaaaagcttgatctatatgatcaacatgtccaacactagtttcattttttctactatgatatccgatgatccaatctgaactatacaaaatgtatctagatattttcttgaatcaatccgaataacgaatagttgcaaaacataaacctagcgtgatcgtgtggtagaaggacgaaggtcgagaagttctcttactcttatgattttctctttactcatttgaccgtaagagaaagaaacggctaggatctcgcgtacgcaactggcggagacaaatcaggaccgttgaaaataagaaagaagccgcgtccaaaatctttgtgtcccacctttgtccccttgcctctaacttgcctcctcatgctccccgacaacgtcataattcatatctctctctctctctcgttaaccctaatttcaaagcatctttccttatataaatctctctctctccctcaccattacacaacacacacaagcattttcaaggatatcaaatcacaatcccaagaagagcaataacaagagaagaagaagtagttcaagaattaaggaagagagcttctccgttaaagtatagtgagagaatatggaagtcaccaatgggcttaaccttaaggacacagagcttcgtttgggattacccggagcacaagaagaacaacaactagaactttcttgcgtcagaagcaacaacaagcgcaagaacaacgactcaacagaagaatctgctcctcctcctgcaaagtaagttgagatctgaaagttatagttttaatatccaaacttcttgatatcaatcggtgtactaataatgaatcttgatttgtaaacttcagaacacaaatcgttggatggcctccagtgagatctaaccgtaagaacaacaacaacaaaaacgtgagttatgtgaaagtgagtatggacggagctccatatctccgtaagatagatctcaagatgtacaaaaactatccagagcttctcaaagcactagagaacatgttcaagttcacagtaggtgaatattccgagagagaaggctacaaaggatctggatttgtacctacttatgaagacaaagatggagattggatgttggtcggtgatgttccatgggacatgttctcttcatcttgtcaaaaactcagaatcatgaaaggatccgaagctcctactgccttatgatccattgtctcaaaacaccttttggtcgaggcaaaaacaaattctactttgtttagataaaaaaaagtttggtgtaaagaaagaaaaagcaatagggttacaaatacgttatatagatgtaaactagctttggttaattctgtaaaagatgagttttgattatacgaagtttatatgtatgctcaagatatttgatactaacataaccaataaagtttagtatttgatactaacataagtttgggacatagtgaaagatataaaattttggattaagaaatgggcaatgtaatggatatcactatcgaaagttttcaacttttttttgttttgtttaatattagatggcgagaatctttagtcactacccaataacttgctccaccaatttgggatttgacttgagctcttctcatcgtcatcttcgtcgccttcttttccgatctactttcatcactccttcactcactcagtctccgtaagctcttcttcttcttctctcagtctctgtttttcaatccgaaaattcattactttgatggtgttaccacgaattgagaatcattgatggtattgctttgatgggtatcgtttatatgacagtttttaatccgaaagtttattactttgattggttttttgtttgttctgttttaacgaatttgaagccaatcatatctactaagaacttgattggtttagagttatggatgatgaatctgattaatggaattgttttgcaatcattagtgatttatgagatacttgtttcagttacaagaattggattcgaagatttgtagct

SEQ ID NO: 6414 - DNA, 3000 bp, Unknown
  misc_feature (1)..( 3000): cDNA_ID_3048343_gDNA_ID_1621093_Annot_ID_170776 3000 nt of promoter + ATG
atgactaaatagtgctgaattgctgatgcatgatgaattcgtttggagttaatgaagattgagtagtgctgattaagttgctaactagtagatccaccgtcaaaataaaaccttcattttttcttaagtattgataaatttatctttatgaaatcactaattattctgacaaatccaatgcactttgggagcttgaaaagccgcaatctcgttctcagtcactaactgtaatgtagcataggcttccactaaacctaattaacgaaatttggaccaccaaataaacaaacgaaattaatactaaccatttgtagtaaaattacacctacaaatctacaacatcctgttttcttataattgttgttttaaaatctgtacgtcacaatatatttaaatattataatttctaatatacctgtcattaatacaattttcttttctgcggatgaacttttttataatatttttttcttcacaatacaaataatcatttagtcataaatcattttgaaattactagtaaatgtttgttccctatcatctacttgccacacaattgatagatattaatcattttcgtatagctttatatatgttttttttattattattgtacattatgttgagtttaaatagtgatacaacgatactaatattaagtattagtattactatatatgttttgatcatatttttaaactaaaaattgattaaatatgcaataaataaaaaatgttaacacctaataattcctccaaattaaaaaaggattctttaatttagcttcttaatgttaaagacggactcatccaaaaatcctcttcttctttatttttgatgagacttcctaccaacaaaagaatcatttgttaccgaaaatatcagttaacttacaattggttggaatcttaaaatgtatacttaataagctgattcgtgtgattgaactaaacaaaagatttccatcaagtattacatcattgcccacttcgtgattgcattagtaatatatttacttgtttcaaacataaagtaactttaaaagaatattggtatatatggaaaaatccaaataaagccataaaggtctatagttaatcctagtcacatcctattctgtatattttctttaacttttattaattaaacataaggaaaacttaagttttgtctttaattaaaggcctttaattggataataatcttctaaccccacctacttgcttgaaacaaaaacacataaaaaatcagtttctagaaacttagaaaagtaagtgtcatttacgtttatcattagcaaatcaaccggatgaacgtatattaaatattgaaaaaacatacaatcagattattaatttgagtcccactattcaaaaactaaaataaaaatacaatcattcattggtgtaaataaattatttttggttgtgatttttcttataaaaaattacaagtaaatgagtaccaatagcctcattaaaaaagtatttataaaaaaaaaatcataaaccaaggaaaatcttgttcctttttatatcaattttctgtatacatatttaaattgccctgtttagtagtattccatcagatataaaactttcatttattcgctatgtcacaactattacagtagtttttctggctgaatttagacacttttaaactgagaactgaaaaatttatagagattagatagtcaaaatatattttttaaaaaagcttacaataaacaaaaggaaagattgttgttaaatttccaaggaaagaaatatgggaaaggcgcaaaaaaagactgaaacaagaaaaagacaaaagaggaaactgaagctttgaccgatacaacatctcccacgtgtacatgcttttcctcccgtaaataccgggcaaccctctcttcaaaattattttatttttacataaaaactgcaacatttagtagtataaattaaaatgaaatacataaaatgtggttccacatcttcttctttttttgttcatgatatcttattcacataataaactttttctttttgtctcatcgtatgttatcttctaaacttagttgaaaaagcttaattatgtaattttagggcatcttcatcaatgagaaactcacaaaatttctcaaacaaaaaaaatattaatattatattataatttgattatttgattaaaaaagtatttttgttaaaaaattgaaccaatagtgagatgagaattatcatgatgaattgtatagagtatctcggagtttctcaagtgagaaactttgtacactctctctccttcattttttttatttttaattttttaattgtgagaaactcttatgagatactcccaatggagatggtcagtttacctacaaaacttagttgaaaaaaacttgttatataagtggtattttattgtcaatgtgtaaattactattccatttctactttttttgtttcttccgttccgttgaactgtacactattctttatattacgtattatggatttatggtactagactactaggctatcggctatgaccaaattcacattcatatataactccggtatcccactgttgtttatgattctataaatatcaccaaagttcaaaatccaaagttttgggactagctagaaccgattgggtggtcagttagtcaggtttgtagaaacaagatgaaatatattggaattagtattttgtgcccaacgtattcatctattttagcccataatcaaacccccagattgcttatttgggttggttttaaagtttagtgatatttttgtttactgcataaatgattttgagaatacgtttagtgatatcaaaatctgattttgagcagatgtttatggagagtcagattttgatatcactaaatgcgtttgacaagctatgcaacacgttcagggccgggtagagtttcatgtagaatcgacgaatttctgatatagggtttccagattcttcaaaatcattgtaaaggaccaaagttat

SEQ ID NO: 6415 - DNA, 3000 bp, Unknown
  misc_feature (1)..( 3000): cDNA_ID_1814389_gDNA_ID_1621093_Annot_ID_170773 3000 nt of promoter + ATG
cagtcccttaagcactgctaagtcgagaccctaaatgtatctttcgagcatcgaacgatgatctaatgctttcgaaaagtctagatataaagaaattgaacttagtttttagttcctagatatgtattgaaattgtagattaagaacattctctccagcattgctatcactagaccctgtataagtctttcggactcaacgacaaggatcgagctatgatgtaatgccttagaaaagtctagttatgaaaacaatgccttttttgttttcactcttgtcaaatctagtttgcaataacgcttgcctgagatgtaagttggtaataatatcttatcaggtgactggagacatacatgaagaagttgagaatcataaccgcttgcttgacaaagtggtaagctgaaagtttgatttcatctgtttcagtttgtagatctctatcacatgcttttcttctaagctatttgttgttgtatctctaggggaacaaaatggactccgcgagggggataatgtcgggaacgatcaaccgcttcaagttggtatgtaaataagatttcgtaccttttatatatgcatcaccccttttgtttttcgctatcaaaacttatatctgaataaaactcgattttaacacgacaggtctttgagaagaagtctaatcgaaaaagttgcaaactcatagcttattttgtgctcctgttcttgatcatgtattaccttattaggtaaaatacacttcttcttatagttatcaaaacacttgacttttcttagggactggttcaagtccttgttctttgactcgaacactgacaatctttcggattttgcaggctattaaactacatcaaagggtaaatttggatacaagaagaaagtagagtgttaaatgaatagtttcgtttgggacttccatttttggatttctcctgatgaatgaatgattcagacatagtaaacaagtcaagggaccctattgaaaccctattgaaaccctattgaaacaagacaaagaaagagattgtgaagagactagtgaaccaaccgaaagaaaaaatgtttgatagagacttgtttgtcacaagcaaaatcatctcatgtcatttcatgtaatgtagcaaaagcttctttatcatttgtcaactatttgatcttgggttcatgttagcagttttgtctacaaaaagcttaattgattgattgataagcttaattattagctttctgtgaaaaaaagtttagcactttgtaataaaaacaagataacttggcgtcttgtttccaaaaatttccaattttcagaattttaaggcgcaaataccgtcctgtatattgacattttgctaaagatccaaatacgtaacaacatgagaaatatcatttttgaacgactcgcaacaattccacaagttgacaggacactactatgcagaagagtttgattttttttccactttaggtaacaagttgacaataatcgacaagttcatttttggtttggtaatagacaacaagttgacatgtacatttccaaatggttcggtttctaggtcaaatcatcttaacaattatgtaaactatagtcttaaatgttgaatttacgagtgaataacaggttgctatgctaaatagtaaatttcttgaaactactgtttagataaatagtcaaataaccatgagttttaatatagctactagaggataacatttgagttctggcacaatatatagaaaaaaagtaaaaaaaaaaaaatgttaccttattaaatcgggagtagtttttcaatttcttctgatcttttagtatatgctaaaataccatgttagtaaatatgaatgtgatttttgtaaaataaatatattataacacaacaacagatgttatgctacatatattaaacagggtgctagattataaacaaaagtgttttggattcacatgaaaaatatgtgtaattatttgaagaagttagatatatagatcattcaaaaaatagtaagctacatggttatctaatatactgttggtagtgaatccatcaacctaatcgtgacatatatacaatgtacaatcgaaatcgtttctaagaaagccgacgaaatactcagcctttagaaagactagtatacgacatgtcctaccaccctaattactaagagaaaaagattcatgatgctgcgggaaatgacttgctttcttcaattaactcttcattcgagctttggttgctctagctcacaaattatcgtcgtagttaattgaatatttacaaggagctgactaaaaaattaaatgtacatgcacatacattggagcacgcccaccatggctatgctaagcatgctctcttagcagaagtgacacctctcagaagctattgggccataacagagttatgacacgggtcatatccgtcaaaagcacattgcttctagaatgcgaggtatgattgctaaaaacacgatcgacaaggaactcaagaacatcaacttgcatattgaacctacatacatgccgtatataggcatgtgcgaggagtattaaggatataggactggttaacttcggttatcactggtttggttgaatgtggtttactaaccacaataatcttatgtatataagtttaatctcgattactttgttagttaagttggttgtaacaacactttaagctgaataagaaaagttgttatcttcttcttcgtctctcttctccgatcttgaatctccgatgtatcggattttatcatggtatcagagcacaatatattgattccgcgtttgttgtgttcatcgggagagagtttcattttcgatttcttcttttgattctttcgttcgcttatgccattcgttatttttccgattcaccggagtatttttcattctgtttcttttacttccttcaattgacctttagcgtgagcgaatctcgttttctatacatcaaattcgtctcgctttctttgtaatttttcattcttactctgaga

SEQ ID NO: 6416 - DNA, 3000 bp, Unknown
  misc_feature (1)..( 3000): cDNA_ID_1007795_gDNA_ID_1621093_Annot_ID_170769 3000 nt of promoter + ATG
atttgtaattcatacttgataatcgtactagcatcagcaatatatgtcacatcatgcatctatttataatatccaaattacgtcatatgaccataatcgtatatatcgccataagatagaatgagaaacgggtgcagtctgatcaaccaaactcaaccgaattagacaacccacgagaaaccttatatggtgtggggaattaatccaaaagacaacattgtatatagagagaggaagtgttacacaaaaataaccatttttttttttttttttgaatgtaaaaccaatacaataagtcagtaacgaagatggaaaaaccaaacaataaacacatattttcttgttacacttgagctatgctttttcttcttctgtcgttaattccaacgagatgtgagtggacatccaaggcggacgaggaaacgactatgaagatcagatagtgtgacggtacaattctatttagatcgaaagtagtatattcggtagcatttcggtatgtttttaccgagacttactgagtcatccgataataaaatatataaaaaaacgattataaagataaattgtattaaaaaaaacatgtgtaactaaaattatagatttctttaaagaaaaaaggaaagaagaagaatcctatgagaaaggaaaagatggtttatatcatttctcattgacattagtgaggataaaactttttaaagagattttgaattttctctagaaatttgcgaaaacccttttaaaaaaactagatgctctttttgtagagaaaatatttattttcataatcttgattgaaaaattaaatttttttttcagaaaaatcaaaaactaaaaacatgttagatattagtaccattcaaggtctaaattatatttggtattaaatccaaatgaaattatgtttgaccaaaaaaagagatctcgtacacgccggcccatgggcctttacaacagattgaaccaaaatggaaacatagaccaatcaggataaggtatatttctctctatatttgcacaattcaacaacaacacgatttctcacacatttcaagttttcattatcatccagaaatcttcttcttcctccgatcaccaccatgtgtacgttagagaaacgcggcgatctcttcctcctaaccctaaccggagacggcgaacacagattccaccccgacacaattgccaccattctctcccttctcgaacaagccaaatctcaatccacccgtggatccatcctcatcaccaccgccaacggcaaattcttctccaacggattcgatcttgcatgggctcaaaccgccggatccaaaaccggagccgcaaaccggcttcaccaaatggttgaatcattcaaaccggtggtagcagcgcttctcgatctccctatgccgacgatcgccgccttgaacggccacgccgccgccgcgggattgattttggctttgagccatgattacgtgttcatgaggaaagatcgtggggttctgtatatgagtgaagttgacatcgggctttcgatgccggattatttctcggcgttggttagggctaagatcgggacgagtgcggcgaggagagagctgttgttgagtgggaagaagattagaggagaagaagcggtgggtttggggattgttgactcggccgcgtatgatagtgaggaaggtgttgttgtggctagtgtgcgccttggtgagaaattggcggcgaagaaatggagcggtgaggtttatgcgtcgataaggaagagtttgtatccggagctttgtgggattcttggtttagagactagagtgtttgcaacacctaagctctaagaaagcgtctttcagagagtgaatctttggtttatttgaaaaacacatgttttgggagaaagagacaatgttaaactctagaactgtgatcacagaaataataaacatgttcaatgttggcttgttcagtgttgttgttgggcttgttcttaggcttggttgtttaaaatatggaaccggtttaatcggttttagagctaattagatgaactagagataaccgggttgtagtagttatcggagaaggagaaacggtgttgtgaatttgtgattgctgaaattacgccatgttaaaccggtattaaaacacaaactgtttttcgttcgaaaacgcatctatcaatcttggtcttttatgttcctaaaagataatttacacactcccagacatgtaataattaaaccagcattagcatacaagacgacaagaaaaactcaccaaaaaatgataattttagttgtgacccctttttcacagtataaattctttttaaaactttatgcaaaattgtattaaattatattatatgaaataaatttaagtaaaattgttgctttttaaaatttaacctctttatattaccattatcataaaacagaatgaatctaaatagaaaaattcccaaacaaaatctcaactatttaaaagttgcccagattcatatacacgatttcatatataaattttttcagttttatcctaaaataaaactaattttatttatttaaaatatcaaatttatattgattttctaaataaataccaaagggtgataaaatagtttggtatttgatttgaggttagttttgatttaaaatgttagtaataatgagtcgcgttttattggttgccggcttaaatacttgaaatgactcggacgaacgtcattggccaggcaacgtgtaaagcatcctacgtggcgtttacttcccaacgaagtagcgagtacaaaaaccaacatcattgtactcgcgcgagtaggtcgacgaaataaaaatctcacctttttgaccccaaaaatttctaaatatttcaaaatcagcctcttcgttttctttctcctcctgtctgttgatttaaagacccaaatctgacgcttctctctctctttctggtatctgcgtttgattcggagaagaaaaaaaaaaaaaaggcaaagagagagcttcaatg

SEQ ID NO: 6417 - DNA, 3000 bp, Unknown
  misc_feature (1)..( 3000): cDNA_ID_3239139_gDNA_ID_1621093_Annot_ID_170768 3000 nt of promoter + ATG
aattgtttgagtaggtgtccttgatgttattcttgatgaatatccaagtcttatggacgagcaagatgaagatggtaggacttgtctttcatacggagcatccattgggtattataaaggactatgcaacatcttaaaccgatcaacaaagggtgtttatgtctgcgaccaagatggttcttttccaattcattcggctgcaaaaaacgaacattacgaaattattaaagagtttataaaacgttgtccagcttcaaaataccttcttaacagacttggtcagaacattctccacgtggcggcaaaaaatgaggcctctcttactgcatatatgttgatgcatgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgaggtatttctgattccgtttcatacaacacatttgatccctcataaatgatttatagcttgacctccatatttttggaattacagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctggtatatttctcaagacttttatgctgactatagacatatctgagttgtttgtgattttgatcaaagcttgttttggttgtgtggcgtgttccgaataaatcatcaaaagtttatagatcaaaggatatttttcttctcttttttttttctttcaaaaagctacgagatatgctggtctctagctctgagaagcggcatcttgatcatacaactcattcgaagtcctatcagaattatctgtagttgtaataaagcgtgaaaagtatatcattcgaagagattttcctctaaaataatcgagtgatattttattattcggtttagtggataccagtttactaatctctcgaatttatgaaccacattcaaaggagatgagtttaacaaaaaaaaaaggtaaattgttttttattctcgtcgtgcgttccacatgagtcgttttcaagagcaatatagacgatacttcacaagaattattatttttgttggggtataaaaatttgaagatacgtttggcaacgacaatacgacgttagattgttccaagaggtgcaaaaacttagggaccctctttattcgttcactgtaaccactgaccacaacatgactaggtagactcttctttttgtcaatgttgatgtttatacgattttgatgagactggctctatcaagatatgaatctctgatcatatctccactaatctttcatcttgttattccctcatttacttttgatttccttctctctctctcttttttatgtatacaaatttttctttatttcgcttcactaaaccccaccatgtaattgtgtgagttttggcgaagtggcgcaacaccgtagagcacaccaacactaacccaatccattttatgaccgtaaattttgttgttgattagtgtatttttttcttgtttagttattctgagaagtaaattttttttttacaattagtttttaaacatagtaaaataaatttatgacagattataatattattttaaaaatcaataatatctaacaaattaaataaacaaatcacaaattactatattttaaataaatattgataattttaattatattattttgtttattggttaactcgcaggatatgcgagttaattcatttgagattgtaatccgccatatactaactcgataaccctgactttttagaaatctaaaagtataaccctataataaaatagattatgtccaactcgcggattctaaacctgaattgacatggcggaaccattcataaaaccataccaattcttgcgttttggaaagttggtttccttttcatttctttgaatttgatcctagattgtgtagttctcaagctcatgctcttgctcgtcaaaaacgtatcaacgatttgcttttcctttagacgttcttgcatcggattggtttactcaactccactcgatgaaaaagttactatcttaaaaagaacaaatgcaaattcaataaaattccccaatatctacgcatgaaaatatgattctgtcttttttttgtttgtctatctttcaatactttaaaaagtgtatttctagaggcgatttgtcatttcccgaataggaatttgagtaaaaaaaaacactctgttttttatttccactaatatcaaatcggcgaatatagttcccaccattcttatctccttgtcgtcactcggaattttttaaataataggatcgctttaataatataatctctataatttatagttccttttccaatattggcgtctccgttgaagctttccacaaatctcaaatttgtttggagactctcaa

SEQ ID NO: 6418 - DNA, 3000 bp, Unknown
  misc_feature (1)..( 3000): cDNA_ID_2991540_gDNA_ID_1621093_Annot_ID_170767 3000 nt of promoter + ATG
ccttctattcgagcaaaactcaagccgtcagacaccgctacatgtggctactcatggcggtcataccaaagttgttgaggctcttgttgcatcggtaacatctgctttagctagtctgagtactgaagagagtgagggactgaatccacatgttcttaaggacgaagatggaaatactgctctgtactacgccattgaaggacgctatttggagatggctacctgtctggtgaacgcggacaaggatgctccttttcttggaaataacaagggaatatcttccttgtacgaagccgtagacgctggaaataaatttgaagaccttgtgaaagcaattttgaaaaccacagacgacaacgtggaccgtgaagtgaggaagtttaacttagattcgaaattacaagggaacaaacatcttgcacatgttgctttgaaggccaaaagtataggtttgttttttgttttctttaataatcagtaacagctacgtttaatctgttaaaattatgtaaaaccagcttgggacgagaatctcctccccaagatggctaattgttgttcccaattgtttgagtaggtgtccttgatgttattcttgatgaatatccaagtcttatggacgagcaagatgaagatggtaggacttgtctttcatacggagcatccattgggtattataaaggactatgcaacatcttaaaccgatcaacaaagggtgtttatgtctgcgaccaagatggttcttttccaattcattcggctgcaaaaaacgaacattacgaaattattaaagagtttataaaacgttgtccagcttcaaaataccttcttaacagacttggtcagaacattctccacgtggcggcaaaaaatgaggcctctcttactgcatatatgttgatgcatgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgaggtatttctgattccgtttcatacaacacatttgatccctcataaatgatttatagcttgacctccatatttttggaattacagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctggtatatttctcaagacttttatgctgactatagacatatctgagttgtttgtgattttgatcaaagcttgttttggttgtgtggcgtgttccgaataaatcatcaaaagtttatagatcaaaggatatttttcttctcttttttttttctttcaaaaagctacgagatatgctggtctctagctctgagaagcggcatcttgatcatacaactcattcgaagtcctatcagaattatctgtagttgtaataaagcgtgaaaagtatatcattcgaagagattttcctctaaaataatcgagtgatattttattattcggtttagtggataccagtttactaatctctcgaatttatgaaccacattcaaaggagatgagtttaacaaaaaaaaaaggtaaattgttttttattctcgtcgtgcgttccacatgagtcgttttcaagagcaatatagacgatacttcacaagaattattatttttgttggggtataaaaatttgaagatacgtttggcaacgacaatacgacgttagattgttccaagaggtgcaaaaacttagggaccctctttattcgttcactgtaaccactgaccacaacatgactaggtagactcttctttttgtcaatgttgatgtttatacgattttgatgagactggctctatcaagatatgaatctctgatcatatctccactaatctttcatcttgttattccctcatttacttttgatttccttctctctctctcttttttatgtatacaaatttttctttatttcgcttcactaaaccccaccatgtaattgtgtgagttttggcgaagtggcgcaacaccgtagagcacaccaacactaacccaatccattttatgaccgtaaattttgttgttgattagtgtatttttttcttgtttagttattctgagaagtaaattttttttttacaattagtttttaaacatagtaaaataaatttatgacagattataatattattttaaaaatcaataatatctaacaaattaaataaacaaatcacaaattactatattttaaataaatattgataattttaattatattattttgtttattggttaactcgcaggatatgcgagttaattcatttgagattgtaatccgccatatactaactcgataaccctgactttttagaaatctaaaagtataaccctataataaaatagattatgtccaactcgcggattctaaacctgaattgac

SEQ ID NO: 6419 - DNA, 3000 bp, Unknown
  misc_feature (1)..( 3000): cDNA_ID_3048351_gDNA_ID_1621093_Annot_ID_170766 3000 nt of promoter + ATG
ggtagctgctcttgtagccacaatgacgtttgctgcaggttttacaataccaggtgggtttaacagctctgctccacacttgggcagggcaactttggccactaatccaactctcttcatttttctggtacttgacatcttggccatgcaaagttccgttgcaacaataggtattcttatttgggcgcagttaggtgatccagtgctcattcgctcatccttacatgtggctttgcccttactgctttttgctttactctgcatgcccttggcattcctttttggcgtggtcactgcagttgggcatgtgaaatggcttgtagtcatcatttgcattatatctgttttattcttttcttgggcgatctttgtccttggccctcacgtcatgctacaacggtcatacgtttctcccaagtacgctggtgactttctcgtgacttttatgcagtataaagacataattgggctttttgtgtctttgataaagtttcttttttgtggttgttattaagagtttgtagcctattcaaaggcattcttcgtatgaaaaaatcatcaaaagtttattgatgaaaggagatttttgttctctttcaaaataaaaataaaaagctagatatgatggtctctctgagaagcggtatcttggtagctttaactgatagctcaactcactcaatccgtagtcatcgaacaccgacttcacaagcttgtcgtgcgttatttccgtatctatttgcacaactctacaccatttatcgacggtgttaaatacaaattctttacccaatcgtatcgagagaaggatgaaagaagaatgaggaagacggtgatgaattggaaattccgatgatgtgaaaaactcatgtgaagaagacgagttgaaaaaaaaaacgtttcgtatttcctttgatgatgatgacatggactgttgcatccgacatcatttttttaattgatgaagtgacaagtaagccaccaaacaaacatgaaaatttgcctaaataaatcagccaaataaagttatatgttagtcgcaacatgaatactattacagtaattaaaaacgaaaaaacggcaagttacttcagccgtttagcaaacaaaataaaacacacacacatgattcgattgctaaccaacacaagaaacaaaacaaacacatctttgcctataagataatgtgtataaaccatacaactagtgatgtgacggaggacaatgagaagactatttcattatgctgaaccgtccttgacgtcttagcagttagcactgtaaaatgggttcatatcatagtaaacgaatcactctacacaacaattacatgctaaaaactaagaagctaagttaccaaattctctatagaaatagcaatcacttacaataaccaatgctacataacaacttttgagtccataactgataaattgatagaaactgtttgaatttgcaaacccaaaaccgtttcttaggatggagaaatgggtttgtatttttctatttccgatcaaggaaaaatatatcaggcaacaactgcggaagatagggcattttgggatgaaggaggaaaccatagttaacaagcggaaacaatttcaaaggttgatttcaaagatcataaagtcaaagtcaaatccccatagagagactcggttacggaagtgttggtatccgaatatccgatagtcatagcctcagaacttatgttagaatcaataggtttaaccatgcagtgtgcactttggaaatcaagccaagaaaagctatccacgcaaacaatttgcgttagagcgaaatcggataaagagaaagaaaatataggatttaaaaatcttatagcgagtaagacttatttgaaacatcgtcaaatttacttcttttggtgtatatttctcattatatggcgtatatatctgtttatgtaagaaattgtttccaaaaattactgtatactgactttgtaatcttgttttgatatcaatgaatttataaggaaaaaaataaaataaaaatataaagtatgatgtacatgtaaaaaaagttgtttcaagcgtaattgttttttggctagagaatgaatatacagcaacagtaaactaataaacttgcgatgaactaaaatttctggtattcctacaatcaatgaatcactaatttatctataagttttagctatatccgcttaaaccccgcctcaacttgctctctggtctgggtatagttgggctacaacagtgaaaccgtaattaggaaagaaatgataaaaacccaatccagaagcttactgcaagataaagagaaagatcatgaagaggtaggagtgattcatataacaaacagggtcacgttgtcactttctcccagaaaaatacaaatttagactaactatataaggagacgacttcagagtcttctaatgggttagtataactcgggtcatcttttaatctctggctttaaagacatggtaagattccatatatatgaaaactctgtgtgtggtggattgcttttttcatttaaggcaaagataggttttaaggcagaagacaagaacgacctttggcttatttataggagaccaccactttcacttgagtcgagacagtaacgacatttagaatttgcattactcatcttgtcactttctcccaggaaaaaaaaatacaaatttagaccaactatattaggagacgacttcaaagtcttctaatgagttagtaactggggtcatcttttaatcgccggctttcaagacatgtacaatttcatatgaaaactctgtgtgtggtggattgcatccaagacagttttaagacagaagataagaacggcctttgcttatttataggagaccaccactcctctcgataaccatgactcgagacattaacgacttttaaaactaagggacgaaccttaagcaaaagctcttgcattactcaaattcttctgccacttggtaagtctttttctctgccccttctgcatgca

SEQ ID NO: 6420 - DNA, 3000 bp, Unknown
  misc_feature (1)..( 3000): cDNA_ID_3048356_gDNA_ID_1621093_Annot_ID_170764 3000 nt of promoter + ATG
tttttttgtgaatgtataaacattcttcttcatagataatttcacttctttttttttgtcaaagataatttcacttcaatgtaagaaaaaaatcattttatttgcaattaaaaaaaaaaggtatattagaaaagtaatataaaaagaagcaagaaaaggaaaagtacagactaagttggacccagaagaacaaattctaatttaagcttccatcacaaataatgaatcatgatgatacatgccaactaattccactctcacatcatgtaattaaaaaggtactataaactcatatgatcatatagtttttcactttttctagacatagcttaagatatttgataaaagcctcactgcaacttcataataatggatgatataaagctggcagattaattcctagattacttagatagattcagttttgttctaggatgcacaaaaaaggttacaaaattatttgttttcttactgtttctggcaccaaaacagaaaatgccttagatgagtgaaccatggccatacatattcatatcaggatcatcttcatcttcataatctggttctgtagatggtctgcttctctttgcctctcttgctattattgattgtcctctccctttcttcggctttcccctgtaattttatcacattggtcaacaaaccaaaaccatgtatcagagacatacagggcaggtacgaacgaggtaaagtaagctaggtcgggaaactaactgtgtcgacaaaccacccttggatcgccctggccctaattcagctcgtccatctatatcatacagagataaagtgtgtaaaaactgatccaagatttgcaaaagtgaattcagtgtagttgtttgctgcagggcttaccttctcttccaacaccaagttcttcagcctgaatacatttcagggaagatcaacataccagtctaaaaacctttctctctaatgaaggcagagtaataaactaacaaatgacagtcacaagaaaagacacaggcatttcaaagaactccagtctctagctatttgacatcatagattcagctttcacttaagtttgaagctgctagagatattagccatgtagtaatcaaccatatctaaagaaactatattctcaaaccttttttctaaagaaggccgagtaataaactaacaaacgacagtcacaagacaagacatatagtcacagaactctagctctttcacaatcatagattcagctttcacacttgtttgaatctgttagagatatttgccatgtagtattcaaccatatctaaagacactgattctcaaaccaaactacctactagaaagggaaccatatgttctttcggcagttgattctattgcaaaccaacacaacaaaacaaaaaacgtctttgcatatgaaagaaggtgataaaaattgtctaaaacatacagctggtgatgtaactgaggacaatgagaagactctgtcttcaggctgaaacttccttgaccttttagcactgcagaaatgggttcataacttcatatcaaactcaatttctcgttccacacaacaaaatactaaaactgagaagttaccacattctctaaagtgtatgaagctgcaaatagaatccaaagtcaatgttttttcagaatcaagagaagaggagaatgagagacctagcagtactcttggaggaagacaaaaacccttcaaagcctttcaaagcatttccaatatgactcgattcttgaagatagcttgtctccaattcataaacctaagattacaaagaacccaagatttgaagtatgccccaaacaataatttctctatgaaatcgaatttcacaattgaatcgactctggaccattggtgccctaacctgtttctcgatgcttcgtaactcttggcgaagcttctctcgcttgttcagaagagaagtgagcatcgcaccaggatccgtcgaactcttttgccctaacgacattttctgagaaagaaatccacaaattgcgcagctttttcccttcccagaaatgggtggtcgctgaaattcgacgcggaggtaaccgttgcctgatttgagtcgattacgatggagacgatgattctggaattcgatttgggggttttcaccaatggtccggtttgatgtcaacaaaaataaaaatggtccggttctcttttctttttataacttttttttatgggtcagagattttattaactcaactagcaaattgaccaaatagtctacggccaaatgtggctacctgctttgctaaagaaagaatcagccaaagagttggcattgcatggaataaacacaagtaaagtgagaagcatggaaaaagaatattgaaaaatattctacctcttgtaagaatattgaaaaatatggtggtatttgcgatcccattgaatctaatgtttaatataaaatgtagtgatgtgcaacaaaataggtaaaataagaaatgctttgttaaaagtcattgatataaaaaagtttgatgtccatggaaaaaaaaataagtttccagtataacgcttgattggttcgatacttcaatttgaagctgttgaattattttacagtagaacgtgcataaggtccaaccaattactcagcaaactataataaacgagtgatgaacttagatttctggtagcctaaaatcactagcttctttataaagtttccactatgtcacatattctcggtgttttatgttaggaataggagcatctccgctgaaaccccgccgcaactttctcccaacaaaatagacatttagactttattaagagacgacgacttcaaagtctttaattataacttaatgacttaataactcgggtcattttttaatctttgtcttgaatttttctcctaattatttccgactaaagaaacactttcccttaatttatatataggtgacctgaccaccactccttccgatcatcatgactcgacgtggctcgagacaaaacttttaatataa

SEQ ID NO: 6421 - DNA, 3000 bp, Unknown
  misc_feature (1)..( 3000): cDNA_ID_3090001_gDNA_ID_1621093_Annot_ID_170760 3000 nt of promoter + ATG
gcacgtggcattccgcgcttgcgactgctaatggaaaactattcacttttggtgatggagcgtttggtgttcttggacatggagatagagagagtgtttcataccctaaagaagtgaaaatgttgagtggtcttaaaaccttgaaagtagcttgtggcgtgtggcatacggtagctatagttgaagttatgaatcagaccggtactagtacctcatctagaaagttgtttacttggggcgatggtgataaaaacaggctaggacatggaaataaagagacttatcttcttccaacttgtgtatcttcactaattgactacaactttaaccaaatcgcgtgtggtcatacattcacagttgcgctcacaacctcaggacatgtttttactatgggagggacttcacatggtcagcttggtagctcgaattctgatggtaaactgccttgcttggttcaagatcgattggttggtgaattcgttgaagaaatatcatgtggggatcatcatgttgctgtcctgacatcgagaagtgaagtctttacttggggaaaaggttcaaatggaagactaggacatggggacaaggatgatcgaaaaacgccaacattagttgaagctctaagggagaggcatgtgaagagtatatcatgtggttccaactttacatcaagtatatgcatccataagtgggtctcaggagctgatcaatctgtttgttctggttgtcgtcaagcatttggttttacgagaaagaggcataattgttataactgcggtttagtgcattgccatgcgtgtagttccaagaaagctttgaaagcagcattagctccaactccagggaaaccacatcgagtatgtgatgcttgttacacaaaacttaaagctggagagtctggttataactctaatgttgctaatagaaattccacaactcctacacggtcactagatgggacaggaagaccagacagagatataaggtcttcaaggattctactgtcccccaaaacagaaccagtcaagtattctgaggttaggtcatcaagatctgaatcttctattgtcagagcttcacaagttccagctctccagcaacttagagatgttgcattcccaagctctcttagcgcgattcaaaatgcctttaaacccgttgcctcatcttcgacatcgacacttccttcgggtacaagatcatcaagaatatcaagccctccacgcagttctggattttccaggggcatgattgatactttgaagaaatctaacggtgttataaacaaagaaatgacaaaattgcaaagccaggttcgtaatattatctcgaaattctcaggtttattaaacataaaattggatctaatacattaatgaacactttcagattaaaaatttgaaagagaaatgtgataatcaaggtacagagatccaaagactaaagaaaacagcaagagaagcttctgacttagctgtaaaacattcttcaaagcataaggcagcaacagaggtcatgaaatctgtcgctgaacatgtaagcttcttcttatatataaaacatgcttaatagattttttccttgagaaacaagcaatgagactttaaaaaactttatttatcacagttgagagagttaaaagagaaactacctcctgaagtatcaagatgtgaagcttttgaatccatgaattctcaagcagaagcctatctaaatgcgagcgaagcatctgaatcatgtttacctacaacatccttgggaatgggtcaacgagatccaaccccttctacaaacacacaagatcaaaacatagaggaaaaacaatcatctaatggaggtaacatgagatctcaagaaccttcagggacaacagaagcttcatcatcgtctaaaggaggagggaaagaacttatcgaacaatttgaaccgggtgtttatgttacttatgtattgcacaagaatggcggaaagatatttagaagagttagattcaggtattttaacttcatagtaatctcctctcttttatatcaaaatttatgtaaatcatttttgtgaattgagtttctttgtagcaaacggagatttgatgagcatcaagcagaagaatggtggaatagcaaaaaagataggttgcttaagaggtatagtcatcatgcttcatcatcgagtccaacggcttctgattcagttccaacaccaactcaacctcaaccaccagcttctgattcagttcctacaccaactcaacctcaaccaccagcttctgattcagttcctacaccaactcaacctcaaccaccagcttctcctacacaaccgaattctgatcaagcagaggattcaaaagaagttcttgatgaaagctagtcatcatgtgtataatagcagtttggcaaagtagattgaggaacaaggcatcattggaatgtcattactgtaggaccaaaatagatacaaagatttattgttttcttttgagtttatgtcacaaatatatgtaaacgtatgaaggttttgatccacgtacgattttcttaggtggaaaacaaaactagatttatttttgtttttttcctatgaaagtttaaattggacataaagattataataatcatctcaagagttgcattaatgttctaattgttagattcttgtttgagtttaccatcaagtccatcttaagaagatatatttggcattttcttgagtcaactccaaagtctccactttttgttttctattaaccgagtccagtcaactctgaactttctccgacacttcattgttcttgaaaaagtcttcaaagcaatagttttttttttgtctttttgaagcaattatacaatcaattcctggctattgccgcgttttttcataatctattcctttacttttccctatttcttaacttaaggcaagaacttttctataaaatagatcttgactttcttcttctcctatctaagttcaattcatttgatattccttctaaaaatg

SEQ ID NO: 6422 - DNA, 3000 bp, Unknown
  misc_feature (1)..( 3000): cDNA_ID_3048360_gDNA_ID_1621093_Annot_ID_170759 3000 nt of promoter + ATG
aaaacaagagtaaaaacacatatacagagagaaaacaaagatattgcataccaaaacagagaatagattctcttaaaactcatacgagaaacataagctgattacaacaagaaaattatgtttttctgctttagtctgtgcatataaccaactcggacctccacgagctaaatatgatatgtattgtccttctttcgtgacactcaaagctatatcccttgcgattgcattcacttttgtagatggtagtttaaagacgatcctcccaaattttgagattaaacgatgaatcatgtataagtaagaaaaatacattggccaattgagataatcatttatggcttctagagcaccattacaatctgaccaaatttcaatattatcctgatgtaaatcactcagactttgtagtaccaaaagatcccatgcaattctgcggcaatgcggtttgaggcaggtagaaacatctctctcgcatagaacataatatcaccatggtcattccgaatgattcaggctcttccacacttatgagcatcattaatccaagaaacatgtacattacacttaagcatgtacattacaaccatatagatggactaaaactctataccctccatatgtttctcgtatgagatttaagaacatatatgctttgttttgagatacaatagctctgtttttcattgtatcagtactattaactcttggtttttaataagaaacattagactaaaaaaaaagtgttcttttttggaaaaccttaaaaatattaaagaagatatgataattgtaaagagaatgcgtagtgtttacttagtttgattttgactccggagcgaggactttgttgttgttggaagaaatcgtaggttgtgtcccaagcaaaacaatgaaacgataatcaactaataatgacgaaccgtaaacaaaataacaatgattagatgatattaaattttgccaaaacttttgaccaaaagaacaaaaaaacaagtttaccattcaatgtatgccgcaatttttttcttctccaagtaaactcttagatcatctttattgatggtctcttaaaacaatttttatgttaagagacatgtcttataattaacaaaagtctcctatttaagtaagagactttaagacacttttgttagttataagacacatcttttaacataagacttgtcttaaaaaaccattaataagaatggtcttactctctcaaatctcagttattaaatcgaatcataacgaataaagctaactaaactcggtgattggttcgtgtcatagttggctgtaaaaaattactactctattttttccattaaattaaatatgatattaatttatttagtttttaaccattcttattctccaatatttcttactattttgttgaactgtttaaattaagtattaattttatgcttttaatgtataaacaaaaaagttactgtaatttaggataatttcttaatttttgtattttttaagtaaaacatctactcctacatagtcaagtttatttacttcctattacatatgcaaaatgtctctaacaaaaaaaagatttctctacagatttgcataagaatctttaatatgaaattttagcaaccaaacaaacagcataattcagagtatcatgttcatattaaacctcccaaaaaatcacaaaatattttacaggaaaaatatatggaggttggacttaaaagatgttgtgagaaataaataactcagcttttacatattgtctcatcaattcatttatttaaaaacacaaaaactagatacaatgtcaataagtttgacatttattctttggcttttgacattgccatcgaacatatttcccgtggcggggtccacgcggaataataaagccgctcaatccatttctctaacctaattttttttatattttttattcactttccttcctaaataaattaatattccattgttttaattagaaccaattaaacccttaatttacgggtaatcactttagtaactaaaagaacaatattaatcacagtagtaatcaatctcccaaacaaaaaagatataaaattgctcgagagagagaaagagaaaacaaaaaacaactgagaaagaaggaagaagaagaagaagattagtgcttagtctttttgcaattcacacacacatcgaaagagggattataaagtttccaactttttctttcaattcccagaatttcgatcttcaaattttgaaggaagaaaaaaaccaagagcaagagttgaggaatcgaatcccaagaatcgaggtcttctccctcttcttttcactttcttttatttttctctcaccataaattacgggtctctgtctttgtgtctgcgtttttgtctcaccatgttgtgttcctaatctgacgcttcttcttcatgttcttcatttcaagcttcgttgagatcgagcttttttgtttcaattgtggtttgttgcattttcgctgactcacaaatagggcttcttgtttgatttcgtatttcccccaattttggtgtacatttggggttttcctctgatttcagatctattaggttttgtgttctactctgaaatgatcatgtaagtaatctatggaggattctgtaatttagattcagatatgtctttgatttggatacaaagttgtcaactttaagctcctttctgttatttgtgaataccaacttcactgcttttttatgactttgcaaagcagttgaattgccttagtttctattgaatcattcttatttcttcaaacatgcttctgttgaagtttctagtcaatgttagctaacatatgtcattttgttgcaggtgtgagaagcagtatcagtcactagatgcatgacatttgaaagttggagtggaacttgttcttagcgcgtattgaactgtctggtcgcttgtacataaagcttgtaactaaaaatatctggtctgaggggtaagctaaaggggagagaaatg

SEQ ID NO: 6423 - DNA, 3000 bp, Unknown
  misc_feature (1)..( 3000): cDNA_ID_1814423_gDNA_ID_1621093_Annot_ID_170757 3000 nt of promoter + ATG
tcagttttgactgactatttcagcagcctctagttctgtaggatacaattatattagagagcgttgggtcatggtcttactcaactcggttggtttcggtttattcgcctcttgcatggttgaaatgtgtgataggttagaatttcatgtaggtttgcttcctattctctgtgttaataggaatcttatcagtaaaattctgtactttccttttgcctcatcctttatctagtgacaaatctacagttcaaggtttggattatgattctatgtgtagtcgattaggaatgtatcatttcgtggttatcttgtggtatatctcattccttttccttttcagattcattgatttgttgtatggttttagtttaggtcttgtcaatggcgtatttctctatttgtcgtgatatgttgatttcctagactatggacttcacatttcactgaccattcagcagcctccagttgtgtaggttacaattagattatagagcattaggttatggtgtggtctctcactcaaatgttttcatttgtcctcaattctcaaattaatggaagcttagttcctttcacaaacagttgtgagctcgccttggctttcagttttttcatgaaacaggtctcttacatggttgaataatcttgtgatagcgatctcttatatctgaatatatggtcttcttgagggttaatcgaaaagcatagaaaaatatgaatatttgtggggtgttctttgctcaaaaaattggttacactttgtagatgtgatgatgttttggaataacttgagatgtcttttgatttccagaaaatgctattaccctgcggccttcctccggaaagagaagaggaataggtgacatgaggattcgatttgtctttcaagttatcaagaactcgtgtgatggaatgttggtttggagttttaaaaactgtccaatttgatcttctggtagagatttatatgactgttaaaaaacaactttgtctgtgtaagtttgcttttcttgaatgtaaaaaacaaaacaccttggatttttaggttggttttacacggtttcgtgttttaatcaaattcatcaaaattttcaatttttgaactatccaaaaacccgaataatccgacataaccgttattgcatgcctagtttgatttgttaaaagttcccgacataaattcttaccgtgggatgtccaaacgacaagaaaacaacgggtgtgacaaatggacaaataaaagcaaaaagcttaggccacttaaaccaaaagccatttcatcaaacgtattctaaaatctaaactataaataatgtaatatcgtcaacgatggaagcctataaacactatagttgatataatcatacgcatctattataagcttgcttacttatggataatttttcttattctctttgacttatttttgcctagtttcattgaccatcataatactttaacaataccgaaagtttcataaacattataaaactttagtcattgtatacaatccgaaagtttcataaacattataaaactttagtcattgtatacaattatcaataagttttgtttcccatgcatgtgaaatatcacttgactcaagatgaatggtcctaacacgtttacctttagagacacatgttaattttcatattgaaaatgaaagtaaaaacaaaatgcttaatatagcatagaagaacattagctatcctactaaattaccatatagaagaaactcatgaatttcacactgtgttcatgagttcatcgagaagatctactaacgacatgtaaactggttattaagtatgagcttgatttctcaagactcatcaacaagtgttccatgtatcgacgttaccaagcgttcgggagatccacaagtaaatggatgctttcttttttaaattgtttgaacttttataaaatcaggtcctttacatgcacttccagaatctgtccaagcgagagatcataagatagaacaaagtgataatatgataatattgcgctagtacacgatttgttgacagtttaaatccaaaaatgttcatcaacatattggtacgattagtaaatgagtaaaaaaaaacttaaataaatcaatgtaaattgggtgatgtatgtagacttaggtattgcactaacttgattttattgattcacaaagtatagtatttatacaagagagacatcttatgagatatactctaatccctaaaatataggacataactctatcacaagatatatagtgataatcttaatgagattatactctatccccaataatgtatcaaaatatataaacgtaaaatgaaaatttcagcttgaaaaatgacaaatgtagaacttttttttttggtggtagattctgtttttaataaaaatatattataaagttttgcaaacttgtttcgtgttgttgttgattaagtgatgtttatggttattacgaattagagttttggtcgttagaaaacagagaatttaaatgttaaaccgtgcacgaaaacaactaattttttcttctaagtaattaaaaaaaaaacagtatacaaaaataaaataaaaagattcaatgaatgataaatatttacgttgaagttttgtctttctttaggttaaattcaattttcacatattcatttctttattattcccttcttcttctttctctttctcttttcttccgcaaatctccgcaaaatcttccctcaaactcagatccgattcttctaattctttgtccccccagagattcttcttctttctccaagtaaaagaaaacaactttctttctcttttcttgcgaaagtcctcaactttcaccactaaatcagcttccttcaatcactgtgtttgctttggacccagtttctgatttagcgactagggttttgattggaaccgtattaagtatatgagaatcgggttttactggtgaatcggattatcatcggaattcggaaaaagatggatcggaatcaaaagatg

SEQ ID NO: 6424 - DNA, 2231 bp, Unknown
  misc_feature (1)..( 2231): cDNA_ID_3090009_gDNA_ID_1621093_Annot_ID_170756 3000 nt of promoter + ATG
tttgcccgcacagctctcaattaaaactaacacaaaggccaaaacacataggactatcatggtaatataaaaagagttgttcatgttctcttttgtgcaataaggagccaggaaacatgttcttctatttatataatttggttttattgtaacacattagtttcgggtcagctaatggcatgattatcatatagccaaaatagaaccttcattttccattcacgttgcggggaatatagaaccaccaatataccgaggagaaacttctgtatgctcttaagaaatttagtgaaagttagtatggctgaagttaaaagaagaaaacaaataatatttagtattatcaattcatttctatacgtatatgtcattttaatttgccaagctcatatataacactgatttgcagcacaaaacgataaatgatttttcgagatccgaaaatagaaagtggtttttagaacttaaagagtgttatgtctactttgtcgcaagttatagagaatactcaagggcagcctaatgaagaaagattggttaaccaaattaaaagacatccataagaccaagtcctatttaaattaaaaaccaggaccatttctggtagattcaaagtatatcacagtattgaagcaggacaggtaccaaacaaaacaaaaaaaagtagatagatgaaacaacaacttaaaagagagatgttccctttcccttcttgtctccaccgatctcaaagtgcttgcacctctgcaaaaaccacacacaaagtgtaagaaacagaactgagactaaagagtgattaacaaaggtaaagaatgtcgcagacattaccttaatcgggcgttgcgagaaatgcttgcagctttggcattgaagcctcagcacaatcttcttagttgtcttagcctgttccaaagaaagacaaataatgagcaaggtccaattaacaaatcattcctataagacatatttcacagagtcaattctgaaatcctaaattggttctcacatagaagacagtaattagagatcaagacaaggaaaagcgagtataccttcttgtggaagacgggcttggtctgacctccataaccagattgtttacgatcataacgacgctttccttgggcagcaaggctatctttacctttcttatactgcgtcaccttgtgcaaggtatgcttcttgcactccttgttcttgcagtaagtgttcttagttttcggaatgttcacctacagaaaaccaagtttaaaactaccacaagatacagtttcaacagcatacagaattaattacgatcatagaagtgaatctaaatacgcccttcagaacaaaccctaaaacttgttaataaaatttcctgcttctcctaaatcattcagaattaattgctaccatacgatctgactactcaactagtcaatattgataaccattttgtgaatcctacaagtccctgaagtacaaatccttcttaattctcctaaaaatcagaacagaattgcagcaacacaaatgaagatacataacactatatcattttgaatctctggtagattggagctaaaactcttcacagagacgaagtgaactgaatcttcgaatttacaacacagaatgcaacataacagattctaaaaatcacaattagactctaataattctcgatttaagatgcaaaatcagaaataaacaacttaaagaagaagaaaaatcacacagcagatctataatcaataatctcgttcttcaatagtaaccaaggagaaatttagcagaaataaagaaagagaagagagtcaccattttcgctcttcggtgaagctcgtgccgtcgtcttccactgccgcaaaacctttaataaaaacctaaagtaacagagcttataagagagacatttgagaaaaccctaatactacaaacattgggcctctataaacacaaaaagcccattaacttaatcaaaaagtcaggcccatctcacttcccttttttaaaagaaagtaaatatattctagttgccgaaaataaaaattgttaataatcagtggcccgtggacaaaaactagccgtttagagatacaacacaacggttatgtttgtttctttgtttcaaacttcaaacctcgtgaatcactcacaaaccctaatccccttttttattttctctctctctaacgctctctgaatctcaatttcaatttcactctttcgaaacttcttcaacaatg

SEQ ID NO: 6425 - DNA, 3000 bp, Unknown; identical to SEQ ID NO: 6407
  misc_feature (1)..( 3000): cDNA_ID_2123319_gDNA_ID_1621093_Annot_ID_170755 3000 nt of promoter + ATG

SEQ ID NO: 6426 - DNA, 2231 bp, Unknown; identical to SEQ ID NO: 6424
  misc_feature (1)..( 2231): cDNA_ID_1814427_gDNA_ID_1621093_Annot_ID_55547 3000 nt of promoter + ATG

SEQ ID NO: 6427 - DNA, 3000 bp, Unknown
  misc_feature (1)..( 3000): cDNA_ID_1814423_gDNA_ID_1621093_Annot_ID_55548 3000 nt of promoter + ATG
tttcttagaccatggacttcagttttgactgactatttcagcagcctctagttctgtaggatacaattatattagagagcgttgggtcatggtcttactcaactcggttggtttcggtttattcgcctcttgcatggttgaaatgtgtgataggttagaatttcatgtaggtttgcttcctattctctgtgttaataggaatcttatcagtaaaattctgtactttccttttgcctcatcctttatctagtgacaaatctacagttcaaggtttggattatgattctatgtgtagtcgattaggaatgtatcatttcgtggttatcttgtggtatatctcattccttttccttttcagattcattgatttgttgtatggttttagtttaggtcttgtcaatggcgtatttctctatttgtcgtgatatgttgatttcctagactatggacttcacatttcactgaccattcagcagcctccagttgtgtaggttacaattagattatagagcattaggttatggtgtggtctctcactcaaatgttttcatttgtcctcaattctcaaattaatggaagcttagttcctttcacaaacagttgtgagctcgccttggctttcagttttttcatgaaacaggtctcttacatggttgaataatcttgtgatagcgatctcttatatctgaatatatggtcttcttgagggttaatcgaaaagcatagaaaaatatgaatatttgtggggtgttctttgctcaaaaaattggttacactttgtagatgtgatgatgttttggaataacttgagatgtcttttgatttccagaaaatgctattaccctgcggccttcctccggaaagagaagaggaataggtgacatgaggattcgatttgtctttcaagttatcaagaactcgtgtgatggaatgttggtttggagttttaaaaactgtccaatttgatcttctggtagagatttatatgactgttaaaaaacaactttgtctgtgtaagtttgcttttcttgaatgtaaaaaacaaaacaccttggatttttaggttggttttacacggtttcgtgttttaatcaaattcatcaaaattttcaatttttgaactatccaaaaacccgaataatccgacataaccgttattgcatgcctagtttgatttgttaaaagttcccgacataaattcttaccgtgggatgtccaaacgacaagaaaacaacgggtgtgacaaatggacaaataaaagcaaaaagcttaggccacttaaaccaaaagccatttcatcaaacgtattctaaaatctaaactataaataatgtaatatcgtcaacgatggaagcctataaacactatagttgatataatcatacgcatctattataagcttgcttacttatggataatttttcttattctctttgacttatttttgcctagtttcattgaccatcataatactttaacaataccgaaagtttcataaacattataaaactttagtcattgtatacaatccgaaagtttcataaacattataaaactttagtcattgtatacaattatcaataagttttgtttcccatgcatgtgaaatatcacttgactcaagatgaatggtcctaacacgtttacctttagagacacatgttaattttcatattgaaaatgaaagtaaaaacaaaatgcttaatatagcatagaagaacattagctatcctactaaattaccatatagaagaaactcatgaatttcacactgtgttcatgagttcatcgagaagatctactaacgacatgtaaactggttattaagtatgagcttgatttctcaagactcatcaacaagtgttccatgtatcgacgttaccaagcgttcgggagatccacaagtaaatggatgctttcttttttaaattgtttgaacttttataaaatcaggtcctttacatgcacttccagaatctgtccaagcgagagatcataagatagaacaaagtgataatatgataatattgcgctagtacacgatttgttgacagtttaaatccaaaaatgttcatcaacatattggtacgattagtaaatgagtaaaaaaaaacttaaataaatcaatgtaaattgggtgatgtatgtagacttaggtattgcactaacttgattttattgattcacaaagtatagtatttatacaagagagacatcttatgagatatactctaatccctaaaatataggacataactctatcacaagatatatagtgataatcttaatgagattatactctatccccaataatgtatcaaaatatataaacgtaaaatgaaaatttcagcttgaaaaatgacaaatgtagaacttttttttttggtggtagattctgtttttaataaaaatatattataaagttttgcaaacttgtttcgtgttgttgttgattaagtgatgtttatggttattacgaattagagttttggtcgttagaaaacagagaatttaaatgttaaaccgtgcacgaaaacaactaattttttcttctaagtaattaaaaaaaaaacagtatacaaaaataaaataaaaagattcaatgaatgataaatatttacgttgaagttttgtctttctttaggttaaattcaattttcacatattcatttctttattattcccttcttcttctttctctttctcttttcttccgcaaatctccgcaaaatcttccctcaaactcagatccgattcttctaattctttgtccccccagagattcttcttctttctccaagtaaaagaaaacaactttctttctcttttcttgcgaaagtcctcaactttcaccactaaatcagcttccttcaatcactgtgtttgctttggacccagtttctgatttagcgactagggttttgattggaaccgtattaagtatatgagaatcgggttttactggtgaatcggattatcatcggaattcggaaaaagatg

SEQ ID NO: 6428 - DNA, 3000 bp, Unknown
  misc_feature (1)..( 3000): cDNA_ID_1814419_gDNA_ID_1621093_Annot_ID_55549 3000 nt of promoter + ATG
tgaccaaatttcaatattatcctgatgtaaatcactcagactttgtagtaccaaaagatcccatgcaattctgcggcaatgcggtttgaggcaggtagaaacatctctctcgcatagaacataatatcaccatggtcattccgaatgattcaggctcttccacacttatgagcatcattaatccaagaaacatgtacattacacttaagcatgtacattacaaccatatagatggactaaaactctataccctccatatgtttctcgtatgagatttaagaacatatatgctttgttttgagatacaatagctctgtttttcattgtatcagtactattaactcttggtttttaataagaaacattagactaaaaaaaaagtgttcttttttggaaaaccttaaaaatattaaagaagatatgataattgtaaagagaatgcgtagtgtttacttagtttgattttgactccggagcgaggactttgttgttgttggaagaaatcgtaggttgtgtcccaagcaaaacaatgaaacgataatcaactaataatgacgaaccgtaaacaaaataacaatgattagatgatattaaattttgccaaaacttttgaccaaaagaacaaaaaaacaagtttaccattcaatgtatgccgcaatttttttcttctccaagtaaactcttagatcatctttattgatggtctcttaaaacaatttttatgttaagagacatgtcttataattaacaaaagtctcctatttaagtaagagactttaagacacttttgttagttataagacacatcttttaacataagacttgtcttaaaaaaccattaataagaatggtcttactctctcaaatctcagttattaaatcgaatcataacgaataaagctaactaaactcggtgattggttcgtgtcatagttggctgtaaaaaattactactctattttttccattaaattaaatatgatattaatttatttagtttttaaccattcttattctccaatatttcttactattttgttgaactgtttaaattaagtattaattttatgcttttaatgtataaacaaaaaagttactgtaatttaggataatttcttaatttttgtattttttaagtaaaacatctactcctacatagtcaagtttatttacttcctattacatatgcaaaatgtctctaacaaaaaaaagatttctctacagatttgcataagaatctttaatatgaaattttagcaaccaaacaaacagcataattcagagtatcatgttcatattaaacctcccaaaaaatcacaaaatattttacaggaaaaatatatggaggttggacttaaaagatgttgtgagaaataaataactcagcttttacatattgtctcatcaattcatttatttaaaaacacaaaaactagatacaatgtcaataagtttgacatttattctttggcttttgacattgccatcgaacatatttcccgtggcggggtccacgcggaataataaagccgctcaatccatttctctaacctaattttttttatattttttattcactttccttcctaaataaattaatattccattgttttaattagaaccaattaaacccttaatttacgggtaatcactttagtaactaaaagaacaatattaatcacagtagtaatcaatctcccaaacaaaaaagatataaaattgctcgagagagagaaagagaaaacaaaaaacaactgagaaagaaggaagaagaagaagaagattagtgcttagtctttttgcaattcacacacacatcgaaagagggattataaagtttccaactttttctttcaattcccagaatttcgatcttcaaattttgaaggaagaaaaaaaccaagagcaagagttgaggaatcgaatcccaagaatcgaggtcttctccctcttcttttcactttcttttatttttctctcaccataaattacgggtctctgtctttgtgtctgcgtttttgtctcaccatgttgtgttcctaatctgacgcttcttcttcatgttcttcatttcaagcttcgttgagatcgagcttttttgtttcaattgtggtttgttgcattttcgctgactcacaaatagggcttcttgtttgatttcgtatttcccccaattttggtgtacatttggggttttcctctgatttcagatctattaggttttgtgttctactctgaaatgatcatgtaagtaatctatggaggattctgtaatttagattcagatatgtctttgatttggatacaaagttgtcaactttaagctcctttctgttatttgtgaataccaacttcactgcttttttatgactttgcaaagcagttgaattgccttagtttctattgaatcattcttatttcttcaaacatgcttctgttgaagtttctagtcaatgttagctaacatatgtcattttgttgcaggtgtgagaagcagtatcagtcactagatgcatgacatttgaaagttggagtggaacttgttcttagcgcgtattgaactgtctggtcgcttgtacataaagcttgtaactaaaaatatctggtctgaggggtaagctaaaggggagagaaatggagactgccaaagcttggctgagtaagttaaaatctaaagacaaggtgaaatcttcgaaaaagaaggaagccacaagtaatgtaaaggaaggaccgaaaacagctggaggtgaagaagcactttcaaatataactaaggagaaggctgctgctgcaaaactgtatattgaaaaccattacaaaatgcaaatgcagagtctgcaggaaagaaaggagcggtatggtttcattacatatttatatgtttcaagttttcatgatgggaaagaactttattcgtgtctttctgctactttcgtgtgaacttccgtccatatccttagctctttgtttggtatttacatttcatacagacgcaaaatg

SEQ ID NO: 6429 - DNA, 3000 bp, Unknown; identical to SEQ ID NO: 6421
  misc_feature (1)..( 3000): cDNA_ID_1814415_gDNA_ID_1621093_Annot_ID_55550 3000 nt of promoter + ATG

SEQ ID NO: 6430 - DNA, 3000 bp, Unknown
  misc_feature (1)..( 3000): cDNA_ID_1814411_gDNA_ID_1621093_Annot_ID_55551 3000 nt of promoter + ATG
gaatcagcaatctccggcatcccttcttcttcttcttcttcttcttctttttgctcttctattcgtctcacaacattctctttgctcccacttgtcccctcaccgcgtgattggctttggtattgatagatttgagagtattcatcatcgtatccatactgacgacgctttggtttggtgagagatcgagaaatgaagttgagaaactgtcgagaactttggttccggctatagtagtatttgtccgtgtagctattgttttgaaggtaccttgttctaaaaggaacgatgagacggcgagaaatgaaccggaagacacgagccgttgattctctgaccgatgaagcgatctccatgtctctgaacttcgacttgaccatgtttgtaaagtttttccatgccctcttcgcaggattttgcttcttcttttgccgcaacgaagccattcagagacttacttttttttttttttttgaaaaataggtttggccaaatgtgtattattgtcaagaaatgctttatattttgctacgagcctttcattcttcgattaaaatattaaaacgctattgcttttgggtaaaaagtagggaacaaaaagtgggttctcttagcttactctggatggcaaaaactcagattctggcttaaaaaagggcatattgtttttgcacatcttcaggtcttaaagcgttttcatgaggaagtttattattttcatacactctgaaagtaaagttatatatcttaagaatttttctttaactaaatttcttcacaatctcttttaaagatgtatgaatccgagttgttttgaagttctgtaaagatgtaagttatgctccttgaagctaagaccatgtgagatccgaccaagggaaggcccataattttattggataaagactaatgaacctaattattggattgggactgttgagctaataattatttatttaaccaacaaccaatcaatcaatcatacatttctctacacattccagaaaattataattaaccatagcattatattcctcatacgcacccaccaatttgttttaagacatgtcttggacattatctgcttcattctgtcttacaatagtcagaaattcagatatttccagtacaacaagtaagtctcgtccttgcattacaagattccacataagcttgaaaggctctttcaacgttggtttgaaatgcgaacaatcttgtgttttgcggtttatccgctattacattagaccgaaaccaaactggtacttcggaggacacaatagcctcataagttacaaaaaaaaaaacatgttttgcgattgtgtcggcttggtctgagagtaagggaaattatgccgaactctgcttgaaatcttttatttggccaattgtgcttaaggagcaccaaatagttttctttcttagcccgttaccggatcttttaccttttcaaacgatttatgcatatttttgtagtgaataagcatggattttctttttctatgctagaggtttaatttccgcctaacaatatgtaagtctatgcaatttttatttttaaattggatgtccaagaaaagtgcattttttctacgccgactaaaaaaaaattgacgtccaaaagctataattgatttttttttcctgttattatttagatttgacactaatggcaccgaccagttaaactttttactagttctctctactaataaaagaaaatagctgatatataaagtactaattttgaggacaaacataactactgatactttgattacaatattaatctgatgatgccggagatcaaaggttccagtaagtgaaagccattgatactcgatttcaaagagttatttggagtataacgaatctggaattttggtataacatgtctacggagaatctacgaattgatgcaagagaagatatcaagtaacatcaataacattagacgattatggagtttcatcgaagagatgataaccaaaaacgacgatctcatcaatttgggattgaatctgaaaaggaaagaaacggttgacgagcaagacttcggtttctaaagcatagtcgaaattcacctttttatcgtttattaaaatatttaattataattgtgtggatgtatgtttgaatgtgtttattaataatgtattacggatgtatctaactcttgtattcgattcaaaatcaatgaatgaattatgtgtaaaaaaaagaagaaaaaagactattaatctgatactgcaaaaccgcaaatgttcagttaaaagttgttttcaatcatgaatcttgtgtcccaagtcccatgaaaaccaaaccaactatgagttggtctagtagttaaccttttaagtaagcaacgtagagattctagaaattacgggttcgaaaacataaaaattattctcttttcaaaactagatagaacttttttctcgtgatacgaaatttcttttttattttttcttgggaaaaaacaaaatattatgactgaactgttgttttcttgtcagcccaaaaatatatttgtcatgaatattaatttaattaatttcaaacattaaaaatttaaaaaataaacttgttaagaaattcaaacattttgaaaaaattatggtcaataagtagttagtcaaactgtcttttaatcaccaaattcacccagaaataaacttgtttaatgttgtccgttacgtatcaaaagctgagactgaaaatacgaagaagcttcatctctctttttctcaaaagtcaaaagtcaaaatagtgaatacgcgttttccagtttattcttcgtatatgtcatagcgttcagaaacattgtgtatatgtgatcttgaacttttcttgacacgttatctcatggcttcttcttcttcgtcttcgtctcgcacctggagataccgcgtgtttacgagcttccacggagcagacgtccgtaaaacatttctgagccatttacgtaaacagtttaactacaatgggatcacgatg

SEQ ID NO: 6431 - DNA, 3000 bp, Unknown; identical to SEQ ID NO: 6420
  misc_feature (1)..( 3000): cDNA_ID_1814403_gDNA_ID_1621093_Annot_ID_55553 3000 nt of promoter + ATG

SEQ ID NO: 6432 - DNA, 3000 bp, Unknown; identical to SEQ ID NO: 6419
  misc_feature (1)..( 3000): cDNA_ID_1814399_gDNA_ID_1621093_Annot_ID_55554 3000 nt of promoter + ATG

SEQ ID NO: 6433 - DNA, 3000 bp, Unknown
  misc_feature (1)..( 3000): cDNA_ID_1814397_gDNA_ID_1621093_Annot_ID_55555 3000 nt of promoter + ATG
atgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgaggtatttctgattccgtttcatacaacacatttgatccctcataaatgatttatagcttgacctccatatttttggaattacagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctggtatatttctcaagacttttatgctgactatagacatatctgagttgtttgtgattttgatcaaagcttgttttggttgtgtggcgtgttccgaataaatcatcaaaagtttatagatcaaaggatatttttcttctcttttttttttctttcaaaaagctacgagatatgctggtctctagctctgagaagcggcatcttgatcatacaactcattcgaagtcctatcagaattatctgtagttgtaataaagcgtgaaaagtatatcattcgaagagattttcctctaaaataatcgagtgatattttattattcggtttagtggataccagtttactaatctctcgaatttatgaaccacattcaaaggagatgagtttaacaaaaaaaaaaggtaaattgttttttattctcgtcgtgcgttccacatgagtcgttttcaagagcaatatagacgatacttcacaagaattattatttttgttggggtataaaaatttgaagatacgtttggcaacgacaatacgacgttagattgttccaagaggtgcaaaaacttagggaccctctttattcgttcactgtaaccactgaccacaacatgactaggtagactcttctttttgtcaatgttgatgtttatacgattttgatgagactggctctatcaagatatgaatctctgatcatatctccactaatctttcatcttgttattccctcatttacttttgatttccttctctctctctcttttttatgtatacaaatttttctttatttcgcttcactaaaccccaccatgtaattgtgtgagttttggcgaagtggcgcaacaccgtagagcacaccaacactaacccaatccattttatgaccgtaaattttgttgttgattagtgtatttttttcttgtttagttattctgagaagtaaattttttttttacaattagtttttaaacatagtaaaataaatttatgacagattataatattattttaaaaatcaataatatctaacaaattaaataaacaaatcacaaattactatattttaaataaatattgataattttaattatattattttgtttattggttaactcgcaggatatgcgagttaattcatttgagattgtaatccgccatatactaactcgataaccctgactttttagaaatctaaaagtataaccctataataaaatagattatgtccaactcgcggattctaaacctgaattgacatggcggaaccattcataaaaccataccaattcttgcgttttggaaagttggtttccttttcatttctttgaatttgatcctagattgtgtagttctcaagctcatgctcttgctcgtcaaaaacgtatcaacgatttgcttttcctttagacgttcttgcatcggattggtttactcaactccactcgatgaaaaagttactatcttaaaaagaacaaatgcaaattcaataaaattccccaatatctacgcatgaaaatatgattctgtcttttttttgtttgtctatctttcaatactttaaaaagtgtatttctagaggcgatttgtcatttcccgaataggaatttgagtaaaaaaaaacactctgttttttatttccactaatatcaaatcggcgaatatagttcccaccattcttatctccttgtcgtcactcggaattttttaaataataggatcgctttaataatataatctctataatttatagttccttttccaatattggcgtctccgttgaagctttccacaaatctcaaatttgtttggagactctcaaatgtatccttctctcgacgatgatttcgtctctgatttgttttgcttcgatcaaaggttcgtcctttcgcactcttctcttccttcaccttcctctgttttctctatctctttcgattcagttgttttatcgaatttgatcccttttttcaattgcaaaatcatatctttaatgttcaattcgatttctgtgaaaagtgttgttgtttttttcgcatttcagggggaaaggttgtgtcttttgatgataatttgacgaaccctaatgtatctgaaagctgttaaattgaataggagaagaagtagctttatggatgttgttgtttatatttactcctattg

SEQ ID NO: 6434 - DNA, 3000 bp, Unknown; identical to SEQ ID NO: 6416
  misc_feature (1)..( 3000): cDNA_ID_1007795_gDNA_ID_1621093_Annot_ID_55556 3000 nt of promoter + ATG

SEQ ID NO: 6435 - DNA, 3000 bp, Unknown; identical to SEQ ID NO: 6415
  misc_feature (1)..( 3000): cDNA_ID_1814389_gDNA_ID_1621093_Annot_ID_55560 3000 nt of promoter + ATG

SEQ ID NO: 6436 - DNA, 3000 bp, Unknown
  misc_feature (1)..( 3000): cDNA_ID_1977166_gDNA_ID_1621093_Annot_ID_55564 3000 nt of promoter + ATG
actgatcaagatcgatggctttgatagcaactaccattgagttcatcggaatgcatatggccttgtagaccgaagcactaacaccaacgcctatcttgcagatgatctcgtaggcttcagcatcaagagggaactcgagcttgttccgagccataaatagaaagaagatgagtacactcttgcttattgaattgttatgtttttagtggaattgtggtcttttagaggctaatagtaccatgaggctattcatatagggatgaaaaaagaaagagttggtttagcatgtgaacttgaaaaaaaagagagcctttaatgtaaaagcaaaacccttatctcttacttaaaaatatgttgatgaaacaataagatgaagcatgtgaaagagctaactaactaaccttagttaatgagattttacctttggtctttccagggacccaaagggcaaacactatcatttcaacttcaaaccggtaaaggtacaaaaattaaatggagctatgaaaatttattttcatcatttcacagaaatttaaagttctagatttagatatctagactcgttttacaacttttttttcatggcatttctgaagaacttgcatttgcctttgaccacatgagaaggaaacaaagactagagaaaagacgtcagccttcttgacatttggtaaaatgaatgatcaagtattcaaacatcaatatgctaagataaaatcacaatggaacagaacttgttttataagtcttcagggatgtccttgaaacatatactataaagtgggcaaaagacttatgaaacctacttaaacatcagcacttcactgtttactttgtctcacacgtaaagcaaatgcaagtaaatcaatgcagtcaaaactctaagcaacacagccaatcccacagcattaaggtctacttcataagaaacttgtacctgtcagtatgtgtttcttattccatgaactgaagctataccaataatcagtgtgcaccatatcagttggacactttgtcaattcaacacatacacgctttagcctgaacttttctttgatctgaaatatactcacgaactctctgagttttacttcgcatgggctcaatcatattttctgtcttgtgaattatctcttttgacagatgaccctccagaaaactgaacaatgctcctaatgtcatctttcttagatctgtatcaagttcattgttcatatcttcttcaacatgacagcttaaaccctgctctcctgaatcagtaacctcatcattttcaaagctcttcaacggcttctgatccgctttcttgttcttccctttgttctttctggctcgatttagaaccatgtccaattccaaataagaatctccaacaatatcaatcttcttgcttcttgtagccctagtaatcctcttctcctttaaagtctctaccttctctacattaaccactcccaaacaagcttttcctacactttcttcaatcttcttgctcctcgtagccttactgctcactctcttcttcaatcccctccctaaattttcctccaccattgcacaatcctccatttcaaccttaattaagtttacagatgaactctgaatactttcaacattcctaaagcttccatttttctccaccagatcctcttgtaatccatcagtaatccctaatttctccgaatcctcgattttcctaactttcctaaccctagaactcggcttgttctcaaatttcacatccaaacccttttcttcctcagtgatatcccccaaattgatactttctaaaaccctaattcgcttcctcgcattagcctgacgcctattgttcctcgtaagcttcttctcctgaaaatcatcaatcacaaaattcaccaaaatagatgtatactcacctagtttgataacatcgccatctccgagatttaccgacgtctctggatcaagagcattcgaattcaataaagtaccgttggaagatccaagatcttgtattacccaattcccagaatccgattcgatccgaagatgcttagtggagattccagcgtctttaattgcgatttcattaccacgaacgattcgaccaacacgaatcgtagatccaggcttgtaatctagagcatcgccttctcttggacccttgacgaatactaatctcaacgatggcgtaaccattgttaccgtttctctcccaaatgcgaattttgaaattttgatttgtctgacgctccaattattaatgggccttaaatgggcttttatcgtttcgacgataaaacaatttcaaggctaaaagctactattggctaaacaactggcattattgattacccaaacttccagcaacacacgtgaatctctcagcaaacttatctctcccttatccactttttttccaacctttttcccctcacgctcctttaccctcgcgtgtatctcacctcatcatttggatatccactgttaaaattcccttttatattcgaaatcaaccaaatttaaccttactcctataaattaattaggctcttatctacaattgttgcaaatcaacaaaacgtgcttctaatgctaacacaataattgatttttgagtatattcctctacgtagtgaacacgacgcgctaagatctgacgcgtgggatataacttgtcggtcaacgaaagcgccacgtcatcgccactatgcttgtccttatcatttcctttcacccgccaacgtcgtttcaagcacagcaaataatatcagaacacatttttttctttttatgatttaatcaattaaatcaccaaactcaattaaataaaaagaaaaaaattattattatcccttcttcttcttcttcgtcttcgtctttgattctcctgattcatgtcgcttaaatttttagcgatcttcgaatcccattttccttcgggaatctgacattttttctcgggaaatttttttatccaaatcggagtaaagtatcgaatctagagaatccgct

SEQ ID NO: 6437 - DNA, 3000 bp, Unknown
  misc_feature (1)..( 3000): cDNA_ID_1814371_gDNA_ID_1621093_Annot_ID_55565 3000 nt of promoter + ATG
gctattatgtcttctctcctccgattcacaggttgcgatcttgacgactccttgttcttccaactctcacgtctccttctactccttcggccattcctctgttgattctgttgtttccgctttcctcaaggatcagggtcttgttcgtaaagagaatctagggttagagttatggtggaagacgagagtcttgctaaatcggaggattcggaggagttgagaaaagcgattgagtcgatgtctacgatgttgagagatctgaaggaattggaatctgtgaataattatcgaagagatcatcaagaggacgtcaagattaacaacgacatcaagattaagaatcttgtttcacacgaaaccctaaatcttcagttaagttctgcaacttttggcgttcctgatgatgatcgtctcaaagaagaaacggagatggttgtattcgatgatcagatcttggcgatttttgagagtaacgacaaacctacaggaaacttggaagatcaagagatagatcttgatcaattcctagattttgatcaactcatagatttcgagggtttgatcgatggcgattactagagcactcaagagtatccagagcctgctgagactcgtcttttgatgaattcgaagatggaagatgtctcgatggtgatgaaaaatccaaatctgtggtctgattcacagaggtttagatgaaagatgatccttttcaatgagttaccacaccattgatgcagtttgaagatagctcagcaactaattttcttatatgcttttgtatgtattagtattatatcaatatgtaactctgtcggtattgaccaattgaaattaatagaatgtaattggttctgtcaactttgtttacaaatatttcttgtcgatccagtttaacacgaaacaaccccaacgaatctgaggttaacctaaaagcaaaaaagtatctaaagacttttaacttttggtgccttgtttgggttacatgtatggctcatctgaccctgtaagagagatgggaccaaatgaaccattgccttccaaagttgcaagaacataatagtcgtttcttctcttgtgtggtctctctttaaaccgcacagccaacacctgaaaccgcacaacaactccaacagcaatctttgagaggtcgtctttctgaaaatgcggtttctcgtcctccgacaatggtgagtggacataatgataatgtggcattttcaagagtgagaggtatgcgtatctgagtggtcctgacctgataaaagctccgttccacaacactttttttacagtcccttgcaagatatctcctcttgcaggcaagaatgtgcggcatgtgaaggacaccgggaatgtgaggatttttgcttgatgattgttttcgttgtcgatgttgttgttcttgttgttaccgatgctttttagagcggtgatgccgagatagaatccgtgttccctgcacgctttctcgtgtattagatcttggagtagtctgcatagaatcggttggtgcggcgattggccattcaagtgtttggcacatatagccacgtctcgagccatttctacttctgaaaacattcgtgtttatctgttacctgaaaaaaacacaggagattctaagttgaaggatgaatcataaaatccgcaaccagaaatgataaccatcaagccttaataaagattataaagcagtataaacgcaggtcataggtcatagagaaaacataacgtttaaagcaacgaagcagatataaaatgttttgacggctaaatagattgaagttatatagcattgaaccttatatggtacctgcataagaagaacttagttactgatcagcccactcaattctacatcagagaaaaggaatcaaccaagagacaaaattaagagcaaagtactcaaaactgaaactgctaattttacatcaaacaaacaaaaaaggtactgaaactgcagtaacaagactagaggtcaataatttctgagaaaatcacacaacctgaagtgatctcaacaagatacaagaagatatatgttgcacttctcaaagaaaatcacattaagcttccagagatatgggcattgatccacgattcagacaagaactagctacataaacatatgtaactgtctcagacaagaactagcaacataaacatatgtaactgtctgatctccaaaaacttaaaagaaatatctttttgattagacaaacgaccatttgaaaaatcactaaaccagtaaatgaaacacacacttatgttattactccgccattagaacctcatttacagtgaaacccaacatcgtaaaaatcaaaagtcttaatttttttccctctactttttcaaaaacatgataaacccaaaatcaaaatcgaaacccttaatcaccaaaattctcaaccgttccacgataaaattagacatcagttaattatcgaggtccctgcaagttctaattttacaccgagaagtaaaaaaaaaaggaacttgtaacgaaatcttcaacaacaaaacaaaatgagaatttttgcaaaattttagtagaaagcgaaaaatctaaccttgagaagaaaattcgatatctcatagagcccgaagaatcgtacgggcaaagagaggctcacgcaaaagatatctattttctactctctcttcccttctctgcataagtaactgcttttgactgacaaaatttggatcccgtcacaaggcgtgtgttattgaaatcgttttatttctgacaagatgcgcactataagtgcattttagcgataataagttatgtttctctataatacgctctttgtggtggtcctagttacgataaaccacgtatccaaacaaccctctaatcatctcgaacatcttattctttcccccgccatggataacagagtcaggagcttcgtttgcgtagctgaaggaatcaaaggtcaaatttttttgttgagagtacccaattgagagtattttctgtcggaaatg

SEQ ID NO: 6438 - DNA, 3000 bp, Unknown
  misc_feature (1)..( 3000): cDNA_ID_1814358_gDNA_ID_1621093_Annot_ID_55569 3000 nt of promoter + ATG
taaatacgatatgcctctccactaccactagaacgagtaaatgagtttatggctaaaagtcaagcggaactgcgggagcctaccatctataatgcataatgaaaaatagatccacgtagtcaaacaatatccactctttacatctaccaaaaatcaatagtatccacaaactatagaagttcaccatatttacgcttcatgttgtagaacttgaaatagataagattcaaaaccctaatcatatgtgcatgaagataattgatcgtacgcattaattaaccagttaagaagaaaacaaaaggatttgatgagaaaattaattcgagggacaagtgcatatgttgttgcatctaatgaaaggtgtttatgcagagaagaatttgtggttgggaagatggacaacgaataagatgatgagtatgaaagatgctgcgagataggaaaaggtattttcattttatgaatatgtattatattggtttagaaacgttattgaaaatctaaaagagaacaataattaaaaagataaaaatgaatgagaatttgaatggtgggagtcatagaaacaatgggttattgggggagtgagggatgttgacaaggcaaaaacatagcctttgagggtttggtatgtttattgcttccccaattggatgtgacttgtctcactatcttcaccggattcaattgaatagtactttgactagggaagatgtgttttcttgtggatataggtcggagatcgagttacccatcaataaatatctactgttcgtgtttttcagtcatattctatgcattaaatgttaataaaatccgatctttcaaggatttcaaaaattagtattgtttgggttattagattgttcttgctatcaagaaaaccaaaaaaaggaacaagcaatgtgtctttgttcgacagtgcaccaccaatctgaaaataattagactacttcttgggcaaaacatttatttaatttttctatgctcctagaaagtagaaacggcaaattacgtagataagtagaaacaagtttaccagaaatctccaatgtagtgcaagtagaattattcgttgggctctcggaactcggaagctaatgctaaaatagtccatcatgaatgtagtgcatctgttttactaatggtttgtgctaattaatgttgtttatatatgataggcttccgcataagtgatgttgctttttattttatttttattactaaaaagtttaggcctaggaacatacgtcctctcaaactagagcattttatatggtttctttccaaatgtcattacaactggtgatttctaggttttgtcttatagtctttaacaattgagctattaacactcagtaagtaatgttattgacataaaagaaatgtttatttgtaatatgatcaaatttaacgatatattatcaaccaaatagttttataataattatttgaatactaataaaaataaatataaatgactgtatatgtcgataatattaaatttacatgatcttgatttactaatactcagttagattgtaacttttaatattttcatcagatttgaatatcaacttttgctggatattttaactttttaagtaaagtattcattatggtgttattaattaaaaggattatgtatcattggaatattttattgtatctaaaataatagtcattttatttccaaagatttccaaaggatattatcccataaccacaaaacaatgggtggtatagtttatatagagatcgcaagtaaaatccatgtgcacttttagcttatttaagttttgaacggctcattatattcttattatttttgatatccaatgattaactaaaatcaatgataagaaatttgattataatacgtctaaacaaagaaaatgtaattgagcatgctaataaatatagtcacaaagccgcactttccgtcgaacaaattatacgttcatgtgtggttatacttgaaccacatgattggaaggttcggaagacaagcttattttaatttgattatgctctttaataatgatttaatggacaactgaacaagcccattttcctaaaattgccccatcatttcccggaatttcaggacaatgttgagagaagatggtccaaattgaagtaaaatatatactaagattgttatcattgattatttgttgtacgtcttaattaggatcaaacttagttggtcataactattttcaccgatgctgacttcgaaagttttaagaaatataattatatgattaaatcatataataatgttgaccaaatacgattcacggaatttttaccgcccaatttctgtatacatgtgatgtgatacgtgaagagttgaccaatggaggcaacgtctaacaaattggtaggcaattaaaaaagtacattaatcatagaagtgatcaataaagacattacttagacatgttgaaagaggtactcatgtttttataatatcatttttatttactcggaatcttaatatattttcatttttatttacttaacatattttgggcaaacgtatgttcgtattttcaaaacctaagagatgtaacaatatcattcaacaatcaacggtcatcactcatcacctatacttttcaggttattgacatgaaagagtgagatttactaaaacaacctaccaacgtttagcagaaggccacgtgttgagaacccacattgcaagaaaatgtagggattccatgcactacagcagatacacaatagacctttgtattttaatagttaaagaattagaaaagtcagacgactaatcacgggtttaaaccgttttttttctaccactatagtatagtactatagtctctttcttcgtcccttatattatcgactctatctccttacctcattcttgttcccctcttatcaaacttcacccccaacaagagttatcgagagagagagaaaacatattctgatttaagacatatatagacagcaagaagagatatg

SEQ ID NO: 6439 - DNA, 3000 bp, Unknown; identical to SEQ ID NO: 6413
  misc_feature (1)..( 3000): cDNA_ID_1814354_gDNA_ID_1621093_Annot_ID_55571 3000 nt of promoter + ATG

SEQ ID NO: 6440 - DNA, 3000 bp, Unknown
  misc_feature (1)..( 3000): cDNA_ID_1814342_gDNA_ID_1621093_Annot_ID_55574 3000 nt of promoter + ATG
tctcagagaaaacgacagataagtaaaacattaaatgtttttctttttcttgacgcccaacatcagctgtgtttttgtatttaggttaaaatgttacatgtatttataggatataaacgataacttaaaacatgtgattttgtgcaaggttttccgaaaattctgtttttatgtttacgaaaaaaaaataaaatctcatatttaaaaagttttctgtttttatcattgtatttacttgatcttgttgacaaaataactattttacttattatttataaaatttaagttaattaatttgtttaagtagtgattaacttactgatatgaatatgattgccactagtatgcttttcttctcaagtcaatatgaaaaatgtgaaattgttagccctaagcatctaacggatactgggaagcatacggttcatgtttgtcactacaacaacaatttttattagtcccttataacatatctcttttactgatcttaagcatcatccatagacaattgcaggatcacaccagttttggatcatctaaattttttttaattttactaaaattcctccagatctaaatttcattaaatcctaagtctaatacattcggtatttgagaaccccgcctttgttttaagatttttaatcataactcataagcgcgtatgaattcggattatccaaaggctaaactacagaaccaaaacgacatagttttttgtcgtttagaatctataagcgcagacaaaagtcaactttagaatcaacccaaaaatagaagtcaaaattaaaaaccaaaaccctaagattttagagtagactctcttcgaatggagaaccactttgttacatcgaaactgatccgtgtctctctacacgaagttgagaaccagctcgaactatcactacgtcaagccttcgagaatctccagccgaaactacgaccaccgttctccttagaactcccagacccacaagagtatcttgagctcaataaagccatcgtctatggagttttatgcgaaccaaattcctctaaaacccacatcaagcacttacatgctctcgtcactgatgggtacgcgtttttcactagtttacttattggaatcgttgttgaattgtatgttaagcttgttgattccgctaagattcagcttatttgggtaactaaggagatgattgatgtttcaagtgtggggattgaggatttggttgtgtcgttgttgcgacgaattggaagtggggattatggtgatcataatgtttggctttgttctgaattagttagtttgtttcttgagaaatgggaatgcttgcttgatgattctccattggtgttgactagtgctctgtatagttttcttcggttattagcggatcattatagggttttaggcgttgtgaaactggagaatgtgaagagattggagatcaaattctgtgttaaaatgtttagagagcagcttcatttaagtttgaagattggacgggaccttatcctgttgttgcaggatctgtctcatgtctctgagttcagagagatatggaacgatttggtgtcgaaccattgctctgagatataccagttgaagacttctagtagatacttccttcttcgaatcactcctgagatggaaacacaattaaggtttttgctaggaaatgttaaattgggaagtcataagcggcatcagatatggttcttgaagaagtttcttttgggtccggagaaagaaacacttttgatagatatagtgagattcgtttgctgtgttattcatccaactaacgaaatcatcagatcagagatcatgccaagatgggctattataggttggcttttggaactgtgtaggcaaaatcatcacatcgagcgaagcgttatgctggctctgttttacgactggctcttctttgacgaaagaatcgataatattatgaatgttgaacctgctgctctcttgatggtatggtcaataccgcagtatccacacatcactcactccttacttgaattcttacttcatcttgtcgaaacttatgacataacccgtcgcgatacgattgtaagaggtttgacgtcagcattcagagaaattgagcgaaaaggagttattcggtcgctggatatattcctagcaaatcctgcacttgcaccagatttgaagaagaagctagcaaatctgttgtcatgtcatcaggagaagacggttcatgtgaatctcaatcaagttagtgttctttctaagcaaacagttctttcttcggaagctaatttaaaagattgcagcaccaaaattgttgatactcctgaccagaagttggacaattccgttgaaaatccagcaaaaaaccataaggttgaactgttcaaagagtttataagaccctcacggtgaacaaaacccttagtctatgttgtgaatcttctataaatcttcagccggaatcgaagctggactctctctactaacgatcaagagactcacactcgagaaaaccatacaatcaaacacttggaacgaagacggagaagaatgacacccacgtgattcagtgattgatcctatgtctcggcgagaacagagactagcaatccactatctcaagtttacaagatcatcaagagttctaccagaggttcacgactaagtgttctcactccaaagataatagaatgaacacagcttagagatgatctttctctattatagttgtaacaaactctcgataaaccaatataatctttaaccattaccggttcaattaaatttttggttaaaagaatctttaaccgtcgatagctctccttactgatatgatccaacggttaaataaaacgtcattgtgtttacggatataactagactaaaacgcagcgttttaaattaaacgactagacccattaacccgacattttgacccgtctttgttcttcctcaatttcaattcgcgttcgatttcaaacctcagcagattccgattagattttgcgtcg

SEQ ID NO: 6441 - DNA, 3000 bp, Unknown
  misc_feature (1)..( 3000): cDNA_ID_1814334_gDNA_ID_1621093_Annot_ID_55576 3000 nt of promoter + ATG
gcgaaaagacggtttccgtcttggtttgatgagataaaccctacaagtagagttccttgttgaacaaccaagatctcggtggcacgtgggtgggtgtgaggtgggttctgaccgttgggtgcatagtctatacgaacaagtgagataccaagagtgtttagtcctccaaggttgttaacattgacggttgtcacgttggacccaaccgcgttatttgtatttccaggtctgttgaggctcgagaaaaagaaatcatccgcgaaaactatccttggatccttgcaaaactttccattcacaaacactagacaaggttttgataaaaatagagtattagtaatgcataaatcaacatacaaatatatttaataaattaaaaaatgatcatgtgcttaccgccatctgctggtgtgttgacaccaacacaaaagtcttgaagggggcttggatcggaagcaattactaatggaagtgtcaaagcaaagagagatagagccgcaagaaaagagagactttttatcgtcatatgtatgtatggagacgatttgtagaagacaaaaaggtttttgttagtttcttatttgtggtgtcaatgaagatgtgataaatttatgagacaaagagttcaatttatagatgattttcggtttgaacaagtccatatgtatgtatattccaatgtaattttcattgtctataagtttgaaacggtaaaatgctgttgaaaccgtgttccctcaggtcatattatattgagaattatttaaattattgtattgttaccattgttaagtgtagctttcattatctcgaagtttgaaatggtaaacctttaactaaaccgtgttgcatcaagtcgtattatgtaaggagttatttaaaacattatcttgttaccatgtttacgttagtagtatcttaattaaacacacaaaagatcttcaactgaaaaaggaggcacttgaaatttaaaatgttaagtgtcggcattgatagagttatataagttacttatactgcaagagggtttattcaataatatgattgtttctcaggttttcatgaactatacctgatgattttgagaatatttgattattttatttgcatgagttttagagttgacattgagagtctttgacaaatgtcaaatgtgaatttttggtggttttgggttgcttgattcgttaagcgataaaacatgaccatatcaatatatagatgttaatagactgatcattgaaagagagaggctgttactacttacttgtcacggaagaatatcctagttttgtagagagattaggaaacgcatataagaagatactgtgaaatttaaacgcatatatatatatatatatatatatatatatagttgtatagttatatagcgtaaagtagataatgtgaagtttcattgaaagattttggttttatattaagattacaaacaaaacattatatctttgttttgacagcttaaagaactcaacatcatgtctgatcatgtccctataagatgtgcaaaaacgactatcggattcatatcaaaacaaaatttggattatttcccctcaccactgactatctcatgtacacggacatacagtttgtatattatagctagctcatgtgtttatatttcaccaaagttttttagtttcgacattgtagctcttataactcacttaagttctacaaatatatgtttcgagtactaatgagttttctaatcaatttgtttttgttaattatttcattgaccgattgaaataagacaagtaaccaaagaggccacgacaaagatttcaagatacaaattacaaatacttcccaaatcccaaccaaatccgtaatactggggatccacacaaaacaaaaaaaaaaaacaatacaaatatatgaacggagaaatgtgggcttttatttccatcattatactgccaattgggcttttacattaataactttggccgacaaaaaaaaaaaaaacgaaacaatccaattcccgaatttaccaagacgcgaaactaagtggactgtgcaatctcttttatacatttttaatcgatcgtctaacaacatataaaaagcaaattcaattgcaattcaacaacgaaggagtaaaaagatcaacttccctcctgctacgtggtccactcttattagcacaaacatcactaattttcctgcgaaaaatagctgtgtctatatatttaaacctttttaattacatcaattcaataaaaacagaagaataaataaataattccgaaaatcccgatgatgactgaaagagatatgcccgatcttccacgccacagtagtggagctgtggagaaagaagacaaaactgtaataatgttcattattacaattttcactgacagtttttttccataaaaagaagctaccacaattactactagcagtaaaaataaaagaaatctgaaatataataataacaaccaaaaagtgaaaaaatcaaaccacaccgtcccactaagaggattaaacggtaatttgctctatcacgtaatataaatgacgtggcatcatcgtgtctagtcagcttcttctttaataacctcttcagcttcagctatcacactgcacctataaaatcaaccaatctcgttttaaccccaaaccagaagaagaaacaaaaatcgaaattctcatcaatagcaaaaaaaaaattactcttagattttcctcaaaaaccttaatcaatcgccgggaaaatgaatattccggtgactatttcctccattactgtttctaataacgctgtttccgacaatcgtcgtcatgtttcccgtgaaaatcgtcagcgttaagaaaaccgtcacttatatttttttttcttttcttcttcgtttttgtgaagatgatgatccactgatttgagagtagtagcttgagaggtttttagtagatttcgattttgcgattatttttgtttcctggagagatctcatttttttgccacttccgatg

SEQ ID NO: 6442 - DNA, 3000 bp, Unknown
  misc_feature (1)..( 3000): cDNA_ID_1814321_gDNA_ID_1621093_Annot_ID_55581 3000 nt of promoter + ATG
caaatcaaagcaatgtcacatagctatcatcattgatccagagaatagaaatactttactatcatcacattcttctcaaaggaaagatatgagaaagactctggaaaaaatcaaaactgaaagatcacagagaaaggaaaaggaagtagacagtaatttccaggtttttctctgaaacgaacatctaggttatacaaatcatcatcagtaacctaaagtaattcatccataagataagatcaaagtttctgtttttataagaatctggacacaatgtagacatgcattagcaaaataccaatttcataactctacagtactcaaaacagagattcagaaattagtttcacattacatatctactaaaacgaacactaaacaaaaaaaaaaaaagagcttttcactaaaaagtatttctcacaggcatttaaacaaacactacgcaggcatgtaagtaaacaagtaagagtcctcaaaattctatcaaaagttaccaactttaataaacccacaaaagctttgtatttgcattttacgattaagtactcagaccatcactttttccacattttctcgagcaacccatggaccaagaccttaagactgaaaatagctgagaaattgattgagaaaatcaacagaatactgaacccatgcctttgtttatagattcctaagatatcaaacgaaacgagaatcggcaatagagagtgaaaactggttttggagaatcaacgatgcgagaagcgagagtttgttttgttgtttcaaactctctatcgactgagaagtaacactcggagactttcaattttggtttgtttacatgtcgatgggctgaaaagacccattattactgagactatattattattggcccattagtattcactttttctctattttcttttaaatatattttcagaaactaattaatttttcattttaagattactaatttcatatatttaaaaactttgaaaatttgattctcaaatatttaaaattagattaaactttttaatcatattcgaaaatatactttttcttctctaaattgatagaaaaatacaaattaatatatatttccttttaattatttaatctaattagattaaaaaaatatctccattgaaatctggtcgtctgtcacgtgttgtgattatgttttttttttactcaaacatgcttctcatattaaatagggattaaaatcccggtataatgcgtttgtgattacattaggaatgaggttgtaaaaatgcgacaaagcatcagatggtattctatgtttcgctaagatatccgccgctttgttgtgatctcttcgaacccaagtaaactggcagtcattaaacttgtctctccaaatgcgtgcttccctaatccaattaaaaatattgaaattgtgttgccgaccatgaagcagttccaccactgttttgttatcgccttcaaaacatactcttgtatatcccttaatccaacagctttgcattgcaagaattagtgcctgaaattcgctttccatagctgtgtttacatgtcttcctttagcttgacctgcacctctaaaggtgcctctgtcgtctctaatcacctatcctgcactagccggttgtccgttgataaagctaccatcatagttgcatttgatccagtttgtattcggcttcatccaatgatattcgccttgaaaaccaacgttctgaaattgcggagggttcgtcattcccaaacttctttcatcttgatcatgccattcctttgcatcacttcgagcttgtcgtattacctttcgccatgaaaagttcctttgttgaaaggtgaggttgtttcgtgatatccatagtctccacaagatccaaagaggtaagtgcttaagatgtggcgttcttgtccccgtgttacacttgaggatctctctcaacttttcttcccatggggtccgtgggtcatagagtaacctgtttgatattccagagcctcgccaaacagctttcgcataggtacagttgaaaaataaatgctctgttgtctcttcctccatacaacatcttcgacacctaaagaaacggctaatgtgattatgttaattactcattttaagaaacaaagttttacttaataaccttttcccctttttaataaggttttcccttttttatgtaattttcttattttcattgaagtgtatcctttttaactatatactttaatataaacgttttactttttttgtcaaaaaattgtatttttcatttttatgttagcatagatcaaaatctaattagaagaagttctttacatgtatcaaaatctcatcaattgattaacacatgtcataaaaaaagagaaagatggaaggtcatgatttcttctaatctcttttttactgtttctttacataagattcttatctttgaatttactaagtgttttgtatttggcaaaaaaaaaaactaactaactcaaaataagaatttacattgaaaaaaaataagaattaacattttttcaataaatattttacaaatctccgctagtttcttagtttcaacaataaataataaatatagatgaaatttgattgttttaaagaattaaatttatttcctataatttatcacaacttagttatttggatttagggtttctagtttttcagaaatcagaaatcaaaattcataaattttcgacggttaaggtaatttgattcacatttcagctttactaatgtgtaatttcaaattagtaattaaattttcttgatgtcgacataccaaaaaaaaagaagtagataagtcaaattatataagaagggaaacatatatattacattaactaaatcagagaaagtattttctttcccaaatcctaaaaggtttttcttgaatctatcttttaaaagaatctagatcatattcgtttatctgccctgtttctctgatattatatatattggatttatgatttcttctcacagggttaagagaaaag

SEQ ID NO: 6443 - DNA, 3000 bp, Unknown; identical to SEQ ID NO: 6412
  misc_feature (1)..( 3000): cDNA_ID_1808894_gDNA_ID_1621093_Annot_ID_55582 3000 nt of promoter + ATG

SEQ ID NO: 6444 - DNA, 3000 bp, Unknown; identical to SEQ ID NO: 6411
  misc_feature (1)..( 3000): cDNA_ID_3593510_gDNA_ID_1621093_Annot_ID_55583 3000 nt of

SEQ ID NO: 6445 - DNA, 3000 bp, Unknown
  misc_feature (1)..( 3000): cDNA_ID_1814309_gDNA_ID_1621093_Annot_ID_55585 3000 nt of promoter + ATG
tttctcagcttactcgcgaagattgccgcaaattcctcaaagagaaaggtttcttcttcttcctttctccatttttttccggtcttattgtcttcgacggtaggatcttcctcacggattttgctgagaagaatcgtacatagtcaattttttgaaattctctattcttcttctctccgagctttttttttcgctctctggagaatggcggctgacacgtgtcgaaacaggaatgcgcaggccttcgtggaataaatctcaggcgatccagcaagttttatctcttaaagctctctatgaacctggagatgattccggcgccggaatcctccgcaagatccttgtttctcagccgccaaatccgcctcgcgtgagtgttgttcttcgattttgtttcgatttacagagaaaaatctaagttctgaagtagtagagaatcgtttacttggttggtgctgatttagggaaaattgttgttctgtgtgtactgctgttttgttcacaggttacaacaacgttgattgagccaaggaacgagctcgaagcttgtggaaggattcctttacaggaagatgatggtgcgtgccatagaagggattctccaagatcagctgagttttctggtagttctggtcagtttgttgcggataaagatagccacaagactgtttctgtttcccccaggtttacattttcttctatagcgttttgactttgtgtggtatctttcttctgctttcatgcctcaagaagagaactgatgcattgtgacattctgtttgtgatcttagaataagtacttggtttgatatcagtgtcttagacattgaaaagtttctatatgaatcatggttttgatggtggattggtcacacagaatttaggttaaaagagtcagatagatcttcttggttctgtgttactctttactcttctgttttgaggattggtatgatgtgatgtgattattgctagtgaacgataaatcagttacttagtccattagtctatatgatttgtgaattctgcaattactaacaagagttttaggggtagttcatgtacaaagtcttattgatattaggtgcatgttgttttataaacaaattactactccaatgttatttaattaagttgtttaaacacgcttttttgtaatgttgcatcagaagcccagctgaaacaaatgcggtggttgggcaaatgacgatattttatagtggcaaagtgaatgtatatgatggagtaccacctgaaaaggtaaatgaatcacataattctgtccagcctgaaaatataaattttgatggtatggttttgatcattcatcttgtgtattgatttgcaggcccggtctatcatgcattttgcagccaatccaattgatttgcctgaaaatggtatttttgcttctagtagaatgatttcgaaacccatgagtaaaggtaagcatttgctaaagtgtctgatctgcttttcagttgaaagattgatgattcagacttgaaatgagttttttttttaatgtataatctaacttgaaaaaatgactagagctgctgcatctcaagatgagtctttctttctttcttatgtcaaacacggcctttcattttgtccaattttgaaaggaggcattgttaaattaccaaagaagcatgtctaaatgctgtaattgctgctacctctactagcttatgtgtctacagatgcctcgtgcccctttttttgaaattgtgatttgattttttcagagaagatggtggagcttccccaatatggacttgaaaaggcacctgcttctcgtgattctggtacaaacagtactcattttaccttaaagatatgaaatcctattattcaatgatgctttaaaacacctgagagcgaaatttggtccacctcttcacctctacatgctacgctaaactacttgcttgttctgcatgatatacgaccatgaaattctgttaatttaactattgttctttttgttggtcttttctgaagatgttgagggtcaggcgaacagaaaagtatcgttgcaaagatatcttgaaaagcggaaagacaggtagttgttgctattatgctgtgtgcttgcttattccaaatcgatgaatactgatacctttctttctgagcagaagattttctaagaccaagaaggctccaggagttgcgtcctctagcttggagatgtttctgaatcgtcagccacggatgaacgctgcatattcacaaaaccttagtggcacagggcattgcgagtcacctgaaaatcaaacaaaaagtcccaatatctcagttgatctaaacagtgatctaaacagcgaaggtatgaacaagcatttgtcaaatggttccaatgatctcccttaaaactctcattcgcttttttatagataattaacaaggtgccaaaagaactggagatggtactacgggtcaaaaggcgggaagaacaatttcatgttcttataacatgttagccatgtacaaaaagaaagaaagcaaacaatgaatgttctcgttcattgtggaagaaacatgggttaaagatttgagctggatcagtgcgggtcttgtatggttttgttttttttacgggttgcgtccatcttttttggtctgtagttttgagtaggttagagagacgcgagagagagagagaggatgtggcggtttgtattatgtaaatgcttgtcttataatgagagagaccttattgatgataccaatctttgaggtccaagtaacacaacttctttgtgattgatatgtatgagataattaatttgtctattttcatggcatgatgtatgtgatatgtctgagatttgcaacattcttctataaagttgagaaataagggtagtttagtctttttaaccaaagatttttatttatttgatcttttccctgttttaaaaagaagaatcgagtaatcgggtggttttgaagacgaagaaggactaagacatcacgaggaacacgatg

SEQ ID NO: 6446 - DNA, 3000 bp, Unknown; identical to SEQ ID NO: 6409
  misc_feature (1)..( 3000): cDNA_ID_1814306_gDNA_ID_1621093_Annot_ID_55586 3000 nt of promoter + ATG

SEQ ID NO: 6447 - DNA, 3000 bp, Unknown
  misc_feature (1)..( 3000): cDNA_ID_1814548_gDNA_ID_1621094_Annot_ID_55588 3000 nt of promoter + ATG
taaaatcggggattggactgtgggcatataaaataggtaggaatagtgtcaaactttaatgatgaagataaagattattgtggagtcccaacacatccacccatccgcataaccacaaataaaattaatttctctctatcattctcttatgcccaatgggtctcttgtatttaatgtcacatctattaaattcatatcaaacgtttctatatatgtgtcacggagatatcattgcggattgtgtatatacatattattctagactattagaaaacattaccttttttctttctgttataaataatgtttcttttgaaattctgattagataagctgattgtgaattttttgttgataatgtgaaaatacttaaacagaaaaaggaagggaaagcacttgtaaaatggacaatggtagtgtcattaagagggaccatgagaaatcatgaagttcagctacatttcccatggattcctcggaaccactttttctaatctctccaaagatttaattaataaggtttaggagagagatagagagtcattagtgttgaaactaatcaaaacaaaatctaaaaatatcttcattaagaaatatgcaatgaatggatgtatgatgatatatctgaatataaactataatatctgagacaaagaaaaaagaatagtagtactaaacaaagtagttgaaatcagaaaacataataaccacaattccaaacgcatgaaatgagaatagtcctgctactaactgctgagtggtgtgtctgttacatatcaagattggggaccatattctcctgaggcgatcattcatttgaaacagttttacattgctcattatttacgaaatcaaatttttgtatttctaagaatcctatgtatttcagaaaaatattcttattatgatatcaagatgtgttttattgatttttttaatattcagaaagtttcacatctaaaacaaaacatacaaaaaggatatagaagtttcacgtcgaaaatcaaatataattctcggaatctgtataacattgagtgtcattaatgtattaacaatggtggagatccttatactataaaagaactcaatctctaaccttttttttttttttttttgtgcaaactcaatctctaacctaaacccacaaaaataaaggaatcttcttcaccaacttataatccaaaattgtaccacatatactgttaaacatcaccacgtataattcacaatatctcagttacagcagcactgtttggaaaagctatttgttttttgcgattgtttcaaaataaactatgtaaagtgatcatatttagacagggaagcgaagatgcatttgacaagactattgtgaaactgaatgtacggaagcatacagtatttgtgcatgcaagtagagaagaaagaagatcacatttttgagattctaatctaacgtacaaattagttgcagtgcagtgtagtttagttccagtccaacacgtacgacgtacttcttttgctttacaaatgtttttttttttacttgtaatttactcaattagaagaacttcaagtctaacttagtttactcttagttttttttttgtaatttttcaacagctgtttgattgtttctatttgggtaattaaaatacgtatttttaattttcaatatacgagtttctttatcggctacaactacataatatacgatgttttgaccgtattgtttttggggtcaaaccattttgttcctatttaaaagaactataaagagtgacgaaccctggaaacaaaatcaaagtcatagaaaaatatcaatccatcgaatattaaatatacttcaagtagttagttgatagatgaagatcgaccgacgagaggctttatcttccatgcttttcgtaggtttactcatgaaagatacgagatggtgagaggtctctcttctcatttatgtcctctatactaacaaaaaaaaactcaaaaacacttatcgaattcaattaaatttttagcatatctattaataagtctctttcatttgtccccatatatttcgggtaattaatttattatctatgaatcatcgttgtcattgcaacgcatgccaattattttttttctatcattcgattataaactcgaacagtatagaactgtcctccattcgatttcaagaaacatcaacagttcttcaaatgaaacgtggcaaaaatattagaacaatgcagaaatggtctgtaagtagattttgtttgccttcatttcttcttccattaataaattgttgagctgctctacgagtaattagttccaaactctatttcaactttttattttatccaaaagatgagtgagattctatatatttaccacgtaagcaacttttttgttgatgtgagattaacatttcacaaaaaaccatatttttattgattattttctacttatatcctgtattccaaaaagaatacaacaagttgccaaaaaagaacaacgttaaactttacaacataaaattttgtcttttaagtaaagatattttctttaatataactaaatcgttcaaataataaatcttgaaatgttctccaattccttctggaatatcaattcacacaaaaaagtgaattgtgtattttttttttttttaattactcgtttaacctaaaaaaatattgatggccaatttcagaaaatatccgtatatttggaaaatttacaaaaataaaaaaaaagcttcatttttaattattttttcacaaaattttagcttatttttcatttagagagagagaaagagagtagtagggaaaaagcaagaaaaaacggaagagctgaaaaagcagagagagtgatgaaaagaacagcttcgttgtcacttgtcattctataaatcgcatccccattgacaacctttcacttccatcaaaactctctctctatatctctctctctatatatctctctctatatctctctctctcttcactctctctttctttcaaaatg

SEQ ID NO: 6448 - DNA, 3000 bp, Unknown
  misc_feature (1)..( 3000): cDNA_ID_1814544_gDNA_ID_1621094_Annot_ID_55589 3000 nt of promoter + ATG
aagagttaaattgaagtaagaaaaaaaagtcatgaccaataatgcactaattactaaagcacaagaagaagaaaaatcatcaaaatcatcttttatagaaaaacaaagaacttttattgttttcgaccaattaaacggtgcgagtgaaatatcattatttgattagtccattgtcgtattctctagcaactccacctctagtttacttcctcaagaaagagtcatatcatacgttaagtctatatcggcaaatcttgaccaaaagaatatatcaaatagaataaaatatattgagatcgaaaggaatagactcttattccaaagattagaaatcagaatgaaaatggatcggcaaacggcgccgtatttgttgccggccgccgggaataaacaagaaaagtaatggcaacaaacatcaaagtaatggtttggatagatcgatgaaaccataattgaggacgctagtcaacgtattgtagtaacatgccatgtgattgccagcttcatgcacagacaccgacatgtattatcatgctactattcatatattaatatcaatatattagtcttatgtaggaattttttagttaactattaatgcacgataattaaggagtgatgatgacaaatcctcatgcatatatagttggaacaaagttccaattcatgcactaaccactagttaatcgtcaatgacagagcgagaggcagcaataatcttctctgatgattggcttccagattcaacaacttaattatatcaatgttttttttgggtgcaatttgatttatatatatactagttatttagcatctcaagacattcttatcatatttaagttgataacttgatattgtaatcagaatcatcaaatattgacattgtacgatgcatgcatttcattagatccacactgtctgatccgcttcttccatttggagtttttgtatactaatccctgatactaatataactatttaattcattttttgtttgtttaagatatcattttttacgagatttgagtgagacattgcattggttgaactaattcaccacaaaaacctaattcattacatacggaccatttctgattgttttaaacttaatttcaactaactcttatttattgtggtacctaaatttcctatataataataagcacatttaagaaaatttgtcgatctcaagtttcaacaactgtctattaaacccaaattgtctagaagcagcatccatcttctcaagctaaacaattgaatttagacctatcatatatgcatcatatctaattatcatttatggatctatgggaaacaaataagcaagaaatattgtggtatagggtctaattactatcaaaacgtgtcctacattttgagggggtcctccgaccaagaaaataaatactttggaattaatctttaatgctgtgaagacataaaagataagtataccaattttattagcaagcgtcacttactgaaaaacaatccctataagatttctatttctgcacaaaagaagaaaaaacatgaaaggttatatagtacttatatatccatcgaatttatacgcccacaaatgactaatgcctgattcacatgcaggcaattcaaaactagctcaattttcttctgttaaccagctctgattactcattttatctaatagtgttggattatatatagggataaaatgtgatgtatagatatctcttgaatagtctcattcgactgaccacaaactaaactactaacatcattttctcatacatttcagcgtgggccaataaagccaacgtgtttttattattccaaatgttgacataagatataatctattatatggtaatggtaatatgtgtctcattctcatgctaaaatccatgaacgcagaacgtctctcatcataaaatactagaagttaatgataaattatgtcacacggattctgcatgttcttatacccttttttcacatggctcacccatcacaaatctcactatctaatgacttattcacccctttctaagtccatgtccaagtccaaaactctaggtgtctatttcttttggatgagcagtgatgtatcaatatctcattatgttacgtagctatcttagctaggttcatcacatacgccgtcctacatatattaagtgttgaatagaaagttaattccatctatctcaattatcaaccaacgtaactatcgtatttagatatcaatcacacacacacacacacacacacaaaagtttatgtgattaattaggagtaggattcggagctacatttaaatgcaagttcaaactctacaatatcgataacaatattaactcaattgtttaattagtctacttatcttttattgagtaaactcgaaggatatgtatgagttgcataagagggtattctagtactttgtgatatccaacgaataaggcaaggaatctaatctgagctaatcataattattgagattgtgtgtagttggccttcgagtggataaatcgtggctatggagcttccgttctgcttcttcttctcccaaattattaagtcatcctccaaatcatatttcactaaacttgcaaaaaatataaaaaagtatatatcttcataattaatgaatggtaattaacctactaaattttcattgatttatgtataatggttatgtgtttttatattacatatatagtttactagagtttaaacattccaacataattccactaaaactcaaccaaaaagggggtacaaaaaaagagaaaaaaaaaattaaatgttattgagtgatgggtagttaaagaacttatggtgttaggctgtccaaaaagagaagcagttaaagagtttggagtacaatgtcttaaacaagaaaatgtctgtcccattataacatctcgaaaccaaacacacacacacacacatataacaatctcttcttctctgacattacacaatggtggtttgagtttacagaagataata

SEQ ID NO: 6449 - DNA, 3000 bp, Unknown
  misc_feature (1)..( 3000): cDNA_ID_2041095_gDNA_ID_1621094_Annot_ID_55590 3000 nt of promoter + ATG
cctacactttatcttacatatacgtccaaattggctacatttgtccatgaatataataaaatacacaaacacaaatcttctgagaaacatgtattgcttggtaattaccattatattatcacacgatggaatcaaattttacaaagaaaaaaaatcttttatcatttttggcttttgatgaggactttacagattaattgagtttctattgttagcttcattagtgaccaaaacaagacaggttataaacttgttctcacatataactctttttgtgacatcccacctttttttatgtctcttctactcacatttttttctgtggagatcttgatgacccctcttcttgatcattatccattttttagatcttgaacgtacacttattgatgtttgttggtggaaatgtggcttgcgtgcaaaacaaaaagaaaaatatttgaacatcttgcggtttttgagactctaagattgtaatttgacaagcactttatcctcactaatacatgtaatcaaatgatataacaatttgaattataactttttatacatttaactgtgtttgtaggcatttgttttagtttaaatatctttttaaactatctattttcaatattgatatttcaattttgacgatttttgtaattaaaaaaaaattgttatttaaataggcgactttacattggaggcaatatctcttactaaattttgtgattaaaatttgttttttttttttaaaatgcagtcatcttccggaaaagatcaatcgtcctcttgaaacccctaattttctattgctgaaatctttaataatttcactaaacatcattaatatcgatgatcacatcttatccagggccaaaacaatatctatctcaccgatcctcccgttaatagttcatttgtcaacggctataatcgttcagacatagtattgaatatcagtgagatctttcactttgcaacaattttttttattagttaagaagagacattaaacaatatttgcttactcctttgttaatacatatgattaattaagaacacaaaaagctaatatgcatgattacacgggcaataatgttgttcaacatgtccctttttataaagtgagaagtgtaaatatttattttcttgaaaaagtagttacaggtgataagtttgtatatagaacaacaattgaatacatgcatgcctaacatttcttaaaacataacatgcccaacttattgctaacttcagactaataaatgagatggtgtgatacacacactatatataatatatgagagaagcttaaactactaaatacatgtaaaatgctaaaataatgttttctttatacagttgatcattttagactaaaaaatcagattacataatctaaaataaatcattgtcgaaattaaattaaacaaagatatctaagacattattcattattgaaattactgtatttaatgtggacacatttgtcgtatgttgaaatttttgatatgtcacatttgtgcctctctgcatatcaaagtctttcatatttaaatcctatcatattgccgacacttaaaatccttttttttttctttcactaaaccatattcctataaagatacaaaaatttccttaaatttcgttaaacaggtaatttttctactatttaattacaaaatgacaccaagataaaaaagagtccaaaagatatagacaaaaaaaaggtaagaaaatttatttttacaaaaaaaaggtaagaaaaattattaaaaatcgaatatttactatatgcgccaatcatactaattattctcttgtcacgcagtgtagacgaaggagagagagaagagaatgttgtgtgtctctgtggttctcctccattgatgtctgaaactgaagagtcaagtgattgaatttgtgttcttgttttttaccctttgtatatatttctttttgggtaagtaagtgcttttgatcctttagaaattctctgagataaatcgttttcgcttgatgtttcagttttcaatcgaaagttgtcatctttgtgtcgctgttgcttgcattcatcacaagtttttctcctgaatttcgataaagttacttcctttggcaattttgttgctacccattttcatatttctggttaatttcatctacaagtaagatttgtttagctttgtttgtgtatataagtttgattagttttgttcccaaagtttgacgaagaattgttatttgctgtctctattattggtggttgatgaagtgtctgtctctctatgatacattttcctgaagtctgcagttttcagtttgtaccaactcaattcttatgaaacataaagactagcttttcccttttctccctcttcttgattgtgttttgttatacattaaaaagcttactcatgtttgtatctttgtctatgccttgtttgaagatagttttgtgtgttatctctctgaagattgctgttttttttttcttgttcaggacgatccagtgtttatcattcttaaggacaccaaattgatatttagcattaagtacaaatccacagtgcaaaggtttgtttgcattgggaaagcaatttaaatctaatgtaacttccttcgttgtttagcttgattataaggtcattttgtttcagttttgtagaattcttagtttctagcatactagtagaggatcaaaggaatcaagtagtttactttggcgtagaacccgttcgttgagcttcttgcagcagctgttatggccagtctgtcgcagtcagaatctgggaggttgtactcgtggtggtgggatagtcacattcctaaaaactcaaaatggattcaggataaccttgcaggtattctataatctttcttgacttctccttggtgttttttatgagtcttgaaaattgtggcattataatgcttttgatttgtatgtttaaagatattttgtttcttttggaagtcaatttaaaggaaatatttgtttgtgttgaaacagac

SEQ ID NO: 6450 - DNA, 3000 bp, Unknown
  misc_feature (1)..( 3000): cDNA_ID_1814533_gDNA_ID_1621094_Annot_ID_55592 3000 nt of promoter + ATG
atgttttgatgaaacatatatcgggtacttcatgcttcatgcttgagcgtttgaatgcatgaaagctagactcgttcggcctaagtgcgggactagccgatcttggatttttttaaaaaaataattaataacaagtttatatgaattatattgcatattatgattttttctaagtgtcttttgattgcgagatgtctacgtatcgttttgtgattcacaatcctaactcaatcaagatttctgtgtcgattttttacgcatgtatgaattagataagtttgtagttgacaattattttttgaaaaacggtattttctcgtaataatttttttgtccattcctcttagattgatgtgaataattgtaatatatatttttgggctgaccttggactttgcaagtctctcgtcttttctctttaagtacaaaaaagttggtatgcaattcttttgacttatgtactcacgaatcaaggtgaatttcaactttttcattttttcatatcaatatattgatttcaatataacaaagtggagccacgccgatatatataatattaagacttgtttttctttatcaccaatgtccggctccttgaagagataaacaaaccatgttataaaaagaggatgtctatttgagctttttagatgataatatatgttttctaatagctagtgttcgaaggtgagaatgttatgtttatatatatcacatcatccccgatttctactttggatcttaaagaaataataccgttcactcataaccggataagtggaagctgttattcactagatatggtatattggtattactattaaccttttgaagtcaagtggagatttaactgcaataaattttggtcataccagatacaatgctagataataaaagcttgacatggttttctaaatgttaatggttttgagagcgcgtacatatgtagattgatgaatggaagcttgacatgctttggtcaaagaaagaactgcaactaataatttgatattggctattatattaaggtgtttagaccaactatactacttataggtttatgaagtcaaatgtttttgacttttcagtaagatatacatgtacatgtcaatcttacgtatagatgtgtattgcgacacaaaacaatatatttaagattgggtttgatcacatcttggaccgggctccttcaaaacaatttatgtttgtttgtattgtattttcaactttttaaaaaaaaaatagttcaaaaaaacttgggaaccccgggaaaacatgtacacacgggttcgtggtaagattttttagaaattacctaaacataatagtttgaatggtttctatatgttaaatgtatttcagtatgaacccaagtgataaggcgcaatggtaagttgggatacattatgtagacacttcagtgtgtacgttggatttctctacgtactaaaatctttagtataaagatatttatttcgtagacttactggtttgtcaaagtcttaagtaccgtttgaaccgatcaagcaggcgactaaatcttctgccttaagtttttatgggtcttagtttgggccatccatgtaaattgggcctcaagatctcagtttgtagtatatgacaagccttaacatttgataacatatgtactcaatttaaaagaaaactattttgtttttgttcaatggctaataatatgtatttcctgccaaattataattttatatgtatgcattatcatacattatatatgcatttaatatttctatattatatagacatatttttcttttttaaaatgttaaaatattacaaaactgaagatataaatgtttaattctgtttagatatatatttcaaacacaatagatatatacattatcaaatagtggatatacactttaatatcctacgcgatatagttggaaaaaatatagaaaacaagaagataaagattaccatagatttaatctcttagatctttagagattaaaacctaattgaaaattcaaacaattagaaggtattgaatttaatattttcaatatctctaagaacaggtctaccaatagcaaaacacataatccaatttttgtttttaattcagttttttggatatgatttagatgggaacgattcaatttatcagatagattaaaaaaataaatgtttttatgatatttacttcctattttaaaaaatccaaaaaccaaagatatgttttgatgatatttctttaagaaatatttgagagaaaaaaacaaataaatacgtatccttaaaagaagcctgaaagaaacagcttctgttccgtctttcactctccatctctcttccgtcgtttcctaagtccttttctcttatttagagattctctcttttcatccaaaaaaaaggagagatatttcagaaacaatcctctgcttctggagataaatctcgctcttttagcctcataatccaaaacccaccattaaaaatcctctctttcgttccctttgaacccatcaatttcagtttgcttattacgtctctgttctctgcatgtccttgtggttgatacagctgacttttggttttgtcgtttatgttaattgaattttaatatttgatcatcgttgtgctatattagtggttaacgagtcgttttcttaaggtttactttttcgtattgtcacgttagattttttaggctacaattgtagagaaattcattatctgaatgtcaaaccatgtgcatgatctttgagaaagtttggtgattaatagtttcttcattattaaagctgcctttgtttaacttagcaatcataagattgtttttgataacttttgtgtgatttaactattcactagtaataatctgaaaaaattagtactagatttcatgatgatgatgaaaagattgatgatttgagtcacaaaatcttgttttttgaaagttgtgtgatcttcttgtttgcatagtgaattagttttgatttgaaaagattttaagta

SEQ ID NO: 6451 - DNA, 3000 bp, Unknown
  misc_feature (1)..( 3000): cDNA_ID_1024003_gDNA_ID_1621094_Annot_ID_55594 3000 nt of promoter + ATG
tcctgccaaagttaatgagccatgatttcagatccattcataaggaccgaaggcgagaataacgaaggaagaaaatatatcttaccaatatctggtacaacccgtgtgtagggtgtgcttgggaatacccagataggaggtcaaatgttggaaatagtccagcacgctgcatgataggagttttgtgtaaacttagacaagcttaagaaggaacagatgtagagaactaatcttaatgccataaatttgcctcaagaataggtgatggagacttgagagaagagtgaagcaacggaagatcctctttgtgcaaacaagttacttcgccaatagggaactttgattgaaacctgccagctctccctacaacaggatcatcagaacattagagaggacataccaatactcttgatgtattatttggtgctttttgttgaaaatttacctgcaatttgtttaatctcagatactgttaggtctctggtctcggaaccatcatatttttgaagggtcgagaagataatccttgaaatattcaaattaagacccatgccaatcgcatcgctggcaacaagcacatcaaagtcattggtctcatcgttaaaccttgttgcctgcagattttaaagcatttggaaacaaaaaaagataattcttagagcatccagttaagcctatagccaagacagtaaggaactcaaacctgtgccgtgcgagtctctggaggcaacgaaccataaaccacagagcaaagatgcttccccgcacgttcaattgttttctacgaaaaggtaccaaaaaaaagagtaaagaatatgtatggaagcattcaatactcatgacgcgtagagaatagagctatgtatgcatataatatgatgccaaaatgttctatttctttcgcagcaaactcaagcagaaaaaagcaaaatacaggaagagagaacaagataagtaactgctaaccttatacgcatatatatcttttcgggaaaaagtgacaagacaatccccagttttaatactggaaactgatgaaacaggaaccttcaaagggactaatggtgaaagcctctcataggtatgaacctgaattcaaaataaaagggatcaagaggtcgtgattacatcaagagtattggtatttaattataaacaagaaataattagagaagaaaaagggactctagctcgaataaacatgatacctcgacatcatctccagttactttcagtatatcttcaacaagaggtacgacagctggatcgccacataaatgtagctcatcagccgcgattccaagtaaagcacgagtaaatgcaaatcccctttgtttacatcccaccatctgaaattagggaaagaaaggatgagaataacaaacaaaaagttcttgtcgatttcttaagccaaagtcgagcaagactagcctgaatttcgtcaatgatggcacaatcgtagacagatgtaacatcagccatttcaactgtcacagctttgtgtgttgccccttccactaagtctttctcttgtcccgtgatcaaatcacatggaacatttgctttgtttaaccgtttagctacctcccatgccaacaatcttaacggaccacaatatacaccttcaagtgaaagaagcaaattttaaacagttcaagaactggcttccaaaaggtttattagtcaccttcaaggcatacctgaagaactctgttcaaggtgcttaagggcactatatgtcttcccgctgtttgtcgggccaacatgtagaatgaccttacgcttcttcttccgagctataggataccatgtatgaggacagctagaattcaaagtaatgacagaaatataaatcagttcctctttactaatctctccacaacaacaatggaactgcaaagagaatcgcaattagttgctactggggagctaacaaaaaaattctacaagaagttttactcttacgtgagatcagtgaaatcgaactttgaggtggttccagtgccagtgaaatcaaactttggagatccagagttctttctataattcctagtcaagacacctaatctcaaaaggtcaccaaactcaggttcaaagtgaaaccgccacaaacttcctttatcagctgaaacattaggcaacacgaagccatcataagatacaacgttaaaccaatccaatcttcttctagacactacacagaaacagatgtagaagctgcaaagctcataaaggttcaaactttctgtatccagatgatcaaaatttctgatagttcctttctaagatcacttacaaactacaatccgcaatttctaaccaaaagagaaccagaaaacagagaaaaaaagggtttaaaagctccaaccttgaagaacacgagaaatccccaaagctgaaacctttcgaagccgaacaacagaatacgccatgtttagattgttttatctattgaaatgaagacacaacacttccttatcctttattcaccatgggaaatacaattcgagtatactcacgacgacacctttcatttgctttgaaggaagctcaaagttacagaaatcaaactcttgaaatcgaggacgagataaacaataaagagaaattaaaaccaaattctcttttataattagaaactgaagaaaccatctcagacttccattgttagaccttattcttctcagagggtcggcgactcagcaagaagcgggagagagaagaaaacgagaggttcctttttaatttacaaattaacccctaagcttttcctattactctctcttacaccctcctactttaaaaaatagaaatgtccccataacgttaatatgtctaaaatacccctgactatattctagaactaccaaatcaacccgtcttgttcgccaagtcgctttgatctaaaaagctcttaaactattcttccagcgaccggaagaaacgaataatcggaatcgaaaaattcgaaaaaggaactgagaagaaacagatctgaag

SEQ ID NO: 6452 - DNA, 3000 bp, Unknown
  misc_feature (1)..( 3000): cDNA_ID_1814522_gDNA_ID_1621094_Annot_ID_55596 3000 nt of promoter + ATG
gagagtgaataatgccgggttccataaggatcgcttactcattctcccggagaggcttaagggcaagaatgtacccaaatcttttgcaagcaaaaacactctttcgcgttatctcgaaactagtttccctgatatggatgctaatgcattctttgcatcttttacctggaacattccggctttgtttcagcctgcagaaagaggtagcaactaacactcttctgttgcgtcagccataaaactctatctgcaacacatgaatgatgtttctttttttctgtagttgatgctgcgtctctgtttgaagagacatccaaagaaggacagaatcaagatgaggatgctgaggatgtaaaaaaagaaggatcaacttcgcgttacagccagaggaagagaaaacaggtgcagatacagactaatgaacctaaagcaactccgcgagctagcaacaggaaaaagacagccacaacaacaccagctgctgaacataagtcagctcgggaatcttcctcgaaacgttacacaagacagcaacaaggtgatgtgtttgacttgactgaagaaaacaaggaatcagatgcaaagaaaggcagcaagaggatgaagaaacgcagaggtaactatgcagacgaagaagaagaagaagaggcttttgttccgcatatctatgtttcttctatgaacggtgtcattgcagtctctcaccctcctgtggatataaacccagaagagtttgacagttatctgaactctctagagaatcttcttcagcaacagccttcagaagcaggacaggagtcttcatcatcacttcccgttagtgcaagctctccagtgagagattacgaatggacagaagctcgaatgaagctttcatcgcttctggagaaagatttctcttccttgttcatgtctaatgaagctacggagatggcaagcttggcagctaaactcaagaaagatccaagcctatcagctgaagaaatagtgaggttgaagctaatcgaagaaattccaactttcagcgaagtttttcaagagaaccaaagcatgatagtagaagcagataggttcttctccgctctcgagcttaacaaagcgaaggtcgcatctctcaagtacgaatacagcgacttaaaggacaagctaggcaatatccaaacggaagtcgatagaaactcagagacaatccgtcaaattgacgagcaaatcgctcagcttcaagctaaacgaaccgagcttacccgctgcatcagtaacaaggggaaagagaaggttgatctaatctttggtcagaagatggtagcgaactcaatccctaaagtggttcaagaagttcaagcagctaacttgaagaaacctgaatgggaaatgaagaaagacaatgctcttaaacgtgaatcagagatcctcaataaatttgcccctctcaaaggattttatctctaaaactaaaaccaattgatgttacgttacataaggcaaaacctactctgtatccatattttcataaagaaacaaaaagatcttaactttgataaccattagataaaaaaagtcaagatttttctcatttgatcacaaacacattagattactgtacaagcactatcaaatctctaccattgtcttcaatcttaggcacagtgacaatcaattctccatcgccgtcgcaatccacggtaacgagctcaggcctagttgattccggtagcctgaaacgccacacgtcaagctcaagctcatcaagcgacaaaccaagagacgatgaaccattggttctcacaagaatcttggtcacaccaggatgaatctcaaccatgtaagccctcacacctcctcctcctcccccgtctgtttccgcgacgaacctgaagcagtcatgactctcttcaacagccacgtcagcgtctgacttcaagggcagctctagaacacggctgaagatatgtgggagacgacggagcttctttccgggttctcgggtcggatcacgagcgtgatggatcagattgttgttattttcgtttctgggtaatgggtggattttcatgggtcttttttttttgggtgtgagagtgataagaagcgaatgggtcaaaattaataggagaaaagatgaggaatctaatataaagtgatcacctttttggtgggaatcaaaattgccagaaagctacggctctgtataacgactttgaaatttggatttctgatccaactttgggattagaactaggcaatgattaagtgatgatttaagaaatggataaacaaaatttggttgacgaaaacagtaagctgcgaatggagccaaccaacagactgagagaaaggttttaaactgtacatttttcgtcaaaacatagggaaacccccctcccttccaaaaaaaaacatttacgtaacttttatttatccgtttaatatttacattattaaatatttctaaacaatatctttcctaacttttatgtttcttaaacataatcgttgtatttgcaagaatattgcccttcaatagttacttctacgcacaaaaaccttcgaatataagtattgacgatttattatgaaatttagacttttttatatgatatgtaaacaataaaagtgaattatttataatctttataaaaaaaactacttatgaaatcgtatgatataataaagttagcaatcttgtgacaaaattaatttttttttgtatatgtcaaaatcatcctatactcaatttgataatttaaatatcagtaatatggaatatggatgtagaaattgataaaattcaactgtatcagatattatagaaattctttaaacatttttttgtttggtatcagcaattcaactgtatcagtctatcagatatgatataaactgttttcagtaatacttattcaattattttctttggtatcaatattttttaaaagaatatatcgatttatgtgttacgtgtgatgatgattcttttaaattcaattgtatacgccgatg

SEQ ID NO: 6453 - DNA, 3000 bp, Unknown
  misc_feature (1)..( 3000): cDNA_ID_1814512_gDNA_ID_1621094_Annot_ID_55599 3000 nt of promoter + ATG
cgtgttctagagctgcccttgaagtcagacgctgacgtggctgttgaagagagtcatgactgcttcaggttcgtcgcggaaacagacgggggaggaggaggaggtgtgagggcttacatggttgagattcatcctggtgtgaccaagattcttgtgagaaccaatggttcatcgtctcttggtttgtcgcttgatgagcttgagcttgacgtgtggcgtttcaggctaccggaatcaactaggcctgagctcgttaccgtggattgcgacggcgatggagaattgattgtcactgtgcctaagattgaagacaatggtagagatttgatagtgcttgtacagtaatctaatgtgtttgtgatcaaatgagaaaaatcttgactttttttatctaatggttatcaaagttaagatctttttgtttctttatgaaaatatggatacagagtaggttttgccttatgtaacgtaacatcaattggttttagttttagagataaaatcctttgagaggggcaaatttattgaggatctctgattcacgtttaagagcattgtctttcttcatttcccattcaggtttcttcaagttagctgcttgaacttcttgaaccactttagggattgagttcgctaccatcttctgaccaaagattagatcaaccttctctttccccttgttactgatgcagcgggtaagctcggttcgtttagcttgaagctgagcgatttgctcgtcaatttgacggattgtctctgagtttctatcgacttccgtttggatattgcctagcttgtcctttaagtcgctgtattcgtacttgagagatgcgaccttcgctttgttaagctcgagagcggagaagaacctatctgcttctactatcatgctttggttctcttgaaaaacttcgctgaaagttggaatttcttcgattagcttcaacctcactatttcttcagctgataggcttggatctttcttgagtttagctgccaagcttgccatctccgtagcttcattagacatgaacaaggaagagaaatctttctccagaagcgatgaaagcttcattcgagcttctgtccattcgtaatctctcactggagagcttgcactaacgggaagtgatgatgaagactcctgtcctgcttctgaaggctgttgctgaagaagattctctagagagttcagataactgtcaaactcttctgggtttatatccacaggagggtgagagactgcaatgacaccgttcatagaagaaacatagatatgcggaacaaaagcctcttcttcttcttcttcgtctgcatagttacctctgcgtttcttcatcctcttgctgcctttctttgcatctgattccttgttttcttcagtcaagtcaaacacatcaccttgttgctgtcttgtgtaacgtttcgaggaagattcccgagctgacttatgttcagcagctggtgttgttgtggctgtctttttcctgttgctagctcgcggagttgctttaggttcattagtctgtatctgcacctgttttctcttcctctggctgtaacgcgaagttgatccttctttttttacatcctcagcatcctcatcttgattctgtccttctttggatgtctcttcaaacagagacgcagcatcaactacagaaaaaaagaaacatcattcatgtgttgcagatagagttttatggctgacgcaacagaagagtgttagttgctacctctttctgcaggctgaaacaaagccggaatgttccaggtaaaagatgcaaagaatgcattagcatccatatcagggaaactagtttcgagataacgcgaaagagtgtttttgcttgcaaaagatttgggtacattcttgcccttaagcctctccgggagaatgagtaagcgatccttatggaacccggcattattcactctcctcccaactctccaagtccaaacatcgccggggctcgggaaatcgacaggtgcaaacggcaaaccttgaccactagaagctggcggaatcgccgggagttgattcaaatcagtgaaggagcttctgtcaccattaaccttcacatcatcaccatcaccatcactgttgaatccgttttcccgataatagtcattctcaaccgggactggttcagtctccttgcttctattactcattgacactactgattcaccatcaaatctgtgcagattcataaatgtgattgaatcaaataacataacttaactaattgctttgcagttataatcacatatattcattactctattcccaataacaaaacaaaatcgatcatgactcaaagtttcctagaatcaatgcagagaaacctatacagaagtgtaaacatattgatagttcttaatgaattgaatttacccaggagaattttgacctatctcttgatccatatccatcgaagcagaccaaaaaccctaattcctgcgatagataaacacccaaataaacaaagcaaaggatgaattctaatctataacaatgttaagggaacaaacccacacaaattaaaagttaagttgattagaaatttctccagaatgcagataaagatacgaactttggagagtcaagaacagagtagccgatcttatgcttcaactacaacagattacaaatttatcaaactcattcgtttcttatatatcctcttttcgatcagattagtcctacaaacagaggtggaataacagttatacccttttagtttgtttttgtttacacagatgaagattgaaattacgattataccgttcaatgtttcttcttcaccgacttgaaagctatgacctttccgatcaccggcgttagttatgagcctcctctccgcggacgcacttgggttacttctcaagaatgcaatctccgcgagttccatgcgtttgggtcgcgtcgttcacgcaagaatcgtcaaaaccctcgattcaccaccacctccgtttctcgcgaactatctcatcaac

SEQ ID NO: 6454 - DNA, 3000 bp, Unknown
  misc_feature (1)..( 3000): cDNA_ID_3238302_gDNA_ID_1621094_Annot_ID_55602 3000 nt of promoter + ATG
agagaaagtgagcaatgattttggatgggcttgtgttgtgattctggagagtttgattccagttatggttgatccagtgatggggaagtctcggctacttgtaactcctagcgttaaggagaaagctaaagagattgctgagacgtggaaggctagcttggaagagagaggagggattgagaatgtgaaaacacctgatgttcatacgtttctgcaacatcttgtgacttttgggattgtgaagaaggatgatctagctctttataggaaacttgtggttggttcagcttggcgtaaacagatgccaaagcttgctgtttcagttggtttgggcgaccaaatgcctggtaatctttcttctttacctttgattaccattagatgtttttagctatatattggggaagcacaagttgttgtcttttgtcatgggaatctgtgagtagtatctgaaatggaaaatgatggtttttgggttgttatggcttcacacagatatgattgaagagttgataatcaggggacaacagcttgatgcggttcatttcacttttgaagttggtcttgtacacttgttccctcctgttcctttgctcaaagcttatctgagggatgcaaagaaagctacagctttaatcactgatgattccaacaattctggccgatctgcggtactttcctccatttgtgttactcgttttctttgctggatccatttgcagggatctgtttcttctgcactcgcttaccaatgtatgtgtgtatttttctagcatcttgtggcgcgcaaagagcaatcagcacttagagcagtcttaaaatgcatagaagaatacaaactcgaggaagaattcccacccgagaatctcaagaagaggttggatcagctagagaagaccaaaaccgagaagagaaaaccagccgtgattcccgccaacaagagaacccgagcaagctacagcggtccaatgccaccagccaaagcagggcgtatcacaaacgcttacgtctcctctttcccaccgcctccaccaacattcatcagatcccaaagtcactcacctcaatacggtgtaccagcatacaccacatccccacctaccatctacagcaacaggagccctccataccaatactcacccgaggcggttcatggttcttaccaaacctctccggtcagttatccgacagcatatggtacctactgcagtccggtggctgctccaccccctccagtttaccatcctcacccgcaccaccaccaccatattcagcatgcttactactgattagacaatgacaaaggaaaaaagaagatggtaagtaaccaaccactgatctctggtgtctacgttttgtctctacctcgtttttgttgtaatctctctttttttatatcgtatcatttgtagctaacactctcactctttctggttctgaattagtctacccttgtgtgtttattaatctaaattatacatatctattcactttcctaatgtttcaatcaacgaatttagttcagtacttaatagattcatcttaaaccaggaatgtttcactgtgattatgttatgtatcactgtttgtattggctcattgaaatcaagatttcgaagtctcatagcaagattcgttacaaagtgttcgtattacaccaaaaaaaagacttctttagtctaaatcaagaagatgattagtcgttggcagtggcgagctggagagacaagagttcttcctcagggatcatcttaatgtgacaatcagaagttggatacgaagcacatagaagcgtgtagccacgttcaaccacatcatcacttagcatcccaccactttgatccaccgttccggtcacgagtttcgctggacaagtcatacaaacaccgagattgcagtcgtagggaacgtcaaggccagagtcaagagccttagatagaatcgtctcgtctggttcgacttccaattcagtcgtctttccgtcgtgctctaccaccactttatatgcccgagctatgatccttccggtggtgagaaagttccggcggtttgttgttgttgagagtgttgcgttacggagtgggaaggagaaggaattggagagataaggtttagggagagagattgtagaagtttgagtcgggagaggaagagtcgccatgagagacagagagacggagacaaaagagtttttgtgtcaagtgagagtgatgactgtttgtggtgaatacggagataaggttgatcatcggttgtagatagtggtgggacataaaaaccgaaaaccgacttaaaccgaaattcattaatgcattaaaccgaattaaccaagatctaataaaatgaattttaaaattttaattatattcgtaattaagggaaatattttttccaaaacagtttgaacaaataaattcagtattatttttccatactcaaaactccaaatcggactaactgaaaaaaagaaaccgaatgttcaaaccccagttatggaaaatattaaccggacttaatacggatatgaccaaatcagaccgagaagtagtaattctggtgaccaaccaccgcgtttttctaaattgatagcgtgtgccatgtgactgacaccaaagagatcatatatctcatcattcgaagattttattccatacaaccgattttctccattttcttcaaaacgattcgggtcaaggttattgactttctcattcaggtatcatcttcttcctcgtcccatactttttgattcacttgcttattcctctgccggtttcgattatatttgtttggatcggataattgtatgggcttaagcttatttcgctgttaaatctgttgatttggtgttaagagtgttgtataactggattggtgctcatacatctggagatttatgtttgatgattttgtatgatgtgtttttggtttgaggatgatttattcctttggtcttacttttctctttttgtgaatttaagcagtgaagcttgaatcatg

SEQ ID NO: 6455 - DNA, 3000 bp, Unknown
  misc_feature (1)..( 3000): cDNA_ID_1814506_gDNA_ID_1621094_Annot_ID_55604 3000 nt of promoter + ATG
aaaacctcgcaagtattggagcagcttggtatgataaagatgaagcaacttagtagccgtagtatcttataaactattggatgtccccatgtcggtatatagaacctatcttttggatctttgggctaaatgaatgcggagtacttttgcaatttcttgcccttgtttattgcttgtacaactctatctatgcaactttattgtttgatcaaatgttactaattgtctttacctatgaatctctctcgtatcacgacttctttgtttacaagtcgattaaacaaattaaaccaagcacatctaaaatgtctgaatctaatatacaatagattggtacttggagcgaatcttggaagatgttttggattttgcataaatttattgatgtgtaaagttgattaaccttttgatgaagtattcatctttaaggttggtgatttcattgttttgcagtcgatcaatgtgaatactgtttgaaaaacttatgttttggagaatgagaatcaataagagcatattcctctatcaaatttatcgaaacctaaaacagtcttgatgctttaaccagtctgacatattttacatggagacaatttgataaacccccggaagctgatactagtctagtagtcagcttcgtaaaaaaaaacacatattataacttacaacttacatttgatctgaatgattctcgttgaaaagaattcttgaaatatttatgataatgcttgatatatgctctcagaactttgatagattctggtgatatgtttttagccttttgtgctttttttcccttttcttttacccttctcgcaaagtggtgattgattttgtggccagccaatgatatccccttttgttatctttaagtcacatgccaaagagctattcagagttctatggtgttttctagagtaacgaaagtggtagggaagagtatctcgtgggaatggtttgccttaatatttggttaattggtggctatcttggtcataggctatatatgccttattaggtcattgtttttttttgcgctcaaagtttcatatatttgtgttggtgactctagatttagtcttatggattaacatgaaaatataatcatatatacgaagtaacttttgcctgaagtttcacttttgctaaataatatattgtctcacaacgttcttgctatatatatatcttctcaaatacatggcctgaaatggtataattattgtttcatatttagtagtccaagataaaagacagaagaagtgttatgaattatgaatgtttgcttttatcatatatgagattataaccgtcatcattgacaattaggacatggatatattaattttacacataatgattaaaagctttagattatgcagtgtcttaatcatgttgctatataaggttaggccaagattcatgtcaaatcactgcatactctgcacgactttagatcattatgatcccttgtgaatttgaaccctcctaatctctcttatcccttttaaatatcatgttcccttagcccattcctgtttcaacatgcggggagaaaactaatcacgttaactccaaacaatcaattattgttgtagttgtcatttgtcaactctattatccaaaaagtgaaatatttcgtttcattcgctttgttttatcttgtcacaatctttgtaagtaaggctataattcagtatcctcacatatccgtcgttaaaaacatatattttcccataataggactaaaaaaaaacatatattttccataataggatatcttcaatgttgtggacttgtggtccaatactgtgatatggaacattatcttgtgcttcttttgggttttgttaaatgttaacgtatacgataactagctatatatagaaaatgagattcctacgtcgaaaataaaatacgtacgttactttatgttcttatagttaatgatggttagtgcgtggttaaaatgttcaccttatcaattgagtgctcgaagtttaaatctttctactctgatttaaattatggttggcaattttagatgagatgacaaaaatacttgactcttctacaaaatacgatgaacacaaaaaagaaaaaatttatgatgaaaaataaaagataaaattaaaatattgaattatcttcacctattctttttaaaagaaagttttttaacacttctgtaagattatcaacatgcatgtctttgcgcttcaacgagaagaaaggagaacaaaaaaaatcacgagtattagtctgaatttggttctgaatcttttggtcatatatttgattaaattatgtaatatgtaaaaacacaaataattagtgtaaaaaggttttgtgcttacctaatcatcacgtctacaaacacaaatattgggcccaacactccaacgcatgcctatttcattacaccatctacaagttcttctccacaaatgtactttcattttttttcttggcaacaacattctcttttttttttctttttttcaaaatatacgttttactacaaaattaaaatttcgtaaagtacaattttgcatacatttatgccggcaatgcttcactgtcttctgactcaacgcatgtggtggtcacccaccgattttctcctaccttttcctttttctggttcacttaaaccgatacaaatttcggtttaccacaacttttctaaaaatacgcgttctccgctcacgttagcaacaaccaatcgggagtttggtgctattgctgccgtcataaaagtacgcaggcacacaaggcgcactctagatggctgtcataatcgcgccatagttacagacgccattacacgtgtcattcttctgactaatccacgtcatcctcctcctcttatactattgccatttttaggttttcctgcaaaacaaacaaatcagtccttcttcttcacttttgttaccttcttctctgcaaaatcgactaaagttttgagtttcttcaccgtacgattaaccggagatg

SEQ ID NO: 6456 - DNA, 3000 bp, Unknown; identical to SEQ ID NO: 6408
  misc_feature (1)..( 3000): cDNA_ID_2024882_gDNA_ID_1621094_Annot_ID_170836 3000 nt of promoter + ATG

SEQ ID NO: 6457 - DNA, 3000 bp, Unknown
  misc_feature (1)..( 3000): cDNA_ID_2043733_gDNA_ID_1621094_Annot_ID_55610 3000 nt of promoter + ATG
cagactgatcaagttggtcttcctcaaagcaagcacagcgtttgctcatcgagccagttattgctatctccaaaggtctttgtaccagtcttggcactccaacatcacaccaaacctgcataatagcttatgcttttagtcccatcaagtattcactaatacgttatagttctctcccctataaaccggattgatagaagataacaagagtttctacctctccaccttcatcttgactccatcgtgagttgcaattcgattgcttggcttcttcagtcttctgtttctccatgagttgtgcacctctggaggcttttgcttcagctcctttaaggtgtttagttggattcccttggctatcgtagtaccgcccaacaagcttcccaacaggactgttgatcacaaattaaaagctgagaaccaaaccaagaggaccatataatacaaggattaaggtgagcaatgtattatccatacaccaccttcttagtttaactatgcatcagctttctattgtgtgaattaaacataaaagtaataaattacgtgtaggtcctggagtagaaacctcgccagtcaacaatgctcttcacctgcggacaagaaatctttgtcaagccatatcaaacatgtaactaaacataatcggagttatagaatatcaaacagttaacaaactatatgctacttcaatatcttagaaagtaatagttatgaagaaataagcacatctggcacaatggcaagatcaaagactactttagacgtttctataatttcattgatgagatatatggagctaaaaaaacattacctcactgctagataacccttgtaacgaatctgtaagtccatctcctgtacaagaaaataatcatagcacacaaatgagaagtttccacagatttcagggacttgatgtataatattctccaaatagctacaaagtttggataattctgacttcttcacgcatgactaatattgtttatgaggattcaaagatgtgtaatgggaggaacacagaaaatttcctcataacattagcaagaaaagagaatgaaatctcatttttttcgaggatgtcatgccaatgtccataagtactaacagaagcaaagaccataatatactacaaaattttccacaaatttatctggatcaaacaggcatggtgattaggatgcagcaaacgattcgtacctgtaaagttgccagaaacaaatgcacgagaagcgtctctgagcgaaagaatgacatggaaaaacacttcccatcagctacaaacatgaaagattaacaagaagaagatagaagaacatatgagaatctctccacataatttttaacaaaacaaaccttccagcaaaatggttgtaccctcctccactaccgtaatgaaattttcctttcgtcacatcgaacacagatctgaatactcagttcacaagttgttaacatatgcgtttactttcaaaaacctgacagcagaaggaaggaaaagaactcacccaagaatccctaagagtataggtaatgtttcatcagtaccattatacaatgccaattcttcagcagaaaataacctcttttgatactgaaacacaaacaaaccatcaaatcaaagacatgagacatcatcataacattggtttatctatttcaattctaattaaactcaagacccatacataacaaccacagagacaaacttcattggctatagaagaccctgtataattcaatcaaaaagtagcagaagctaaatagagattttgaattccagctaagctcgtgtctgtttggaattttcagaacagggaagttagttagaaagaagagcagttggtacttggtgttgtggagacttgaaggaagatctgaagtagagagagacgagaacgacgataaacgtgacgccgacaaatggagataagagaaacctcctcgccggaatcatcgcattggatccgatttcacgtgtctgcgaaatttgctaattttttacaccactttttaggatgtgatgacttttttaactaaacaacaaaagttaaggtactaaactgtgatacttcaaatattcagagtgcgtttcataaattttttaagaccgaccttgaacacgataaattaataagataataatttttctgaaagtttgatgtgaatgtatggtctcatcaatatcataaattaataattgtataaatatattaactatatatatattatatgtaaaagaatttctttaaaatatattttaaaattttttttgcttaaattcatatttgttctttgtttgagtataattttcatattttattgtatcaaaatttttggtgttgttttctaaacattattattatgttttacttgtaactggttctaaatatatattttctacaatgaaagaaatcttataaaacaattttaaaagttaccaaattaggaaaatgtctgtataaattaataaatattaatttatcgataaattaatacctctctaaattaataaaatttcgcggtcccaacattattaatttatagaggttttattgtatatcgatttatcatttccctgaagattgattgcaagttcaaacatacaatggaaattacttatctgatacactttggttcagtcctaaataatggtctgatacggttcaattccagttaaaattccggttaagttccacgcaattcaagggattttgcttttcaaaaattccaaaattataaaatacacagctcacgagaataacaacaaatcgtggttttaacaacaacccaattacatcattacacgtgtaatatacctgccgttacatacagatgggataattttcgcttataaaatacagcatcaaacaccttcctcataacctagaaatcgaaaatatcagatctaaagaagagcgtcttcataaacgcccttcgtcttcttccctgcaaatctattttctagatctttctttcttccgcgaaacgacaatg

SEQ ID NO: 6458 - DNA, 3000 bp, Unknown
  misc_feature (1)..( 3000): cDNA_ID_1814482_gDNA_ID_1621094_Annot_ID_55611 3000 nt of promoter + ATG
agacattttcctaatttggtaacttttaaaattgttttataagatttctttcattgtagaaaatatatatttagaaccagttacaagtaaaacataataataatgtttagaaaacaacaccaaaaattttgatacaataaaatatgaaaattatactcaaacaaagaacaaatatgaatttaagcaaaaaaaattttaaaatatattttaaagaaattcttttacatataatatatatatagttaatatatttatacaattattaatttatgatattgatgagaccatacattcacatcaaactttcagaaaaattattatcttattaatttatcgtgttcaaggtcggtcttaaaaaatttatgaaacgcactctgaatatttgaagtatcacagtttagtaccttaacttttgttgtttagttaaaaaagtcatcacatcctaaaaagtggtgtaaaaaattagcaaatttcgcagacacgtgaaatcggatccaatgcgatgattccggcgaggaggtttctcttatctccatttgtcggcgtcacgtttatcgtcgttctcgtctctctctacttcagatcttccttcaagtctccacaacaccaagtaccaactgctcttctttctaactaacttccctgttctgaaaattccaaacagacacgagcttagctggaattcaaaatctctatttagcttctgctactttttgattgaattatacagggtcttctatagccaatgaagtttgtctctgtggttgttatgtatgggtcttgagtttaattagaattgaaatagataaaccaatgttatgatgatgtctcatgtctttgatttgatggtttgtttgtgtttcagtatcaaaagaggttattttctgctgaagaattggcattgtataatggtactgatgaaacattacctatactcttagggattcttgggtgagttcttttccttccttctgctgtcaggtttttgaaagtaaacgcatatgttaacaacttgtgaactgagtattcagatctgtgttcgatgtgacgaaaggaaaatttcattacggtagtggaggagggtacaaccattttgctggaaggtttgttttgttaaaaattatgtggagagattctcatatgttcttctatcttcttcttgttaatctttcatgtttgtagctgatgggaagtgtttttccatgtcattctttcgctcagagacgcttctcgtgcatttgtttctggcaactttacaggtacgaatcgtttgctgcatcctaatcaccatgcctgtttgatccagataaatttgtggaaaattttgtagtatattatggtctttgcttctgttagtacttatggacattggcatgacatcctcgaaaaaaatgagatttcattctcttttcttgctaatgttatgaggaaattttctgtgttcctcccattacacatctttgaatcctcataaacaatattagtcatgcgtgaagaagtcagaattatccaaactttgtagctatttggagaatattatacatcaagtccctgaaatctgtggaaacttctcatttgtgtgctatgattattttcttgtacaggagatggacttacagattcgttacaagggttatctagcagtgaggtaatgtttttttagctccatatatctcatcaatgaaattatagaaacgtctaaagtagtctttgatcttgccattgtgccagatgtgcttatttcttcataactattactttctaagatattgaagtagcatatagtttgttaactgtttgatattctataactccgattatgtttagttacatgtttgatatggcttgacaaagatttcttgtccgcaggtgaagagcattgttgactggcgaggtttctactccaggacctacacgtaatttattacttttatgtttaattcacacaatagaaagctgatgcatagttaaactaagaaggtggtgtatggataatacattgctcaccttaatccttgtattatatggtcctcttggtttggttctcagcttttaatttgtgatcaacagtcctgttgggaagcttgttgggcggtactacgatagccaagggaatccaactaaacaccttaaaggagctgaagcaaaagcctccagaggtgcacaactcatggagaaacagaagactgaagaagccaagcaatcgaattgcaactcacgatggagtcaagatgaaggtggagaggtagaaactcttgttatcttctatcaatccggtttataggggagagaactataacgtattagtgaatacttgatgggactaaaagcataagctattatgcaggtttggtgtgatgttggagtgccaagactggtacaaagacctttggagatagcaataactggctcgatgagcaaacgctgtgcttgctttgaggaagaccaacttgatcagtctggcttggagatctataaagactgtgaacctcttgccaagacttgcagggtttgaatatgattcacgagacttgtcttaacaagtttgcaaattgcaatagctagttctttcgtagccttgtactcttgtataccacatagaattctttatgattttgtatggatgcattgcgtgtagtttatgtgtaactaaattaaaacggcgaatagttctaaatactatgggtattttggttacacaccctgcagtttttgcttttgcgtcaacagattgcggattgcgtagtttgtgtactgaatttaaacggcaatcagttctagaatcttacggagtaatttaataacacagagtgccgtttgaattttcgtcgatagactgcatgtcatgtaatgaggaactctgggcgcttctttgttgaaaatttggcggtagcttcttcagggttactaaattttgaaatctaatttcttcaggaaattagctaatcggagaatcaataggcgaaattaagagtaatctccgtcgccgtcactggaaaa

SEQ ID NO: 6459 - DNA, 3000 bp, Unknown
  misc_feature (1)..( 3000): cDNA_ID_1814474_gDNA_ID_1621094_Annot_ID_55613 3000 nt of promoter + ATG
gaaaatggatgcggagagaacctagtttcagttattgggcctttaggttagacccatttttaatttgggctttatattcttatcacacggcctggtaaacctagcttcagttattgggtcatactaattctagttttccttttttttttttcttacgttcgtacaaacttcaaaagagttattattacaaaaacttttttttttgaactaacaaagacatatataaaattatacaactgttatggatcccattgataatacaaaactgtaaaaagaattaagttgttagctggagttgtaagtatttttgaaatagtgcaaaatttacaaaagaattatacgagagagctgtaaaaaaaaaaaaaagtaaaacttttagtaacggttttgataaaacttttatgattggtgttgaagctatccaactctatatttgactgctaattttagttactcatatatgttttttggcttgctcatagcactaccactatgtatagtgactaacttttacaaaattacacttatactatctacaaaattatacatttatcatattattattggaattgtttgtgaaactatacattgtatcgcataaaaacatgctgtctttttctcaaaatcttctaatttttcgatcaagttccatactcaaaattatcaatttaattgtcacgaaaatttcgaaaacctttctaccaatattttaagactttcaaacatgtctactttcgttttcgatcacaaaatttacctttcatcatacgaacaaagttggaaacttcttctcgcagcaatcaatatatttgtttataattctactaaaatgtgtcaaatatttataattaaaaattgcatgcttgacttttctagccactgcgagactatagtctataattatggactgttaacatcatatttgcagattattatatattttagaaaactttgcttggccggttatatcgtgtctacgcaagtaagtatataggtgtcatattttataaaaaatagaccatttgaatttgtgtataataaattagcaaatgagatcaaattgaaccgaccggatgaaatccgttcacatggaccatataacttgtccctccagttattttattttatttcgtcgatgtgtatttaattttgttaatctctatgcaattaagttttcataactaacttatttggtttggttgaggagtttcaaacaagtaaaagcataaacttaaaaggagaaaataggtggaatcatatatttagaaggatcgtcttactaattagaatcatatactagtagttagtggatgtggtataacctatatggctatatcaattaaattgtttttcgtagttatccaaaataattacagaaataagacgaattctcgtagttatccaataatttatttaatgttttcatataaaatctgaagcctagaaatgcaaattatgaaattatgtatggtttacatgtataattgtttatagtggtctcatatgttaaaaaaataattttttttaatcgtgaatgtagtgtggattacacgaaatcggtcgatgtttttcaaatgccgcaggaaattatatttctatgataagaaaatgtttatgatcactaatattagtagacacagcaatatgtaataaataatattaaaatagagagaataataaaataaaaaagcagacagcactaaaaaaaggttattcttatcttttgtaatcactatcactaattttagtaacatactgtataattttaattaaaagaaaaaaaagttcggaaagtggaatatttttacttttgattttttgtcaacagaagagaatttttccttgacgacaaaagaaaacatttttaatttattctcttttattttaacttaacgaaccaaaaaaaaaaaaaaggtgaaatgcttatttcagacagagaaatgaggatttgttcgagatgtgtcaatgttacgcatagcacagggcagagataataaaaaaaggctctctctttctttctctctctctctctctctcttctctaatctaatctaatcaaaaatctcttctttaggaagagaagtttcctccttcgactttcttctttctcaatatgaatcccggaaaatcgggaacctctagcgatttcagctaatctttacttaccttttctttagttctgacaagaagtagcaatacccttttggagattcgatcgtattcgctgttttttttttttgtgttttagctgtcttcgtgtctctgctactttgtgtttgatcatggagagatctgattctagagatttctacaacttcgctaagacttcttctggtcagttctctttcttgttcagctctttttgttttcaaatctaataaaagtgtttttattttgtgattcatcagtttgctaaagcttctttctttgatctgagatgtgaatgatttgatttgcttctgatttgtgaaaactttaagagaaacatactttttgtttcatgcttgttatgtttgatttatcttccttgttacagtatttgattcgttttttttttaagttttgtagtaacctataagatttactaatttgatttttgaagttgtatgaaatgattgaaatgtcacagatttgtttacaaaagctttagttttacttaaattttctggtcaactgattgtcacttacctcatgtgtttgatgaaactggatcttattgtctttgtgcagataacaatagtgcactctttgacgcatctcaatatgagttctttggtcaaagtcttgaagaagtcgaattgggtggtcttgatgatgatggtactgttcgtggacatgttgatgatgaagagtatcacttgtttgataaaagagaggtaatttggactgagtctgttcttggcaatatttgatgctaattatatatgagataaatggaagataaaacaaaacatttacttctggtttcagggtgctggtttaggatcattatctgacatg

SEQ ID NO: 6460 - DNA, 3000 bp, Unknown
  misc_feature (1)..( 3000): cDNA_ID_1814470_gDNA_ID_1621094_Annot_ID_55615 3000 nt of promoter + ATG
caatggagttctttgattggtatatgtgttcgacaggtatctggtttctcctgcagctaactgagaactgcacgtctgactaagaatgcgtatcgcaaaacgtgagaggtcaagcagctttctccatacgtagaccaccactcagctaagaaacaagaatgtaacgagagtcaagtaagagaagtacaagcgaaaagatttatacaagaaaatcaggaaaattaaccataccaggaggcattgtatcccgagctcttattgccaagttttttccaaaaactccaccagcagttttgtgggaggttaactccttgatgattttatcttgaatcttgtcgtcaggaaccaatctctcaaatgcaatcgggcaccgatagaataagctaactacggattttcttcgttggtattataaaagagttttggattaagaaagaaacccagcagcaagcaaaggaatatgctgttgttgctcccaccatgatctataattttccagtatattatgtaatcctccctattaaccagatgtgtcttgattgcatcctttgctcggtacaatgctgcatagacataccccattgcaggtctcttttcagaacaaactattctcaaagcccgcaaaagaggactagttaaatggtttaccaaagctactgccttccaaaaggcttcatcagtgagagcattcatcaccaatccacttggttcttccgaatatgaacattcattccactcggccgaagtaaccatagcctgcagattggatttgagctcggctattcttcccaatgtagcaaaatttgtggcagaagagctaaatgctggtagcagaatatcattaccagaagtaaatttccacatcagattaaaacaccactatggttataaacaaatcttgtgatagcttgagcctgttcaatagtctcacttatccagccaagtttcccaaactcctcgagcatctggtctatgcaatgtgcagcgcaaggaacccaatatagagaaggatacacaagcatcaaccttttcccagcatcaacgtagtaatcatcacattttgtaatcacttgaacaacattggtactgccaacttcttcaaccagttcgctaagtagctcaaacaatttatcagcagaagataaaacctcagatgcgtccacagatttcagaaacactaccttttcagggcaataaaccaaaaagttaagaactttaaagcctttatcagagttcagttcctcaaccaaaatagaacagccagtcctcttccacatcgctttgcattcatcaatctctttcgccatctcctcaacacaattcttcagtatccaccctcgaaggtcatcatgcgtgggagcagataccccgaatcctccagaggcaatggcatcgatcatcggttggaaattaacagaattcactgcatcaaaatcagctccaataccaaacaaaaaccttccaatcgccatatgaattgtattctccctatctctaaaggaaggatgcacaatgttcttcacactactaatcgcaaccggaatcaaattatccatatctctaccaatcaaatcaacattgttactcgcactaccattctcaaaagcattctttttactcctgtaagtcctttgctttgttctgccactcaacaagctctcgttttgcacaacgacatccgaactacccggcgacttaaacccgtcatttacatcaggttgaacgaccatcatatctccttcaataggaggtaaagaagcaacagacaaaggctctgaactagatttatgtctcttcctctgacgtctcacagttccatcaatacactgctgcaaaaagagcctaacatcttcaggaacttggtcacagatagtaccttgtccctttttaccagcaagatgtccttaaccctagttataccaccacctttgaacattttccgacagtagagacaacgcatctgaagtctatcaccatatttgtaaatttcacaatgcttccatgcattgtcttgtttctgaggtgtaagagctacaggttctaattccgcatccatctaattcattcaagaggaagaagatataagaaaaggtaaagactttgttaatgggtaaataagcctagatcctctaatgaacaattcgagaaaaaagatttgaaatttcgcagacctcatgcaccaaattcttagccggaataaacaatttcgatacaaacaaaacaaacccgtaaaaaatttgtacaaggagatgaagagaaaagacctgatttggtttgtggccggttacggtgaatcggtttcggggaaagtgataaaattccggtacagtagcttcggttctggagaagaggaagctggaatcagccggagatggagatttccgacgaacggcggagagaatcagaggagggtggaggattgcgatggcggagaaatcgacccggcccgtttttagggttcgaagaaaataggtttggcagctttttctggtttatgacctataaatcggcaaatctgtatcgtgacgtcaccaacccaattttgctaaaatttgttttccgttttttaacttttttttgtttacccttgataactaaaacgacgtcatttcctttagggcattttctgattgaacgacgtcgtcttttcttctccgattagcgtcggtcgtcttcttcgtcttctctctgtcgctgatctgggttttgcttcaacgtgaaacatctttgaggttgatgatgaggtttctgtttacttaatatcctgtgagagaaaactcttcttgacttgaggtatgataatactctaattattgtttattttgtgttggatcaaatggatgataagaacttgttgatctacttctaaacctcttaattttggagactatgataagagtaaaggacatagtatgtttgaatactgatactgtagtctgtagtgttgctgacaaaaacgtataggtatatgtacatttgttttcgctgaggctaaagatg

SEQ ID NO: 6461 - DNA, 3000 bp, Unknown
  misc_feature (1)..( 3000): cDNA_ID_1814462_gDNA_ID_1621094_Annot_ID_55617 3000 nt of promoter + ATG
ttgaggagatggcgaaagagattgatgaatgcaaagcgatgtggaagaggactggctgttctattttggttgaggaactgaactctgataaaggctttaaagttcttaactttttggtttattgccctgaaaaggtagtgtttctgaaatctgtggacgcatctgaggttttatcttctgctgataaattgtttgagctacttagcgaactggttgaagaagttggcagtaccaatgttgttcaagtgattacaaaatgtgatgattactacgttgatgctgggaaaaggttgatgcttgtgtatccttctctatattgggttccttgcgctgcacattgcatagaccagatgctcgaggagtttgggaaacttggctggataagtgagactattgaacaggctcaagctatcacaagatttgtttataaccatagtggtgttttaatctgatgtggaaatttacttctggtaatgatattctgctaccagcatttagctcttctgccacaaattttgctacattgggaagaatagccgagctcaaatccaatctgcaggctatggttacttcggccgagtggaatgaatgttcatattcggaagaaccaagtggattggtgatgaatgctctcactgatgaagccttttggaaggcagtagctttggtaaaccatttaactagtcctcttttgcgggctttgagaatagtttgttctgaaaagagacctgcaatggggtatgtctatgcagcattgtaccgagcaaaggatgcaatcaagacacatctggttaatagggaggattacataatatactggaaaattatagatcatggtgggagcaacaacagcatattcctttgcttgctgctgggtttctttcttaatccaaaactcttttataataccaacgaagaaaatccgtagttagcttattctatcggtgcccgattgcatttgagagattggttcctgacgacaagattcaagataaaatcatcaaggagttaacctcccacaaaactgctggtggagtttttggaaaaaacttggcaataagagctcgggatacaatgcctcctggtatggttaattttcctgattttcttgtataaatcttttcgcttgtacttctcttacttgactctcgttacattcttgtttcttagctgagtggtggtctacgtatggagaaagctgcttgacctctcacgttttgcgatacgcattcttagtcagacgtgcagttctcagttagctgcaggagaaaccagatacctgtcgaacacatataccaatcaaagaactccattgagcaaaaacgactcagcgatcttgtatttgttcagtacaacatgcgcctcagacaactgtaagtcttagatcttgtcccatctcagccaactgcattgtttccaaggaataagaaagtatagaaataatggttctatgtcttctctaggggtcctggaagcggagatgacacactagacccgttgtcacacaacaggatagatgttctgaaagaatgggtttctggagaccaagcttgtgtagaaggaaatggaagcgcggactggaagtcgcttgagtctattcataggaaccaagtagcaccaatcattgatgatactgaagacttgggttcaggtaaaaagatttagcatcctcggacaactttttttgtgtgtttcgaagattttagattttaaaagttgaaatgaatgtgtacaggtttcgatgatattgagatattcaaggtagaaaaagaagtgagagatgaaggttattatacaaacacatcggagaagttattcacgtaagattgatcatggttggtttaagcttcttcgtcgatgctttctgacttacatgaagctgttgtagtcataggtgtcgatttgtaacattagagtcttccctttagaattatctcttctacaagacgtttcagtattcttattcttcttactctgcattgtcctattaggtttccatagagtttgggttttataatcaggttctgtccagatttttaagttgtttgacaaatatatttaatatggtcatgaaatctaaatgcctattttctttcatatatatatttgatggctttgttagaccatctgttttattactagcataattactccttaattcttgtcaagtttttgaccgatatctaagcatacacaacagaaggacctctcacaatgtatgatccattcgaccaaaccatagaaactggaaggtcattgtcagagattgtaatggtgagaccttgaatttcatcagtttagaaaccaaagacatttcagtggcccatattatatgcccatacggcccagcccattaagaaacaattggagcaatcggagaaaaaagagccagagataagctaaaaggtctacgatagttccatcggacatcggcggcgacatgacttcttcggcggcgatcagatctgacatctacgacagagaagaacgcaagcagttaatcttccttctttcgattcttcttcttcttcattctcttgttcactgtgttcgaattctgtcttctttctcttgattgctcagtcgtgtgtgcaggcaataccaagcacatattcgtggcctgaatgcttacgagcggcataagaagttcttgaaagactacggtactacacgtctttcaatctccttgtaaatgtctttggatttgttagctcgataattaggttttaataatggacaaaaagtttgggaaatagggtaaataagtggctttctatttatccaaaatccatattgtcccaaatcaaaactggttgatgaacagtcttctcctctgagctaggaaggagggctatagtcagccttacatgtcttatttgtggttccattagaaagagtattctttaccctggagttagctactatttgaggagctgttggtgttcttgtttaagattttgtagtttcattctttgttttgcaactttacagttcgatttt

SEQ ID NO: 6462 - DNA, 3000 bp, Unknown
  misc_feature (1)..( 3000): cDNA_ID_3090248_gDNA_ID_1621094_Annot_ID_55618 3000 nt of promoter + ATG
gagattttcaaattttatatagtttcaaattatttcaaaatccatatatcttgatttcataaccactaacaccctattcgttatattaattatttgtaataaatttaaatgtttgcatctttaactctcacacacaatacctatacttttaaaaactataatcctttaccattatttttgtcgtatttacaaattaacagttggattgagaatttttattatgattttagatttgtagttgtgaaagtaaaaatgttgttatatatatacatttctttgtctatataactatattagtgatacttttttattttcagattctgatatgacattcttgggtagcaaccaatactaattatgaaaccattatattgctccggcttgaagattgcttactctctatatatacccactacttggtatattgttttctatataggctatgattaccaggtatcacaaaatgcatacccttaaaatacttgtttgcttcatatggacaaaaacctcacacattgaaaaccatatccggcaggaaatccgaatcttaatagtacattttttgcttatttcatggcttttctggactccaacaaaatcaatattatacaccaaaatctcagtgattagaacaaatatctagtgtatataaggaataagaattctaaattcaaaaaccagaaacaaatttacatgcccaacgaatatatgaaacgaaaacttaccatcaacgttgcttttctcttcaggtaaaggaaagtccaaccaagccataggctcaagatgcatcatacacaagattaagatctttcattcccaaatgatcaaattacaaaccattaagacacattcatgtgactactgaacaaaaagagatatctaacataagttgcaagtgatatttatgagaatagcatttcacttcacgggtgctcagaaccccgtggtccttagaagaaagccatccttaaacaaatgcaaattatagtgacttatcaatgcttgtgactatacatattgttaaaactttgatttattagggcttgtcctgaacttttctttgaggaggagaggaaaaggtatttgccaaagctgatgtagcatcgatttagaataaattgatggttttaattttgagaatttagagtaagatgacatggaatcttgagagggcttaatagaaaaactgatgttgatgacttgagatgcatcagtgagcttcgtttgtttgttacgtgaaatattttgatatgattcataaatgactataaattgaaataaatagatttttcctagaaatctaaatctttggtgtatatatatatatatatatatatatatatatatatatacatatgtgtgtgcatataaataactcaaagaatttattgaatggatttttcactaatttattttaacgctaagaatgccaactttgtgcccacattgtctctcggccatgggtcgactcttatccgatggcgtgaccgttatttttggaggagttaaagatttgtttaacgactctaaatcaccatatgagatttctttttgttttgtgttctctcgcacaaaatcgacaatcacttctcgatatgtcaccatcttaaaaacattttgcttaaacacatttaacggtagagtttttctcaatacgtttaaccaaaaagataagtttactttggtaacataagtggcaaaattattttttcaagctctcctcatgcaccacatgtttcctgaaaccgagatgtttcttgtgttatatatatatatcagttttgaaaatagttttgatcaaaaaaagttcttcagttcacccataggagcaaatctctcttattcacccacttttgattagccaatcaaaatagaacaattttccatgtaatactatattttaaaataaatccaaattaaaaaatatgtcggtttgggtttataaataaggattatggttaaattttataattaccaaattatatgtcggtttggattaataaaagagtgattaggttttagattttataattaaacaaaatgatatgtcaaatttgggtttataaatgagatttaaggtttatattttacaattaaaccaaaattattaagtcagtttgagtttatatattgattggttttggaagattttacaattaaataaaattaaatgcttagggtttaagatttaaaatttaattcaatctaacattttttaatgaattaatttaatttatttagataataggtgagcgtgttttggtttagttaattagattaaataaaaacattaattggctagttaagagggttgaataagaaagggtgaacccaagaattgaaaattagaattaaaataaggtctttcatgtttttgaatttcgaaatttgtatctaatactattataagatcttgatttttttttttggggacatcttataagatctgatatataaagaatcaaagtaactaagagtaaacatttatgatttatggagttcgcttcccatatatacactgttaaagatatcaatcataatggacacaatcaaaccagattcaaatacataaatctccacacacacacacaaaaaaaagcttaaggaaatatatttaaagcctaataaataaataaatctctaaaacataaatgcattgttaatttctctcttgcagacgtatatatataaccatgtaactagcaacttcacatattgagaattcttatcaacaattaaacatctcgataatggcttcccttggcttgttcctatgtctttcctcggttcttctcatgagcctttgtcaagttcctacagctattgaagatgaaagaaaagcaagtcatttctgttttgtttcgtaaacatatataataacaactatcaagttcctctcttaaacaaaaaaagaaaaagaacaaaatctatcgacgttcttaatttgtattggcctatttcattcgttgtgtcatgacgcaggtgtatatagcttacatg

SEQ ID NO: 6463 - DNA, 3000 bp, Unknown
  misc_feature (1)..( 3000): cDNA_ID_1814446_gDNA_ID_1621094_Annot_ID_55621 3000 nt of promoter + ATG
gacactacctcaaaccaacttccagtgtttgctcctgtaggtacccgcaagtaaaccatcagtctttgaaggctttgatctcgcagatctaagactgacatgacaaggacaggtagcttcttgagagttgagggtcagagtttgctcaacagttgcaggaaagtatcaaggattgataccattgtatgaatctcttggatttgtgatcgagagatttggggataagttgatgaggtagaaagtagaatcctttgtgataatttcttccacgggttcgatattcttagccagatatgatgactcttcacaattcgctctaaagaactagtatttgttgtatgactctatgaatctctctaacctctttcttttatgatcattacattcatgtctgctatttctaagcgtaaaatattgtgatccagataccttttaacaactgatgtgttacgtctttggtgacataattgtaagacacaacaatggctttgtcaaaagactcgaaaccaaggtttttctaattcgaaaatgtaagaaatgtaagaagaaacttcaaaacgatcataagtgaaaaccctataaattgtagtatatgaaaaacattcattgattaaaatcttcaatcaaatacgagttggcatgttgttgaagaaagtaacaactcctggatcatcgtcttatgtttatcctctgtatctggagtagacttaaacaagattgtcgcagtctttaagcaacaagcatttctcaaaatatatttaagcatatctatctctttctgtgatccatgcatccctgtccacttagtttcgagattcgacctcaaacattcaggaacatagttcaactgattctccaagcaaaccagtggatcgaccacacaactatctatatgatcctgagatgatcaaacatgagagttttccttaaagtttgaatgcagtaaattaaaccaaaagtaaaagactatatcgaaaatacttacatcgttcagatcgatctctagctctagtaaattatgcgaattttcgagaaaacggacaagtaactttgaccaatttgcatcacatggacaaagcttcagattctcaagctggttgaagaaattccctcacaataaaaatcctagaataaataatgatttaagctcaatatgaaagtgttcatagatgagagtatatatatagatggatggaaataaattacctcttccgcagagttgactcttacacataatgaaagccggttgacagatgtgattgatgttacaaacttgttgatatcggggtatgtcgtttcgatatccgcctcccctaacttaggcatatctttaaaatcgtaggagtagctatctctatctgtaagtaacttgaagtacttcaaaggagtgtttatggttgactaggcttccaactgggtttagaatttttatagggactttcaagatagattgattgttaggttgttatatttggattgatattttggttcttcattagtgggtgttcttattgtttaattcagattggtcccttagattttgattttagatttaatacattttgacaccaaaaagtgttgttgaattgtttgaaacaatataggtgagcaaagtgtccttagccgacgagagttgaggttaatttactttgtgaacatatcaaactggacgttaatggttgctcgttttcttagattcaaacgaaagtttagtgtctggaaaattcattgcttagataatcaacactccaagagcggatgcaattttcgtgttttgagttcaagaatggcttttaatgcaatcttatttaattgtctattcttttgccatgaaccctgaggattccctttacccgatgtcttttacctattgatttacaatcgtttttttttcgttttttttttcttgttaatttctgaatttttggccaaaactctttagcattctagcttaatctaaaccatcatagattcataatttatatcgtattcacttggtctttgtggttcattccgtacatatactattgcgtttgttaaacacttgcagtatattttctaggaaaaaacacgtggatcacaagttgacgttgttgccgtggaccaataaacgagtgccctgtgaatttttggttaagattttatttaggaatatttttcatttcattttatttatatatttatttatttttgtttctgtactaactatttatttatccttcgattatacgaaagtgggcactacgtcaaaactagtcgttgccattatttctttgaaactgccgctttctctcttcttctgatttctctttctcagcttccccaagcaatctccccttgataaaaaagacttcatcgaaataatgatcagattgatggttatggtgttaattacatagcctgttattagttagtacatctcaccaatcaattttttattagtataagtaaaaaaaaaacattattttagttgggatacataaccatgtatagatgtcgattatatagccatctgttatatcttaactgatcattgactttgcgttcagatgacctataaattttaacattgtacggctgtaaactttttcaaatctatataaatagaatgaggaaagatccgcaagttatattataaaagaagaggaaaagattagcaagttgtcaaaaaacaaaaagagagagacaagatccgccagctacacatgattaatgtccatggcgccattcaaagtcgaccgttcaatgcttttgggaaatgagaaacaaaatagtggaagattatttaaacaaattttgtttacgaagacaatcgtgtagtgcataaacacgaatactaaactcttgtaatactccaaattgatcgttgactttgtagtcgcgacagcccctaagtttgtcaatgtctcgttaacaaattagcaattagaaacatagtcaaaataatcatctcattctcatatctctcgttgctcaaaaaatctctcagcatctcttatg

SEQ ID NO: 6464 - DNA, 3000 bp, Unknown
  misc_feature (1)..( 3000): cDNA_ID_3048384_gDNA_ID_1621094_Annot_ID_170888 3000 nt of promoter + ATG
aagtctttaccttttcttatatcttcttcctcttgaatgaattagatggatgcggaattagaacctgtagctcttacacctcagaaacaagacaatgcatggaagcattgtgaaatttacaaatatggtgatagacttcagatgcgttgtctctactgtcggaaaatgttcaaaggtggtggtataactagggttaaggacatcttgctggtaaaaagggacaaggtactatctgtgaccaagttcctgaagatgttaggctctttttgcagcagtgtattgatggaactgtgagacgtcagaggaagagacataaatctagttcagagcctttgtctgttgcttctttacctcctattgaaggagatatgatggtcgttcaacctgatgtaaatgacgggtttaagtcgccgggtagttcggatgtcgttgtgcaaaacgagagcttgttgagtggcagaacaaagcaaaggacttacaggagtaaaaagaatgcttttgagaatggtagtgcgagtaacaatgttgatttgattggtagagatatggataatttgattccggttgcgattagtagtgtgaagaacattgtgcatccttcctttagagatagggagaatacaattcatatggcgattggaaggtttttgtttggtattggagctgattttgatgcagtgaattctgttaatttccaaccgatgatcgatgccattgcctctggaggattcggggtatctgctcccacgcatgatgaccttcgagggtggatactgaagaattgtgttgaggagatggcgaaagagattgatgaatgcaaagcgatgtggaagaggactggctgttctattttggttgaggaactgaactctgataaaggctttaaagttcttaactttttggtttattgccctgaaaaggtagtgtttctgaaatctgtggacgcatctgaggttttatcttctgctgataaattgtttgagctacttagcgaactggttgaagaagttggcagtaccaatgttgttcaagtgattacaaaatgtgatgattactacgttgatgctgggaaaaggttgatgcttgtgtatccttctctatattgggttccttgcgctgcacattgcatagaccagatgctcgaggagtttgggaaacttggctggataagtgagactattgaacaggctcaagctatcacaagatttgtttataaccatagtggtgttttaatctgatgtggaaatttacttctggtaatgatattctgctaccagcatttagctcttctgccacaaattttgctacattgggaagaatagccgagctcaaatccaatctgcaggctatggttacttcggccgagtggaatgaatgttcatattcggaagaaccaagtggattggtgatgaatgctctcactgatgaagccttttggaaggcagtagctttggtaaaccatttaactagtcctcttttgcgggctttgagaatagtttgttctgaaaagagacctgcaatggggtatgtctatgcagcattgtaccgagcaaaggatgcaatcaagacacatctggttaatagggaggattacataatatactggaaaattatagatcatggtgggagcaacaacagcatattcctttgcttgctgctgggtttctttcttaatccaaaactcttttataataccaacgaagaaaatccgtagttagcttattctatcggtgcccgattgcatttgagagattggttcctgacgacaagattcaagataaaatcatcaaggagttaacctcccacaaaactgctggtggagtttttggaaaaaacttggcaataagagctcgggatacaatgcctcctggtatggttaattttcctgattttcttgtataaatcttttcgcttgtacttctcttacttgactctcgttacattcttgtttcttagctgagtggtggtctacgtatggagaaagctgcttgacctctcacgttttgcgatacgcattcttagtcagacgtgcagttctcagttagctgcaggagaaaccagatacctgtcgaacacatataccaatcaaagaactccattgagcaaaaacgactcagcgatcttgtatttgttcagtacaacatgcgcctcagacaactgtaagtcttagatcttgtcccatctcagccaactgcattgtttccaaggaataagaaagtatagaaataatggttctatgtcttctctaggggtcctggaagcggagatgacacactagacccgttgtcacacaacaggatagatgttctgaaagaatgggtttctggagaccaagcttgtgtagaaggaaatggaagcgcggactggaagtcgcttgagtctattcataggaaccaagtagcaccaatcattgatgatactgaagacttgggttcaggtaaaaagatttagcatcctcggacaactttttttgtgtgtttcgaagattttagattttaaaagttgaaatgaatgtgtacaggtttcgatgatattgagatattcaaggtagaaaaagaagtgagagatgaaggttattatacaaacacatcggagaagttattcacgtaagattgatcatggttggtttaagcttcttcgtcgatgctttctgacttacatgaagctgttgtagtcataggtgtcgatttgtaacattagagtcttccctttagaattatctcttctacaagacgtttcagtattcttattcttcttactctgcattgtcctattaggtttccatagagtttgggttttataatcaggttctgtccagatttttaagttgtttgacaaatatatttaatatggtcatgaaatctaaatgcctattttctttcatatatatatttgatggctttgttagaccatctgttttattactagcataattactccttaattcttgtcaagtttttgaccgatatctaagcatacacaacagaaggacctctcaca

SEQ ID NO: 6465 - DNA, 3000 bp, Unknown; identical to SEQ ID NO: 6460
  misc_feature (1)..( 3000): cDNA_ID_3090256_gDNA_ID_1621094_Annot_ID_170886 3000 nt of promoter + ATG

SEQ ID NO: 6466 - DNA, 3000 bp, Unknown
  misc_feature (1)..( 3000): cDNA_ID_2043719_gDNA_ID_1621094_Annot_ID_170883 3000 nt of promoter + ATG
ataattcaacggaaacaaaagagtaaataagaatgcattagagaatcaaaataaaagatcaaatccataatccaaacttcaacaaaacatcttccacaatccaaaacaggatccacatttttcaccatgggaaatgaaccctagaaactaaaaaacacgataacaaaacgctcaaaatgaattcctcacgaaatagaaaatttcttcagaacctgagcttggtaaagaaccatctgttcttaccggttttgaacctctcctcaagcttagccttagcttccttaagagcagcaaccttcttatccttactctgaagagcatcaagagtcgccacttccttgagatccacgtcgagtgtgtaacgagtaggcatcagatgctggtaattaacaagcttgatgaaacacttaaccctagatttcttagctgtcttcttagctgagtctttgcggatgactttgctcgggtacttcttgagtccggcgacgaggcagtgtccgtaaggacgatcacggttaccgtcgtcgaaggatttgatgatgacggctttctttccggcgtaacgtccttgaagaaggatcacggccttgttctgcttcaagaacttcaccattgttgcttcgtttggtagatccctctcacttgtctctctctctggctgctatgaaccctaagtggcggattctatgagaaatgcggctttaatagtaatgcagaaaatggatgcggagagaacctagtttcagttattgggcctttaggttagacccatttttaatttgggctttatattcttatcacacggcctggtaaacctagcttcagttattgggtcatactaattctagttttccttttttttttttcttacgttcgtacaaacttcaaaagagttattattacaaaaacttttttttttgaactaacaaagacatatataaaattatacaactgttatggatcccattgataatacaaaactgtaaaaagaattaagttgttagctggagttgtaagtatttttgaaatagtgcaaaatttacaaaagaattatacgagagagctgtaaaaaaaaaaaaaagtaaaacttttagtaacggttttgataaaacttttatgattggtgttgaagctatccaactctatatttgactgctaattttagttactcatatatgttttttggcttgctcatagcactaccactatgtatagtgactaacttttacaaaattacacttatactatctacaaaattatacatttatcatattattattggaattgtttgtgaaactatacattgtatcgcataaaaacatgctgtctttttctcaaaatcttctaatttttcgatcaagttccatactcaaaattatcaatttaattgtcacgaaaatttcgaaaacctttctaccaatattttaagactttcaaacatgtctactttcgttttcgatcacaaaatttacctttcatcatacgaacaaagttggaaacttcttctcgcagcaatcaatatatttgtttataattctactaaaatgtgtcaaatatttataattaaaaattgcatgcttgacttttctagccactgcgagactatagtctataattatggactgttaacatcatatttgcagattattatatattttagaaaactttgcttggccggttatatcgtgtctacgcaagtaagtatataggtgtcatattttataaaaaatagaccatttgaatttgtgtataataaattagcaaatgagatcaaattgaaccgaccggatgaaatccgttcacatggaccatataacttgtccctccagttattttattttatttcgtcgatgtgtatttaattttgttaatctctatgcaattaagttttcataactaacttatttggtttggttgaggagtttcaaacaagtaaaagcataaacttaaaaggagaaaataggtggaatcatatatttagaaggatcgtcttactaattagaatcatatactagtagttagtggatgtggtataacctatatggctatatcaattaaattgtttttcgtagttatccaaaataattacagaaataagacgaattctcgtagttatccaataatttatttaatgttttcatataaaatctgaagcctagaaatgcaaattatgaaattatgtatggtttacatgtataattgtttatagtggtctcatatgttaaaaaaataattttttttaatcgtgaatgtagtgtggattacacgaaatcggtcgatgtttttcaaatgccgcaggaaattatatttctatgataagaaaatgtttatgatcactaatattagtagacacagcaatatgtaataaataatattaaaatagagagaataataaaataaaaaagcagacagcactaaaaaaaggttattcttatcttttgtaatcactatcactaattttagtaacatactgtataattttaattaaaagaaaaaaaagttcggaaagtggaatatttttacttttgattttttgtcaacagaagagaatttttccttgacgacaaaagaaaacatttttaatttattctcttttattttaacttaacgaaccaaaaaaaaaaaaaaggtgaaatgcttatttcagacagagaaatgaggatttgttcgagatgtgtcaatgttacgcatagcacagggcagagataataaaaaaaggctctctctttctttctctctctctctctctctcttctctaatctaatctaatcaaaaatctcttctttaggaagagaagtttcctccttcgactttcttctttctcaatatgaatcccggaaaatcgggaacctctagcgatttcagctaatctttacttaccttttctttagttctgacaagaagtagcaatacccttttggagattcgatcgtattcgctgttttttttttttgtgttttagctgtcttcgtgtctctgctactttgtgtttgatcatg

SEQ ID NO: 6467 - DNA, 3000 bp, Unknown; identical to SEQ ID NO: 6458
  misc_feature (1)..( 3000): cDNA_ID_3048396_gDNA_ID_1621094_Annot_ID_170879 3000 nt of promoter + ATG

SEQ ID NO: 6468 - DNA, 3000 bp, Unknown; identical to SEQ ID NO: 6457
  misc_feature (1)..( 3000): cDNA_ID_2043733_gDNA_ID_1621094_Annot_ID_170876 3000 nt of promoter + ATG

SEQ ID NO: 6469 - DNA, 3000 bp, Unknown
  misc_feature (1)..( 3000): cDNA_ID_3090281_gDNA_ID_1621094_Annot_ID_170869 3000 nt of promoter + ATG
aatctccatcgctccggttagagaaatccgtacgaaatagagattagagagaaaaagaaggagaaagcttttggagcttgtaattagtggagtggcttaatttgataatgactaactttaacacttatttatagtaatttgggaagttatgaacttaccatttgaaaaaatcaaatcctttatcgtctgtagtgatacattatatgtttcataataataataactatttttattttaatatattcataaaattgtttatatgaattaaattatgtaatttccaatgttgtcttgaccacaatgttgtctttaaataaatgaaacagtcaatctagtcatttattattcactaatatatttttgtaataatgcgaatataaaagaaaaataactttcaaaaaaaatcttattccattttcacatgtttcgtgtacacatcccatccaataattttaagtgttatcatcatgtttatgtaacggctaacgataaagataaaagaactttattgttagaggttgtggtcattttcacgcaacaacaaagtggtcaagttcaatgtataaacaaaacatttccatttattcctacactcttttgaactggggttgaaagatacatcaaattattgtccccttaaaattttgtcatcaacctatctagaggaaaacgttttctagatgacttactagttactacgtgtcataccgcaatcgaccgtttgtaactttgtattatttactttcacacaagtcgcaataacaagtcaatgtcaattaatactttatgggtttggttttgatttattcgttattacattcatggtggtttattgttgttttgtctaagtttgtttcgaacatattagagtcattttacataatgtataatactaccattaattattttcccattcaatattttgaacttgcatagaaaaatttggtgaaagcaacgtcacaactaataataaaacagaagcttgcaaatcaacgataaagttgggccaatcctatcttaagcttgataatggatcgaaaaataaaacgtcatgggaaataagaaaaccatactaatttttattacttatccactcatcgatgggcccaagaatctaaatgcacgcttttatatcattttccaaaaacaataaaattggacttatatttatgtcacattacacaaaattatcagataaaacaataaaaacggagtcatgatcagccctcaaacctcataacaaaaagatgtttacagtttctctgaagacttgatgcaaacctaaacacatccgacgataagagagcgtctacggacagctatagagaccgagtttggccactattcccaaacgtgaagggacaagaaccatcacccacatttaaaataacccacttagaccgaaccgtcacctttattcgattccgaaaacccttaccgaagcattcctttgtattctcttcttcggttcatataattatcttaatcgaccttattttctttttatttcataagtgaaatcaattaacattatgcaagtaatatttttcctgtgaacctttatcaaacttcatcgccattttaaaaaagctttcatcgccaattatctctatgcaagtgattgacaattttaacataatattttacttgagggtgagatttttaaagaaaatgtagtgaacgatttttttataaatcttttgatacatgtaatgtgatatgcactcttcttgcaaaatgcatataaatatcatgggtgaatctatattcataatcatgatcatgcaactgaagtatgttagtcatttcatcacatccacatagatatagattttattacccaaactattgaactttttttttttttcatcaaaaaaaaaaaaaaaaaaaaaaactattgaactttttttactattgaactttttttttttcacccaaactattgaacttatctcgataattcaagtctaattttgtttgctttttatatacatttcttgatagttgaaagatcaagaaccgattaggaaccaaaaattttgaagtaattttggttttggtctatatatctgaataacaaagaattgaaaatgttttgagtatatttttcttttcagagttcgaatatttttttgttattttggttcagatctatttggtttattcgggtatttttcgttcaaaaattcttaaatttttccgattattcagttttagaataactattatttttggaaatatttcggttttagagtttatgatttattcgaaaatttagttggtttggtttagttcagtttctctacttaggattcggtttcgttttggtattttatgtttgggtattttgactaggactaatgggacagtacatgtatataactcagggacatgtttgtttacactaatagtctagtagtagtaaataattgacataacctatgatccttttgtcgagggatgagatcttgccactttattcttcaatatcgggaaataacgctaagggatttcccatcgtcgaacgagatttggagggaaacagaaaaggtaagtgacaaacctacaacgtttaagaaataattaagcaacacaattaaatttaaatttaacaaaaaattctatttacaatagtaatgagtctttttttttctttttttttacagtggacatataattaggccgtgtgaaacaaactctcatctctttcttccattttaaatcgttgttggtggccggaaaaattacatctccgcccaccgccgtcggaataatccatgttatctgatcggcggagtcttccattgtcgcgtcggaaattattctctgtaattactgtcacgtttcgtctctcattgagggaatatttgcagatcgatctatcgtcgatttagatctggcgttcctagggttcatcgacgctggagattcatggtctctggtgattgcattttcgaatttttgctgaaattggggaaaattttaggtgctgtgtagatg

SEQ ID NO: 6470 - DNA, 3000 bp, Unknown; identical to SEQ ID NO: 6455
  misc_feature (1)..( 3000): cDNA_ID_1442397_gDNA_ID_1621094_Annot_ID_170865 3000 nt of promoter + ATG

SEQ ID NO: 6471 - DNA, 3000 bp, Unknown; identical to SEQ ID NO: 6454
  misc_feature (1)..( 3000): cDNA_ID_3238302_gDNA_ID_1621094_Annot_ID_170863 3000 nt of promoter + ATG

SEQ ID NO: 6472 - DNA, 3000 bp, Unknown
  misc_feature (1)..( 3000): cDNA_ID_1814431_gDNA_ID_1621094_Annot_ID_170904 3000 nt of promoter + ATG
agttgatcatcacatggaaggaaaaggaaaagaaaattcatttagacctttccatgtacaagtatatgatactcgaactattaccataacgaatattcatacatataaaatacgactacgggatcttataatcgaatttatgtaggatagtttgaacaagttgttcgaatactaaactatgaacaccaaaatgcataattttgtagtcgaatagttatgaacatatttatccatatcatgtgatcacgtttgagtatatttgtttccaaagccgcttaaattttttgtttccctttctaaatgagttcttaaactcgaaatgacgatatctcaaattggtaaatgctatttaaagttctgaatgaagacaaaatcgcattatgtagtgcgttattaaaaccataccgcattttatctctaattgaatcgtataattctattaagtttatttaatttatccgtccacaagtcctcaaaatatgaaaaacaataaacaactaaagaaaattacaatagtcaaagttttcattctgctacaaacaaagtcagtatacctaacatttcttcctttatgttttttttcctcggaataggtaaaaaactagaaaaagaacatttctaagaataatataccgttttttcctcggaataggtagtattgctattcctctccgacgacggagcataacctcctcctcctcctccaccaccctctctactctcctccgcccccacaaaaccatcggtagccactgcgttaggatagctaagagtgctcacgttgtttgacgacgaaaacatgtacggtcgctgttgttgcattagctcgttatgagccatttggttctgcaaattagcgtattgccaaggagaggaagatactccggcagtgggatcagacgaggtgagactaaaaccagacgacggcgaagacccgaacgcaacggcggatggaccgccggtgaattgttgcaccatggctctgaagttggctgtgtcggtgttgaaaagtgtagtaggtgtacgacgtgaggctctagatctccgacgtgttggctttgcaacacggcgattatccggactcagaggagaatcagctgacgtggcggtggtggtggtggttgtgacggtggaggttgcggtggtgaagaaggtttggttgttgtagaattgagaccagtcgttgttagagttggccatcttcttcttattattatgggagagatcaaagaggagcccttgtttagtatttatggactttctctcatcttttggtttttaatagcattttaaaacttgtcaattggttggatttggtcaaagtaagaccatctaacaaatcacagccgttggttttggtttgtttttacattttagggacacgtggatctaaaaaagattgtcgttgatgcgtcgcctaatgtttggatgatgttgtcgatttgcatttctcaattctcacatgcagtagtaaattagtaattcaagaatgcgatttttttatctaacttttttgttttgggaaaaatataaaaaaaaacatgaactttcaaatttgggataagaaaccatgaacttataaaatattattaaaatcgtaaagttttgtttgactttcaataaaatagcaaagtttccttgactatgccattttaggcatgtcgttaagttttcgtcaacaaaaaaatcacggaattaattttccgttagcattttctgttaaaagcaaacaacgtcgttttgataaaaataaaataacaattgggagcccggcaaggctttgaacccatgacctattattttcctatcatgtactcaaccattaggccacaatctcatttcaataatagtgcaaacatatctatatagcatataaactaaaaataacaaaataaccaaacatgcacaaatattaaatatacataccataaatatacgtttcgaatatcatatacttaactttacatatagcaatttcttctaaatgcaccgaattttcatctgaaaatttattatttcttcattttatcttatataaaaaactaaaacttattgaattagaaaattacctaaaatttacacaatcaatctcaaataaatataggattaatttatacatgcacatagaatggaaagtattttaaaaacttatgcacataggcaatatatttaattttctatatttcataaatttcatttttatatcatttaagaaagactaacttaaattcaatgcattaatatacaagaaatctttatatacatggaataaatatttttggtgtattaaatatttgtacaatattagttgttaatatattttagtttggttatttttaattaattgtgtatttatatgttatatatattttggtttgtcattttgttaaaatattatcgtggctctgtggtttagttgttgtaaggaagacagaagttcaatggttcgaatcaccatgggctcgtttttttttttttataaacgacgtcatttcgtttataacagaaaatgctaacggaaagttaaccctgtgattttcttgttaacggaaatttaacgacatgctcgaaatggcaaactcaacgaaacttgaccattttatcaaaagtcaaaaaagactttacgattttaattgcgttttagaaattcatatttttttcatcccaaatttaaaagttcgtgcttttttttgacattttacccgttctacattcgtaactttgcaactatccacctcatcttctcattttcttaaacttttgacactaatttaatttacttagcaactaaataagccaatttgttttttaaaaaccgcgaacgtgtatgacacgtgtcacaattaaaaaaatctttggtccaagtgcatctgtgtcgtcgttatgcttggtgcttgaagtggccattttcaagcaaaaagataagaatgttcttcaatcttcttctccttcatctaactttagagcttctcttttcatttgaagatggtagcagccatg

SEQ ID NO: 6473 - DNA, 3000 bp, Unknown
  misc_feature (1)..( 3000): cDNA_ID_1814438_gDNA_ID_1621094_Annot_ID_170900 3000 nt of promoter + ATG
aggtatctagctttggaagaaggagattctcaagtactgcttgagtacttcaagcgtatcaagaaagaaaaccctaaattcttttatgctatagacctgaacgaggaccaacgtttaagaaatctgttttgggctgatgccaagagcagagatgactatttgagtttcaatgatgttgtatcctttgatactacttatgtcaagtttaacgataagttgccactagctttatttattggggtgaaccatcactcccaacctatgttactaggctgtgcattggttgctgatgagtctatggagacttttgtgtggctgataaaaacatggctacgagcaatgggtggtcgagctcctaaagttatactcactgaccaagataaattcttgatgtctgctgtttcagagctcctaccaaacactcgtcattgctttgcgttatggcatgttttagaaaagattcctgaatatttctcacatgtgatgaaacggcacgagaatttcttactgaaattcaacaaatgcattttcagatcttggacagatgatgagtttgatatgaggtggtggaaaatggtcagccagtttggacttgagaatgatgaatggctgctatggttgcatgaacatcgccaaaagtgggtgcccacatttatgagcgatgtgtttctggcaggcatgtcgacatctcaacgttcagaaagtgtgaactctttcttcgataagtacatccataagaaaatcacgctgaaagagttcttgaggcaatacggtgtgattctgcagaataggtacgaagaggaatctgttgcagatttcgatacttgccacaagcaacctgcattgaagtccccctcgccctgggagaagcaaatggcaacaacttacacccacacaatatttaagaaatttcaagtcgaggtcttgggggttgtcgcttgccatcctagaaaggaaaaagaagatgaaaatatggcgacgtttagagttcaagactgtgaaaaagacgatgactttcttgtaacgtggagcaaaactaagtcagaactttgctgcttctgtcgtatgtttgaatacaaagggtttctttgtcggcatgctttgatgattctgcagatgtgtggtttcgccagcatcccgcctcagtatatattgaaaaggtggacaaaagatgctaagagtggagtattagctggtgaaggagcagaccagatacagacccgagttcagcgctataacgatttgtgtagtcgagccactgaattgagtgaggaaggttgtgtgtcagaagaaaactacaacatcgcattgcgcacactagtcgagaccctgaaaaattgtgttgatatgaataatgctagaaacaacatcactgagtctaatagccagcttaataatggtactcacgaagaagaaaaccaggtaatggctggggtaaaagcaacaaaaaagaagactgtatataggaaaagaaaggtatgcttttactgaagcttctcgccaatctaaacctacgtacattttcttagcttcaaaggttaaaaagaagatactcaaattgatcttatgcagggacaacaagaggctagccaaatgcttgaatctcaacagagcttgcaaccaatggtttgtgctttgatttgatcttctctaattagtttgatcattgtaactgcacattgctttatgagattaagagtaggatgtcttggatatatggccttatagttttaacattttgtgcaggaaactataagttcagaggcgatggacatgaatggttactatggtcctcaacagaacgttcaaggactggtatgctatgttagttgattaatacaaacctggttaagccattcgacatctattataaaccctaatactaaacctgtttaaactgtggatatagttaaatttaatggagccacctcatgaaggctactatgtagatcaacgaaccatccaaggcctggtaggttacatatagtttaaatgcttgaatctcccaaatctgtgctagagtataagtcaacgacatgaattttggttcttttgactcttcagggacaactgaattcgatagcaccggcgcaggatagcttcttcacgaatcagcaagccatgtctgggatggtggtacattataaaatccttcaaactgattttaaaaactgtgttatgaatgatcgtgttgttaacatcttttgtttattgtccggtccagggtcaaatcgatttcagacctcctcccaatttcacttacactttacaggtctcagctgcctggataaagtctttactttagtatcattttgtactcgaaccacacgtgttgatatcgttaaatcttttcgttattccaggaagagcatttgagttctgcccaattacctggtagttcatcaaggcagctatagtagcaacacgttttgattactttggagagaagttttgtctcaggaaacatttgcaagaagctgttccaaacatgagaaaaacacaagatctttcatggagctgagttgcaatgacaagatgtaatcttttcttaaattggtttctgtatattatgggattgccttatgatgtattaatgtgggatgaaatattgtgttatctgattgaatgtcttgagatttaatagatgcacttgtaacaacatctttatctaaacacatagaaatctatcctctgtgtattagtcaaacaagtaattttgagatcacattaaatcaaaattgttaaaacaggtttcaacttatttagtagaaacaaaaagttatttttagattaaatgtggttaatttggttaaatacacattccctggtcgttgtcgtatgtaggtgtgtcccttttgacaaaacaaacaaacagaaaaggtttctttattcagacaacatcaaaactggggaagaaccaaaactaatagagttggtcaaaagaaacatttgcaaaaaaaaaaaaagagaggcaaagatctcgagagatttcaattttca

SEQ ID NO: 6474 - DNA, 3000 bp, Unknown
  misc_feature (1)..( 3000): cDNA_ID_3090248_gDNA_ID_1621094_Annot_ID_170889 3000 nt of promoter + ATG
aacaaaaatcatttgttattcaatcattgattttgaaattctaattaaaatcatgtgttattgattcgatgatttataaatactagttaaatcatttgttattcgtttagtcatctgtttttggatttgagaatccaaatttatgttttaaatagaattgaatggatttgaaagagaaaaatagaatgattcaaatccatgagtaaacacatttcgaaatccatatatcttgatttcataattaatagagattttcaaattttatatagtttcaaattatttcaaaatccatatatcttgatttcataaccactaacaccctattcgttatattaattatttgtaataaatttaaatgtttgcatctttaactctcacacacaatacctatacttttaaaaactataatcctttaccattatttttgtcgtatttacaaattaacagttggattgagaatttttattatgattttagatttgtagttgtgaaagtaaaaatgttgttatatatatacatttctttgtctatataactatattagtgatacttttttattttcagattctgatatgacattcttgggtagcaaccaatactaattatgaaaccattatattgctccggcttgaagattgcttactctctatatatacccactacttggtatattgttttctatataggctatgattaccaggtatcacaaaatgcatacccttaaaatacttgtttgcttcatatggacaaaaacctcacacattgaaaaccatatccggcaggaaatccgaatcttaatagtacattttttgcttatttcatggcttttctggactccaacaaaatcaatattatacaccaaaatctcagtgattagaacaaatatctagtgtatataaggaataagaattctaaattcaaaaaccagaaacaaatttacatgcccaacgaatatatgaaacgaaaacttaccatcaacgttgcttttctcttcaggtaaaggaaagtccaaccaagccataggctcaagatgcatcatacacaagattaagatctttcattcccaaatgatcaaattacaaaccattaagacacattcatgtgactactgaacaaaaagagatatctaacataagttgcaagtgatatttatgagaatagcatttcacttcacgggtgctcagaaccccgtggtccttagaagaaagccatccttaaacaaatgcaaattatagtgacttatcaatgcttgtgactatacatattgttaaaactttgatttattagggcttgtcctgaacttttctttgaggaggagaggaaaaggtatttgccaaagctgatgtagcatcgatttagaataaattgatggttttaattttgagaatttagagtaagatgacatggaatcttgagagggcttaatagaaaaactgatgttgatgacttgagatgcatcagtgagcttcgtttgtttgttacgtgaaatattttgatatgattcataaatgactataaattgaaataaatagatttttcctagaaatctaaatctttggtgtatatatatatatatatatatatatatatatatatatacatatgtgtgtgcatataaataactcaaagaatttattgaatggatttttcactaatttattttaacgctaagaatgccaactttgtgcccacattgtctctcggccatgggtcgactcttatccgatggcgtgaccgttatttttggaggagttaaagatttgtttaacgactctaaatcaccatatgagatttctttttgttttgtgttctctcgcacaaaatcgacaatcacttctcgatatgtcaccatcttaaaaacattttgcttaaacacatttaacggtagagtttttctcaatacgtttaaccaaaaagataagtttactttggtaacataagtggcaaaattattttttcaagctctcctcatgcaccacatgtttcctgaaaccgagatgtttcttgtgttatatatatatatcagttttgaaaatagttttgatcaaaaaaagttcttcagttcacccataggagcaaatctctcttattcacccacttttgattagccaatcaaaatagaacaattttccatgtaatactatattttaaaataaatccaaattaaaaaatatgtcggtttgggtttataaataaggattatggttaaattttataattaccaaattatatgtcggtttggattaataaaagagtgattaggttttagattttataattaaacaaaatgatatgtcaaatttgggtttataaatgagatttaaggtttatattttacaattaaaccaaaattattaagtcagtttgagtttatatattgattggttttggaagattttacaattaaataaaattaaatgcttagggtttaagatttaaaatttaattcaatctaacattttttaatgaattaatttaatttatttagataataggtgagcgtgttttggtttagttaattagattaaataaaaacattaattggctagttaagagggttgaataagaaagggtgaacccaagaattgaaaattagaattaaaataaggtctttcatgtttttgaatttcgaaatttgtatctaatactattataagatcttgatttttttttttggggacatcttataagatctgatatataaagaatcaaagtaactaagagtaaacatttatgatttatggagttcgcttcccatatatacactgttaaagatatcaatcataatggacacaatcaaaccagattcaaatacataaatctccacacacacacacaaaaaaaagcttaaggaaatatatttaaagcctaataaataaataaatctctaaaacataaatgcattgttaatttctctcttgcagacgtatatatataaccatgtaactagcaacttcacatattgagaattcttatcaacaattaaacatctcgataatg

SEQ ID NO: 6475 - DNA, 3000 bp, Unknown; identical to SEQ ID NO: 6452
  misc_feature (1)..( 3000): cDNA_ID_1814522_gDNA_ID_1621094_Annot_ID_170858 3000 nt of promoter + ATG

SEQ ID NO: 6476 - DNA, 3000 bp, Unknown; identical to SEQ ID NO: 6451
  misc_feature (1)..( 3000): cDNA_ID_1024003_gDNA_ID_1621094_Annot_ID_170855 3000 nt of promoter + ATG

SEQ ID NO: 6477 - DNA, 3000 bp, Unknown
  misc_feature (1)..( 3000): cDNA_ID_3090297_gDNA_ID_1621094_Annot_ID_170854 3000 nt of promoter + ATG
tatcaggttaatttcgaatcctcctatgtaattgaatcgattgaattcgaatctcagatgtgtgatttctatggttttgatctgtggtgcagagtcgccggagcttcctccgcttcagagtattcagttcacaaatccgtttgtttccggtaagaaacggattattccggtggattctgttttaagtttcgttgacatgtaacttgcttcattcattcatattctgcaggtaataatgtttctgcctctcctcaatcagtcgacttagcaccggaagtttcaccaagctccgatctattctcaccggaaacagccaccctagcaccaccaccaccaccaccaccactaccagttctacaatacttctcaagcgactctctcaagatcagaaacttctggtttccatcgactatcatcatgacttttgccacttctattctcgctcgtatctgaactgttttaagctctctgtgctttttactgcttatgtttacttcattgatacttaagattttaccattgggcttgtgttaaagtcttccctatgtagaaacgcagagaatagagatgatatagtagaagaagatgtttaggtttacattgcactatcttttgcttcatatacgcaataaggaaagaaaaagttcaacacatgcatatcatcatcattatctaggaactttaatatccagggagcttgaagttcaacagagaatataaatgtgagccgagtaacataaatggactaataaacacaatgaaaacaacttaggcatcagcagtgctgatacgccatccgtactcacgggctccgtccttgtcaacaatcttgataacaaagtttggtggtgcaatgaccagccttgacctgatctcgagtatgcatttgtccaccaattcaatggcttcttcaacagacatgtcgctgcggtagtgtctgtccattgtagagagagagaagtatgagccgtatccaaatgctcccttatcaaccttgtggagggttgcaatgtagtcaatgtagtatagagatgcgccggcttctttgtcatagccagccatcaggatgttcaccgaatatggattctggaatcaaatagaacagacaacaatgggaaatctcaaaatgtcaagtgcgaatatgcagaccagtcctaaacaacccaaaaaaatccagggaatcaatcagatcatttaacaatctatagctaaggctacatgggtataaaccccactcaacactgtccaaagttggaagatctaccctaaaccggtaaaaatgatcacacatcagttagccttgagtatcagattttcaccatcaagacacagaagtcagagtaaccttggaaggtagcacaaaattcctagtcttgtaaattcttagttaatgaaataatattacttatcaagcttggcataagaaaactattaagctgtaatccgagtttcatcttttctgcatcataattctaaatttcataacttcgtccaactcaaagataatcttctgtaacatccaaggacataaaactgcaacaatgtgtagaatagtctgaaataccttgaatatttctaaaggccacactatgtctacataatgaacacattaggtaaagtttctaatggcatttagctactctgaggtaatgaatattaacaagtattagaactacctgtatcaacaatggttttacaccaccatacaagaggaagtgaaacacaaaggcttatataaacttatcaacaagtattaagcatcaaacatcttaacacaatcaaaaccatagtatgacagaggaaagcttcaaaaaaattgacatgtttaactaaagaagaaagacaagttcaactacattgcatcaaaagaggaaactaaaaaaccaagaataagcactaagcaccaatcgctgatctgatgataccccacaatctcactatttcataaaagtatatgtacctcaaagagattaaaaccctaattccccaaatctaaaataaggcagagaaacttctgaaataaaaaaataaaaaaccgtagaagaaaagttagaacctttctcaaagcagtggcaagttctccacgagtgaagttagcagcagcagcagtactcaaaggaatcccattacgaaactgatacagtgacacattcttctgaacatactccgtaaactgaaccctaaagtaaatccaaaaaaaaacagaaatcaaattcatgtactactactactgaatcacagacagagagagagacggagaagtttttttaccggtcaccaggctcaccactagcggcgacgagcttgtgagagtcaagagtcatgatcttgtcctctttgttcttgtgaagaagaatactgtgaactgctgatgtatccgccgccacgatagcgaatccattcccaactagaccaaatacacactccatcttcagatctgtttcttctcagttcctttttcgaatttttcgattccgattattcgtttcttccggtcgctggaagaatagtttaagagctttttagatcaaagcgacttggcgaacaagacgggttgatttggtagttctagaatatagtcaggggtattttagacatattaacgttatggggacatttctattttttaaagtaggagggtgtaagagagagtaataggaaaagcttaggggttaatttgtaaattaaaaaggaacctctcgttttcttctctctcccgcttcttgctgagtcgccgaccctctgagaagaataaggtctaacaatggaagtctgagatggtttcttcagtttctaattataaaagagaatttggttttaatttctctttattgtttatctcgtcctcgatttcaagagtttgatttctgtaactttgagcttccttcaaagcaaatgaaaggtgtcgtcgtgagtatactcgaattgtatttcccatggtgaataaaggataaggaagtgttgtgtcttcatttcaatagataaaacaatctaaacatg

SEQ ID NO: 6478 - DNA, 3000 bp, Unknown; identical to SEQ ID NO: 6450
  misc_feature (1)..( 3000): cDNA_ID_1814533_gDNA_ID_1621094_Annot_ID_170852 3000 nt of promoter + ATG

SEQ ID NO: 6479 - DNA, 3000 bp, Unknown
  misc_feature (1)..( 3000): cDNA_ID_2041095_gDNA_ID_1621094_Annot_ID_170848 3000 nt of promoter + ATG
ataccgaaaagttaataatgcaaccatatcgatttatttcacctaatgctatgatacacattgttttaaacatggattgattataccatcctcacaattgtacatttttgtcaaattatagttcagtgttgttataatattcaccgggatgagaaggacacaataatgccacccttataacaacgacatttctccatacctaacattgacaattcacttactatatggcaaaatgaatatgatatgaagaccctacactttatcttacatatacgtccaaattggctacatttgtccatgaatataataaaatacacaaacacaaatcttctgagaaacatgtattgcttggtaattaccattatattatcacacgatggaatcaaattttacaaagaaaaaaaatcttttatcatttttggcttttgatgaggactttacagattaattgagtttctattgttagcttcattagtgaccaaaacaagacaggttataaacttgttctcacatataactctttttgtgacatcccacctttttttatgtctcttctactcacatttttttctgtggagatcttgatgacccctcttcttgatcattatccattttttagatcttgaacgtacacttattgatgtttgttggtggaaatgtggcttgcgtgcaaaacaaaaagaaaaatatttgaacatcttgcggtttttgagactctaagattgtaatttgacaagcactttatcctcactaatacatgtaatcaaatgatataacaatttgaattataactttttatacatttaactgtgtttgtaggcatttgttttagtttaaatatctttttaaactatctattttcaatattgatatttcaattttgacgatttttgtaattaaaaaaaaattgttatttaaataggcgactttacattggaggcaatatctcttactaaattttgtgattaaaatttgttttttttttttaaaatgcagtcatcttccggaaaagatcaatcgtcctcttgaaacccctaattttctattgctgaaatctttaataatttcactaaacatcattaatatcgatgatcacatcttatccagggccaaaacaatatctatctcaccgatcctcccgttaatagttcatttgtcaacggctataatcgttcagacatagtattgaatatcagtgagatctttcactttgcaacaattttttttattagttaagaagagacattaaacaatatttgcttactcctttgttaatacatatgattaattaagaacacaaaaagctaatatgcatgattacacgggcaataatgttgttcaacatgtccctttttataaagtgagaagtgtaaatatttattttcttgaaaaagtagttacaggtgataagtttgtatatagaacaacaattgaatacatgcatgcctaacatttcttaaaacataacatgcccaacttattgctaacttcagactaataaatgagatggtgtgatacacacactatatataatatatgagagaagcttaaactactaaatacatgtaaaatgctaaaataatgttttctttatacagttgatcattttagactaaaaaatcagattacataatctaaaataaatcattgtcgaaattaaattaaacaaagatatctaagacattattcattattgaaattactgtatttaatgtggacacatttgtcgtatgttgaaatttttgatatgtcacatttgtgcctctctgcatatcaaagtctttcatatttaaatcctatcatattgccgacacttaaaatccttttttttttctttcactaaaccatattcctataaagatacaaaaatttccttaaatttcgttaaacaggtaatttttctactatttaattacaaaatgacaccaagataaaaaagagtccaaaagatatagacaaaaaaaaggtaagaaaatttatttttacaaaaaaaaggtaagaaaaattattaaaaatcgaatatttactatatgcgccaatcatactaattattctcttgtcacgcagtgtagacgaaggagagagagaagagaatgttgtgtgtctctgtggttctcctccattgatgtctgaaactgaagagtcaagtgattgaatttgtgttcttgttttttaccctttgtatatatttctttttgggtaagtaagtgcttttgatcctttagaaattctctgagataaatcgttttcgcttgatgtttcagttttcaatcgaaagttgtcatctttgtgtcgctgttgcttgcattcatcacaagtttttctcctgaatttcgataaagttacttcctttggcaattttgttgctacccattttcatatttctggttaatttcatctacaagtaagatttgtttagctttgtttgtgtatataagtttgattagttttgttcccaaagtttgacgaagaattgttatttgctgtctctattattggtggttgatgaagtgtctgtctctctatgatacattttcctgaagtctgcagttttcagtttgtaccaactcaattcttatgaaacataaagactagcttttcccttttctccctcttcttgattgtgttttgttatacattaaaaagcttactcatgtttgtatctttgtctatgccttgtttgaagatagttttgtgtgttatctctctgaagattgctgttttttttttcttgttcaggacgatccagtgtttatcattcttaaggacaccaaattgatatttagcattaagtacaaatccacagtgcaaaggtttgtttgcattgggaaagcaatttaaatctaatgtaacttccttcgttgtttagcttgattataaggtcattttgtttcagttttgtagaattcttagtttctagcatactagtagaggatcaaaggaatcaagtagtttactttggcgtagaacccgttcgttgagcttcttgcagcagctgtt

SEQ ID NO: 6480 - DNA, 3000 bp, Unknown; identical to SEQ ID NO: 6448
  misc_feature (1)..( 3000): cDNA_ID_2024980_gDNA_ID_1621094_Annot_ID_170847 3000 nt of promoter + ATG

SEQ ID NO: 6481 - DNA, 3000 bp, Unknown
  misc_feature (1)..( 3000): cDNA_ID_2041104_gDNA_ID_1621094_Annot_ID_170845 3000 nt of promoter + ATG
acattagtttcggtcagatatattagacatatactccattaataattttaaaactaaaaaaaaacataagtaaatatactcgtatgtggatacagaaacataggtacgaatgaaaccatatttccatttacgtgttagtatcgagacatatgcatggaccacataaccacttaattcctacgtattaaatgtttactaaagtggatgagctgtcaaaattatagagttaccatggtttataaatgaaatctgttaacatatcgaaacacgaaactctcggttctcggatcatgtcgccactttctgcttacaaaatttagcttcttctacttctatttctggttctttttgccaatccaatattgaaatttgtctcaatgtttcaacattatttgattgactgacgtagacactattttcgaatcttttatttctgctgcatttagatcttttgcatgtcttctgagttctggcggctaaaataactggacgtgatcagtgttataagtagtgtatattagtttattaattgcgaagtaagcgttaaggaatgaagcccaatgccctaatagatataaggcccattaccaaagtcagcaaaaccaatctgtgatgtatgagtaggactgaacacgaactacaaaatgaaatcgagaatatatttgtttggttagaaaccactgaaattgatatgtatatgcccaatgtttggattttatatgcgatgaatgggtagacgacacaaataattgattgtatgcggaaatatagcaaggtcgtttgagttttgtttttgtcccttttagatattaaactagatatgtatatgtcaatcttttatttaactagatttacttagatacagtcttgtcgtaatataggaaactcattgtatataaatacttctctttgctactcaataccatcaagctattacgacatatttcatttggggatctccaatcatattggtgttcttattgcgttttcgggttttaattggaaagcttaggggaagtcttttgagtttgtacttcaattttaatgcttaaggttgaatttgtgccgtgattttaatcctcttttataaaatagaaacactggtaacagaaacaatgggaataggaatttatgggagttgaatcctttggatgatgacatctatttgtggaagtcggaccatcatcccccgtgaaccgtgatagacttaggatcgagggacattttatctctccctcttgtgttcgttgcaacggttctaatgagttaagagagtacttgttttttattacctgttatgttgtttgaacttttttttttttgaataacaggaagttctggaccgaaactcataatctcccagacccgaaactacagccagtaatattagtttcgtcctaagcgtcactcgaaccagcaatctctaaactttgtctaggatctttaccaattgagctaacgacacttggttacccccaaaccattttatggcttgttttcactgggtctactcggctactagggatccaaatcttgatttgatcataataattgtgtttcaggcagcggtctatctcctttggaagaaatgtaactctcgtatctgcactacgaatttcaagaccccacgtcaatcatcaaagacatcaagtcgttaatgtgggcgcgtcttgatcatcttgctaaaaagcaacgtatcgctcctccatggttttctctactctccgcttggttaattttcttagattaaggggtctcttctccttttgtgtccggacttcttgagcgtttaagatttttttatagttttggttttttttttttgttgttgtttggcatatgcgtttttttggggtatatgtgcctctttcagtttgcttgaccttgtatttgtttctctttaataaaaaataaaaaataaaatagaaacactgttttgctttagaatggcgactgctcaacgtgagagttctgaagtcgtgatctttattacataagcgtgttcgatgggccggtgacttgactttttgccattctatcggataaaatagaaggcataccgtgtcctataaactagatgagcatgtttgacataaatacttttaaactataaatgcaacttcttagaattttttttaggtatggaattcaacagaactttttaaacacttattactttctactttttaagtatcacatggctacaatgaagtaaaaacatattatgttaaaaatagaattatatgtctatgactaattaatctattaatctgatttagtatagagttttaagattttttattcctagaattctagtataaaggatttctctattttcttatgtagaattgtttcatataaattatttagaatctgattaatagtaatcatagtatgaattttcaattcaataaccctgtttatttgagaaaactttatatcagtggcatttttagaacaaaaagaaacaggtttgaattattaatttcaacactaatttattgatcataatttattagctttctgccgttttttttgtcagattcatccataaaacttgttttgttcgtaataaacacaataattatattatatatgatagaacttaatatcaatgtcaatattgtgcaagtgcaacaaaaaaatatgatatgaatgattattattcttctcttttttatttgctccaatatgatatgattattttcaagactaatttattgaatatgttgaccctaaatatataaaaaaaacaaagaaatgaaaattaaacgcattaattggatctcagcaatcaactaataactaactcaagaaaatctgtagccaagtcggtcagtccacatcactattgacatccgtatccaccttacacacttaccaaatcctcaactaatttatataacaaaagtccaagaatctttcgtcttcttattttgttatttcaaattaattgttttctgtgtacttcaaattaagggagaagaagacagaatcatg

SEQ ID NO: 6482 - DNA, 3000 bp, Unknown; identical to SEQ ID NO: 6447
  misc_feature (1)..( 3000): cDNA_ID_3090071_gDNA_ID_1621094_Annot_ID_170841 3000 nt of promoter + ATG

SEQ ID NO: 6483 - DNA, 3000 bp, Unknown
  misc_feature (1)..( 3000): cDNA_ID_1814442_gDNA_ID_1621094_Annot_ID_55622 3000 nt of promoter + ATG
gatccatttcccatctggtcttctcttcacatgcatactagccttgcaatctgtttttttcacagttgaccttcgactactactaccactactctcagactcaggagtcacaccatatctggaacaagcaaacttagcatcaatgaagtctttagttttcttggaacgtctactgtttttaatcgacgtagtaaaaacccatagattttgcatattcctgataaaagatatacgctgcctcatgggtatcaaagtctataccatttcgtggctcaagatccagatcaccactaaatccaacatctccacctatattgaactcatcaacaattcctatatctctgttactatgcggttcaactacaatgtcaaccatatggtcatcccctgcatcactaaccagattctcttgcaaatccatcctaaccttagccacatatggattcactaacacactcaaaagcaactaccccactatgggcttccatgaaattggaaactgaaatctttctactagataatccaccttagcacctgaaaaatgtcacaaccaaacttcataagaaccagcgcgacatcttctacctaaaaacatcaaacttgaaacacacaaagcaatatgaaatcaatggaatcaaatgaaagtgaagaactttcaacaacataacttctaatagtagaaaagttctgtttctaaagccaaaaaagagtaaaatttcacacaaataagagaaggagacctgagaactcaaactaagagagtcagagacaacatacttctagtagtagaaaagttctggttctaaaatttcagtgaaagaactgaactttcattagtatcagcataaaagacagagactttaatgtatcttaagagaaaacctgagaattcaaatgaagagactacaaaattcaggaaatgtcaaacttttggattggtgagggctttttactgtattttctcggccacccagagagagacaaagggagggaaggcaaaattctgacgtgaaaagagcaaagcaaagaagaacacgaagcaggcgagtggggaagcaaaagcgagtgaggaaccaaggagcgtgagaggagaaaatctagggttctttttgggaatttttagggatcttggattatgtttttatttttatttttttcatttgttgtaaatctcttactagcctttactaattaaacataaaggctttttgattggtaacacgtgtaatgacataatgacgtttgttttcgacgcgattttttttcataatcgcgtctatatttacgtttggcgtgtgagaagcattgctgatttatgtattcttagaaaaattgattattttaaaagcatcagcattgtgattttttaccaaaatctctcgcctacattaataataataaaataataaacaatatttttttaattaaaacaatttctaagaaaatatgagaaagtttttaatttaaaagatttgaaaaaactattttaaaaaactcttcaaattaaatattttttttattattattactttagtaaattaaaaactttggttagaaaccaccactacacatgttctaaaagattttaattttaactgtatgataatcttcttttcatacagtttactataatttttccacatttttcaaaagagttatgtagtaaactaaatttatcataacttttaatatgatttttacatctatttttatgatttttacataactattaatatctacagttttttttttattataagttcaaataaaacaaaaaatacaagaatattaaaataaataacattaaatctatttttgtacatatgagatacatgcttattcttattatgacaaatcaagtatacttttttttttaatctttaccgtcattttttctatatatatgtgggtatctcatattctatatgtaatatgctaatcaattacatgatgttgatggctttcacatcaaaacagagctgacatttgccaccaaatataaataaaactgtagggcaaattgtacgagagttgtgctctgagtcacttgcttttagatttagttatggagttacaaatgcagggtttgcatcttatcttttaatattttttttcttttctactcacatatctttttttttatgtggagtggaagataattgtttttaattcatttaatattttttgatttaattcctttttaaacagcaaaatcttttaatatttgatttaatttggctaaattcttctaaaaatctgaaatttagacattaaataactttctaatatatatatatttaagtattactgagaactttttaatattatataaaaattatattatttaattaatactttaagctaccatattatcattaataatggttatataatttaaaaataattaaaatttgctacggaaaaaaagaaaatatcaaagaggtgaaatagacacgtaagctaaaaatccagcgttggtactaatagtaaccagtaaccactttcatttgtccgtctcgctcttttagcctgtcaacgcttttctattttgtcttttttctttcttctaaaaattctctcttttattccttcttccatttctctctctcttcttccttctccagttactttggtctccgccatggctacacagtaagctttttcttcgctattcgactctaaatttgctaactttgaattcgcttaggtcatctctaatttcacattcgttatttttcttttattttcaatttaatatattacaggagtttactttcctctttcgtcacttgactatgactgacctaccatagttagttagatagggagagatacgaagaccaagaagatattttctcagcttggtttctcttatatccttctgggtttcgcaaaactgcaagcaaaattgtctctttttacgatttgcggcggcgttagggtttcgtttagattttgtgattcgtgagtgtgttcaagctttgggaggaagcaaaaatg

SEQ ID NO: 6484 - DNA, 3000 bp, Unknown
  misc_feature (1)..( 3000): cDNA_ID_1814438_gDNA_ID_1621094_Annot_ID_55623 3000 nt of promoter + ATG
gattcctggatcagcaggattgattgcagtacaacgaacataaagaacgaaaacaataagagcctgcaaaacaaacacatgacacaagaagcaaaagggtatcagatatgcaaaactaccatgtacctacctagctcttatcaattccttatcattctctaaagcgattctagtacataccacaggagagtaaacaccgagaagaatatactcccagatgcgtcctccaacaaaaggagcgaaaaacgcatagtatgctacactcaataagcagaacaccgtaatcgcaaccacctgtttcatgaccaaacgaaacaaatgaactaaaacccaaatgttagaaattggagaaaatcagagaaaggttgaaataaaagacctgaaatttgtgagcaggaagttgccaaccatgtttcctcaccatttttgcttcctcccaaagcttgaacacactcacgaatcacaaaatctaaacgaaaccctaacgccgccgcaaatcgtaaaaagagacaattttgcttgcagttttgcgaaacccagaaggatataagagaaaccaagctgagaaaatatcttcttggtcttcgtatctctccctatctaactaactatggtaggtcagtcatagtcaagtgacgaaagaggaaagtaaactcctgtaatatattaaattgaaaataaaagaaaaataacgaatgtgaaattagagatgacctaagcgaattcaaagttagcaaatttagagtcgaatagcgaagaaaaagcttactgtgtagccatggcggagaccaaagtaactggagaaggaagaagagagagagaaatggaagaaggaataaaagagagaatttttagaagaaagaaaaaagacaaaatagaaaagcgttgacaggctaaaagagcgagacggacaaatgaaagtggttactggttactattagtaccaacgctggatttttagcttacgtgtctatttcacctctttgatattttctttttttccgtagcaaattttaattatttttaaattatataaccattattaatgataatatggtagcttaaagtattaattaaataatataatttttatataatattaaaaagttctcagtaatacttaaatatatatatattagaaagttatttaatgtctaaatttcagatttttagaagaatttagccaaattaaatcaaatattaaaagattttgctgtttaaaaaggaattaaatcaaaaaatattaaatgaattaaaaacaattatcttccactccacataaaaaaaaagatatgtgagtagaaaagaaaaaaaatattaaaagataagatgcaaaccctgcatttgtaactccataactaaatctaaaagcaagtgactcagagcacaactctcgtacaatttgccctacagttttatttatatttggtggcaaatgtcagctctgttttgatgtgaaagccatcaacatcatgtaattgattagcatattacatatagaatatgagatacccacatatatatagaaaaaatgacggtaaagattaaaaaaaaaagtatacttgatttgtcataataagaataagcatgtatctcatatgtacaaaaatagatttaatgttatttattttaatattcttgtattttttgttttatttgaacttataataaaaaaaaaactgtagatattaatagttatgtaaaaatcataaaaatagatgtaaaaatcatattaaaagttatgataaatttagtttactacataactcttttgaaaaatgtggaaaaattatagtaaactgtatgaaaagaagattatcatacagttaaaattaaaatcttttagaacatgtgtagtggtggtttctaaccaaagtttttaatttactaaagtaataataataaaaaaaatatttaatttgaagagttttttaaaatagttttttcaaatcttttaaattaaaaactttctcatattttcttagaaattgttttaattaaaaaaatattgtttattattttattattattaatgtaggcgagagattttggtaaaaaatcacaatgctgatgcttttaaaataatcaatttttctaagaatacataaatcagcaatgcttctcacacgccaaacgtaaatatagacgcgattatgaaaaaaaatcgcgtcgaaaacaaacgtcattatgtcattacacgtgttaccaatcaaaaagcctttatgtttaattagtaaaggctagtaagagatttacaacaaatgaaaaaaataaaaataaaaacataatccaagatccctaaaaattcccaaaaagaaccctagattttctcctctcacgctccttggttcctcactcgcttttgcttccccactcgcctgcttcgtgttcttctttgctttgctcttttcacgtcagaattttgccttccctccctttgtctctctctgggtggccgagaaaatacagtaaaaagccctcaccaatccaaaagtttgacatttcctgaattttgtagtctcttcatttgaattctcaggttttctcttaagatacattaaagtctctgtcttttatgctgatactaatgaaagttcagttctttcactgaaattttagaaccagaacttttctactactagaagtatgttgtctctgactctcttagtttgagttctcaggtctccttctcttatttgtgtgaaattttactcttttttggctttagaaacagaacttttctactattagaagttatgttgttgaaagttcttcactttcatttgattccattgatttcatattgctttgtgtgtttcaagtttgatgtttttaggtagaagatgtcgcgctggttcttatgaagtttggttgtgacatttttcaggtgctaaggtggattatctagtagaaagatttcagtttccaatttcatggaagcccatagtggggtagttgcttttgagtgtgttagtgaatccatatgtggctaaggttagg

SEQ ID NO: 6485 - DNA, 3000 bp, Unknown; identical to SEQ ID NO: 6472
  misc_feature (1)..( 3000): cDNA_ID_1814431_gDNA_ID_1621094_Annot_ID_55625 3000 nt of promoter + ATG

SEQ ID NO: 6486 - DNA, 3000 bp, Unknown
  misc_feature (1)..( 3000): cDNA_ID_1814641_gDNA_ID_1621095_Annot_ID_55632 3000 nt of promoter + ATG
tttcgtatgctcctaaaatctgggcaattcattagatttcgttgcgtagataaacttaagcttgatgtattctttggtacaatgtaattctgtttagttctataacttggaatcactctaagtgtaatgtatattgatgcgaagtcaaatgttgctgaatttttgctctcctgcattttccccaattttttctgagccagtattgtgaaaaattggagtctgagaaaactgaaaagtttaatggattctcatttaatcagtgttcatagattcactagttgtttgaccagggcttaggcttaatcattcttgtgacacttggttttcttttaaatctgttttgatgttcagttttctttggaagctatatacccataaacttaaaatgaataaagatggaagctttagctgatataatttgggtgtttctttctttcttccttggtgtgaagctgtttcaaaatgtctcggaggtatgatagtcgcaccacgatcttctcaccggaaggtcgtctctaccaggttgaatatgctatggaagctattggcaatgctggttctgccattggaattcttggcaaaagacggagtggtgttggttggtgagaagaaagtcacttctaaacttcttcaaacctcttcatccatggagaaaatgtacaagatcgatgaccatgtggcttgtgcagttgctggtataatgtctgatgccaacattctgattaacactgctcgagttcaagctcagcgttacacctttatgtaccaagagccaatgcccgtttagcagctggttcagtctctttgtgacaccaagcaaggatacacccagtttggtggtctccgcccgtttggagtttcctttctttttgcaggctgggacaggaaccacgggtttcagctgtatatgagtgacccaagtggaaactatggtggatggcaagctgcagctgttggagcaaataatcaagcggctcagtctattcttaagcaagactataaggatgatgcaacgagggaagaagtggttcagctcgctatcaaggttttgagcaagacgatgacagcacgacttgacagctgaaaaactcgagcttgctgagttgtatctgactccttcaaaatgtgttaagtaccatgttcactcgcctgactcgctcactaagctcttggttaagcatggtgtgactcaaccagccgcagaaacttcctaagctagaaactggtgacagttttacctgacccgcctggttactgtagatgtccatttgctttctttccctttggagatatcgtatcagaatcaatttaccactctgattatgtcatgtgattcatttgggttgactatcttttatcttgagattgatcttcttctagtctaaagtaaagttagactttagaggttttattcaataaatgaatgagcaatcaccaacgggcccattagaaagcccataacattcattgattgaggtaacgggttttaatggctcaaattaacgaagaatcagaatctctttaagtttcaccacgtcgatttacggtcaagagtgtctgtttattaacagaacagtaaaaatgttaccgctcaaagcgtatatcttgagcgccaaatggaatttcattggtacaatgcccagaagttctgggccagaactggcctcattgtaagagattttttaggagatttatgcagatctggaaaaacaagtttttctctcttggattatctacaaaatattatttacttaagtagttgtcagttagacaatgccctgaatccaaggaattgtatcgaccgggattgaagagaccattcttgcatcgtctcttctttttgcagcatcgcgattgtatgaaacattgatggccagatctttcttctataagtcaatcaaccggccaccggaattaccctaaaaacatagaaaatatgttgaaatatattgagatattagtcatcgactatgactaagtgtcacaaacttttgtgtgataggattcaatcaatccaatggatcttagtaagaatattttacattctataccagtctagttcacatattttctaccacaaattgttaattcctcacaccttttaaattcattttctagtttgcagtttttttttaagtgtcactttaccagattacctcaaacttaaaaattatcaaattattatcaaaatatacaaatttactaattataaaacaagtatatatctaatatcttatcttaaaaggtaaatatataaatattttctaccttttgtcatgtaatacaatttttttcctatttattaggtatcagaatctcaattaattaaattcagaaaaagtgtgagaaaataatttccagtaagcaaaaaaaaaaagtattaacacgacggcttcttctttcagcaaaaaaaaaaaaacataaacggagaaagagagagagaacgatacagaagagaagccaaggtcgcagagagaaacaatacacacggcgacagatatatttcccggcgaaacgggaacaataatatatacagagagagagagagatttagtgagagagctttctagggttttcttcttctcgatttatcttcctttgacctcgatctattcctcttccttctccataaattttcccttcttctcaccttcattcatatctctcctagctccattctagggttcttgatccgtttctctaccttttcgttttcttcctccgggtataatttcttcttcaattcgtttgttttcgcgtctcttcgtctcttctaatttcatcaatttgggtcttgtagggttttgagattttctccttcgtcgggtgaagaaaaccctacattttgttttgtcactgattgtgttttcggtgtttcaggttgtttaatttactccggcgggtgaccaaattggcggtggcaaagtatgagtattgatttccctgggaaaggggagagttagggaagtttgggctagagagaaattggattgggtttcc

SEQ ID NO: 6487 - DNA, 3000 bp, Unknown
  misc_feature (1)..( 3000): cDNA_ID_3100843_gDNA_ID_1621095_Annot_ID_55635 3000 nt of promoter + ATG
ctttcttattttcctgagtaaacggaggttatcagcttcgatttgtttgacgagcttttcaatcaacaaccgtctctcagcatcctcaagtttagtaacatcaataatatctgacgagtcatctcctgtgtgtaacaaagcagtagtaacccttttaaaagttggtaatctctcaactgttgcccactgcgaccgaagcttctcctcatcatcaacaccatttccacaagcaaactcaacttggaaggactttgccttgtcaacatcttcacctgtttgagccattgtcaggtaaaagcagccaaagaaactaataacaacaaggagaagcaagcaaaactccacatgaatgaagaagctaatgaagtcagagttttatatatataacttgaacaaaacttacgcatacactaatatcacgcgagctccacgtgatcataaccatagaatccggtcttgtacagagagaaaaactgaacaaaagaacgaataaactagtgaaaaatcaggtaagcgttgaaaaaactggtgattcattaaagtaagtaaataaaatcaacgaagagatcttttagacaatagtcaactcactaaacaatgtcagaactgatttcacaatgtgcgaacggattcatactgacacacaacttattggctttctgtgaggcattccatcgaacactttatgtgcgttttatctgtttcggtagacgaatttgttcctgagatttgtgaatctgatcgaatcgaagctgcagtgaggtagacgaatgaataaacaatgcatgggtgagaaatcacatggataatttcttcaagatcacgtactctggaagatgagatatcacaaaatacttgatgcatgtcagagattaatgagattagcttgcattacaatttacagaggaagaatcatatgcaatcgaatcgttggcgcgcgtttacagtgttattcgctgacgccgacactgtgagaattgatgacgcgacaacagtttcaaaatagtttttggcttttataatattataaacagtccaatcagatgagtttaatcgtatttttttctatcacaagtgtgttttattaatattatagagccaaaattaacaggccaataattcacaaaaactgaaataaacaagcccaaaaaaaaaaaaaaattcccaaaagctcaaatgaataaaccctaaactgaaggaagagaacaagtgattgttgtgcgccgcatagaaaacacgtgtcagtggaaaacattttgaaggacacgtaggaactggaagagaagggagtcgccgtcagaagcttcaattccggctgaaacaccggaaaacttgttcaactggcatagctcactcgtcgcccaaaggattaatggcgaaatttcagttgtaccttggatgagaatttgactccacgaagtgctattcttcttcttcttctttttctttttcttcctcttcttcttcaatcaacatctttttaacttgggttcatcaatctttaaactacaggcagaagataaaaaaaacaaaacaaatctaaatccggtcaagaaaccggagagaaagccggccaaagacgccggagaaaagcccggcgaaacaaaaaagaggatatcttgctctcgggagataagccagccaccaccgctgaaagtagccggtcgatgccggaagctgagccaaccaacgcttctaaggaagccagcgatgccagagtagaagccgaccaaacactgctgataaagccagtcattgccggccagaaaagctgaaactggtttgctctctctgaaagatgaggagagagaagagagagaaaacatgtagatcaacaaatctatgtcgagtttaatcgtattttaatgttaaaaaaaacgtattgtgtgatgttatttacaattccccggtaagttttatatatatatatataattactcaaattaacttgaagtataagtcaactattctgaaaaattcagatttaacacaaaccgaattattatccagattttgatttatctttaactcgtggaaattttaaaacagattatttggcacgaaatattgaaccaaacacatattattatatttgcaaacaatatttctcaacattggcttatttgagtcaatctaataaaattgtcgacaaaaaaaacacaccctcacgaacctaatccaacggaagcccattcaatttcaaagataacaaggaggtaaagttcactattttttctgaaagtcactctacctacatcttttttctttctttgtaatttgtttgacacattatcaataagatcactctttcactttgttgttttctcttgattcccttttgttcagtcttcatttagctcaacttagtaacttacagattttggactccagtttattttcacgatttataaaatccatcacaccaaatttttgacatccacataatccacctactataatattcaagttgtaagacatcaacactaaggtaaattttgacattgagcttacttattaaggtaacaagatttgaatggtgaatacagacatgaacaaatatcatttgcatttactccacgtgcttaaaaacaacacatggagaaacaaaaagaaggccggcgagtggcgacaacacaatcagtgtcggaaatcaaaatcggtgaacctcaattatagaaaaaggtatcattccaaagaatctcaggaaatgacgaaagaggacaaggaagacgccaaaaacagagggcaataaagtcattatacaatcctcaaatggaccgctgaaaacagagcaccagtcgttttagatcagtacacaaaaatcacaaccactcgcataatatcatctacttctatataaagagctcgtgagctttctttaagagagacatgtgagcttcatctactactcatattgcttatattttcctacaacactctctcaacaaaaaaacaaaaaaaaaagacgttctttctttgtttgtatttagaagaaaaatg

SEQ ID NO: 6488 - DNA, 3000 bp, Unknown
  misc_feature (1)..( 3000): cDNA_ID_1814625_gDNA_ID_1621095_Annot_ID_55637 3000 nt of promoter + ATG
catggaaatgagaaaaatgtaatgttttccgcagaaaatcccaaaatggtggatatggatgtactacctgagccctacatcgtgggtgttggaaggattactgagttcgcagtatggagatgtcgagaaagagataacagtatttggagagaagaagagtgtttcagctttcttggaggattacttcggctacaaacatgactccttggctgttgtagcgtttgtcctcattgcttttcctatcatcgttgcttctctttttgccttcttcatgagcaaactcaattttcaaaagaaatagttctttttatttttgtcagttaggcttttctttctcttatgatatcatcataaacgttttacattttctctatctggtctcaaaaatgggcaattgtgaagcacacaaagaacaagttttgagaattgattccagcagcaaaagatgatcttttattacatataacaacataactagaaaattcttgagaggtggcttggttttgttgtttattcaaaatgcggtatggaccataccgtatggtctaaaatgttcgacgtaacgattccaacggaattggctcgagaaagcaacccctatttgtttattgattacttggcctgtgttattcagttgcaccatgcctataaggacggacttgtctaacttttttttttttttttaattttattttgtaaagttgaatctttttatttttctaatgtggtttccaataatgaaaatgcatcaagacggatgaaatttagtatgatgacttgatgatgagattaccaaattttaggtaatttgtcatcggaaaaacgtgttttcttttctcaaaagaattttaaatttgtgtgttgctctcccaaaaaaataaaacattccttacactgttacacataccaaataggcaaataaaaccgaactctgctgtgtaagatttggttttaaccaaaaaaacaacaaagaaaaaactatttcttggtggaatttgaagattccattggttaaatgatctactaactatcctcatccatattttactaataaagtaataatcatgttaatttatgaaagaactaaaaattgtcactgtttggaggattaaactcctctgacatgtttttaaaaaactatatacacacagttatttgaaagttaagttttgttgcgtcaccacttctcatattgtaaacgcgtttgcaagctaaggttttttgattaaacaaaaccttatctcattaaattctgacaacgaatcaaatattcaatcttcgtgctgatgttgaagataatatcacgtctctctcactgcagattcgatctcagggaaatataatacttttacagagttacgtggtcaaagtgttcgacgaaatgcctcacagaaagccaataagttgcgttcaagtatgaatactcttgcagatagtgggatcattgtcaataagctgattttcgaaaagatttcgtcttgataacattttgtcaacgcttaccagatttgtattagtttattcgatctttttctcccggattctatggatatgatcacgtgaagcatgggagatgataatgtatgcgtaatgtttgttaaagttattataattacaaacattcttccttcaatagttcttcattcatttgacgtttgcttcttcttgttcttgttaagtttgttttttgttgttgagttccgttggcattttaactgaaaatgatccaaacaggtgaagaagatgaagaaaaggcaacgtcccttgaagttgagtttgcttctggaaatggtgttgatgatgaggaagagcttcggttgcagtgggcaacagttgagagattaccaacttttaaaagggttactactgctttgttggcaagagatgaagtgtcagggaaagggcgagtcattgatgttactagacttgagggtgctgagagacgcttgttgattgaaatgctcgttaaacaaatcgaggatgataatctccgtttactcagaaaaataaggaagagaattgacaagtaagtcactgcacgactctactgtgtttttttatgtcaagtagagcaacatttgttttgtaaattgtatgtgcatgttagcaactattgaaccttcatgtaattgtagagttggtatagagttgccaacggtggaagtgaggttcaataacctttctgttgaggcggaatgccaagtaattcatggaaagcctatcccaactctttggaatactatcaagggcttactatctgtaagtactcaaatttatttgctgcatcgatctgaatatggagcgcttttctgctctcaatgttctttattcatgtttttctgctttccatgttacaggagttcatttgttctaagaaagaaaccaagataggcatcttgaaaggagtgagtggaatcgtaaggcctggaaggtaaagtattcaagaggttattctctagtccctttagttgcacggaagaagaaatgaagggtgactggttattttgtgcatgtagtgtttttttataggttttcattacagagttcaaaagaggtgttggttttcttgcagaatgacgttgttgctcggtcctcctggttgcggtaaaactactctgttacaagcactttctggaaaattttccgattctgtaaaggtttgactaacagagtaaaaacataagcctgttgaactaatataaaataatatattggagatcattaaggttgtcttcactttacaggttggaggagaagtatgttacaatggttgctcactctcagagtttattccggagaaaacgtcgagttatataagtcaaaacgatctgcatattcctgagctgagtgtaagagagacacttgacttctctgcgtgttgtcagggcatcggaagccgtatgggtgaggatcagatttctgaaagtttgaactgaaggatacttttgtgtgtttgaactcagttcacattaacaagcaatggtttattaaacagaaatt

SEQ ID NO: 6489 - DNA, 3000 bp, Unknown
  misc_feature (1)..( 3000): cDNA_ID_1814614_gDNA_ID_1621095_Annot_ID_55640 3000 nt of promoter + ATG
aatcgtctaattcctggagcagggtatcagaaaatggagagaccaaacttgtgacagaaggttctaaagttgaagaccagatcttgccgaaatctgatggagaaggacaatcagagtaagggttcagactctgaagtctgtgtcctaaaccagtgcagttactagcggtccactgacatccttggcaaagagaaacattttcgttcatacagtgtactgccgtgggttgtaaggaacatttctcgcagagtagagatcgcgtgtgtctttgagacagaggattcgctgagtgtacattaacgtcacagtttaaacaaagtttagccgaatcagatttgcagtagattaatgctttttcggttccacaaaagtcacatcgagcctccatacttcttcgaagacaaaactccaaagaaataacgatttctcaatcccaatcgctacacacacctaaaatcctatagcatagaaggatcgtgagacaaaaacagaacattcagagatcaaacaaaattacgattcattataggttcatgtatctttttaatgtgtgactgtgactgtgactaatacatggttgtgtttgaatgttagagaaacactcacaaactaagaaaatgtggattctcgagaccgaatcagtactaaaatcacaatgtctagaaactcataaccagttaattacagagttttttctaaacaagagtataacaataatcgtgtaaaattgtttatgtttcagggttccagagattagaagctttacaagggtgtgtgagagtccagtgagaaggagatgagaaagaacagagaagaaaaggttttgctctgtttttatcctgtgtggggtccaccttgttaagcgggtttgccacgcggggtatcttttgtcacgtgtggttttattgttccttagattttgttgatgtcataatgtggttgaccatacaattcggagtttttgtttgattctttaggtactttctgtggctcgcaagaatttcgagaattgttaataaaaaaacgtgtaaatgtcattaattttgaacacgtttttcttgttattcaaaacatccgagtaataagactagttcgaagcaatttattccgagtgttggtttaatggatctaggagtttgcagcatactagtccggtttcattaacctgtggttatggatagttattgtatctatttctcactaattttactaagtgtgttttcacaacttaaaatatgagatgttagaagcacttaaatgattgaaattctagtgagcgatcatgttttaagagagaaaactttgtgacaacgattgatattcgtttacgattttttaccagcctcagtaaaaaggctaaatgtactatttttgaaacatctcccaatgcattccatgccaaaaaaggctaaatgtacttgtaaacaattcaacagacagtaactgctggcattagctgaaaaggtcgctcatggcatgaccagtctggttgtcattgtttgtttgccaaaagatttcattagatgtccaaaaagcagctcattcgaccaaacaattgtttcctgataagtcaattgttttgttaatcaattctataggaacgctaaatccattattcgtccaaaaatcagctcatagttttcaattgttttgttaaccacttattttgcaaaagtagtgaagaaaacataacatttaaacacaccaattgttttcataaagcccttccaccaactgaaaatcaaagaataactagctaatctcttccggtattaaaaaagaggaaaaacaaaaccaattgatataatgtgcgaggcatttccaggatcaaaaggcatggaaaaaagcaaaaagatcaggatataccacaaccaatatagcgtcacaagccattatacctgaaggaactgtttttatccttcagaattggtaatggacgccaatacaaaaacaaaaaacactaaaactctttcttcaatagggcaaaatttttgataaaaaatgctcagtggaaggagaagtcgttttaaaggagagctcacggtaaacccactgctcttctcacactcttcgtgctttcatctcatcattgcatcatcatcatcaaacccataacagtaatccaacaaaacaaaacaaaaaacattgaaagaacaaataagcttcagtgtgtgtaacaaattcagttcattgattcaaaaacctcactgaaatccgctaagataattgtttttatcatcatcagctttataacccaaaacaagtacatacaaacatcaatcaaacctattaacaataatccaactaaacaaaagccaaacattaaaaaaaaaaaaaagcctcagtgtgtgtaacaaattcagatcattgattgaaaaacctcactgaaatccgctaagataattgttttctatcatcataagcttataagtggaaaaacatcaaccaacaaaaaaaaacaataacagagaaatttgtcttcaaaccaatcaaaagataagattttgggtgaaaggggaattaatactcagacagccaagggttaatcttcaacttctgggagaagaatcccagatctgaaactctagtccacaatactcttgtatcatcaccatattcaaccccttccacatcccataaaactaagacatcacaaatctctttcacaaaaaccttaaatatcaccaatttcaacatatatacacaaacgaaaatagtcacagacctaaccctaaaatcacctaacatatcattcagacatgaaaagaaagagagttcctatgatttgcattagacgaaaccttataaatacacagacacagcagacaattagggtttacttcggtcggcggctaccatatctattttaggttctcggcccaattatactaaatgggccagctttcgtgacccaacaaacaacttacatttattttactttattaacacattcactttacaaacccaatcaacgaaaagtccaaaaacgtaaaaacagaa

SEQ ID NO: 6490 - DNA, 3000 bp, Unknown
  misc_feature (1)..( 3000): cDNA_ID_3090357_gDNA_ID_1621095_Annot_ID_55644 3000 nt of promoter + ATG
tcatagatgacttggtggaatcaaacacataattgagcaaatgatatggacattaaactgaaagttagtctgtctaatggtacaactcgggttctccgattaaaattttgtcattaaaagtttgtgttgtatacttgtatgatttaaaagtttaaaagtttgaatggtacaaaacttgattttgtcataaacttgtatgatttaaaagtttaatggtacaaatgatatggacatttaaaagtttgtgttgtatacttgtatgatttaaaaaataataataataataataataataatatatatatatatatctacttgtatgatttgtatagatgtggctgtctattttttctccaccgttaactcatgtaatatatataaaaaacaaatttatacttttttgtgaaggtcttttttaaataataaaaacaaatttgggtagggaggtctatttaaaataatatggtcgcaatatttaacaatttttaaattgccaatagcttagagtcgcgtaataatagaaccaaactatgcaactatcattcctaccaaaaaaaaaaaaactatgcaactatcattagaaatatgtatctaataacgtgcatgttcgcattgcacgtcgtccttctttctccgacttttcctattttttttaatattattttatcaaatgtatctagcttagatacttttgatggagatgctccaatgataaaaaatagttgatccgttagccacgctagtaacatagtagttctgcataccattttctcttcattctcaattgcgtctgtttaaaatcaatgattgtgattttctaactttttcatattctattggatgggtctccaggtcaaggcgtcaagccagataatccagtggttagcagacttttcggaggagttcccgcaaatttttttcttttctttgaatttaatgtatatgcaaacttttttttagcataattataaatttttatatcctggatgttatctcgatatgaacaacacttggagtcctcccacaagcttctctacattcccttgccttagagtactcaattttgaccatagaaacgctgcacatcttgttgtattgttcccgcaaatcttttttgataaaggattcaggctaaatccctaagtccaaatagccacgtgattcctcaaccctaaatgtcaagacttgcacataataagtttgaaccatataaaaaataaaacgcctaagcctaaaccccatctaacaaaacttgcttacaccatgtgtttgatgtaagaatgatatccctctttccaacaatcttgcttcttccctgatttgccataattcaccactaatttggtaagttgtgaagaaacttccatgaggggtaacatgaaaagaatcaccagatctacaatccatgagctatcgtcagcgacaatgttgcaaatattactttgttcaatgagatatacatctacatcttcatctgccacggcagtggtggtcttttcatgttgttgactaaaaatgataccaaaggctcacaggcacatgttaataccattataccacaatttactatctagatattaaagacataaatggtaaataagttatagataaattttcctatatggaacggaaatgccttctgtttaattttctggatggtgaaaaacaatggagcaattcttcttatttaccaagattatgcgagtgggaaaaagttctaacctcatagatgatatcgaagaagtgtgtcggtctaatctgtaggtcgagacgtggaggctatccccagttaaaggaatctgtaccaaactgaaacatcttctactcagtcaaatcccaatcctcatctcctacttatttcacaaacgcaaaaaaaaacagcccattgtatagatcgtgagttcttactattgaaggttacgaattgatggaatcggcttcttgttgcgattgaacggtagccatcttggtacgacatcatcgtaagaagccttgattttaattccctaaccagaaaccaatatgagaattctaaaacggtcgtgaaagtaaggaaaaacgaccaaaatcaatcccaactattttcatgtggcttttctcaatccctatgactttttgaattaatcaattcgaactcacacaatttttaaatagcaaacttgaactatatgaccgttaaccagtttcaacatagaactcgactttgtgatcgacgtgcgcatcaacaattaaaatttgatttgctcaagcatatatgaaaatgttttggcaagaatcaatagtgtaattaatcgttttcgtttatgtttacgtcatgtttgtttaaacttttatttcatgtatgttttaaattttataagttgtaataattattaaggttttcaaaattaaagtttttgtatttttaaatattttttttttattaaaactccaagttaagatctcacaattacatattgctaaaagtttaatcttttaaccaaattcttattcaaaactaagctaagattaacctaagatactaccgataataatgttcttagtcttgttttagtcttcttttagttggttcatattttatttttaattaaatttaagtaaatgactaaattatatagaaaaaaatcattgatattttaatgttatatctatgaagggttctaaaccaatgtatatgctctcacgtgtttatatctagttgtttgtaaaatactgcggcgatagtattgactgagttgacatcataaatttataactgttttacaacttgcttcaattagttgcctcttttaaacataaagacaactgtatttttcttaaataaataattacccatatatgaaatattttagagagaacacccctaagactaacacacatattcactagtataaatagaatgccttcttcgtagaaccatgtataccccttaaacacacaacttcaaagttgttgaaaaaaattaaaatggtagaatttcatgagttattgactgtgatg

SEQ ID NO: 6491 - DNA, 3000 bp, Unknown
  misc_feature (1)..( 3000): cDNA_ID_2041178_gDNA_ID_1621095_Annot_ID_170965 3000 nt of promoter + ATG
tatccatggttttagggttgtaactttaaatcgtacttgatattttcatatatgcagatattgattaacgcggtaatgcgcacatggtagttgtgatcgagtgattggtgagactttgaaatatatgctaaaacgcttcttccagaatttgaggattaggcacattgtcaaacctcgtgaaattgcttgtatgttcatacagttgtattaacatctactattagagagggacacctcgttcagaaatcattcttctaaaataattgatatcgaggaagagaatatgaagacatatgaacgactactcgatgtttacaatcctctattgttagatggtgcaagttatggatattggaaagtgagaacaaagaacaacatttgtggcacccctgaagacgcttggacggctgttgagtgtggttggaaataactgtatgtgacatttgaagatagagaagtaatagtgaaaccaaggacaaggtggattgcaactgaggctgtcaaagtttaattcaaaggcgttgaatgaaatttctaaatcggtgaatcaaagagaattcaaacttataccagggtgtagataagataaagaggcatgtgatatactgcaaaacgtctttgagagaaaaaatagtttgcaaaaaaggttgaaagtaataatgaggttactacttaccatatatggattggtgtgcttgcacttatttgattaaatcaattttggtccaactcttgcaagtgaactttttttttgtttttgacaaataaaagttggctagccaaagcttttccctcttcaccaaaaaaaaaaagtttttctttgctcgcagccccttaaatctgagaaccggttctggctctaatcattggtccaacgaaaacatgcacttgagtctcttcctcagcctagctaaagtgctcatgatgtccttttcatgcatgtgctaattttttttgttttttaaggtttagttgtgtgctagcttaagctgaaaaaaaaaaaactatttgagttaaaagaaagctatggttatgcaatattagaattgatgaaatggagtcttggaaatatatttaaaaaaattgacatgtacaataatcaaatgtgggaacctaatcaaatattgtaagagagtggtcctatatgctaccgcttcctcatggtcaaagccaggtctatatatataactccaagccaccgcttccctagtttctgcttaaattcaggtttgatgaaacctcggggctcagtatgcatgtcaacgtggaacttgggaaagtgaaaagatatgaggtaagacatgtaacaaattctcggatgttttcatccttttgccattaaattgaacaatgtctcgttcatgctcaaggaggctcaattaatgaactgaactaacctagagccacgtgttttccttctgccttttctgattcaaaaagttgactgaggataatgacatacgggtagttaattatagtgtatcacacatcttataagttgtaatattgtctacttcaaacattagctagccaccaagtataaaccaggaagtttctagggatgtatttaatttggctcgatgggctttgtgtcaaaaaaaatccagtcgctattaagtatgagatatctcgaccgttctagtcgaattcgtctattatgtataagtttgccatatacggccgacaacttgagattttgctcatggatattaaagatactttataaaataaagttattgataaataaaaaaaatcaaactaaaatggagtggagaattcacaagagaattcaaggacaggaaatatttatgttgataagtggatggaaattaggataagcattggtcatcggtaaaatttgtaaatgacggtttattggtaattaactacgtcatatcagcggagggattattttcagaaaaattaaaccttaaaatgatattccagtaggtttcatttcttgcattacatcttgaagatcagtgtatccaaatctttattgaggaaacaaaaattttagtgcaggatttaaaccaaaacactagggtttatggaagcaaaggcgagcaactctgggttctgctcaaaggacgacatgttctcttcaggcaatgtgacgaacgcttaaattccttgtccgtccttggaatctatcaacatggtcaagtagcttaacactggggcaacatttccggcaacccaaacggagaaccccatccacagctggtctcgtaaagatcaggtagcttgcaccagctactcacagtattgggttcgtgagtttcatagctcaaccgaggtagcttgcaccagtttaaaactttaaataagtacttgtaactttagttaatctcaacttaatggaattgttggagtttgaaatggccgacttatttggaaacgcaagaagttaacaaacaaatgtcaaacataccatataccgtacaaactctatcaagattataaccacatcaatgatcaagtaaatcaacaagaatttcgaaaaaaatgttttttttttttttcatttgttgttcatgtggcaaaatgcaaaagctaacaattctaaaatcaagcatagatcagacttgaatactcttgacaattttcctttataaaatgaagttgttttcaagttgtgaacgtaaaatgatttaggcaagaagaaattggaaggggaaaagaataaaaaagaaaaatgtaagtccaaaagggccaagattaggagttttcaacaaatatatattttaagtaatttttccacaaaatataattctaattggcaatatatgtaaatacaaatacaaaatcaggtttaaaggtcattttcaaaattttatatgctattttattaagcttgattttggttaagctgttatagtcattctcataaatttatgtgctattgtaagtagtttccgtagcttttatgtaacacatacataattgactttagattagcatcccatttctcatcttcctctttctctttgagcaatt

SEQ ID NO: 6492 - DNA, 3000 bp, Unknown
  misc_feature (1)..( 3000): cDNA_ID_3090349_gDNA_ID_1621095_Annot_ID_170955 3000 nt of promoter + ATG
tgtcttctagagagacaatttttttaacagtatgaacattgtcctctaaaacgattattgaattagtttattaatattgagggaaaaaatccaaattgaaaaatttgtagaacaaacctaaatcagggtcaaattgtgaaacgaaattttgaattgataaataagtgtattcttgttttggaagagcagtaataaatggttagatagaagggtatatgtacaaaataatttttgacttgtaaataatgaacaaagtaactttgatccaatagtactcatttgctacagaattttcggcaacttttggtttatactatatattgtgggtgattggttagactgtaactgtaaattttttgctgtagaattttagctgtaagtgtgtaagctgtagctgtagaattttggcggtaactttttggctctgtagattacaaaaatatataattttggtggtaaatttattagttgtaattaaaaattatgattaataaatatttgaaattttgtatatataaattttattttcttaaattgtaaaattatatattatagttaataaaattatttaataacaatgtaaattgtattatgcacatatatgtaaacagcaatctatataaatatagaaatcatttctaaatgtataaaatattttatatggtattcatataataactaaatattagtttaaaattatttatacatataagattttttcgttcaaaatatatatacatctatgtctatatattaagactagtgaataaatatatatgtatatatataagaaaataatagtgacaatataaaaactagacgagagaatcaaaaaaaaaaagaaaaacctacagcacaaaataataggatgtagaaattaaaagatttacagtcaaaacaaaaatagtttttttttttgggctgtaagttagaaaaaaaccctacaacatgattggtaaaaatttagtttttacaaaaatattgtggctgtaagtaccaattacagcccaaccaatcaacaccattatccttttactttatttttctttttttttgtttttttctttacgagatttcagccatgaaactctctttctctcttcattttttagaactcaaaatcagattcaccatctcattttctttttctttctccttctcttttcccctcctagaatctcttcaggtgaatcttgtcgttctagctggatatttggtggctctaaaacggccgagttgtagtcacggaggaggtggttcgggtcaatttggcagaggcttgtgggtgtattttggttgttatattgttccttccgtttctaaaagggttttttgcatgaaaaatattgcatctcattgtcactctctctaaagctgcctttttgacagttttatttgttgtttgcaatgtgggaaaatagtatgtaacgatagggccgaccctaggctaatgtttgttcactgtccattggtagttatttccttgtaccaaaagcaacccgagtacaaaccaataagatgtgtttgttgtacatattagtccttttctagtccttgtttcatttttttctttcctctcgccttgtacatgtcaattttctttgttaagtttatttttcttttgattcactaatttgtgtcttttcaatatatgaatctaacttaaagctataaattaaaggtttaactaaactaaaaggaaaaggaaatatgcatatttccaaaaactttgaaacattatgattaaccatccaccctcgttggtcgtctatgccgtctgaagaaagcccataaccaaacctaaataataaattcatgtataccctaattacctaattttaattacaaaagctacaaaaataaaaaaataattattattattattacaaaagttaaccaatatacccatctagttataatgagaacctaaccaatctaaccgcctaatcttagatccacctaactaaattaactactttaattaaaaatcataaaacttagtaatacatattagagtccaaaaaccataaaactttcacttttccactctaggctaaatcaattatgacttacttatatttatccgttaataatccatatatgttagatttataagttcaaatctacatcatatcaagaaatagtttggtactgaaatggcatttgtatacaacatccttataaattattttatatttttttaacatatacaacacttaattgtgttgctaatttgcatgaaaattaatgacattctttacttattttatgcatttttctattttcaagaaactgatgaatttatcaacagatttacctattccattgctaatgtcgctaaattaacacaaccaagatatcgtacatgttagaaatactcaagagtacaaatacataagactattttggtatcgtcgttaatagtttgctcaaagttaagtgtaaacgtgaatggtatattcaatattgtatgtgtcgatatcccctcaggtttattaaagatggaaatatttattagaagaacatttttatttgattagaccctccaataccgtagtccacatcttataaatcggaataatttagaaattgtgcatgttttatgttttaattcttaaaatcgattacatgattataaaaaacgatcgagactctaaataatgtatatcataaacaaaacgatataaacacactaagttaatattctaaattctttcttttcagtttattatatcatttgggttgtcaacagattattacatgtacctttaatgagataaaaattttaagaagttaagaaatttttttagtaataagatattgcatatatagttgaaagactatttaaaacatatgtgattttaaagtcaattaaaatgtagcccaatctacatcaatccaaattatatattgatgtgtatatataaaaacttcagaagcatatagcattacacacacacacattcatataaaaaaaacaggaagaaagctcctccaatg

SEQ ID NO: 6493 - DNA, 3000 bp, Unknown
  misc_feature (1)..( 3000): cDNA_ID_3090353_gDNA_ID_1621095_Annot_ID_170954 3000 nt of promoter + ATG
tgttagatggggtttaggcttaggcgttttattttttatatggttcaaacttattatgtgcaagtcttgacatttagggttgaggaatcacgtggctatttggacttagggatttagcctgaatcctttatcaaaaaagatttgcgggaacaatacaacaagatgtgcagcgtttctatggtcaaaattgagtactctaaggcaagggaatgtagagaagcttgtgggaggactccaagtgttgttcatatcgagataacatccaggatataaaaatttataattatgctaaaaaaaagtttgcatatacattaaattcaaagaaaagaaaaaaatttgcgggaactcctccgaaaagtctgctaaccactggattatctggcttgacgccttgacctggagacccatccaatagaatatgaaaaagttagaaaatcacaatcattgattttaaacagacgcaattgagaatgaagagaaaatggtatgcagaactactatgttactagcgtggctaacggatcaactattttttatcattggagcatctccatcaaaagtatctaagctagatacatttgataaaataatattaaaaaaaataggaaaagtcggagaaagaaggacgacgtgcaatgcgaacatgcacgttattagatacatatttctaatgatagttgcatagtttttttttttttggtaggaatgatagttgcatagtttggttctattattacgcgactctaagctattggcaatttaaaaattgttaaatattgcgaccatattattttaaatagacctccctacccaaatttgtttttattatttaaaaaagaccttcacaaaaaagtataaatttgttttttatatatattacatgagttaacggtggagaaaaaatagacagccacatctatacaaatcatacaagtagatatatatatatatattattattattattattattattattttttaaatcatacaagtatacaacacaaacttttaaatgtccatatcatttgtaccattaaacttttaaatcatacaagtttatgacaaaatcaagttttgtaccattcaaacttttaaacttttaaatcatacaagtatacaacacaaacttttaatgacaaaattttaatcggagaacccgagttgtaccattagacagactaactttcagtttaatgtccatatcatttgctcaattatgtgtttgattccaccaagtcatctatgattgatttacctctaaactctagatagcaaagtgtggtattcactttttaccgtgagtctgtgatatcatcttttgtcaacaaaatgcagcggcccggatattttattcgagatggacttgcgcaaaactcttgccaatagacgtcacgtgctcacccccaaattattcggtttcacgtggacactggagccattataaagttggaaaatctcattcaataattttaagtgacgccaccaggaccggtcatgaatgatgaaataatcggaaatccatacggaaaagtagaaacttattttttatagttatgaaaaggtctatgagatagttaacaaaaaaaaaaaggtgttgagataacttcttcaaacgtgactttgacgcaacccacgttgataaacgaagtcaatggagaatgaagaaaaaggaagtattccagaaagattgcggtgaaaatttataagattattttcaaaaacattattttgcatgacaattttttccgaaaaaataatttttaaatttgtcatttataaaaactaaagatttcagaattatttttttcgtaaaagacatacttcaaaacgaaactatatcctaaaagcctagaacctaataaattcaaaatcatgtatttttttttgtgtttttatattaaaaactgacatttttaaaactttttgaccaaattgtgaaacttataaacacccctcaaataattcccttattatgaaatagtaattgattcatttgaaaatgatcgttacaaaacaacaacaaacaaaaaatatatataactgtatattatatattacacgatctattgatcaaccatatatattttatgacttgaacgtcgactcgactatagagttaactcataaaagaaaagaaaaatgaagaatcgactatatatagagagccataactatgtgaatcatacaagtagaacttttaatctttaaagaagaaaaacaaatgtcagaaatttatgtcttagcattgtctgttgtattctcactcatagtagtgaaactctgccattgggtttaccagtggagtaacccaaaatgtaaaggaaaacttcctccaggatcgatggggtttccgatcatcggagaaactttcgaatttatgacgccatttgacatcagtctagtagtttcaccgtatctgaagaagagaatatccaggtttcttaacttcttagtttttatttttgagttcccttatgctgttattatacatgcactgatcatggttagaagtacaaataaactgtttcatatctaatttctaattttaaaagcatgatttattgtaatatcgtaacttaaaatttctaatttcatatgccatctaaatactaaaaaagcttgatatgttagagtcacttgttttttgattagcattacgtttgactatgaaaatattaatcaaatgtttattgaaaatttgaaatgtctaattattatttcagaattaaaaataattgtcaggatatttgattaattttcatttcgatatatgacttcaatctagctagaggacaaaaagtttcagaaaaaaattatctacgaacttctgtttttattataaatgatatgagtatgtgtttcaataacattgtatggaactttaaataattatttgttatttacaagtaaacaaatctgaatcagatatggttcgaaagtgtttcggacaagtctattcggggcaaaagttattgtctctattgatcccgacgtgaat

SEQ ID NO: 6494 - DNA, 3000 bp, Unknown
  misc_feature (1)..( 3000): cDNA_ID_3090357_gDNA_ID_1621095_Annot_ID_170951 3000 nt of promoter + ATG
tttgctatctagagtttagaggtaaatcaatcatagatgacttggtggaatcaaacacataattgagcaaatgatatggacattaaactgaaagttagtctgtctaatggtacaactcgggttctccgattaaaattttgtcattaaaagtttgtgttgtatacttgtatgatttaaaagtttaaaagtttgaatggtacaaaacttgattttgtcataaacttgtatgatttaaaagtttaatggtacaaatgatatggacatttaaaagtttgtgttgtatacttgtatgatttaaaaaataataataataataataataataatatatatatatatatctacttgtatgatttgtatagatgtggctgtctattttttctccaccgttaactcatgtaatatatataaaaaacaaatttatacttttttgtgaaggtcttttttaaataataaaaacaaatttgggtagggaggtctatttaaaataatatggtcgcaatatttaacaatttttaaattgccaatagcttagagtcgcgtaataatagaaccaaactatgcaactatcattcctaccaaaaaaaaaaaaactatgcaactatcattagaaatatgtatctaataacgtgcatgttcgcattgcacgtcgtccttctttctccgacttttcctattttttttaatattattttatcaaatgtatctagcttagatacttttgatggagatgctccaatgataaaaaatagttgatccgttagccacgctagtaacatagtagttctgcataccattttctcttcattctcaattgcgtctgtttaaaatcaatgattgtgattttctaactttttcatattctattggatgggtctccaggtcaaggcgtcaagccagataatccagtggttagcagacttttcggaggagttcccgcaaatttttttcttttctttgaatttaatgtatatgcaaacttttttttagcataattataaatttttatatcctggatgttatctcgatatgaacaacacttggagtcctcccacaagcttctctacattcccttgccttagagtactcaattttgaccatagaaacgctgcacatcttgttgtattgttcccgcaaatcttttttgataaaggattcaggctaaatccctaagtccaaatagccacgtgattcctcaaccctaaatgtcaagacttgcacataataagtttgaaccatataaaaaataaaacgcctaagcctaaaccccatctaacaaaacttgcttacaccatgtgtttgatgtaagaatgatatccctctttccaacaatcttgcttcttccctgatttgccataattcaccactaatttggtaagttgtgaagaaacttccatgaggggtaacatgaaaagaatcaccagatctacaatccatgagctatcgtcagcgacaatgttgcaaatattactttgttcaatgagatatacatctacatcttcatctgccacggcagtggtggtcttttcatgttgttgactaaaaatgataccaaaggctcacaggcacatgttaataccattataccacaatttactatctagatattaaagacataaatggtaaataagttatagataaattttcctatatggaacggaaatgccttctgtttaattttctggatggtgaaaaacaatggagcaattcttcttatttaccaagattatgcgagtgggaaaaagttctaacctcatagatgatatcgaagaagtgtgtcggtctaatctgtaggtcgagacgtggaggctatccccagttaaaggaatctgtaccaaactgaaacatcttctactcagtcaaatcccaatcctcatctcctacttatttcacaaacgcaaaaaaaaacagcccattgtatagatcgtgagttcttactattgaaggttacgaattgatggaatcggcttcttgttgcgattgaacggtagccatcttggtacgacatcatcgtaagaagccttgattttaattccctaaccagaaaccaatatgagaattctaaaacggtcgtgaaagtaaggaaaaacgaccaaaatcaatcccaactattttcatgtggcttttctcaatccctatgactttttgaattaatcaattcgaactcacacaatttttaaatagcaaacttgaactatatgaccgttaaccagtttcaacatagaactcgactttgtgatcgacgtgcgcatcaacaattaaaatttgatttgctcaagcatatatgaaaatgttttggcaagaatcaatagtgtaattaatcgttttcgtttatgtttacgtcatgtttgtttaaacttttatttcatgtatgttttaaattttataagttgtaataattattaaggttttcaaaattaaagtttttgtatttttaaatattttttttttattaaaactccaagttaagatctcacaattacatattgctaaaagtttaatcttttaaccaaattcttattcaaaactaagctaagattaacctaagatactaccgataataatgttcttagtcttgttttagtcttcttttagttggttcatattttatttttaattaaatttaagtaaatgactaaattatatagaaaaaaatcattgatattttaatgttatatctatgaagggttctaaaccaatgtatatgctctcacgtgtttatatctagttgtttgtaaaatactgcggcgatagtattgactgagttgacatcataaatttataactgttttacaacttgcttcaattagttgcctcttttaaacataaagacaactgtatttttcttaaataaataattacccatatatgaaatattttagagagaacacccctaagactaacacacatattcactagtataaatagaatgccttcttcgtagaaccatgtataccccttaaacacacaacttcaaagttgttgaaaaaaattaaaatg

SEQ ID NO: 6495 - DNA, 3000 bp, Unknown; identical to SEQ ID NO: 6489
  misc_feature (1)..( 3000): cDNA_ID_1814614_gDNA_ID_1621095_Annot_ID_170946 3000 nt of promoter + ATG

SEQ ID NO: 6496 - DNA, 3000 bp, Unknown
  misc_feature (1)..( 3000): cDNA_ID_3090367_gDNA_ID_1621095_Annot_ID_170938 3000 nt of promoter + ATG
tgcgtaaaaaccgattgttctcattgctggttgttcggtcttttcttgcaggcagaacaaaatggtggttgagcaactgagttctgcgtctctgggatcagaagctttgaggtttccttcgcaattttcacaaacagcttgggtgcaactaaaggcttgcctttggaaacaacattactcgtattggagaaacccttcacacaatataactcgcatagtcttcatattgctcgattctacgttatgtggccttctcttctggcaaaaagctgaggacatgtaagtctctgctccccatttcgaaatatgattgtatgctactagatagtggaatcacagtttttctttcttagaggtaaagttcgaactaaaatgatcttactagtaaacataatttctcttttcttctgtatcaggtctttttttatagaatattctgttcgtttatggtgggtaaaatttgagtttacctttgcagaaataatcagcaagatcttatcagcatatttggatccatgtacactctagtagtcttcccgggaatgaacaactgtgcggcagtgataaacttcattgcagccgaacgcaatgttttctaccgtgaaaggtttgcacggatgtactcctcatgggcgtattcattttctcaggttaacactgtttcctttaaaaataggttatgtcaacttttaagaaatagatcttatagcaaatcgcttaggctgtttataattttcttggatatagcatccactagcaaatatctctctacataatccaggaatttaatgttttgcaggtcctaattgaggttccatactcactactccagtccctactatgtacgataattgtatatcctacgatcggctaccatatgtccgtttacaagatgttttggagcttgtacagcatcttctgctcgttactcatcttcaactacagtgggatgcttatggttgctttgacgccaaacattcacatggcagtgactctacgctcatcttttttctccatgttaaatctgtttgctggctttgtcattccaaaacaggtaaggctccccttatcccccacgccgtttgacatatagccaagatccaacgtatgtgtcacttagtgcatgttaaacctgtggtcttgtagacttattgcatcaataaccagtaggcttagagctatgtcaggtctatttaactcgaaatgttgctgcgttgcgtggaatattaattgtatatcattcatataaaggctcctgaacacaaaaaatgtatcgttttccgtagaaaatcccaaaatggtggatatggatgtactacctgagcccgacatcatgggtgttggaaggattactgagttcgcaatatggagatgtcgacaaagagatattagtatttggagagaagaagagagtttcagctttcttggaggattactttggttacaaacatgaatcattggctgttgtggcgtttgttctcatcgcttatcccattatcgtggcaactctttttgccttcttcatgagcaaactcagtttccaaaagaaatagttgcttgcttgtaatagtagtagttcactacacttacttcagttaggcttttttctctcccaccatatcttaagttattatcagaaacattttacaattcttatggtcacaaatcttggccgattgcaatggtcctgataatcccatagtgacaatcttacacctacacttcggtttaaccggaaaaagctgagttggggcaacagatattattgaagcatacaagaacctttgttattggcagaaatgatgattccaaacagccaaagtcgaatcttttacatatcaagaaaaattctttagaggtggctagtttttacaactatggtactatggtccaagtgttcgacgtaatgatactaaccgaaagcaacccatttgttcttttgttcattgattactttgtctgtcttattcagttgctccatgcttgtgaggacttcacattaaaaccgtttacttcttttatccacattgtgaagccacttgattatcataatatcgtccaccatggtttatttttattataaaccttatctcattaatttctgacaaatgaatcaaatatttttctgataatcatgtgggttttgtccatgcacgtctctctgactgcagatatgattcgatctgcaaaattattagttgacaaggctcactcaggggattgggaaataatactctctatcagttgcgtagtcaaagtgttcgatgaaatgccaatgagacatatttgtggtattattgttaaaggagccgacttttgtcgaaaagataccatcttgatgatgccattgtcaacgcttacaagatttgtattactttattcattctttcctctgtgcaggaccggatttttattatttttatggagatgatcacgtggagcatgggggctaataatgtataccgcgtaagttttgttaaagttattatatttacaaacattctgacttcaattagcttctccttgttgttgttctcaagttgtttgttttttatagactttgttggttgctttgggacagtaatttggattttcactactgttacatacaagtaagattttttttttgagatttgattcttttacataacaggataattcttcagaggcggctcggatttgttttgttttgttgtttcttcaaatttggtatatatatggtctaaaatgttcgtcgtgaaagcaacgtgtctttcacctattactttttcaatgctctcccatttgtttattgattatctttgttttgtctgttgttttagttggcacttggtccatgatgatagacataaagaccgttgacttgtgtgtcaaccttgtgaaaccaacttggttgtgattaattgtttgcaagctagcacactaacttgtatataaacattctcttctctttgtaagtctaataatcctttttttcgaatttggtttctaataatgaca

SEQ ID NO: 6497 - DNA, 3000 bp, Unknown
  misc_feature (1)..( 3000): cDNA_ID_3090203_gDNA_ID_1621095_Annot_ID_170935 3000 nt of promoter + ATG
aaatttcctccaagatctagtatagtcagcttatacttttaatcaacactcagactaatggggccattaaagggtccttgcctttcgccactggtccaaggcgctaggttgttaaaaaaaaaaagttatttgcatacacgtaataaaaaattcatgtattatagttgaactcttgaaacattagccaaaagatgttaactcaaacagtgatcgacagtgagttaccggaagcataacgtaaacgggaacataattaagaagaagcttctcgttgtaattggtagccatttttcttctaaatacaaacaaagaaagaacgtcttttttttttgtttttttgttgagagagtgttgtaggaaaatataagcaatatgagtagtagatgaagctcacatgtctctcttaaagaaagctcacgagctctttatatagaagtagatgatattatgcgagtggttgtgatttttgtgtactgatctaaaacgactggtgctctgttttcagcggtccatttgaggattgtataatgactttattgccctctgtttttggcgtcttccttgtcctctttcgtcatttcctgagattctttggaatgatacctttttctataattgaggttcaccgattttgatttccgacactgattgtgttgtcgccactcgccggccttctttttgtttctccatgtgttgtttttaagcacgtggagtaaatgcaaatgatatttgttcatgtctgtattcaccattcaaatcttgttaccttaataagtaagctcaatgtcaaaatttaccttagtgttgatgtcttacaacttgaatattatagtaggtggattatgtggatgtcaaaaatttggtgtgatggattttataaatcgtgaaaataaactggagtccaaaatctgtaagttactaagttgagctaaatgaagactgaacaaaagggaatcaagagaaaacaacaaagtgaaagagtgatcttattgataatgtgtcaaacaaattacaaagaaagaaaaaagatgtaggtagagtgactttcagaaaaaatagtgaactttacctccttgttatctttgaaattgaatgggcttccgttggattaggttcgtgagggtgtgttttttttgtcgacaattttattagattgactcaaataagccaatgttgagaaatattgtttgcaaatataataatatgtgtttggttcaatatttcgtgccaaataatctgttttaaaatttccacgagttaaagataaatcaaaatctggataataattcggtttgtgttaaatctgaatttttcagaatagttgacttatacttcaagttaatttgagtaattatatatatatatataaaacttaccggggaattgtaaataacatcacacaatacgttttttttaacattaaaatacgattaaactcgacatagatttgttgatctacatgttttctctctcttctctctcctcatctttcagagagagcaaaccagtttcagcttttctggccggcaatgactggctttatcagcagtgtttggtcggcttctactctggcatcgctggcttccttagaagcgttggttggctcagcttccggcatcgaccggctactttcagcggtggtggctggcttatctcccgagagcaagatatcctcttttttgtttcgccgggcttttctccggcgtctttggccggctttctctccggtttcttgaccggatttagatttgttttgttttttttatcttctgcctgtagtttaaagattgatgaacccaagttaaaaagatgttgattgaagaagaagaggaagaaaaagaaaaagaagaagaagaagaatagcacttcgtggagtcaaattctcatccaaggtacaactgaaatttcgccattaatcctttgggcgacgagtgagctatgccagttgaacaagttttccggtgtttcagccggaattgaagcttctgacggcgactcccttctcttccagttcctacgtgtccttcaaaatgttttccactgacacgtgttttctatgcggcgcacaacaatcacttgttctcttccttcagtttagggtttattcatttgagcttttgggaatttttttttttttttgggcttgtttatttcagtttttgtgaattattggcctgttaattttggctctataatattaataaaacacacttgtgatagaaaaaaatacgattaaactcatctgattggactgtttataatattataaaagccaaaaactattttgaaactgttgtcgcgtcatcaattctcacagtgtcggcgtcagcgaataacactgtaaacgcgcgccaacgattcgattgcatatgattcttcctctgtaaattgtaatgcaagctaatctcattaatctctgacatgcatcaagtattttgtgatatctcatcttccagagtacgtgatcttgaagaaattatccatgtgatttctcacccatgcattgtttattcattcgtctacctcactgcagcttcgattcgatcagattcacaaatctcaggaacaaattcgtctaccgaaacagataaaacgcacataaagtgttcgatggaatgcctcacagaaagccaataagttgtgtgtcagtatgaatccgttcgcacattgtgaaatcagttctgacattgtttagtgagttgactattgtctaaaagatctcttcgttgattttatttacttactttaatgaatcaccagttttttcaacgcttacctgatttttcactagtttattcgttcttttgttcagtttttctctctgtacaagaccggattctatggttatgatcacgtggagctcgcgtgatattagtgtatgcgtaagttttgttcaagttatatatataaaactctgacttcattagcttcttcattcatgtggagttttgcttgcttctccttgttgttattagtttctttggctgcttttacctgaca

SEQ ID NO: 6498 - DNA, 3000 bp, Unknown; identical to SEQ ID NO: 6487
  misc_feature (1)..( 3000): cDNA_ID_2991458_gDNA_ID_1621095_Annot_ID_170933 3000 nt of promoter + ATG

SEQ ID NO: 6499 - DNA, 3000 bp, Unknown
  misc_feature (1)..( 3000): cDNA_ID_3048432_gDNA_ID_1621095_Annot_ID_170974 3000 nt of promoter + ATG
tggttaaaaactaagaaaaaacattgaaggaaatctacactaaacacttaaattatcatgaagtagttattagtaactggaaaaacaaattgacaaaacaaataaccatatagagtacaaacaagatcaaggtaacatataaactgaattaacatggaacttgaaatgattggtcactttattcaaatcacaacgaaaagcgaaagccaataattaattaaatccagcgtagagcaattggtagtagtcttgtttatgccacgaccgggggatttaggacggcataagcaagcaactcttggtcatcgacaaacacggacatgtcttcctcaggtaagcttatccatgcttctacaccatcaccttcttttgaatcaatcaacacgacacccaccatgttgtcgtaaatggtatgtgacgcgtatcccacccagaccggactacccgatccgaagtcaacctcgtagaaaggctttctgcaccagctagacattatgtatcggtctatctccgttgactctgacacagtttccgccatcaaactcaacaaactctgaccaattgtattgccttgaagactctctttgatcatctcgttgactctctctttgttcttcctgaatgtggccacgatttcagggatctcaaactcgctctccgcgtctttcttgagagaaaatccgctttgtaggttaccaatcacgtcttttggcgcaacactagatggaatcctaagtcgaatgtccatggcctgccacatgacggcttgccttggaattaacaagttagagcgtgaggagtttctagcacatctccagataagtgacatgatagcttcaacacgtgtaggcacagggacgctttcgctagcggccttgtgtttcagctcagcaatcttagaaggttcgaagacgaatcttttgagtacgtatttacttgtgatgttagaatcggaatccgttgatgggaactgttcatacatatgagaaggaggaggaggataaatagtcgtttcagcgaactcgatagtactgtttgacttccctttggccgtggtggtagcccagtcttttacaaaggtaaccaatgaggctatatcacagattttgtgagagacagagacagaaaccgccactcctgatccagacccgaagaaagtgaccttgacactcaacaacggccaggccgctggagattctccagcagctagtgtcgggaggaatcccgacagggagtcagtgttgaggtttctaaggaaatcaggaagaaggagatcggtgcgtgcctcggtgaagacggctccttcgtcgttacagctgatggaaaggccttctattcgtccagctagtggatagaagcgtgagagagtctcggacagagagagtttcagattttccgagaaaacctccgaggactcggtgatgagatcgtagaagaagatcgtcgacacgtagattccaggacaatagagatcaaggatagagagctgaaggcgatcacgaggtgatggtgaagcaggtttgatcacttctttcccggtcacctctagcttcgcttccatcgtcttcctttaaaagtcaacgggttacaagattgaagtattgaggaaactttgacaagaggagaagatggaagagacaaatggatcagagatgtgtccttttaaactggtagttgaatcgttgatacaagtttcaactcctatccatgtgtccacactaggaacaaaatttaatttaagaaaaaataaagtctgctaacaatgtttatttaattcattcatattagtaaattaaataaaacttcaaatgcttaaaatagacgactatgtaatatttaattggtgatagtaatataattcgacttctaaacaaacaaaaaaaaacatatattgaagattgatttaattgtatttaaaattttagagagcgtttatgaattataaaaggggaaataattttgaaatatatagttatatatatagaaataaaataaaaaatcagaaagaaaatataaacgttatgagaaagaaaaaagagcaaatgatagtggcatataccaactggtaaaacttctaagaggattgtttgttaaaagtctcacatcgaatatgagactgagccctagtccaaaaattactaaaatggtcaaaatgatttgttcaaaaagggggtatggaacctcactaaaataatagtggttgcattttagtaagtgaggttagactaatggttgaattttagtaagccaaaaactttccatcagtaattgctaattggatcaactaaatgccatcacacaaagaaactattgctgaaattgaatattgatattatcaaattttggtatatctccaacaaccatagtcctcaacaaacatagagtaagtctagttcctaaattttcaatatctagctgtttttttcttttcaatatccaacttagtaaacacattgttcagaaacacgccaaaaaaaaaaatcaacacatctcaaaccatcattatccagaagggtacagtaaatccagttcctagttttcgatttctaacttcaaaaatgctctctttctacatacacttttttacaagtctctatcacagaatcggaacatgtggatagagcaatggttagtagactcttttccccgaccactctttgacgttcctcgataaatccgaacctaatgatcaatgaacacgacgagtcatttatacaaaggcaacaacaaaatgtggtttcttctcagtttgcttccttgaaaatttagctgttatatactaaaaggccttttgtaaggctaaaaggccaagcctttgggcccattaacatcaccgtttattcgaaacgtatgttgttaagacttgagagaagtttgacggtgaaaaaaggaaaatatttacatatatatagtaaaattaaaatagtagaaagaaaaaaatcagaaagctacgaaagaaaaaaaaaacaatctagcaacagaagaagcttcgagaagacg

SEQ ID NO: 6500 - DNA, 3000 bp, Unknown
  misc_feature (1)..( 3000): cDNA_ID_2041166_gDNA_ID_1621095_Annot_ID_170971 3000 nt of promoter + ATG
atcttgacttcatctggtttgtaatttaacgacttgccaattcacctattgcccatgatctaattctttaaaccaccagaagttgtattgaactgattgatctattttttattttttttttttttgaatatttggaagttcgggcccaaagaccctatgtttctcagagacggaacccatagtagattaaattcatctcttttatagagagattccttccaacgtgaaaccattcctgaattgcttagaatcttttctaaattttgtaaactcttttctaaatttcagtttttttggcaggaaaatttgagagtagttttctacggaaaacttttggtgttaccagaaatgtttttgcgaaaaacttttaacgaaaaaattttgggcaagaaaatattgtcaggaatttttggtgataaatttacgtaattttttaaattttaattttaatattaaaaataaaataattatttaaatactatttttgtgcaaaaaaaacttttaagtactatttgtgaaaatttctcattttcaaattgccttaggattttatgtttctagccttctaggcccttttcggttatgtctatcaaactcaaagacaaaggaattaattggtcggccaagggacctttggttttggagttaatcttgaatatgattatatgaaatatgtcttaatatgattatatgaaatatgttaatcttgaatccaataaacgtccgagctgtggaaacctccagttaaaagatgaaatacaccaattttctcctttttcgcaaatctccctaagctcttttaaaaaaatctcaatccacgttttatccatattgtggaactgtgaacccaaaaaaaaaaatctgtattgtgaaaaacatcattaatgatacaaactacatcatattcactaattaaatcttgtaaatgtgatgcaaaaaatcatattttacataaattacaagtggtttgtaccatcctactatattatttgggaagtatattttaaatataaccttaatttctgtaattaattacatgacaatgtcattagaaaaatttaatcaaaaacaaaatcgtttaatgacgtcattaacaaaatcatttaatgacaatatttatttcttaattatagggcttattggatctaaagacggatcatcaaagattttctaaactgaagcaaaatatagtgaatattcaaatatctatctgttactaaatgataaacaaataagttaataagtcaataactatttagagtgacgggtttttgaatcaacattaataaaaaaaagtaaaatataattaatccaccgtttcaatacgagttaaatcattaatttattaaacatatcaaatcaataatatttttaaaatattattaatatgttgttttaataagagttaaaacttcagttttttaacaattgtctcatgtattcgtcgtataacgttacttaataacaattataaactgtaaaatataaatattttataaaaaataaaatttgtaagttttaatatatattacctttaaaaaataaattgtcctgcggtgtaccgcaggttaaaatctagttggggtataaatcgggaggatgatgtttaggccaatttttataaaacaagtgtcctgagtcttattgtatacaataggagtgtcaaaatgggtcaaaattcatgagtcaactcaactcaactcaacccatgaatcctaataagttgaaatttttgactcaaatgagttgatgggtcaaatgagttattgagtcaattggtttgatgagtaaaatgagttgagttgtaatggttaatggtttcagtggtttacccaattaacccattatattttgtaaaattgaattaaaccaactaaaatctctaaaccaatatcaatttaagtttaaccaacacatgtaaaccaatttaatacaatcattatttttccaaatttcttaaatatacaagcgatgaaattaagaaaaaataaaccggtgatttttccacaaaaaaacataaatccgttattttcccgccaaaaacgtaaacccatgattttcccgccaaaaacgtaaacccgtaattttcctgccaaaaacctaaacccgtaattttcccgccaaaaacgtaaacccgtgattttccgccaaaaacgtaaatccgtgattttcccgcaaaaacgtaaatccgtgattttcccgcaaaaaacgtaaacccgtgattttcccgccaaaaacgaaaaacccgtgattttcccgccaaaaacgtaaacccgtaattttctcgccaaaaacttaaacccataatcttcccgcaaaaaatgtaaacccgtgatttttctgctaaaaaagtaaacccgtaatttttccgccgaaaacgtaaactcgtaaaaagtgaaatccgtaaatatcctaagtttgatgatagtgaattaataattattaataatggtaattatttattattgtttaataataatatgaattaaattattacttaaatgggttaacccatttaacaactcaacccattttgtaaatgagttgggtacaaaatgagttgggtcaacccataactcatttaaccttaaactcatttgattatgagttgagttgagttgggttacccattttaacatccctagtatacaacttggttttaaagttactcataaacatgatcgtgacacatgtcaaatgtttatataaatatttttaacaaaaagatatatatactaatttaaaaataaattaaattttctttcccataatccaaaaacgaaaatgtataaaatattaaaaatgtataacgaaaaacaaaaactaacaaaacaatatataattaattttatattaatggttataattaatcaacgacttgccaattcacctacgtactactagttaatcgaccagagagctagactagtataaaagagatagtgcctccctcataatttttatatccaaaagactaggaaaaagaaaataacttaacat

SEQ ID NO: 6501 - DNA, 3000 bp, Unknown
  misc_feature (1)..( 3000): cDNA_ID_3090207_gDNA_ID_1621095_Annot_ID_170931 3000 nt of promoter + ATG
tgcgtagataaacttaagcttgatgtattctttggtacaatgtaattctgtttagttctataacttggaatcactctaagtgtaatgtatattgatgcgaagtcaaatgttgctgaatttttgctctcctgcattttccccaattttttctgagccagtattgtgaaaaattggagtctgagaaaactgaaaagtttaatggattctcatttaatcagtgttcatagattcactagttgtttgaccagggcttaggcttaatcattcttgtgacacttggttttcttttaaatctgttttgatgttcagttttctttggaagctatatacccataaacttaaaatgaataaagatggaagctttagctgatataatttgggtgtttctttctttcttccttggtgtgaagctgtttcaaaatgtctcggaggtatgatagtcgcaccacgatcttctcaccggaaggtcgtctctaccaggttgaatatgctatggaagctattggcaatgctggttctgccattggaattcttggcaaaagacggagtggtgttggttggtgagaagaaagtcacttctaaacttcttcaaacctcttcatccatggagaaaatgtacaagatcgatgaccatgtggcttgtgcagttgctggtataatgtctgatgccaacattctgattaacactgctcgagttcaagctcagcgttacacctttatgtaccaagagccaatgcccgtttagcagctggttcagtctctttgtgacaccaagcaaggatacacccagtttggtggtctccgcccgtttggagtttcctttctttttgcaggctgggacaggaaccacgggtttcagctgtatatgagtgacccaagtggaaactatggtggatggcaagctgcagctgttggagcaaataatcaagcggctcagtctattcttaagcaagactataaggatgatgcaacgagggaagaagtggttcagctcgctatcaaggttttgagcaagacgatgacagcacgacttgacagctgaaaaactcgagcttgctgagttgtatctgactccttcaaaatgtgttaagtaccatgttcactcgcctgactcgctcactaagctcttggttaagcatggtgtgactcaaccagccgcagaaacttcctaagctagaaactggtgacagttttacctgacccgcctggttactgtagatgtccatttgctttctttccctttggagatatcgtatcagaatcaatttaccactctgattatgtcatgtgattcatttgggttgactatcttttatcttgagattgatcttcttctagtctaaagtaaagttagactttagaggttttattcaataaatgaatgagcaatcaccaacgggcccattagaaagcccataacattcattgattgaggtaacgggttttaatggctcaaattaacgaagaatcagaatctctttaagtttcaccacgtcgatttacggtcaagagtgtctgtttattaacagaacagtaaaaatgttaccgctcaaagcgtatatcttgagcgccaaatggaatttcattggtacaatgcccagaagttctgggccagaactggcctcattgtaagagattttttaggagatttatgcagatctggaaaaacaagtttttctctcttggattatctacaaaatattatttacttaagtagttgtcagttagacaatgccctgaatccaaggaattgtatcgaccgggattgaagagaccattcttgcatcgtctcttctttttgcagcatcgcgattgtatgaaacattgatggccagatctttcttctataagtcaatcaaccggccaccggaattaccctaaaaacatagaaaatatgttgaaatatattgagatattagtcatcgactatgactaagtgtcacaaacttttgtgtgataggattcaatcaatccaatggatcttagtaagaatattttacattctataccagtctagttcacatattttctaccacaaattgttaattcctcacaccttttaaattcattttctagtttgcagtttttttttaagtgtcactttaccagattacctcaaacttaaaaattatcaaattattatcaaaatatacaaatttactaattataaaacaagtatatatctaatatcttatcttaaaaggtaaatatataaatattttctaccttttgtcatgtaatacaatttttttcctatttattaggtatcagaatctcaattaattaaattcagaaaaagtgtgagaaaataatttccagtaagcaaaaaaaaaaagtattaacacgacggcttcttctttcagcaaaaaaaaaaaaacataaacggagaaagagagagagaacgatacagaagagaagccaaggtcgcagagagaaacaatacacacggcgacagatatatttcccggcgaaacgggaacaataatatatacagagagagagagagatttagtgagagagctttctagggttttcttcttctcgatttatcttcctttgacctcgatctattcctcttccttctccataaattttcccttcttctcaccttcattcatatctctcctagctccattctagggttcttgatccgtttctctaccttttcgttttcttcctccgggtataatttcttcttcaattcgtttgttttcgcgtctcttcgtctcttctaatttcatcaatttgggtcttgtagggttttgagattttctccttcgtcgggtgaagaaaaccctacattttgttttgtcactgattgtgttttcggtgtttcaggttgtttaatttactccggcgggtgaccaaattggcggtggcaaagtatgagtattgatttccctgggaaaggggagagttagggaagtttgggctagagagaaattggattgggtttccatgagcgatgggggtgtcgcatgcatgcctctactgaatatc

SEQ ID NO: 6502 - DNA, 3000 bp, Unknown; identical to SEQ ID NO: 6493
  misc_feature (1)..( 3000): cDNA_ID_1814598_gDNA_ID_1621095_Annot_ID_55645 3000 nt of promoter + ATG

SEQ ID NO: 6503 - DNA, 3000 bp, Unknown
  misc_feature (1)..( 3000): cDNA_ID_1814586_gDNA_ID_1621095_Annot_ID_55648 3000 nt of promoter + ATG
cagtcaccaagcctctgattctctccgcctcaccggtctcctcagaacaactcctccccatgatcatcttgcagatggtgttgttattgagcttcgctgcttcctcaacaatctcaacactctccttcttcatcgccttgtcgagcagagttttataaaacctatcaagctcatcttcacggaatcttcgtgaccgctcgagtgcctgcggtccaagaatcttggtaaccatgagcttcctcatgaatttccagtaatctccatagggggcgctaatgaagctatacgaccccaaaaagagagactcttcaatcggaggcgaatgccgaaatgatacattcacgtcttggtccctgaagatttcgtaggccactgaggctgaggaggcgaggactataggtacgtggaagatgcggagatggagaagaggcccatactttgatgagagtctctgaaaagacttgtgggttaaagtagacagaagaattaggtgaagatgaccgatgattggaagagaaggagggctcggaggaaggtcacggccatctcgtgaatctttaggtttcatgaagaagagagagtaacataggaatgacaagagacataagaggatgaagatgatcaatactgccattgttgctcaaagtgcagagacaaatgaaacagagtaatctttgatcaagatgcatgtgttatcgtgctctgttttattagcaaaaatgatacgttgtcgctttgaaagaacgtgaaaaaaaaaaactcgttaagcgtgtacgtcccaagttgacaatagacattcaatattgtcagattcgtctaatataagataggcgcatgtgaaatatttagatattagggtaatggacgctttaaacgtaagaaggaaaagagatggaactctccactctcattaaagctttgatctagtgtgaaacaggagactgcatgccttttctttcttggccgaaacatctcaaatttccgttgacttaagtttcataggctttaaatttaaaatcaactaggactctcccggggcaaaatatttcaacttacttatatttttcttttattctattttcttaattaaaatataatcttgtcttaaaaatatctagttgaattgtatcatttaagcaactttgctactcccttccgtgcctattaagaatcatatgtatatatcaatttgttgccaaaaaaatgtaaatgtcaattcataaatgtatgtatataaaatcctgtattttcgaaaacaagatgaagtaaagttatgttcaccttcacgactcgataaacagtcgtcccaggagtgttgtatgagaagttaaaccaattagttcggaaatcaacccaacaaagtcccaattcttttacagccccagactccattacatcacgataagatcaaccaccatcttcaagttgttaaggttagaaatactcattagacatgagactgggacatccttatactacacaagatttttcgaaaggttctcaaatataacaaatatatagttattatattgtgtaggaaacgttaactatgactaaagtctgcttgggaattagggaccttggttgcggatggagaaacgtgtacgtgatatgctaataattattgctattttctatagttatgttataagattatattgttatttcctttgttcgtttaggagatgtctttaaatatgtactctttagcaaaaagtcgatcatcaaggaattaggttttacaattttctattggacggctacgccattggacaagattcgtcttgttggagagaagtacattctctaggagagctattgctctattctatatttcagatttgttattcacttaaataaagtttattccaaattcatttttttcttctattcgtaattctctctgatcttaactccatcaattggtccgacctgccaaccaaatgccgtaattagataggatacaaatcatcgttaggagaatagatttgttcgagggaaattgataatatataatatagaggtaaacagttagaaaagggcaaaataaccggaaccaaaatcgaaccgaaccggaccaaatctgaatatagtttatagaatatttcaatggatctcaaatttcctaaccggagtacccagaactgaaccatatcgaaccaaaaattaaatgggtaatcaaaatatccaaaaaccgaatgtacacccaaaatacacgcaaagtaatgattaaaatacccaacattataatgataaacccaaaataattatgtttagactcaaaatactctaaataaccaatatatcaaaatgttgttagttatatttttcaaaactaaatattattttttggtaaattaaataatattttatagttttatgggtatttcagatagttttggtattttcggtagttcaaccgaacccaaaaaagttttacttctatttcagttctccattcaaatatttgaaccgatccgaaccaagagagaacgaaaccgaaccggaatcaaaattttaaaatacccaatagattcttaaatcccctaaccaaatttactgaaatcaaaaacgaaaatgatctgaacttgaatgatactcgaacgcccagtcgtactgtacacttgtggaaaaggtgagcttgtggttggtgattggaattttattaaagttttcatttccacgttttattttcatatcttcaagaaagcttcttgggagttgttagcatgtactttgttaaagttttcatttaaaaattatatatctttcaaaagaaaaaggaaaaaggttgatcttgtagaaaataaattaaaataaaagaatactttcctatagaaaaatagcacaagttaaatacgttaagaaaacaaattagttgaaaattattaattaacttatcatcagttcccactcaaatcatcgttttcacaagcattatcaatctatataattagttgttttgcctctcgactgaacttggaggattaatacaaaatg

SEQ ID NO: 6504 - DNA, 3000 bp, Unknown
  misc_feature (1)..( 3000): cDNA_ID_1814574_gDNA_ID_1621095_Annot_ID_55651 3000 nt of promoter + ATG
ctttaacaattgaggttagtatttataaatttaaatatgtgtattgcttatatatgagaattcatatagaatatttgttatttatgtcaatagtcgtatactaattttatctagatcaacatgttttaactcatagtttcaaaaaagttttcacaattaatataatactctgtataaattaataaaatattaatttacactataatctaataaattataaattataaattataaattaataaattaccataattccaacactattaatttatattgagatcttactgtgcctcataactttgtacgatattcggagctgtgcttacttagtttaaaaaaaagggcaatagccctagggcacatcctcaatcattatttttgaggcaacatttgacaagtatttttttttagtttttttttcagttaattgtaatgtttaaccgtttgatctttatcatcattatcatatatatttttgttgtcatctgttatactatttatttaattcaaaaactttataaagttttattttaaccacattttcagatgatttattgttagttaatttttctaacaataattgataagccttccgagtcattggtccggcggtgacgttattcgttttgtattagtagaggcgtacctcctacgttatacattgtactctatccgttatatatattcctacttgccatttatcagtcaactagttacctcataagacttgtacattctgtgatcgatattaaaatgatatacattatgtgaatcagtgaatgatcgggggaaaactaaaaaagagtttcatttttctttactaatttcacttagtagataacatttgtagttataatctttatttgtcgttattacatgtggactagtactggactattgaatttcattttttgtcgagttcacactggtgttaaataaaactggcatatataatagattattggtgttgaatcttgtacctaaatctggtctaaggaaacttccatttgtattttgtatagttattttgcagaaaagaaagtgattgaccagtgatgtgacgattttgaccactgaattcttttatttaaagtcaaaactaaacaagtcatgcaatattatataaaaatggacaataactcactataactttttcatttaatcttcaatgaaattatattccaatcttcttcttgatattttttttttcaatatttgtttcattatacaaaataacaaaatttaatatgtgcatgacaaattaaaaactttacttttttttcatcgagttataagatttatacagtatatggtttgatctgtcttttctcttgagacccggtgtaacttcaaatggatatctcaacctcggttttcagttttcaccttccgctgaacggatccactggtatttattcggttctttgaaaaatgagacaatggtgagaacgaaataaattccttcaactctgctagatttaagttcaaacccttggtcacctatagttggtggaaattgagctatctcgaaaggagttcaggcttggtagccttggccaaaagactttggagtttgagcaaatggtcaagaataaattgttggcactaattaaggtttaacatgttgaaagtaaacatgaaattggcactaatatttttgctcttgtagaagatatatgagtaatttgacttctagttgaaggctcatttttttttaaagattaagaggaaaacggctatttacgtagcatactactctaaggctctcatgaatcatgatcatatatattaatgaactaaaagtgtcatgcctaaaactacatgaacaaaacaatattatgaatttagtacatgacctatttaaatatgtagtcggaaacctacgttgaagtagatatcattacccaaactattagtgctttcttactagaataccatgttgtacaataaaacgaatatgttttacgaaaacaaatcggtctcctcgaaacgatattgttttatttgttaaatttgacttcagttaaaaaataatatatgaattagattataccatgttgtttgtatttcaccatgtatctcatccttgtatttcactttggttgcttttttttttttgtcaaaccttgctttcattcagtggaacaaagaacaattacaagtacaagagttaaacaacccaaaggttaaaacattacaacaagaggtattccccaataccataaaaaaaagatagagttcatcgatttgaagtccatgtatctcatccttgtatttcactttggttgctatttcatgaataattcagacggaaaaaaaaaagattataccatgttgttttgcgtctccctctcttctctctcctctcttactccaatttcaccactacgagttagagaaagattctaacgccgataagtatgtttaatagcaagtgtaaataagagatcgaaagataaatccaaacttcgtatatcgatttaaatagtttttattttatttttatttttcaattaaacttgggtgagaaagtgagactgtataagtgatagcaaggtaaggtgaattacttaaatatgtgagaacgtaagacataaatttaaagttcaaagcttaaattgattaaattacggaatgttgaagtttaattttttttttttttaaatttactttataaaagttatttgattaaaaaaagtcattaaataaaaaaatcatagaaaatcatatatatacttttaaaaataaattatgtaacggtaattactaaaatatgattaatgatttcaaaaaataaaatatcaacttttagaagatgaggatatagtactataacgataaaatatgggaattattaaagttatagttattaaacaactagatagtagatacactagtttttcccaacatgcatgcatcgtcagtttctttcttatttatatgtatagggtatcgcgtattctttcattccgaataaacttgaacgattgatagaaaatg

SEQ ID NO: 6505 - DNA, 3000 bp, Unknown
  misc_feature (1)..( 3000): cDNA_ID_1814559_gDNA_ID_1621095_Annot_ID_55656 3000 nt of promoter + ATG
cattgttcagtttgtagagaaagacttcaagcttgctgatacggtcattagaggacttctaaagtattggcctgtgactaatagttcaaaggaagttatgtttcttggagagttggaagaagttttggaagcaactcaagcagctgagtttcagcgatgtatggttcctttatttcgtcaaatcgctagatgcctcaacagttcacattttcaggtgcgactctcgataagttgttcatatagtctcgcaattttgcaggttatattcaaagttgcttcttttgtcaggtggctgaaagggctctatttctatggaacaacgatcacataagaaacctgattactcaaaaccataaagtgataatgcccattgtgttcccggctatggagagaaacacacgggggcattggaaccaagcagttcagagtctgactttgaatgtgagaaaggtaatggcagagacagaccaaattctgtttgatgaatgcttagccaagttccaagaagatgaagcgaatgaaaccgaggttgtagccaaacgagaagcaacatggaagcttttggaagagttagcagcttcgaaatccgtaagcaacgaggcagtgctcgtcccccgattttcatcttcagttactcttgcaaccggtaaaacttcgggtagttgaacactttctgctctctatcaccgagacatactttcaaacaatccagcagaattgtatcgatccgttcgagcatcaggatcagtccttgaagaagattaagcacgatgattaagaagggcaatatcatcagtgaatacttaattataacatttttttcaggtttatggaatcatgggttcaattgtttgttgcttctgatcctttttttttcttactcagctcttagttgaataacaatctgaggtgtaagaaatatggcttatagatatagttcttgagaggacgactaaacaattattcgtatttgtattgtggaatgaattgtattttatgctttgaagttcattaatttagctcccctactaaccaaatcataaccgaagttatcgaatctcggtttggttcggtatatatgcaacggcattttcgtaaacaagtcatgttttttttcgtgtgagttttagaaaatacaaaaatcatatataacactagattttaatttaaagttagtataattttttttttgcaaattgtatctatctataatatatttttattttatagtttacaattgttattaagtaacgtcctgccaaacccgtcccgccaaacctgtcctgtaaaaaaatcatttatttatattaatattgatcttatttatgatatgtttataaatcattctctaaatatttttgtcgatgcaggacattgaacccacacattgtttgccaattggttaatatatgttcatttttaaaattttgaatcataaaatgtgacagaaaaaattaagatttttttaaactctatatattatataatgatgttaaaaaattgtgatatatcaaactttttataagtttaaatattaataatgttttataaattttaaatatataaataataatatttaaaaaattaatatttttgcttataaggtaatgacataataactctaaaagcaaggatttagaagatttaaatctttaattaaatattttcattaataaataattaatgtcagtgacatgacattgtaaataagtttaaatacaaaatttatttatttaaacaaaaaacggttagtaagaataatatttatttaacaaaaaactttgttttaaaatattgttaacaaatgtctatgctaattttaagggattgatttgaattttgttgggattaaatttgattgataatgtgattgactatttaaatcaaaaatttaaaataaaattaattattttggaaaaaagatttaatgctaatggcattagattgtaaataagttcaagtccaggatttatttgctaaaatggttgcaaaaatgtatatatagatagtgtaaaaataaattgaattaccgatgtatttttaaaaaaaatcgtgaaatctaatttatttacggaaaaatattaccacattatttttgcaaatattgtgtatggtaatgaatccaatccattattctaatttgttcttagtcaatgagtggtattcaatttcattgtcccggtcccacggactgactactcagcaacccaatcttacaaagtcaaagtcaacttttattttgtttctctttttttccgtttccatcccaaattcatttctttataaattatttattcctaaaaggatttgtaaattaacctaatttgcatttcaaaatatttttatctattttagtattaaattggaataattgttatttttgtattaaaaaaacactaatatccaaaattgttatattgctttttattttgcttttttctatttttaatttctattttttaatagcatcgccgtatcgtcgcatcgatactcggatttagtaaataagtgttttttagcaagagtttatgcaagtccgcttcgattaaagtatctaaaccaaaatccaaacacgtgggagtttccgttttaatttctagttatattatacccttcgttatttaagatataaaacagcaatttattatcactaattgataaaaccttcattgcaaatataaactagattttaaaaataaaatttgacttttaaaatacaatgtaatattattaatgatataaaaacaaaaaacctaaaatggtattgaagtgtcaaacagaggaagtatatgatatatatgtaattaactagtcaaaatctgctgtgataacgaccaattctaaacaattataaaatcttctaaaaattaatgagaatctactatatttaataactaaaataatagaaggatgacaattgacaactataacaatattgaagaagtcataccaaatatattaagacgtgtataaaaagggtatcataaccgaagacttaag

SEQ ID NO: 6506 - DNA, 3000 bp, Unknown
  misc_feature (1)..( 3000): cDNA_ID_1814702_gDNA_ID_1621096_Annot_ID_55659 3000 nt of promoter + ATG
aggaaactataagttaaaaaaaaaaattgttggcagtctttaattgtaccaatcctgtgagactttattattacagactagatgatcacccgcgctacgctgcggttttttcggatttttttgtattatttaatttaaatttaatttttatttatctaatcattcactcatgcaataagtaattactttaatattaaaaatatttttttctaacaacattctcaacaatgcatcatacatataattcataaacaacatttgtcttaaaccaatttaagagagggtagggttggattctagaaacctgagaatttgatgatagagctccttacgtattcatcagcctcagtgatttattatataaatatcataagagaatataaatatcaatttaagagaataacttactcaaatcactaagtaatccacgactattatacattcatactttgagtttggattaaaaaaaaaatcttcaagtatgagaaaactattaaaatagttttattgaaaaatcatataaaataaaaataaatttagtaataatataattaaatatgtaaaataaaattaaataagaaatatatcattaacctataaattagaagttgaagaacttacattaattatttaatagacacatgtcaaatgctaaagtgatgatgtgtcaatcatatggagagagttgaccaacttttcatatatatgattggtaagaaaagttgtgtgtggttgtagttgtactacaagcttagtagaaacaaaagtattattgtgtaaagcatattgtatttttatgtattaaaatacagaagaaacgtgatacaaaatttggcgttttccactaaatcaaaaagtgagcaccattgtaatcgatgaacagtagaatttttgttttttctttacagttgaataatataatactaaatactaatgaactcaaatttttacatgtgaattttatgtttgttacatgttataaactcagataaaaggtttcgctatggaaacactaaaacgaagctcaaaagtatggctacaagagcttcgttcaaacctaaacattttctggggaacaatcgaatccgaaatctccaaaaacggtgccgcttcatatatcttccctctccaacgttgcatcttcagtttcctctgcgcctctctcgccggcgttgacgcttccgtatcgccggacatcgctgagaacggttggaaaacaatcaatacttggcttgcgttgcaagttattcccactgctaaacttggcgtagttcctcagcctcttgaagagattttacttcatacttggccttatccttctctcttaatcgccggaaattacaaaaagctttacaatttcatcgacgagaacgccggagattgtctccggttaggtcaagaagaattcgggttgacccgagatgaggctattcaaaatcttctctttgttttaggttttaatgcctacgggggcttttccgtcttcttaccttctttgatcgggagaataaccggcgacaattccggtttacaggagaggattagaaccgaagtcaggagagtttgcggatccgggtcggatcttaatttcaagacggttaacgaaatggagctggttaaatccgtggtttacgaaacgctgcgttttagtcctccggttccgctgcaattcgcacgtgcgaggaaagattttcagataagttcacacgatgctgtttttgaggtcaagaaaggtgagcttctttgtggttatcagccgcttgtgatgagagacgctaatgtttttgacgaaccggaggaatttaaaccggaccggtatgtaggtgagaccgggtctgaattgctgaattatctctactggtctaacggtccacaaaccggtaccccgagcgcgtcgaacaaacagtgtgcagctaaggacattgtcactctcacggcttccttgctcgttgccgatttatttctccggtatgatacgattactggtgactccggttcaattaaagctgttgttaaagctaaataagttaaagattgattagtgtttaatgttatgtaatcaatcttcaacggtttcatttgttcggagtgtataaattatatgtaaactaaaataatccgaattgaaactcaaattgttatgttagatggtgttgctatgttagagagattttaactgctttttacattttattaaggatatatgactctaatttttatgatagcaagataatttttgtaatacaagaaaataaatacaaagctcagtagtataatcataaccacaaagctcagtagtataatcataaccacaaagctcagtagtatttagggttaccaagcaatataataaatgtaataaatttgtgcgatggctctaaaaaaatgtaactttgtgtgatcagcagtataataaatttctgatctaaaaaactgtaactttgagagttgtctcaaaaccaactctctttcttaacatttatgaactattaattaatcaaaatcgatttaggtcttagtggcaatctaatttttttcctttcttacatttcaatctcttttggatttactttcaagtaagccatcttttatgttgaaacaaaatcttatggatgagcttctttaaatgttttagccatttatcaagaatgtattgcttaaagagtggtgtagttctaataataataaatatatatatatatccagatatttttgttagtctaaaataatccttcttgaaacacaaattgccatgtcggtaggattcgtaattattttaaataatttcttgaaattgccataataagagaagacaaatgtggtcatgttgggggtcctagaataaagtagtttgcctcgattaacaccgaaagtaaaaacattgtataatcaattcctcttttttgttttctatttactcgataagattctcctaaaaccaaaaaggaaaaaaaatttcaatcaatcttgagattgtgtcaagaaacctcaagagtgaaa

SEQ ID NO: 6507 - DNA, 3000 bp, Unknown
  misc_feature (1)..( 3000): cDNA_ID_1814696_gDNA_ID_1621096_Annot_ID_55661 3000 nt of promoter + ATG
gggtccagttgtaaagtcgaagccagggaaagcttttttctcaatggttccaggggaggttctattggcttcacttgatgctcttagtaagttaaatttatatttattagctccacattgacattagattagattatctttgtaatgatgaactaaaaatagtttgatttgatctttgaaattagataaattactagacgctgctgaagccgcagagagacaaactctttctgctacgtccaaagctctacaagaatggttagtgagaggtaagtttcacagacaaagtcctcaattttgcctcacgtttagtgtaaatgtctcacataagtgaggttacattaacaggttaggtgagagcgcgggagaagctacgaaagatgtactaggcacggttgggcacgcagccggcactgcgtggaacgtcttcaatatccgcaaagctttctctccttcctcttcagtcacatcggggatcctcaaaaacgcttcacgaaagtgatatttggtgtttgtatttatttgtgggcagagaccataaggttaaaattaagtcagaatatgcaaatgtgtaatcttgaatctcaaacaaaggaaacctctcttccttaccaaatttatccctcatgtgtctaaggaatacacagactccaaacatatcaaacaacttaaccttaaaccaaaagctttgacccaaaatgaaaaaaaaactaccaaaatcaaatcatgaaatttaaatatatcaaagaaaattgagctttagttaaataaaaaaaatatgatcatgaaaacagttgtagatccatcgacaaagggaatagttagtgtagagcctccgttcctcgtcgctggtcgatgaaccataccaccacctcttccgatcccatgcccaccttcttcttctccatgtccgccaccgcctccaccagcatggcctcctccttcaacagcatgaccacctcctccactagcatggcctcctcctacactagcatgaccacctcctccactagcatggcctcctcctacactagcatgagcacctccgacactaacatggactccacctccaccgtgagcgcctccaccaccgcctttggcaaccacggtggtacaattgactaaaagtaaagtgataattagaaggacggcgagtttcgctgcataattggtaacaaagtgtgctcgagtcttcgtgattttcatgctggtaatatcaaacatacacctttatcaaaacaaacaagttctatatcaaaattcaaaacataaacatatatgcgtagttgcgtacactatctttgattcttaaattgctgtttgctaccttaaaacggaaaagaggaatttgttatcgtggggtgagatgctttagaaaagcctctattgtatatatgtgtaggcaatattcaagatttttttgattcttttactttttgttgtgtttaggataagttgtgagtaattctaaaaaatactctttgtatttatttttcctcaaaatatggatttagatattgtgtataattatcattaccctaattaatggaaaagtaagtttcacaaaacctttgtaggttatcattaccctaattaattatcattatatttttgtaggttataaaatccataacaattattgtagcatgtagcaaaaatgaaaacgaaaagcatgatatatcattagaaaaaaaatataattaccatatgctggaattggtatatttagagtttgatgggaaagtttaacctaatcaattcgtcaattcaaaattcaatatagattacattggtgctaaagttttaacacgtgttgcttcatatataacttactatgtttaagatggtaaaaatttataatgtttacaaacacatgctttctcaattattctatacttcatagacgagactagcattttgagattagacaaaagtatcttattatataaaatttggtttcttaaagttacgattagacgtgttttcctatttttatttgaattggatttgattatttttttcattatttaatatatttctattttcacaaaaattccatgaaatgattattctgtttctctttgaaattagtttttttttcaccaaaaaagaaaaatttgaaattagtttactttttaatattaatcatattttcaaaatttatttatttatttcttaagtatgttaacaatttaacgataaagtcatatcatatctacgacataattaaataaaaattggaactgcaactaatacaaaacttaccaaaataataagaaaatgtgcatgcatgattgcatgtgatgtgtgtatataaaacactatttactggtgcgttattgtgaatccatgtcctaacttttatattttgtttgtataaattttttaaatttaatttgtaaatttttggaaatcttattatttgggtttcaataaaattttaacttactttttaaatttgactttcatatatctcattgctttccaatcaaaatttgtcacatgtttttagttatttgacgaagaaagaattgatcgagtataaccctaacccaaattgttattcatttaatttattctaactggtttaaatgttaaataaattatgggatgaattgtttggaataatccatgttcatcaaatttaaattaattgaccaatttatacataaatttctacttcacaaataaaaaagagttaaatatgtctacccatgaacacagaaatatgtttcctcaaaataattaacagactttttctctattggtctttcatataaagctaacactaacagcgttttagacatgaataatacaacgcgttatcgtaacaaatcatgtccgttcatgttgccacgtgtacatcatattgttagattagagggaaatgactcgtcgccttcgtcaacacagaatatataaatctcaaaattctataattcgatattttttcccagaatcaaccagatctgctttcgaagacgaatctagctattagcc

SEQ ID NO: 6508 - DNA, 3000 bp, Unknown
  misc_feature (1)..( 3000): cDNA_ID_1814690_gDNA_ID_1621096_Annot_ID_55667 3000 nt of promoter + ATG
aatcttgaagaaaagagaagacttggctgtaggcaaacttctcgacctgcatattcaacaacaagtaagtttcatattctttaaaacttagcaagagtcatagttgcttcgagaagatcaagtaccttccaaagataagtgaaagtagaagaaggacaagtgtagcaccaacataagcgtaaaacacaaagacataaaagctaaatcctctcaaggtagcagctttatacagtatgctggatccaaccgttgtacactctatagcgatcatcgcagtgaacggaacaacatctcttttaaagtacttccaagaaactgtctcttctctcatgatagattatttgatatcttagaaactctctcacaagttaaagtgagtttagaagcaatcaactccaatacatgattagtgaccacaaaatgtaaaaaatatctctcaacttgactaatactttacaccaaaaggatcatagattcgaatattctagggaccccatgacaatgaactttgccccattctagctttggtttcttcagctaaatcattcattcaactgaagaaaagtttccaattttccatttgaactttcttatccaaagattgagactttatatcttcagagaacaaatcttgggaaggggatagtggattttctcgtcaccttgcagagagattagccccaaattatgaaacctttaatcaatagtaactaacctgaagcaattggagtacaaaaattagactaaagcttcgattttcagtatcatccaatatattagcattaaccttcactaatctccgatatagcagatatgttcagccgtgcgcgacggcgaaacgaaaccagaagctgggtgggtctgagactcttgactctcgagtgtttgaaatctgtgttttttttttccattaaaataataaaaatggttcaaaaaaatatacacaaaacgtctacattatccccaaaaatctaaaagttcctcaattttaatatgagattttctacttgaaagcacaacatttaagaattacatagttatatatatttcattaagaaaatcatttatatcaactagaaataattcaaccaataagaaaaaataatgcagaatattaggaatcataaaacatcaaattgaattaaataaagcatagaaacttggaaacaaaaaaatctaatgaatgagaaaaaattacttcttaatcatgttacataatggagaacagatggactaataatttattttaattagaaaaaaccttttctgtataaacattaaacagtgataaaaaaaacactcgtttaactttctaagataattgaattgagtgggtcaaaaatatcctgaaatattaatctctaaaaatgtcaaaaaaacatatgcaaatataaatatttatatatgttttaaataatttgtaagaaaattgaaccattggttgtaaaaatttgaaaaaacaaatactttgaagatataccaatttttagaaaaacactgaaaaagacttaattattaaaaatatattttcttccattaaatttaatagtcattcacttcattttatcatatatttgatcaaatgatggttatctcacctaattatcatttatcaattatcatcacctaaatgatggtattgcaaaacattggaccggcagtctggcacgcaagcgttggctcacatcttccacgtaattgccacaatttatgagtctttggagttatctaatagttatactctaaccaaaaacatcaccagaaagttcaacagagcatggcacatagccacacactcccataacatttgggtcccttagttaactcgagcatcaatgtatatgacacttccagattcttcggaagttctaagccctctcttttcattctttgaatgcttttttttttactgccatgcgtgcatttccataaatgttacaaatttttgaaaaaatggtctcaagttatataatattcatgcttgcttcgtgaattcctttgtccgattagtaatcaaatgagcgattgaattttttaaaccattttaaactaattaagccccaattaaactttagtatgatttaccccccccccccaaaagtcttaacagtttagatgtaattgtataaattattataagcatgtatcgctaagttaatattataaacttaatcaatagattaagaaaaaatgcattcattatcttcttcttttttctcttcaacattcttttaataacttaacaaaatgatatataaaaatgtatgcaacagtatacaaacaaatttttgtaaatatatagttaaattgtataccacatccctctcctggaacctggctagtcatattcacaccgagcagaaccacaaatacttttaggttcctactccatcaatctcctttatttccttaatatcttaacatgtggaaaacaaaccaagcaacatcattttaccaataagatggagttgaacttaagaaaaagttttttactatttgaaaataaaactatatacatatgacctcataattttggaaactgattcttattcaaaacctaacaacttctagagatcaattttaatggtagccacttatatggtcgttcaaaggaaaaagaacaaccgtggaatggacacattagccaatcataaccacatctatctttcatccactcacgtcactcgtcaaaccaaaatctataaacctccaaaaatacataaaatataaataaaaaaatagatcacataaagtctacgtaactaataagaaccaacaaaaatcaaataaattaggatcagagaagaaatttatagaaccgccatttctactctcgcaaatagctaaccatcaaacaccaatttccatatcacgtaagctatatatatttttattttatacactcctttctctcaacttctttatttttatatacaactcttaaaagtaagtatattatatttatttaagtggtttatgctttatataagaaagaaaatg

SEQ ID NO: 6509 - DNA, 3000 bp, Unknown
  misc_feature (1)..( 3000): cDNA_ID_1814682_gDNA_ID_1621096_Annot_ID_55669 3000 nt of promoter + ATG
caaaacgaatagagaagatctcgagagattggatagttgtgcgaatgcactctgataaaccattctaacaacatacaatcaaacatgttactaacaacatttaggaggaaacaggttcattgatcactcgaatgtcacctctttatcatttccttgtattatcagtgatcaacttcactttttggagaggttcaaccctattccaaaaggtaactgttttcccttcatctcaccatgtatatcatcatctacttcatatgacttctctactgattctagaacactaccataaaaaaacattctcattaacctaccattatatccgttcacattgacatcttccaacacaacaaatttgtatcttcacaatggaaagaataatgaaaattacgagtagaagttgtgttctggaaagaggttcggctcaaatattggcaagacccggtgctagagcggacccaaaaaaattaagggttattggaaaaaaaatattggcctatgattattattaaagaagtgtggtttctaattatagaaatgttacttttaagaaacttggatatttccatatttattttttaaaccaaatttagaattttaaggtatatttcttgattagtggttctgtttttttagataactaagaatatttttaattttttaaatataagtagttttttttttttttttcaacacaactttgctttattaacttgtaccagaataatcagcatgttgtgcttctgctatacaacgagggatgtaaaaatgagaaacatataatcataattagtagctatttgtttttcaaaaaagtagaactttttgtatgaattaaataaagatttttttttggaccatatcgtctagcactcctaacacatgtgttaagtcgggcctgtaggacctatggagctcaattgatcacaaatttctctaaactcacgaagataattaggcaagaattcattttatctcgaatcatttgcaatttacatcaaagttcaagataaagaaactaattattttgtaaagatatcatgtatactcatgtgtgtgttgatagtgatgactgaactttccgaaaaaacgtgagaaattactgtctttctcaaaggttctactttttattttgtaaaccttgaacctttttgtctagaactcacaagactcttataacatgaatgtctttagtttcttataatttgttatcaagctttctgtctaagacagaaaatcttattgtgttctaactttgtgtaaacatatctgtatatttgtgttagaatgagattaaaaaggaaataatggaaccataattatatatgaacccaaattcacttgttttatcgaactaattaataaaatgttgctatcacagtttatttgcaagcatgttttgaaatgtttaactcataacatttttttagggccgactgtgcagtcctcttattgattaattacataatggatctgatgatgcacaaaatggctagatacgtgacgatcaggttttcttgtcatagtcgatatctttcttttttaagaattttttttatccgatcttgtttggacaaaaatcgaaagtttatctttcaagttttgggataattctttaatctttttgcatgacatgtcgtcactatcaaaagatattatttttttttaattgagatatcaattacttcatccatatgaaatcaaattaattctccatgagtaaatattgaagtcaaacttcttgaatattataaaacataaaaacttcacctttaatcattaatctaataacttagtgtcgtgccaatgattaagaggcctacggcaaaaatttaacaaacatagcctctttttaaattaactaaaaactcatatgtataaaatatttaattttgattattattttattgttgttttttaaaacttccattggacaactagaaattactaaatacttttcaaacattagtagagaataagtaaaatactaccatagaaacataaatatacacaaaaatatttccgatttatgtcaaaagcccatgtgattaaaaaaaaaaatgaataaagttttagtggaattgtagctggatatctttggaaaaatgactgttagtgaggtaattttgccaacaacactaacattttcttaaaaatgtggcatcctaaaattaggctataagatgtggcttagggcatttgcccttttcattacagagtaagcacggctctataccattcgtatcttatctttatactaggtagagtttgtactgatattatcgatatagctcaatttcaaacccaaaatatacataagtgatagtttttttgataaaacatatatagcaaagaaagttgtttgacatggtgcaatccctacaagctagctacaattcagcatatttttctaagactttggatttgactagacaaatataaaccagtagactttggtgaatgaataacacgatgaacgccgcttttaagactgtctcagtcaattcggtctttatcttttgcattaatgcgttcaaattaatgtcaaacaattctactttttcacgtacgttgaaagttctttttcttttctttttactgataaaaggctttatagttgaatgttctcgttcgttatttatcacttacacatatattcgttaaatatcactatcacttatatacacatctgataaacttgtgtatatcatgcatcgatttcttcaaaaaaaacaaaaaaagtatggtaggccaaatggtcgtgtgctcgtatccactgaatccatatagatttttcgtcatcactaacgtcacaaaattgcgttgttcaatgtttagttagtggggtttgctctgtttctgtctttgtttaatattattactttcctattttcactgagatcagattttgtctgtcagtataaactctctataaaaccaaacttttgtgttattgtctttcattagtaacaacaacaccaaccaataattaaacaaatg

SEQ ID NO: 6510 - DNA, 3000 bp, Unknown
  misc_feature (1)..( 3000): cDNA_ID_2999793_gDNA_ID_1621096_Annot_ID_55670 3000 nt of promoter + ATG
aaagttcagtcatcactatcaacacacacatgagtatacatgatatctttacaaaataattagtttctttatcttgaactttgatgtaaattgcaaatgattcgagataaaatgaattcttgcctaattatcttcgtgagtttagagaaatttgtgatcaattgagctccataggtcctacaggcccgacttaacacatgtgttaggagtgctagacgatatggtccaaaaaaaaatctttatttaattcatacaaaaagttctacttttttgaaaaacaaatagctactaattatgattatatgtttctcatttttacatccctcgttgtatagcagaagcacaacatgctgattattctggtacaagttaataaagcaaagttgtgttgaaaaaaaaaaaaaaaactacttatatttaaaaaattaaaaatattcttagttatctaaaaaaacagaaccactaatcaagaaatataccttaaaattctaaatttggtttaaaaaataaatatggaaatatccaagtttcttaaaagtaacatttctataattagaaaccacacttctttaataataatcataggccaatattttttttccaataacccttaatttttttgggtccgctctagcaccgggtcttgccaatatttgagccgaacctctttccagaacacaacttctactcgtaattttcattattctttccattgtgaagatacaaatttgttgtgttggaagatgtcaatgtgaacggatataatggtaggttaatgagaatgtttttttatggtagtgttctagaatcagtagagaagtcatatgaagtagatgatgatatacatggtgagatgaagggaaaacagttaccttttggaatagggttgaacctctccaaaaagtgaagttgatcactgataatacaaggaaatgataaagaggtgacattcgagtgatcaatgaacctgtttcctcctaaatgttgttagtaacatgtttgattgtatgttgttagaatggtttatcagagtgcattcgcacaactatccaatctctcgagatcttctctattcgttttgatattttgaactttttgaaaacctctcaatctattgataagacaacttttttatgaaaaaatcaagtttgagaactaggttttgtgtttattgatctagtttacttagtcatattcactaagtcgtcaatatggtatgctttcaacaataacatagtaatttgaatgcctcgtacattttaggcgattttctattacaatgttttggtagagaatacgtatttgtatatttatgatgtatacgtgcatatacattaattgttttgtcggtttattatgatcaaacaatagtttgtctgtcagaagattcaagaaatatctttgaatctgagagtttccaaaaaacgttatgatgaaaatttggcatatacgtatttctgacaagctgataatattgtcatcttgcatttcaagcagtttcgacaaaattttatccaactgttatattcaaactaattgaaaatcgaaaaaccaccattaaaaattagttaaaaataacatatcattttgaaaatgcaatatttaaaaatttaacatatcaatttaacatgcttgttttcttaataagttttgatatattataaaatgaaccgcgtgattacaatttttctttttgtgatggaactgtcgttagttaaacacttaaacttaaactttcatgtaagttttgtttattcatatttgactcaattgaaacccaataatcaagaatgtcaaatattatatgttttgtcggatttgtaacgtgattctcgctcatttaataatgtgataatatcataaaatttaatctatgtagttgtttaatatgatattaaactttattaatgtaataagatcgataatactaagttactaacccaaatcatacacttacgagttacgacactaccgcactatcttggttatattaaatactccttttgtttctaatagtttgatgtttatatcaacattattatttactttcatttgttaccgatagaaagaggagaaaattgttgacaaaaacaaagaaaaaagtaaaattaatattattaaattaataaaaataacaaactgtaaaagctatttttaaaaatttttcttgtaaaacatctaaaaattattcttgtagaaacagaggaatatcattgaagataatagtgtgaaattatatatatatatagaaatatataaagtaggatttttttctgtatacaaatatacgtttccaattttatcaaaaactgtaaagatttttttctttgtcagtacctgctaaacttgttaatttttttattaaaaaaaaatcaaattacaattcttctataatcattttaaattccatttctttataccacaaaagattatattgcctttatcgtctttggtatgtatgcgtgaatatatttatttattttcttttctttcattttctttttaaagaactttataaatgaaataaggaacaaacaatatacacatgtactaacgtatataaataatatcatcaatatctatccaaaacttggatttcatggttgacgtggcccaaccaaaatctcaagttctctgcggatgacgaaccatctcaccatctctttttttctctctcttttttttttttaatatcatcagcacggttacataaaattcgtgatccatgaagttggctttcttgtcgttttacttcatcaccccatttttttaaagtctccatctttatacttcttcaactctccaccaccaccattgtcaccaccacatttaaacacacactttcacttgtagtgggattcgaaagtgcgttttattcatttgttttactgtttttgataacctcaaaatttgcctaaattttattctctataaatccttatatgttttacttacattcctaaagttttcaactttcttgagcttcaaaaagtacctcca

SEQ ID NO: 6511 - DNA, 3000 bp, Unknown
  misc_feature (1)..( 3000): cDNA_ID_3090439_gDNA_ID_1621096_Annot_ID_55673 3000 nt of promoter + ATG
acttttatgcatgaatgaaaaatgataactaaagatacgtgaaagatttgtctaaacagattgttgctctatttgtaaattaacaacaagaaaaaagtaagatacgtatggccattggccattactatttaaaattcgcctaaaaaggaagttcacaaaaaagtattaaaaataaaataaggcagctgtcctgaataaacgaagatcgttgccttgaatattgaaagtgtatatgataaggcaatgatcacgacagcgatgatgattgattttgtcttgcattcattttgtcaaagtcttttgtcctccaaaagttcaagcagatgtgcttctttttctataactatacgtgtttataattttatatacacattgtcaatatgtgtattaatgcgtatttagagttttctacgggtgaatcttgaaattttttattactttcatattgtgcaagttgcgacatctgaaagcagcagctgaataatgaaaatatagttcagaaaccataaaatatggtgattttgatatttgccttcaatatcaaagcttttactaattaaaaaatatatagtgatcgaaaattcacttaataaaatacagttttattttatacctcataattttattttctggtactatagtgatcatctatgaaatacaaaatcataaatcttaataatttaataaaatactattattataaacttacgtacacaattaagcataaaattacatctcttaagtcttaattaacataattaaatataaactacttaacataaaattatagaaataaattaattttaaaatctgtatttttaaaataatatatcaatgtattaactaaattaaagcagggaaatcaatgtgttaatgggaagccctagccgccacgggggattgcgatctgagattcgagatgaggagatagaggaggatggtcagccgccaggattgcagagggtggatatcaaatcctttgtggagactgttcggggtagtggtggtgggggagttccggtgccggagagtgtgttagatgatgattttgtgaggtcacggatgcgattggaatttccagatggggttgacggcgaacctgtaatcacaatcgagaaagaagttttggatgctatgaacgggttgtacaagcagtgtatgttggtgaaaatcctgggtcgtcacaccacaattgaagtgttgtctcggaagcttcgggatctatggagaccaacgggagggatgtcagtgttggatctcccgcgacagttcttcatggttagattcgaggtggaggaagactacatgatggcattgacgggtggtccgtggagagttttgggcagcattctaatggtccaagcttggtcaccggagtttaatccattgagagatgtgatagagacgactccggtttgggtgcgagtagcgaatttgccagttactttctatcataatgaaattctgctgggaattgcagcaggattggggaagcctattaaagtggacttgacgactttgcggaaggaacgaggcaggtttgctcgtgtgtgtgttgaagtgaatctcaagaatccacttaaaggaacactagtagttaacggagaaaggtactttgtgtcttatgaggggttgcagactatttgttcgttatgtggtatctatggtcacacagtgaacaactgcccaatggggagaacaactcaagggtcgcagaggagtgaacagggaatggaaatagtgagtagtgcgtctacacagaaccaagatgggtttacagaggttagaagggcacgcaacagaacgcagggtccaaagcttgttttttctgctggaggatcgttagataaaccgaatgtggagaggttgcagaatgaagggtcaacaccactggcggtagcgaatagttttggtgggcttgcggagttgactgatagggtggaggttgatcgtcaggtaggtgtgggggaggtggataaggagaatgtgaggccacagaatgggggtaatcagaatcgcagtggggagcagagcttggtaatacagaaaaataggaagggggctcctgcaacaggtggtgtgcggacagtggagttggataagagagttggaggaagtaaattagggaagcactatgttgcaagaggtaggatctctaagtctttggctccgggacgtggtttggtgtatggtccaacgcgaggggatttaggtggagtatcccctggcaaacgcttgagagtggaacatgttagtgtgggaagagacggtggtgtcttcacgaatggtagcgagcccagtgtaggggctagcttactgcaggtgaatgatcctccgagttctttgggggacggggtctcagcagaaggtaccacattgatggaggtcgctcttccggagttgactgggactcctattgatggggatggggctaaataatatttttccccggcagtttttcgtgttattcatatctttatgatgaattgtctattgtggaattgccgggggccgaataaacccatttttagaagatccataagatacgtgttgaagaaatttgatacagatgtgctggctttatttgaaacgcatgctggtggagacagagcgggaaggatctgtcaacggttggggttcgagaatcagtttagagttgatgcagttgggcagagtagtggtttgtggttgttgtggaggtcttcagttgggaatgtggagattgtgtcctcaacgtctcaatttatccatgcgaagattttgactgggttggagagtgtgcatttggtggtagtttatgctgctccatcagttagtcgccgcagtggtttgtggaatgaattacgggaagctgtgagtgggttagatgggccattgatcattggtggtgactttaatactatcttacgggtggatgagagaacatgaggtaatgggcagttgtcttctgactctttggcatttggagagtggataaatgatctctctctgatagacatg

SEQ ID NO: 6512 - DNA, 3000 bp, Unknown
  misc_feature (1)..( 3000): cDNA_ID_1842138_gDNA_ID_1621096_Annot_ID_55676 3000 nt of promoter + ATG
aaataattgggattaataaattttagtgaaaatgattcgttagccatttgaccgttgacagctggtatctgttacgtcacaatttttgtaatcatatctttgtttattagatttaagattatatcttagtgtagccgtagcctcaagagaacccataatttaagattatccaataaaattatcaatttacttacgtattacgtatctttgagtctaggtgtcctgcatgacgggctattattttagcttatgattgcgtgtaagaaactctaatagctaaattcagaatcttagatattataatcgcaatgatatgtgttatccaacgaccttattagtatcccatttgtttggaacagttttgacaactcattaaagtaacaaaatcaatgaaaaaaacaaaacaatgatattttcttgtgaacaaatatgggtaatgcaaaagattgacttttattgaaactcctaaaaaaagaaataaaagatgtgatggaaaacaagtatacggtctcgtagccccatgcatgcctgtcccaagacattataagactttatacggcctctatctaccgttatacgtctgtctcaactaattattaggagaagcaataattcataaagatattaaagctttactaaattgaaagttctactgatatattacactgaaagtgtaatgttggcaaacaaataaatggggtgcttgttagattttactgttttagatgtatatattggtagtctatctccatttacaaatcaaaattacaacttttgttttacacaatacaatttgttgttgttattgtttgccttgggttatatgaacccatgcattagtttggaagagatcacatattcacatgacgaaaaacatttttccgaattaccttcaaattgttcataatttattttggttttcgatcgtctttacaaacaataaaaactttcataaattgtgttaaaagtaaagttgtacttaggtttaatattgtatttttcttaaccataaagtttaggccaaaacatcatgtctcgtggagggatcgaaacagatacaatttcaactaaatttgtgatctatcttttaaatcattttctttatccgtattatcatttatgtagagaaatatgttaagcatttataaaacattttactaattgagaataaaaatccttagaaataaatttggaaaaatgatttttgctcttattttttggagcgataatccggttatttaaaacatggtcaacttctgactttttgcttttgctctaccaaaagatttgccaaagtcgataaagaattatttattgctccggttactttttagtttttggtccattcattttgatcaagtcaagtttatgaacaaaagtaaatgactcgtaaaattcttcacaatttttctttttcaacagttactatatcgtaacgtatttgtttataatgtgaatatatcaatattattattacatacaactcttgtataaattagtatgtgtcgccatttgtaatagacacgagttcgagttggtgtatacataatcgtatggtatgtgaagatgactgccgtaaaattatttctcttaaattgagtatttccaaaacactgctgtcagtacccacacttgccaacggccattgttgcattaagtatcgcaatgcactgatttatgaccttcaatgatctccctactacacaaactaccaatttttactctaggttgcatgctttggcattcgtcaagttttgctctctatttcgtaatcgagataagtaaatttgatgtttgttttttatatttcttattgacatttctataactaatttagtaatttaacatttatgtacacgagtttttttaatactaaaaatattgtttacaaatatagtttggtcatatgtgagatcctcaactggttgattaggtgctccaagatattgattaatcgtatgagattagtttttggaggcttgagtttgaaagtatttctctccacaaccgggagtttgagataattagtttggttgaactgagaaaataaggttaaaatgatgatctaaaattggatttgaacaataggataattatgtttagttgagttatttaaattgatgtattagattgttgttggttcataactcttactattatgtgatgtttaatatttcaattcatactcatcacatccgtttttttttggttaattgtaaaatattttgcatttccgattttatgcaacttagttttattttctgttctctatttagtttaagttgttatgtatatttttatgaaaacaatgttttaaacttaatctagccatttgtttaaacgaaatcgaattatacgtaagattagactcgcgtagatctggttactttttctaatggttgatgcctatagttaaagagattattattttgattagaattcaatattagtagtttagcactcatttcgttatggatcttatataatgacaaaagtattattattattattattattttttttttttttgaaaacaacaatattattattaccaccgatcgtttttacacaatatgctaaaaaacaagacactttgccaaatttggaaccattttttgtattcgagtcaaatcactctaaaatgacaatgaagatgtggcctccgaaatttctacttttagagactattctttcttattgtgctttataccagtcaatgaaatgttttcacactttgcgatccgtatgtatccataatagcgttttgtttcataagctaatatctctttagtgtgccacataaactaaaagccacgtagacatcatttagtgacgtattctctttttgtcttattatccgagtaagcgtattcaatatatatacatgtctcttctcacatctagagcatgagaagcttaggggaaaacgatcaatctttgttatctctcactcttcctcttcttattttgatcttcctcacttctgtttgattcctaata

SEQ ID NO: 6513 - DNA, 3000 bp, Unknown
  misc_feature (1)..( 3000): cDNA_ID_2993904_gDNA_ID_1621096_Annot_ID_55678 3000 nt of promoter + ATG
gccgtgatatcatcattgtccgtggctgcgatatcgtcattttccgtggctgcgatatcgtcattttccgtggctgcgatatcgtcattttccgtggctgcgatttcgtcagtttccgtggtcggaatttcttgtgcttctaattccgttgttactggagtatgtacctccggtattggttcttcaacctcagaagatgcaatttcggtatcaacatcaccatctttttcatcctctacacttttctcttctaccaccgtatcaatatcaattttttctgctaccaaacccaaaaatttacgtcaatatttctatacaacgtgcctcacaagaaaaagttcgagaagttatataacacgtaaattgggtgtatagttttgaatttgtaacaaagatcatataaaaagtccacaattccaacgtatgattgttattgaaaaaaaaaaaatcaacatcaaatatgaagaaatcatcacaaatatataaacatgtaaaatttaccatttaattaaattaaatttaatatttgcatacccttttgttcttcaaccggcgaaacactctcatttacgtcgttgacggtctcctccgtcacaatattctccggcactatcgcctccaccgccgtgaccggaggaaaactggctgccgtctctttttcctccggttgtttgtcaccattcgcattgtctaccgccatctcctcactacaatctcctccatcttccttttcctccggtttcttgctattgttttctacggttgtctccggctggtcgccgggaactacggcggaaacgtcgtttgtttcctggcaccggcagctttcttgtcttttaattgcttcgctatcttttcccttcactgattcagcttccgaaggtttcttgatcctcgtggtgtttcccgtaacaacatcgtgttttgattttccacaacccatcttttaatttctctaataaaactcaattctttttctacaataacctcgtttttgcttgctttaaattgatttttttttgtgaaaataaaaaatcaaagtgttaatggaaaaaagatgaatcttttgatggatttttattgaaggagattcaataaaacgataaaccaattccagttcttatttatttttgcgttgtgattcacttttgttagaaaaaggttctttttcgttattgttattgtttggtgttccaacttccaaatttaagggtgacaccattattttcaataaacaaattaaaattaaaccatttagtttttattaatagaatagaaaggttatacgtttagttactaaaattatttaggaaaaaatagaaaaaaatagaaatgttctaaattaatgaactgtttgttaatacaaagaaaattgaaacaaaaattggtccaaatggtgagtgaactcacatcatttgaatgcagttactggaagagaatttaatcggaacaaaaaaaagaagcagaaaaaaatatggatataccattatcaaattaaaagtaacggtgtaaattagttaattaataatatatatagggacttctatttgcaaatagtgcattgttaaaggtctaaattctaaaaacataaaccctaaatctttgattccggcgtctagccatcgtccttctcctctcaatcgcgcgactctactctactctactctactcaaaaccaatcaaaaacccaactttgaatcacaaccagtagaatcacgagtcatgcaattcctccagaactctcgtagaatcgctacggtcttaaaacccattgttaccaccgagactaatctgagattcttctcctctgcttctcaaatctcaagatccttccaatggcggagtcaagcatcttcgtcttcctctgtattaaaaggttcttttttttgccatttcacagttcctattgcgaaattaatcatccccatctttggaaatggagattttttttgtcctacgcgagataacttaacttgtgtaacgttaggaaatgtagctagtgaaggtgatgatcctgaaaaattcgaactttagtgttccaattttagcttgtgtcgagatacgtacttatctttcaatgcctagcttaggatcaatgtaagtgtgtaaatgaattagctttatgtcattggtgtgagttattaatataatgatgtgttgcagggattgatagtagtagtcacttgtcctctatgagcttgttgatccccagatcgagctttacgtctgaagcggaaaagcttgcgggaaatcctacaggttgcttataccttgctttgattttgaattacattttgagatcaccaaagcggtttctcattgtgtttcctctgtgtagtgactgtgaaggatttgcatgataaaatgcttaattctgtaaatgtcaagagatcaatgcctccaaatgcgtggttgtggctgttgattgagaactgtcagaatcaggatgatattcatcttctctttgacgttcttcagaatctacggagatttgtgagtactatattgccctctctatttacatgctctgttctgtttcagttgagatttcttatgatcaatcaattcttacaaatttttgtttctggattgcagagattatctaatcttcgtattcatgacaacttcaattgcaatctatgccaacaagttgctaagacttgtgtacgtgttggggctattgactctggtactcccaattttgattttgtgtagttttttttttcttaatccaatcgaacaagctgttaaatatcctttctatagctgttacatggatctgagggtactaatgcagttctttgtggttgtaggaaagaaggctttgtggaaacataatgttcacggtttgactcccagtgttgcatctgcacaccatcttatggtattggatatctatatgttttttcggttgtttctttgttaaacatagacgtttaagtcatgttctggattgtcatgtagtcatatgcactagagcacaagaattctgaactcatg

SEQ ID NO: 6514 - DNA, 3000 bp, Unknown
  misc_feature (1)..( 3000): cDNA_ID_1814775_gDNA_ID_1621096_Annot_ID_55685 3000 nt of promoter + ATG
tctcgtagaaaaaggcaacgtaataagaaaggttacgtactttagaaagctatatataaaggaccttacccacttcactccatcaaacacaaaaacacagagtcacttctcattttcacccaaatatatcaataatctctctataagttatctagttttcccatattcatctctaatctagcattttgaccaaacacacctatttttctcctttgcaagacagttttcaaatatctatcacgttatattactaatggagaatctacaaaagatgatctccgagaagtcggtagtgatctttagcaagaactcttgctgcatgtctcacacaatcaagactctcttcttagaccttggcgtgaacccgacgatctatgaactcgatgagattagcagaggaaaggagatagagcatgcattggctcagctcgggtgcagcccgacagtgccagtggtgttcataggagggcagcttgttggtggagccaatcaagtcatgagtctccatctcaaccgctcccttgttccaatgcttaagcgcgctggagctttatggctttgacttcaaaataaatggaattgcaaatgacttaggttctgagaaacttattaatgtgaacaaaaaaaggtaaaaaaaacatatacaaaaatgtatgtatgagtttattactatatatgtctatctatctaagttttcaaaagatagattatgcggttacctattttgtaaacatgcatctaagagatatttatattttataataaaaatcagcaacatttggatttctcctttttcccaattcatatttatataattttgtatacatatatgcatctagaaatgaatacacgtgcactgaatatagatgattttttatggtgtaaaggaaaaaagaaagaatatataactatttatgcagaacatgcgccaagacataataattaatttaaaaatttgaagaaggcatattttataggctaagaatattgtatttgtatctgccacaaattaaaaagcgatgacgagtctgaatcgtgtgtaatgtcaagccttaacttttcaaacgaaattcttacaatgatatgcaactgttaataaatgttaggcgtgattgtcaactgaattagctagttacaacttacaagtgtaaaaatacaggagattgcgtaaatttgagatatggatcttagaacaactctataatcaattaaagaaatttagaattaaggtaaatcaatcattaaattcttcactgtctatctacagaaacattgttgaacatcatgataaaaaatgacgtttctaaccattaaaataacaaagtgtgtaaggaattggattctgccatataaggaaaatctttgcattgttacatatattccaataataggacagtacgagccagttgcggaacttgatgcgaataggcatcttacatacatataatgtgtcggtacgtgaatcacgtaatgttcaaatgatgataaccttgtattgtgatataagaataacggctcttgagatcaaaattgggccaccaataatcttttaggaaggaaggaatgcaaaactatggctttaaaattttgttgagccccacgtggctgcttcactaatcaatcttcttggccacaagcttgagatttcagaatttcgtggaattgaggataaagctctctttgattcttgattcttaacattgtaagattcgatttcattcatgacgataaggctagaacggaaccacatagttttcctttccctctcaagtggtcatacaagaatattataattcttgagatgcattatatcttgcgatttcgagttttcgcaaattaaagaatgagaggagctagaaactttttatggcatatctaaaactatgtcaaagggacatgacatacatatgaaattctatttctttatagtatatacatatgaaataaaaagttttcatgatattacgtatcccatttatgagatatggaagttaatcaagaattggttacttctcatctcaggttttcttgttaagtcttttctttttgttctcgattccttgtcttatctcatgtaaccttaatccttcactcaagttataaggtgacttagatgaccaaagacatgtgatttacataactgaattgtcttttgttaatgttctatagtaactagttttattacaaatagcacattgtttgtcaacacatggaatttaccaccccgagtctttagaacaatatggaaactgcaaattcatgcggttcttattgtgggcttcgacgatgtggacaaattcaaaaactattattgtttgctcgatcattcatgtaaaccaggtgacaagctgacctaattctatcatttttagttatatggctaacatatataaacttggactttttaggacatgagttgggagatgtagaatcctggtatttactttaactcagtatttatgatgatggtttttctaatttcagtttgagttaaatttttatttcggttgatgcggcttcaagacacggagaagtctatgagagacaagacatatcttcaattttctttaatttaataaagtgttattttattattttgttttgaagtggtttaggatcagtttagatcgtaaaccgattaaattaattaatttatgtgtattttgaggtcttgattcgggggtatctaactttaggacatagtattattgactttattatgtgggcattatgtgatacttctatcatgtgaaaatagatcgtgtctttttgttttattttgtggattgttttggttttgttaaattgatcggataatttgggtttggtaggagtttctggttcgaaaaccaaacacgatccgaattctaatagaaccgaaccgatctattccgacggttcataataaaacggacccgtcgagttctactcgctacaaacacacaaaaagctccgcaagagaaaaagaaaaacaagaaaagggggatctagggtttgaga

SEQ ID NO: 6515 - DNA, 3000 bp, Unknown
  misc_feature (1)..( 3000): cDNA_ID_1814767_gDNA_ID_1621096_Annot_ID_55687 3000 nt of promoter + ATG
gtattaatagtataattgatacaactcagttatacgggacaaatggtacaaaatggtggaagtttaagcgatttgtatttctaaaccctaaagctatcatatttaatggcatcgtcgtcgccgtcgattttgtgaaccgtcttctccaagcgtcgtcgtcgccgccaattctgtgaacgtcttctccaagcgtcgttgctgccgattctgtgaaccgtcttctccaagcgtcgtcgccgccgattttgtgaaccgtcttctccaagcgtcgtcgtcgccgccaattctgtgaacgtcttctcttttccttcggttatgcataaactgattttgcagagatctagtttggagatatctagggttcgttgagaagaaagaagagatctaggttttgttagattgcagagaaagaagaagagatcgaagaaagagaatagaaatccatgaaaaagaagaagatagatagatccatggagaagaagaagaaagatttctggaaaattgattttgagagaaaagagacaaagtctaaaagaataaagaggagaaacgtgaaagagaaaaaaaagaggcagtgttttattttaagttggcaaagaaagaagtggcaggcatacgttatatatggattaggttaagggtttttggatttttcatataaattttgatttaaaataaactaaaattaaaataaaaaacgtggaagggtatgaatgaacaattttattgagttagtggcattagtgataaaattccgaccaattatattcaactgtatttatatatagactaaccaatctttaaactctgatgcttgtagcagaaacttcgcactcacatgcagccctgctatcacaagcgacaaccggacaaatcattattggggtttaattgtggtttcaaaaaagtaaggtgaaattggaagaaaataaaaaaagtttagtctatagaaaaaactatttaaagttcaaacttatgcattaaagtttaatcaattataataaaataaatttagcaaaagaaaaaaaaaagcaagatcaaaatcttagatgaagatagtaataaaatatcaaagaattaaattcgtagaaagaaaagagaatatgaaagttatattaactcgtagaagaaaaagagaatatgaaaattatattaaatttgtagaagaaaaagagtggtatcatgcaaccaatctgcacaatttgcaatccgaaaatggatttggtaacaacttacgactagcctttttgacatttgtaaacgtagttaatgcacttaactacaatacaaccattttaaactagaattttttttttatgattacacatatatagaactgtttatccaatttagacatggtctacaacgagctagagttttattagaaacaattgtatatgtgatattgactataagtatatgagttaaagatcggattagtgccctactactgtatatatagaactagattttgactcgcggtataccgcggggctaggtttttaataaaatttgttatataaaatgtatatgtaaatatttgttttattaatattgtttgctttgtttagtgtttaagataatgtatatatagattttagttgttatatctaggatttcatccgtagtatatcgtttcgtattattatcgatcaaaactcgtcataccatctaatcctgcacattgaaattaaacatatctaatagatttcacttgtggtataccgtctcgtaatactatcgaccaaacccgtcctaccactaaccccgttcagtaaaattagacattattttgttatttttgttttaataatactttagtttaaaaaatattaattcaaatcaatttaaaagttttttttcaaatggttatttaattattataaagtttatatattataatattataaacacgtcctaccatctattcctactatctaatcatgttcggtgaaattatttttctatttttttaataatatttttattaaaagatttataatttaaatcaatttaaagttttctttcaaatggttatttaatttttaaatattttaaccattttggcaaaaataattaggccatgaaataaaagcatattcttttgaataagatttgctttgatttggtagttaatttttgcatttaataagtcagtggcagccattgtaaataagttccaattgcaggatttatttcataaaatgactacaaaaatgtatatatagattagatagtgtttagagtaatacatataacaagttatattttattaaatacataaatatatacataataataaaagtgtggtatcatgcaacctatttagcgaacttaggaacaaaatccacaattcgttattgtcatgaattcgtatctctcatttctaaactgttaagcaatatccgataaaatctaagaaatataaggggcaaaatgtaaattatttctcaagcattaataaatgagagatacgaattatagaaaaattaaagttgtttataattaattaattaatgattaaaccataaacgaaaggaaccctccaaaactaaacactcttcaacacatagcgtcttgtctgcaaaaaaaatcggagacgcaaaaccaacttgccgccgaatcttccttaaaccctcaacgctgctcttcgccgccgttgagacgatcacagtgatcgaatcttccttttcaactttctcgtcttttgatcaaacgagtttggttgagtttttgataaacgtgattaagcgattaatttcgcgttttaacaacaatctagattgtcctttggagattgaacaaatttagggtttttggggataatctaagtgtttatgatttgaaactttgtgtgttttgagattgttttgggcaatgttggattttcgagacggtttggtggcggcagagttagtgagtgttggggtttaggaagtagtagtagttattagggtttggaattgggttatgtttagggttttactagtttagaagatg

SEQ ID NO: 6516 - DNA, 3000 bp, Unknown
  misc_feature (1)..( 3000): cDNA_ID_1030500_gDNA_ID_1621096_Annot_ID_55689 3000 nt of promoter + ATG
atgtcaagctctcatcacagttatggcgaatctaactctagagctaaacatcaactccgcaagaaaccttttaaatgtcaatctcatcactaaaatgaacgttttcactgccatcaccatcaacggcgagaatactcgaaagaaacaaaaggcgaaaaccacggttgatcgttatggtggatctaacccgacttggaatcaaaccatcaaattttccgtggacgagaggtcagcccgtggtggtcattcgtcacttgtcatgagagtaatctctcgtcgagtcctaggcaacaaagaaatcggaagagttaacatcccgttacttgagctcttgaatgcaaccacaccatcatttaacggtgatggtaacgatcatgagatgaaactgatgtcgtatcaggtgagaacttcgtcgggtaaacggtcaggttctttgtctttctcgtaccggtttaaaccaaatgttccagtgatcactaaccggagttgtgtagactccgcggcaccatctcaaatcgagcatgcaccttcggctccacccgaattgccaattgagtttcctaagctgcctcagccgccgtatcttttgagacatcctttcgccgccggttctagccgtggtcttcttccaatatcatatggcgctgggatgaccgagcaaaccggtcacgctaataactatgcgcaaaccggtcacgctaacaactatgcgccaccaccgagacaaggatatggaccgtacggttatgtgtcgtcgggatatggatacggaagtccctcgtatcaacaacgtaaggagatggggattgggcttggattgggagccggactttttggtggattaatggtgggagacattgtgtctgatgttgcaaattgttatgatctttgaattttatttcattttgttatctctaaacatttcctttcccatatttacatgaacttatcatagggatgttgttttctagatctataaaactttttgttgtatgaatcaaataaataatgggaaagagtttaggtaaaacatggtaaatggcaaacaaaataaaaaataaaaaatttggtgtcaactgtcaagtatcaaaatcaacaaaactcatcatcaagcaaggccaaaacatccatatctcaagttccatatataataaacaaactcaccgaacacatttctcacaatcccaaatcaaaacttgttgtgtaaatgatccttgtgtatataatctgaatttctcttgaaactaagtctatatatttccgtgtatataatccaatacatgcacttttgtatattgtacatgcatccaaatcttcaatttttaaatttatctataaattaatgcattggattttatgtttttttcattcatgaatgtcaaaaaatttctttctttttttgactcactaatattttcttcctttttttcaataatcagtcaaaatttcaataatcactaatatttttttcctttttttcaataatcagtcaaaatttatcgataatttcttttcagcattgtcattaatcagttagtgccttagtgaaatgaaaaatgttgttcatcaatgatggacaatttgaattttttgttatttgataatgaatctaattatagtaaatcaataactgatgcattttccatttgacattcagttattgaaaaagtgaatttaaaacttatataccacatcgtatcagagccttaatcaaaatttttatgggtctcctatgggttaacattatttttatgaaagtaaattataattcttccctaaaaacttatgtattttttagtttcatcaaacttatcatgatttcagatcacgtctctcttttgttttttggcggaaaataaaaaaatgttaacccataagaatttggatcaagactttgataccatgatacatttgatgagagtaaataacacaaaatatttatatgaagaaattataatagactctcataaaaatagtgttacaacttacattctcttatatagaaattaggataaacagaaatgtaaataatatatttcgaaataatgttaaatttcctaaattctaatattaatatttataaatggtcatttaactttttcgtaccggttcgatgggacatgtgttatattcagttaaggttaccaccatgcgccaacttggcctctaccaagtcaacatggatatggaccttatggttacatgccgcctccgcctccaccgctaccgggatatggatacagaggtccgccacctcagcaaccgacgaggaatgaaacaaggcaataatatattgatgctattgtggatttagttactgataattagtgccttagtgacagttcaaaaatgttgttcatcaataatctacaatttaaggtttgtgttgtggaatgtttcatgattttatgaagtcttgcttatcaaaaagtatgatgattaagaatttgacttcatggcatattcatttgagttagcaaaacttttttgtgttgcaccttcaaatttataaatttatgatttttaaccatcgaaattatatatttgaaaagactatctctacaagccaaacccactgggccaccaatatgggtttatctgcgaaatctgtgaaccttagaaaatcaaagcccatatccactttgctggaactttgctggaatgtaggttagacaaaaccttaagacgcagctacaagtctcttatgtggcagatgtcaaaattaatgagcacgtataatttacccaagaggagcaaaataagattagcagcttaaattaattgtgttggattaaatgaaacttgcactatgaatggcaaaaaagaggttacaatctagcaaccacctcataaaccctcattaatgagatactgactcgtgaaccaatcaaatctcaagtttcgtagtttaaataagtagtaaacacctcctgatcaaagcatcaccaccaccaaatatcaaacgcaaaaacctattatcaaaagaactagggagaaatg

SEQ ID NO: 6517 - DNA, 3000 bp, Unknown; identical to SEQ ID NO: 6516
  misc_feature (1)..( 3000): cDNA_ID_1030500_gDNA_ID_1621096_Annot_ID_171036 3000 nt of promoter + ATG

SEQ ID NO: 6518 - DNA, 3000 bp, Unknown; identical to SEQ ID NO: 6515
  misc_feature (1)..( 3000): cDNA_ID_2173556_gDNA_ID_1621096_Annot_ID_171031 3000 nt of promoter + ATG

SEQ ID NO: 6519 - DNA, 3000 bp, Unknown; identical to SEQ ID NO: 6512
  misc_feature (1)..( 3000): cDNA_ID_1842138_gDNA_ID_1621096_Annot_ID_171017 3000 nt of promoter + ATG

SEQ ID NO: 6520 - DNA, 3000 bp, Unknown
  misc_feature (1)..( 3000): cDNA_ID_3090439_gDNA_ID_1621096_Annot_ID_171014 3000 nt of promoter + ATG
aatggcaagatttagcaagagaaccgcagagcaggaatgcttcttgaaagcagatacggtgacaaatgtagatacaatgctgtaaaagcatgccacggataatgctaccacaaagtatctacacattagcaaacgaaaaaagtggatttagttaattaaatactacataaattaaaagatttatacgatatttaaatcatctgatacaaagatgttttttaaaataggttgacaaaaaagaaagaaagaagctgctttatcattatcactgaacatttactataattttgagtctttttcgttaactaaagttcgccaacttacttttgactttccacaacctttgtttcgaaattccaactactcccacacgtaaataaacaattcatataagatcggcgatttgtatgtataaattttacttgttaagtatatgtttaaacatttacgtgatactacatcctcttttccatatacatgaccaaaatcctcttggtttctcaaaattaaatatatatttttgtatacatgaaaaaatccacgctctgaccagattttcaatggtccatacatgtgaccgatcaagcgatcattgtattacactatcctaatttgacatgacttcttctaagttaggattaagatatggtttaagacccgtgtttgataaaacaacctctattacttctccaaacaacacaacaacccataattatattgtctacttagtttgactatatatgagatatacaaatcacatatgaactctggcccttagtcacatttactaaagatgatcaatcaaattcgagaaaataaaagaaaatattaattaatgaattattaggatgaacttacataagagccggtgagttggtgaactctgcagcaggaatacgaatgggagttccaggaaggaatatattcttggtctgtttacttgtaaccattaccactattgatgtcaaagtggctgcaaacagaacaaatcttaggacaacttgagtcatcgaacaactcttcgtcgtggtgccggttcctggcgcggtcgatctctcggtgtccaaagtcgatttggtttcataacccatagcttaatcttgaattgttataggaaaagtgaaatgaatttttcgttatggggaggtggtgaaatttttggtacgttgagagggggttttatattgtggctttgtgtgtgttagcaagaagtaattgagttttttttattgctataataatgtttattactattataatattaggtcgtgggactaatttggtgggtgttttggacacgccagagatatttgaaaattcataaagagtcaatatgttcatatatatccgtaagactcatcttctggcattctcatcttttattggtcttatggtggctgttaatgtgaaactacgctaaaatatcgtctgtgtgtgagtgtgtgtgcgtaaattcatgttgccgatattagacaaaataaaaaaggaacagtcgtaacctatctacgtgtatacgatagaccagagttgacattttaattaaaattatttccttcctttattatgagatatatcgttaattatatgccatttcataaaacgcctaatacatttaccgcaaaaaaaaagaagagttacattaagtatccacaatttgacatattttcgtgtatttcgtatcttcaccaccaaaggtaaatgtgacttagttgatattggtttatggtctagaataacaaaacaccacaaattactaaaaatcaaaacaatttttttatctgacctaattaattaagccgatatttttttttatgaaaggcagtttaattgagatcagactagatttttgatgttttgttttcaaatgtaagaaaaattacgaataatatatacaggacaccagattaaataatattacaaactaatgaactaatgataaaaatgagtagaaaataaaataaaaacttgaaatggaccaattccaacctcggagtctctcggtaagtcggtttcacgtaattaataaacaaaattataatgttgatgattcggttacatatatcagattataggtcgtttaatccacttaaataaagataagtgagcttgcaataattgaggaacacttttatgcatgaatgaaaaatgataactaaagatacgtgaaagatttgtctaaacagattgttgctctatttgtaaattaacaacaagaaaaaagtaagatacgtatggccattggccattactatttaaaattcgcctaaaaaggaagttcacaaaaaagtattaaaaataaaataaggcagctgtcctgaataaacgaagatcgttgccttgaatattgaaagtgtatatgataaggcaatgatcacgacagcgatgatgattgattttgtcttgcattcattttgtcaaagtcttttgtcctccaaaagttcaagcagatgtgcttctttttctataactatacgtgtttataattttatatacacattgtcaatatgtgtattaatgcgtatttagagttttctacgggtgaatcttgaaattttttattactttcatattgtgcaagttgcgacatctgaaagcagcagctgaataatgaaaatatagttcagaaaccataaaatatggtgattttgatatttgccttcaatatcaaagcttttactaattaaaaaatatatagtgatcgaaaattcacttaataaaatacagttttattttatacctcataattttattttctggtactatagtgatcatctatgaaatacaaaatcataaatcttaataatttaataaaatactattattataaacttacgtacacaattaagcataaaattacatctcttaagtcttaattaacataattaaatataaactacttaacataaaattatagaaataaattaattttaaaatctgtatttttaaaataatatatcaatgtattaactaaattaaagcagggaaatcaatgtgttaatg

SEQ ID NO: 6521 - DNA, 3000 bp, Unknown
  misc_feature (1)..( 3000): cDNA_ID_3090447_gDNA_ID_1621096_Annot_ID_171012 3000 nt of promoter + ATG
ggcacacaaaaagttcatgtatgtttacgaaaaccaagaggttgttagtatatttttttttatggaatttctctaagatcttaatattctttgttagtttctttaacaaaaaaatatatattctttgttagtgtgagtctataagtattaagtagtcttggaataactcttttgtaaagctcttcatatatgttttgtaaagaaatatttctatgcttttaagcactcttcaaggtatagaactagaagttttgacagttttataaaaagtcaatggcttaataagttaatattgacagtattatcaaaagtcaatgctatatgtaattagcttatttgttagttctaaacgcgttatgtcataatttattattaaaaagtgatcaacgttgggcatttggtctagtgatcaaaattttgcagatgctgcaattaacaagtctcaataactgagttttctaagtgattatctttctctcaggcatatcatcgaacaacttacaggcatccaccaaagtctaccaaagaagagctttttcttggttatcctctggagaagatgagttcttatgagattgggcatataaatctgatctgggcacaagccgtcttcgaagttcatggcctacagagaaagaagaaataaccaaaaattgacgtttttgtctgttcggttaattttgtctctttttgttgtttgagtcaacatcaacaaggtatattttttatgtggtgagtcattgtcattgtcatcatcatcatcatcagcagcagcagcagctccttcacattgtaaatagtcatacggtaacgtgttctctctagaaaccaaagacatcaaaggaaaatttagaattgataaaaaaaaaatatggatacaattcgatttttttcttgtagctctctccctcaagacataatcctgaagatcggctcttctcttcaggtttttgcttgtattttttttactaattcttcagttttttttttattgtgatgctacttcttggtaaattgtgtgctatttgatgaataggtgattgatctttgtgcattaagtagctgttctacgttttggagagagttatgtggttctgatatcttatgggaacctctgtttaggcaaagatggcctttattgtcctcatttgaatctgatggagacaatactctgtttctttaaacccaaaccaatgaaaattctcaggtagaaatgagacagttccatggattcttgtttctttcaaattcaagtttctgagttgttttagattttggccatttttgtaggatagtgagtttgtttgttgttgaattgaattctatttatgatgaattggttctcattagatggatgatgtttgattgacatggtagagaacaattgtttagttgagatatttaacaattgttctgtcttggagaaacaaattactgaggcatattgaaggtgatgtgattcttgatattatctgctttaattgtggatagttggattatagaaagcttgagacttttttcttgaagaggtgatagttggaattggacatggtcatcataatcgtttatatatctcaacttgcagttagactttgcttgtttataatttgttgttgtggcagagactaaaattctttgttgttgcgttagcattactttgaggtctattacaggtttcatgaatagtctattttaaagcttttgtaggaatggagaagattttatgtgatgcaacacaaggaaatggcatcaagagcttccgaggtgattaaatatgtgactaagtctcctgctacgttgtctttagaggcaggtatatatctgcacgcggttgaaaccatgagctcgatgcggtttggatttcaagatgtggagttatttttcttcaaaccaaacttaagtgtgctgctcaacctcattggactcatttactgcatacaacacttgaaaccgcgggttagttactcccagagaaagtcgaccggcctttcggaacattttctaacttctttaacattttctttctgcagcgagagcaagtcgtggatgtgctaaggcaatgtggaatctcagagcagctagtttgggtgaaatggttaacgttaggtcgatggtcaggtgggagtcgaatgagagacgacatcgtgtcgcgtcaggtctctctagtcgatgttgtaacagggaaagaagaaacggttctacgagtgcttcaacgaggagttgttcacgaagttctacgtgtttgtatctcaaccgttgatcttgcctgtgcaccttgcagcagtagcaccatcagaaactactaaactgtttcaaggattcgaggattacaagttgaattggattcaatgaatgtgattaaacatgtgatattgaaacagtattgaagttcgagtaaataataacaacgcgcaattcaaatgcaaacgattgtatggagaattaactgtaagaaattcgcggtaaaaaaactgaaattataggattcatatattgggccttagtatattttcggcccattaccaaaattatcttaaacaagtttgagtcctaaacccttttctccggttacagctacaccgccgttttctctctccgccgtcttttctcttcttctccgactggtaaaaatcctctctccagaactctggtctcccgttatatatatatgctcgtctacattctccaattgcttctcgagttcttagctcatatcagtcacatgttgttctctgtaaattcaattccctaatttcaatttgaaattttctctgttggtgaaaaggctctgctatttgattaggttgatgcatagtaattcgatttcgaaactctgcttttaattccatagactatataatggaaaagatgatgataacaagttacttgactgatgattatacaatcacattatgcttatgctaaagtttttttttttgtatgttcatgtagaatctgtgaaggtgaatttcggagttgagaaagagagattagcgtgta

SEQ ID NO: 6522 - DNA, 3000 bp, Unknown; identical to SEQ ID NO: 6508
  misc_feature (1)..( 3000): cDNA_ID_3090314_gDNA_ID_1621096_Annot_ID_171003 3000 nt of promoter + ATG

SEQ ID NO: 6523 - DNA, 3000 bp, Unknown; identical to SEQ ID NO: 6507
  misc_feature (1)..( 3000): cDNA_ID_3048467_gDNA_ID_1621096_Annot_ID_170996 3000 nt of promoter + ATG

SEQ ID NO: 6524 - DNA, 3000 bp, Unknown; identical to SEQ ID NO: 6506
  misc_feature (1)..( 3000): cDNA_ID_2173491_gDNA_ID_1621096_Annot_ID_170994 3000 nt of promoter + ATG

SEQ ID NO: 6525 - DNA, 3000 bp, Unknown
  misc_feature (1)..( 3000): cDNA_ID_2108258_gDNA_ID_1621096_Annot_ID_171059 3000 nt of promoter + ATG
tattggagaaagagtttctgagagagagagaaagagaaagagacagagagacaaagagagaaaggaaagaggaggaggcttcttaattgggggaaacgtgacttgaagtcttaataatgtttttattttatttgttcacactataatgattcaagtatgcaagtgtgtgtctattggtgtgaatggatagtatcggatgaatgaatgacaagaaaacaaaattaatgatttggttaaagtataatagaggaatgaagtgaaatagataatggacttttcttatctttctaaactggagattgtttttcatgttatgaaaaaagtttactggaatatagatttacctcactctgtagcaaattgtacccttttagtggaatataaaaatataattttctacttctttttacccatcatttttatttatataaactagtataagctacatactagttgattttggtctataatatccagatttgagactaattttggcaatcaatatgagaaaataaatttcatgcaattagttgcaccatatgaataggattggtaaaagtgatatagttttcttcttaaatcacccataaatcttaacctaaggatgggcattgaagatatgtaagtagttaagtcaatttgattacccttttctgaccggagtttgattctactaaatcgcgttatcttgcgtagtatggattgactatacatcgagtcttgtggatccaaaaatgtatataaaataaaagatgggcacaaatacttggtaattttcctttatccaccttgaaaacataaacactcatcattattaagataactaatactcattctatttcatattagttgtagtttaaggtttttacacacatattaagaaagtttttaaaaattcatttaatatatctcttttatataaaaacatcatttattataaccaattcaaccaataaaaaatatataattaagtatagttggttaaaaagtattgaatatatttattatttatacacaaagttgaaaacaacagttattgtgaaaaaatataaaaacctttaaattacatttatattgaaacaaagggaataataagtaacataactttgatacttacaattaatttgcaaatagttttacaaaaaacacgtaatagaacaaagcaagtaaagtaaaatatttttagcaaatatttgaaattgaagatactcgtttctcacaagtcaaatacgaatactaattttacccttacaaaatgggtcaagtagcaaatacttgtcctgtgcccatccctaatttttgcaagcaagatgcactaagtatgagagagttttgtagaacctagtgttttatagcaaatctgtaactaatcctaaaatatggaattacataagtagtaaagtagcaaccaccggtttactttctgaggaattagcaaactattaatggaatgaagaccctttctggggaattagcatacaaaactaatatgagaatttcatgtggtgattattggccaaggcaaaagtcttgactacataaattctaccttttattcagactgaacaacagctcttttaatttttacttcctgcgctagttttttgttcctattaaaagagtcattcaagatttcttaggtaaattcttaaatgaactaaaaataaattttgttaagtaatcagaatcaaaggaaaacgatggtataacagtctggtatcatatcccacttggttgctactcgctagtaaacttcaaccacaaccctctgtccctctatgacgttgatgccacttttaagactaacaacaataatattgtcttttttttcttctttcgaatccacatctcttgaaattttgttaaataatttaaaatatgtaatctatatgtctgtgtgtacatatgcataaatcatactccctctgtttctaaatatttgtagtttaaaatttttgcacacaaattaaaaaaccatacaaatctcatttaatttatctctttcctataaaaacatcattaattacaactaatccaaccaataaaaaatatgatgtaaaatacaattggttaaaactattaaatacatttaatgtttgcatagaaaagtaaaaacaacacttatattgaaaaaaataaaaaacctttaaactacacttaattagaaacagagggagtaatacggatctacgagaaaaatttagtgaagtcgcggtcgaaggaccttaggttggtggctagaccatttcgttcaaatcaatcccactttctttcatcaagataacaaagattcacaaacatccttaccaaatgatacaaccaaatgaccaaccaaatgataaaaactacctaaggtctatcatcaagtttttataagttctatttatcacttaatatcacaatggtgcattcgagaggatacaaccaaatgaccaatacacatgtatttttaactgcttgtaagtatcacatatctcatgattttaaaacaaaaatattgatttacttgtttattattattattattttttctatacttatttggtttgatagtagatgtttttatatatatttaagatatcattttatatatcttgagactgtatttatacctctcttctttattctacaaactacctgtcaaaatagttggttttgaaatgtaacattggtgatgatttttcttttgtctttaaatgtaactttggatgacaaaattcagtaataataatgggcctgaggttatgaatatagaattccactttatcacattggacccaaatttgccatgatataatataaaacgacgtggtatcaagtgttcagtgagtgtgagtcctccgacacgaataatctagaaaattttactaagactagtgtcagtatttttctaccacactcgtcgccttgctttacgctttattctctcttctttagctttttatttcttcagcaaatctgatttcaaaaaaatttcatcgaggaaactgaaaaaaaaaa

SEQ ID NO: 6526 - DNA, 3000 bp, Unknown; identical to SEQ ID NO: 2905
  misc_feature (1)..( 3000): cDNA_ID_3070480_gDNA_ID_1621096_Annot_ID_171056 3000 nt of promoter + ATG

SEQ ID NO: 6527 - DNA, 3000 bp, Unknown; identical to SEQ ID NO: 2906
  misc_feature (1)..( 3000): cDNA_ID_1814718_gDNA_ID_1621096_Annot_ID_171055 3000 nt of promoter + ATG

SEQ ID NO: 6528 - DNA, 3000 bp, Unknown
  misc_feature (1)..( 3000): cDNA_ID_1814730_gDNA_ID_1621096_Annot_ID_171050 3000 nt of promoter + ATG
agttgggtttcccttgtaaagccgtgaatgatggcctctggttgcaggttcgttgtccttaaacttgctttgctttctcattcagccagttgtagaaatgttgggatggttgatgtgcttagcgttgatacatttgacttaaggcatttacatgagcaattctagtctagtgtttcatgttagattacaaatgcaataatattgttaataaatgcaataatgtttatgtgtttgactacatttcagatgcttctcagtcaaagggtgcaggaagttgctgccaacacatgcaaaaggtgttgccttatcagtattgcatgtgcgtgtaaacaaggatttggggtttcacatggtgcaaccttcaacaattattattgccaagaaaacgtgcagaacaatatgatgggagacatggataacgtatatgtgccggaatcttctcaaggcgatgggataggcatctttaagcctgtcaggatcagtgtcagaggacaacatattgatggacttaccggcattggatgcgaagctacatttgtaccaccacctgcttggcctcctactccttttgtgtactctcgtgtccctattaacagaaatggtcagcaatctattgctagtgatggttctgaaggtagaattgatcagagtggagaaatttcaaaagatgggctgacagctcttgttgggttgagccaagggacaagcggtgttggtaacaatcctcgtggagaacaaactgagggagggcgtggcagtggagctactgttggaatgtcagaaccaaaggaaccttcagtaggtactgagtgggagaacgcaagttgtaccatatcacttgatacaaagacacctttgtgtcactttcctccctttcgttttgggtaacgtttccagccttatttacttgtaaacaacactcttggtttattccaattgcggtgactccttgatttgtcctgtttggcaaaatagttcctctcagatgtgtctttttcattgctgcagagttgaatttgaagatgtccacagactcgctaacggtcatgtagagcattctcctgaattcttctatgctggttctctgtggaaggtatcagaaactcacaactaagtcgtcaagcttttctcttcgagctgttcttgctttctaagaatgaaatatgggttttgataagatgttttaataccatatccagattagcatacaggctttcaatgatgaagatcctcaaggacgccgaactatcggtaacccgagttaacacaatgacaagatcacatgttttcctcacgttagattggtctgtcatagtatacataactttgataatcaatatctacaggattatttcttcaccgccgcgaagcagagatagtggattcagtaaggaaggttagttttctgtggtctattgttataaaagagctgtttagagctacttaaattgtcatgtcttgtgaaataacaatctcttctgccacattcaggtccatgtttacatagatcctcgtgacaaagtgactgcacgttaccaggtatgttacaaatatctatttgcaagttctcgttgaaattcatataagattccatttctaaccccttgttttgatgcatctagtcatggtttcctcataagttatatcattttcattgttcttgtagcttatctgcccgtcgaaaagagaagtgatgttgtttgggagctttaaacagagaggaactcttctgcctaaagctcccaaagggtggggatggcgcaccgcactgctctttgatgagctctcggaacttctccagaacggtgctctgagagtggctgctgttgttcagctcgtttagaggtgtcttaaacccgagagttgtatgtaaaaaaactcaacaaaatccacattttgaagttaaccctcttaataaatagtatatattctacttccttaaactgtggatgtgtttgtataaatgagtcacagaaactatttgagagaaatatcaagttttcagaataagaatgtctttttatataacagtcaactgcatcatccaacaattggagaatccaaggaggagagccaagatcagggtacgacaacatctacaaagtaccaaacataagtaacatacaacacattctaacactaaagaacagcgacaaaatggtaacttggtaatagcaaaaacataacaactctcaataagaccaaacacaaacggcgtagtttaatcaataataatgaaccggaacctaccggttcaagcaatcggttcatggttaacaattaacaagtaaatgtaaaaccctattggtacacccttgccggagagaagcttttgtctcaccactcaccgtcacaacttgtgcttcctctcgtcctcgtcgccgtcgtcagagagaaaacgattaaagctggtggtatggggagagataaagaagattaagacagagatggattcggttgttccatggatgagagctccggttgacgtcagcaatgtcgaaaactgcgctctcgataccctcccttgccttaatcccaagtaaacatcgtttatctgtttaaaagtttttcgttttgattgaattatctttctgtttacgacttttgactgaaacttgggcttcgggaaatctaggcaacacaacagcgttttgaccttactatgtcaaagttgttcgtttctaaaggttaaattttgatttggttgcagttagagatttctcgagttattatttgctctttcgaattggagtattagatactcaaatagtatacacttctgttaatactgaagtaaaacacctccaaatttgcttagtgttaaactgatgttctgtctcttgctcttcttcttcttagatcaatttcttgtttgaaaattttaccatatacttacaatattcatacgagtaagaagaactgttttggatcacttggtgcgtgatgaatgcctcatttttcaagttttgatgtgataggttgaagaaggcattggagaac

SEQ ID NO: 6529 - DNA, 3000 bp, Unknown
  misc_feature (1)..( 3000): cDNA_ID_3090413_gDNA_ID_1621096_Annot_ID_171049 3000 nt of promoter + ATG
ggatgtaccgaatagatattggattgtctagcgatgaatatgagatttagtagactggaaagaacgtgtagctatttttgacttgaagtgcatgcaaagttgagcttgtgtagtataactatatggaatatgctaactagtcttgaagaggaaatattttgcaatcttcagcttatcttaaaattttaggtgctgctcaggattctgagcaaagacgaccatcaaacgaagttaagaagtcaagaatatctggaaatcgagtgggcggaacaccaaatatgaaagctggttctggatttggtagcacttcattgtcagagaaacatggagacgtcaggaaaggaacaccattgagaagagcaaaggagaaacaatctgagaaagagaataaattgtggtggctcaagcttccctatgtgctggtaggtaaataatattggatttttggttaaaaagctttctttgccagatccaattattaattcacaatcaagaacgaactatcacaaaatattatgagccagacacttaccgttttctcttttcttcagagaattctcatgcggagtaatatcgatcaagacatatctgagggatattttaccttgaggaccgaatctatggaacaaaatgagggtcaagtttcacatatgattgcatttgaagatcaaagtgatgctagaaacttctcttatctgcttgaatcagtttttgaagacttggatgatttcagtgccgatatagctcccgtaacaaccaaggtagatagttcatttctttaccaacttgattcttctttattaatgtctgtatctgtgaagtttacttgtttaggagaattttgttccttaaacccttaatttctcttcatgatctgagagtatactgaattctaagagcagtgagatcgtatttttatttataggatctttatgaggaagttagttctggtggcaagaatgtgatagttgtgaggaagaggcagcttacgttgtatgctggacaaccatttgaagacgttgaaagagctttgcgaactctgattcaagaacgaagatgaaaaaagtaacaacattacttcggactgaaaaaactagagagcccagagatgatcaatgtggagatgacaggggcagtaagaacaatggttccacaacaacaatttttcatgaagcttaaagaaccactgagcttctgttgtattatggtagtagcattggaattgagaggacagatccactagaaataaaaaagattgtttatatcatgtaaaaacgtattttacatgaatcagagagaacaacattttcatcttcagaattttattgagatgcaacgatcttgatcatggcttgtgcattaagccctgttacattcttctcacaaaacttcttccaagcttcttgcttgcttccttcttcgtcttcttcttcattccatgtaaatttctcgaaaagcgagttcaccatactccttgcagcttcccttgcctctggcaacttgtcactcaactgatccgcagccatttgtgcgagcagaatcatcccaaattcttccatttcatttacctcctgataacaaacatagagacaaatatatcaatcacacaattcaagaaaataataactttgctctgagcattttaatcattgttgaagaattcaaaataccattttagaaacgcagttggaagtagacacagcagctttggccctgacacgagggttactgtgacggacataactctgaagcttacgcagaagcggcaagcgagccaccgagttaaccatcgtgttcagcgctttctctgcttcttcacacacaaacttcttgtcttgtgaagctttcatcagcaactgcaacagctgttattttcaccatcaagataccaaaatcaaactttattattaaatcaacaatccatagccaatcaaaaagctaaactaaccggaaaaaacaaaaaacaaaaatcaattttaccagatcgtccatagatttcaaatgaggtccttccagcaacttttctccataagcagtgaagatatcagaacaagtcataatcgaagtcttgcacaatgcacttctaggattcttcatcgccttcaccatcacaactataagcttttctctacaaattgacaaaaacaaaatcatcaccaagaaactccataagatttcagattctggtcaaaaaataaaaaatactcacagaattggtagcaacagagaagagtgatgaattgcaaatctccttgtgttgttcaatgagtcacatactttaatccaatcctttgatgctaattcttcaagtaatctctgtgatagattgaatcaataatcatcaaaaacaaattactacacataaattcagaatcaattgagaaatttaattacctggacagaagattcaggatctgaaaatggtttgagattctcagaagcaacgtattcgacggtcgattcagccacagcgacagggttgttttcgtcatttagaccaatctccggttgctttgagagtttggccagcttcttaggtcgttcctgtgagatcggaagagcgttttcaatgttcctcaacgccattagagataagagaaagagagagattttgatttgaaattcgttaggggaataataatcaatggtggggttgaaaagcttaatataaagagaaatttttgttacctttttcgcattttatattcaaaaattcaagaggaaaaaaagcaaaagaccgttggtaaggttttggctccaacggtcacaagcatcggttcggtttacatgaattagattcggttatctggtttattgttcaattcacacgacgtcgtttcataacttttaagaaacgacagcgtctaagttatcacttttgcgccacacgcgagtgagagctaagctaattctccgtcttcaatggcttttctcttttccccaattgaaattgaatctattccctagaacaaattgattgtgaatccggcgtcatttttg

SEQ ID NO: 6530 - DNA, 3000 bp, Unknown
  misc_feature (1)..( 3000): cDNA_ID_3090424_gDNA_ID_1621096_Annot_ID_171042 3000 nt of promoter + ATG
ggataagagatgaatgacaatattatatgtgacgcattttacttgaatatgctaccaactaaatgaaagaaattttatataaggctcgaatttgaaattagtggaattgataaattttgaatgaatgaaaagaattttgccccccaaaaaaaaaggaatgaaaagaaataagatgaatatatatatatataaaaaaagcttggttgttggttcattgattgatcgatttattaaaattaaaagcttctatgttctttgaatttggagaatgcaaattatgatcaacgaattattcgaaataggttggttttgtattctagaccaaaccggtttgttcattggtttatggaaatttctgaatatctgatttgggagcttcatttcacaatttcactctatcatggtgtcaagaacagaggaggaagctcggttttgagatctgtacacgagttggttctgtatcaacttgttgacatatcaatctgcagcaaaccattgtgtcatggtgcatcattagaatcaactaaaccgcggaactacatattaagcatactagtacaatctcaaggtagtggtaacagtagtggcgagaatatcataagaacaaacaattttcatattatctaatgttctgcttctttggcattatcatcagtcgatagagcttccactttctcttctgtcacctcacttctcttatcaatttgctcttttgaatcttgtagctgcaaagcacaaaacagataatcgtggaggagaaccatagattagtttctgcaagtctaaaaaccggtcttttctttgggttataatattgaaaatacttttaggaagaagagtgtatcacgagagactcacgcctaagcttttcaggctagcggaaacatcatcttgctgttgattcaaggtagttttcagatctttgaattcctagtttttatggagacaaaacgaatcaaacatgtatcatgaatagaaaccgtttaaatattcatgtggctgctggctcaatatacatacatacctcacgaagctgctcaacttcaagattcagagtcttctttagcccagagagctcctgtaaaaaaccaaggaagagtatacatcgaatgtcaaaacagttcaaactgatcccggctaaaacagcaattctcttgcttgataccacaaaatggataaagaggactagatatggaactcacctcacggtagactttaacttgagtgtccaatttacctctccaactttgcaagtcctgcgacgataagatataaagattggtttgttttaaaaagacaacagatgttctaaaacaacatgacaatgtcagagatgagaatgaaagtgttaaaacctgtttcagattctggatcctgtttagtaactcagcccttgattcattcaattcctacataaaacgaaatcaagacttgagaaaaaccgcttgatcagaagatttgactaaaaacactaatagtatctaacaacacagcgacgtaccgtgagcttcgaatcaacaggattggtattatctttcttctgcagcagaaagaacaaccaagatcaacatcaatttcaatttaaccacttaaaaacaattccacagggaaacagatattataactcttaagctgtacaaaccaaaatcataagcctgttatatatatatatataaacaagaaaagtatgctttaagaccaatgtgagattgttgttaattgcacagaactaaagatatactacacagtaatggctcacgatccaaatctgacttcaaatctaaagagatactacacagtgatagcccaagatccaccaaaggtaaaaagctttgcatgtgaatcaactcaacatcaatgtaatcagaatctgaaattgttaaatccgtggaacgataaattcagacaattccaacaaaaacataaaaatacacagtaataagagtaaaatttcaggcaaaaatcggaagaaacgaaaccttcttctatactataccacttgaattcgaatcgagaatacagaacacaatgatatgttcgaagttgcagacaaaacacagatctaggtccgaaatgccatatctaaactcgaaaccctagataaattagatcaaaaaccaaattatattaatctcattttgaacctaaaattcagaaacctagagctccgagactacgtccgcgtccatgaagcgtaaaattaaagcgattaaagagaaattgagagagtttacagtagcagtaggagaagatacggagagaggagccacgggagatgttgaatcggaggtttggtccgccattatcgatgtaaactcggaatcaaatttgtcaatagagtagaagcttgtagggtttaaggaagaaggaagaggaagaggaagaagaaggaagatctgtaagtgagattggtaaagtgagaaacaaacaaacatgagaataaattagtgatgtcgttgcgagccacactcaaaatttcaaaaaacaaaaaattaataaaatatgacaacatttcaaaatttattttatgtgatagggttgttttccccagaatttattttattctgtatattcatttctttttcatttattcactatgcataagttttacatttttttgtgttttaaaaagcatcaaaatactattgttttcatagattgatattgactttgtgagtatttcacacttatttcctgccgaaatttaagatgcatcttcgcttttttgaattgtattagatttataaataataacacaaatttaatatgaagaaaaaaaatatttaattttcctaccaaaaaaagaaaaaattatttaatttagtatacaaaaaggaaaattaaaaataaaaactaagaaatgtagttgagttgagtcacgggcaaagtacttggtttctttgcagcaaaggtaaagaaagaataaaaagactctctttctctttctctttctctctgtctgagccaactcggttccatactcggtggcgactcaaaatg

SEQ ID NO: 6531 - DNA, 3000 bp, Unknown
  misc_feature (1)..( 3000): cDNA_ID_2173579_gDNA_ID_1621096_Annot_ID_171041 3000 nt of promoter + ATG
tctgtttatgttataatgcagactttaagtcttttatcaactagggtggggtttttgtaacacaaatgatatggacttctcttccttcatcaaaatatacgaaaaatgtatttgaataattattgattatttttggtccaaaaaacttgaatccagaattattaattggattaaaatgtttttgagaatatttttttgcagatgataccgcccataattttcttaaataagtttttgattggacttcttttgtctttcacaactcacaagtgagaaagactaatatcatagttcttttaataatcgaacaaaaattatcagaagcgaacaaacaggaaacattcgcaagaacaatgagtaaccaacctcatgatacaatcatctcacgaagcacacaactctcgcaatttagacagttcgtacataagataaatttatagactgccacaatcatatcgagtatgaccaatttgatcacgaaacagaatcatcaacataactacaagcaatagcttcctaaccggcgaagaagctgctattaaactaccggtaagataagtttgtgtcgaaagccccacgagtctacctcttctttccctaatgtactcatcaattgcttcttctatttgcatccttgaagagaaggaagatacattaattataccgtcttgacctaaatttaacttcctccacaagcatctagccaaaacaacaccgtcctcaagcgcagccgaacatccttgtcctaagaatgggcccattaggtgcatactgtctccggccaactgtcacgggtgccacgtcggaatttttccagacagaacatcccaaggagcacggtaccttaaacggttgatatacaaagagtccatatcacaattcttcaccatctctttccactcttctgagaattcgcggactgatgctagtgccaatcttgcgatatcctcttgattttttaagaagtttgagtctatttataaaacaaattataaatacgttagtgcgttatatgaaaacaatagaagtctatgtatagtatgaaatgtagcatgaccgggttattaattaccttggggacaatttcgcaaaacaacaaaccaaaagacgagtttgtgagttataggaagtcgtccgcttacgacgttgtccatcttgattcttataaactcttgtcggaatccatggtcgttccgggtaatttgtgaaccctctgatggcccgcgaaccgaggtctttagtcgggtttaatcctagaaatctagagactacagaatttgacccatcgcagccaatcaaaacctaaattaaaagaaaagtatattatcaaaatatataagacccatgcatttcatgctaaacatgttgctttcagtgaaaaacaaacaaaacacaaaccattaaaaccgatcacgacccataaatgtcactgtcggctaatataaggtatatactaaaaaaattccactacggcatcacctcaataattgatcaataaatatatctactgttgttaaaacgtgcctttgctttgatagcttctcccgtttttaacgtgcacaatcggaaacgattttgtttcgtcgagcttaaccgacaaaatatggcaaccaagccggagagtgccaagaggaagagcatgagccaaagctcgaaccaagtcgttccttagtacacctcttacttctccataggatgctggtccaaccgattctcttcgtttaatacctttctcgatcaaaacatctcttatcctgttttagtaccataccggaaatcattataactagataaggttagttaaaatataaatatttatatacttactgatgaattgggagagacttaagacgaagctagcttatcggcgacaccaagttgttgaagagcaagccagccgttagtctgaataccaaaatgctgctccttccgatcttacagactctgatctctccaacacaacgctctttatgcccttcctttataatcatatttgtatgtttagttagtcaatagttcatgtatatgttttctaatttaaattaccttataattgagaaaatgaggagattatagtgaacctgtgaagagcaagggaagttgcaagaccagcaatgcctcctcccacgattactatgtccaattcttccattcttctatatttgtatttcctccaaattttatgatcgttatgtcctgcaatgtcgtggacttatatgtgggggttgaagccacatggcaatatggcatgtcgtggttgtaccttgacccgcgtatttttcgttatctatacatattcattcacagcgatttttattggtatttgtcgattcatatatcaattaaactgtgtatcacacagatcgttatatgaaaccaattctgaagagagaaaaaaaagaaaagaaaaatttaagccttcttgtgttagaattactaattttaataatttatttaatatttttactgtattagtgattaaatgtataatttacttaatcttagaagtatatatatatatttaaaacaattattttcttacacgttatacaatatttgtaattaattgtatttatttatattagaaatatatatacctttttctaaaataatatatttttgttttgtcaattgcccttataatattagtaattcattgtatgatttccttataatatttttacacatgaaaaaatctctaactaaacatcttttcaataaactacatgaactatcaaatttgttataactttcagttatcctccaaagtccaaatattcaaagtgaattattcatgggttggatttaacaaaaataataatttcgaggttgaaatgacaatagatatttttaaaacaaaggaccaaagtcgaaataacaaaactcatcggccgcattaggtttggtcctaaatccctaaaaccctaaaaaaacacaatccctcttagaaacagagagcttctcttctttctccattattcatcactttcttccccgaag

SEQ ID NO: 6532 - DNA, 3000 bp, Unknown
  misc_feature (1)..( 3000): cDNA_ID_3090427_gDNA_ID_1621096_Annot_ID_171039 3000 nt of promoter + ATG
tcttttcttttttttctctcttcagaattggtttcatataacgatctgtgtgatacacagtttaattgatatatgaatcgacaaataccaataaaaatcgctgtgaatgaatatgtatagataacgaaaaatacgcgggtcaaggtacaaccacgacatgccatattgccatgtggcttcaacccccacatataagtccacgacattgcaggacataacgatcataaaatttggaggaaatacaaatatagaagaatggaagaattggacatagtaatcgtgggaggaggcattgctggtcttgcaacttcccttgctcttcacaggttcactataatctcctcattttctcaattataaggtaatttaaattagaaaacatatacatgaactattgactaactaaacatacaaatatgattataaaggaagggcataaagagcgttgtgttggagagatcagagtctgtaagatcggaaggagcagcattttggtattcagactaacggctggcttgctcttcaacaacttggtgtcgccgataagctagcttcgtcttaagtctctcccaattcatcagtaagtatataaatatttatattttaactaaccttatctagttataatgatttccggtatggtactaaaacaggataagagatgttttgatcgagaaaggtattaaacgaagagaatcggttggaccagcatcctatggagaagtaagaggtgtactaaggaacgacttggttcgagctttggctcatgctcttcctcttggcactctccggcttggttgccatattttgtcggttaagctcgacgaaacaaaatcgtttccgattgtgcacgttaaaaacgggagaagctatcaaagcaaaggcacgttttaacaacagtagatatatttattgatcaattattgaggtgatgccgtagtggaatttttttagtatataccttatattagccgacagtgacatttatgggtcgtgatcggttttaatggtttgtgttttgtttgtttttcactgaaagcaacatgtttagcatgaaatgcatgggtcttatatattttgataatatacttttcttttaatttaggttttgattggctgcgatgggtcaaattctgtagtctctagatttctaggattaaacccgactaaagacctcggttcgcgggccatcagagggttcacaaattacccggaacgaccatggattccgacaagagtttataagaatcaagatggacaacgtcgtaagcggacgacttcctataactcacaaactcgtcttttggtttgttgttttgcgaaattgtccccaaggtaattaataacccggtcatgctacatttcatactatacatagacttctattgttttcatataacgcactaacgtatttataatttgttttataaatagactcaaacttcttaaaaaatcaagaggatatcgcaagattggcactagcatcagtccgcgaattctcagaagagtggaaagagatggtgaagaattgtgatatggactctttgtatatcaaccgtttaaggtaccgtgctccttgggatgttctgtctggaaaaattccgacgtggcacccgtgacagttggccggagacagtatgcacctaatgggcccattcttaggacaaggatgttcggctgcgcttgaggacggtgttgttttggctagatgcttgtggaggaagttaaatttaggtcaagacggtataattaatgtatcttccttctcttcaaggatgcaaatagaagaagcaattgatgagtacattagggaaagaagaggtagactcgtggggctttcgacacaaacttatcttaccggtagtttaatagcagcttcttcgccggttaggaagctattgcttgtagttatgttgatgattctgtttcgtgatcaaattggtcatactcgatatgattgtggcagtctataaatttatcttatgtacgaactgtctaaattgcgagagttgtgtgcttcgtgagatgattgtatcatgaggttggttactcattgttcttgcgaatgtttcctgtttgttcgcttctgataatttttgttcgattattaaaagaactatgatattagtctttctcacttgtgagttgtgaaagacaaaagaagtccaatcaaaaacttatttaagaaaattatgggcggtatcatctgcaaaaaaatattctcaaaaacattttaatccaattaataattctggattcaagttttttggaccaaaaataatcaataattattcaaatacatttttcgtatattttgatgaaggaagagaagtccatatcatttgtgttacaaaaaccccaccctagttgataaaagacttaaagtctgcattataacataaacagaaccaagaaaatgtagagagaaatgtcaaattatccagtagcccactcaaaatgtagaagctgaatcaatggaggtgatagaaaacttatctagagaaaaccagaattgcaaaggctcaattcgaagatgttttttttgatgatcccatctttattcttatatatatcaaaagtttaatagtatagaagatcgattttttttttgtcagtttagatttttgatatactaggaaaagccaaaaagataagtattgtgtcacactcattacaacaagtacacaaaattgatattggatggaactagttgttttatccaaaagccgagttaatgtaagtggcgtcataggcttgcgtcaacaggtcaagttacttcataaacaaagagcgcttgtttgactcgcaaagacccaccacactcacgtaaattgattgtctcccaagtaatttaattgtcttaatgaaaagtcttcgctgttcctctactctatataaataaattaaaaacactatactacatgttccctataggactacagattattaaaacaactccccaaacaaaactttagatctgaaaatctcagctttgaaatg

SEQ ID NO: 6533 - DNA, 3000 bp, Unknown
  misc_feature (1)..( 3000): cDNA_ID_3090318_gDNA_ID_1621096_Annot_ID_170993 3000 nt of promoter + ATG
catgcatatctagccttacttataagcttttcagtttttattgaagtatactaaatgttttgattgttagaagagatagaacatgtacatattggacaatttactatccaccgttagaacattgcgtgaacgactcagtcatagtactagtcaggtttgtagttatagacatatcaagatttctgtctagttcatgtctatatcaaaggttgtggtatctctgcattcgaagacttatgtttctttttttgtccgtaaatttttaagatttatcttttcttgatagatatatatgtatcacaatgcatagcaatatcgacgtgattggcccagaatcaagtcttatctttggttgtgttcaataatgtaaagtccctttataagctggtacaatatgatggtgcagtgtttggaactatattataaaaggaatgatgactcagggaccatgtaaagcgttagtacaaatgtgtcgttgagacttgaaacttacttgggaccataattatgtttcttgggtttctttttttcagtgctagtaaactttctcatcagtttctctctcgttgattacattctaaaaatttctccatatatgctcatagtgaaaacgtaaatcatgtcttctgagtcgtgaaagctgaagtcgaaagtgttttagtttagggtaatttctgaaatgggctttgcttcaggttgctggaggtggaatcctaggatatttacatatttggagagaagcaaaagttatagcttataagatttttgtcattgttatgatttatcaattcttaagttgtacgtataatttatatttgtcttcggttaataagttattctcattgtttagaactacaactctttctcacattgctctgaactgaatcgcctagaatttgcttcttcttgtttcttaaacgctaagtggtaactaaacattattcatagtgtctgagtattatcagttaaacaaaaacataaataatcgtttcatttttaccaaaaaaagaccattaatggttcttaattccaaattgtaaatacaaaatttacacaagtaatgtcatgcttctaaagtctaggactactgcatgctaaactattcgttttaaaatttaaaatacatcaaatgaaagaaattagattgaataaaaaaatcaaatataaccgagcttccagagtttctctaagtaaattgagaacgcaagccatgaccaatctggtgaatatgaaaaaaactcaaatatttatcatttacatacaatgcacactagatacatatgaagattttaactagtttagtataagataaaaaacacaattttccatgattatttcattaaaaatcttaaaatttgctaaaaacaatcctgatactttgcattattatcattcatattacgttgttttacttttcaaggaactgttttatctaaacatgtataaggttatcaaatgattaacgtcaaatctgaaacaataatgtaaccaatatggaatttcgccataacgtggatacttggcagtggttacttggcttttcctttattttcttttggacggaagcggtggttactttgtcacacatttaaaaaaacacgtgtttctcacttttttctattcccgtcacaaacaattttaagaaagatcgatctatcgtgatctttctatcaaacaaaagaaaaaaggtcttcatagtaacgctacaacatcaaatatgtggttgctctgacatcagtcgggaaaataaggatatggcgccattggccacatctattggggtcccaacttcctttcacaaaaaaattaaattgggtgtcccaacttttatctttgatatagtgacatgagtatcgggagcattggacaatggataaaatgagaactaaaaaaattctggttaatttttgatcattgttatttaaaaggttattttatctataatctacccatattgatcagttttatttaaatttgtttagctaccgctcctcgagagagatcctcatcttaaaaatggaatatggaaattacacacgaccccaaaagtatattttttctctggagaatgctatttagagctttgactatatggtctgaattagaaagacgggaaataaaatctgctaagtgatataagctctaagtaggcgatgtgtgatggagaacaccttttctttaacagtcttcatgttttacagattcgcgaacttcgaatatccctatacggtctgtctaaccctcgtgtgtcttttgagtccaagataaaggccattattgagtaacatagacatgctggaatccaaccattgaagtcacaactgtccatgtagattctttggagaatctgaaaagtcttaataaaggtggtgtttcaaagaaaacaaaacaattgagttaagaaaaaaaaatatcatgtagtggtcgagtattatgttatttattgtgtagctaccaatctttattctttaaatctgacataaaatgctacaaactttttacctcgtctatagccccaaaaaacctaaccacggttctaaaaccacacacagtgattttggttgacgacaatgcctctccttcctcaaaacgatttatttacattttttaaatcaaatgttacattttataccataattaagtctttttacagaatacttagatggaagagatgtataaaaaaggaggaaattgtaaaaaacatatttcgatcaattaaaccaggattcataaaaatataagtatatatataaatgatgtttcgtttagcgatgaacttcactcatatgataatacttaacaatataagtacataaaaaataaaataaaattaattgtttacgaaaagtctacaaatactgcatgtataattaatgttctctttatttatttatttataccttaccaagatatatctataaccgcatagaaatagaaggcgaagagataatttccaaaaacaagaaaaacctctaagctcaaaagatgttgttgagaacg

SEQ ID NO: 6534 - DNA, 3000 bp, Unknown; identical to SEQ ID NO: 6532
  misc_feature (1)..( 3000): cDNA_ID_1814759_gDNA_ID_1621096_Annot_ID_55690 3000 nt of promoter + ATG

SEQ ID NO: 6535 - DNA, 3000 bp, Unknown
  misc_feature (1)..( 3000): cDNA_ID_1814754_gDNA_ID_1621096_Annot_ID_55693 3000 nt of promoter + ATG
attgcataactttttgggaaagatattgagggtgttctttgaataaatatgttgtacactgaaaatttcccacattaagagtaggggattgatattcatcatcttttcaaacgtaatcttgtaaagttcaacttcaacccaaagtcttggcctttgtacgtttgttcctcacttgggaattgggatgcaaagctgtgttgcaaaatgtttagaaataatatttactgttatatagtttttctggtatcattagtcacaaagcccgtctagctcagttggtagagcgcaaggctcttaaccttgtggtcgtgggttcgagccccacggtgggcgctttgtttttgtttttttaatccaaatttgatcatattctgattttagttttgagtaccttgactagtgactcttgagcatgtgttttatgcaagttttaagatatcctcgcctttaattacgctacgtagaatatgtgaattagtatggtacacccaaagaaagaacacaaatactttatataataatacaacatccaaagtcaaaaccttacaatacatatggtaccattttgttcccctctctctctctttactaatctctctactgaagacttttgtctctgtttgtcgcctgtctccgccaaaagctctaagtctctaaccatcacgtagagtaatttgttgtgtcttcaatccgtgcaattaaatccatgacaaaccgatatccagattatgagaacaagtagtagcaagatcccaagaacccaccagttttatcttcatgttctggtaaccacaaatttcctcctccacctgtgtcccttggttttcttgtattcccgcgccttaaagtatacaaattaacccttacattaaaatggctatcacggaaggtctatgaatttaatgtttggagtcaagtttgcctttacctgagagcgtagattctcggtcttgtcagtaagaactgttagattttcccctctgtcgattgcctgaaaatggatcaacaatattggaggtgtataaagcacagtgatttttgcagacttatcattgtaaaaggtaaagcaaaggagaatgatttgttgcttgtcttaagtgtggagaaagacataagagagtcaaatgatgagcattaccttgtcaatattctccaacattatacttttaacttctgaaacctgagccttgacttttattagtttttcaatctcctctgcatggtcaacaatataattcatgtgttccttcatcaccggcctgcaatattttaattttaccattaccttgtattcaatatattatagaacattttcctcaaatattgaaatgttttctaagtacccgaactccttgttgagacttttggcgatagctgtacttgcttttccacctccatatctcttcttgaaatcagctttcacacgctccagaaatgcgatcgagatttgcttgctaagagaatctttcgccacaacacaatatgctgaataagaaatttcaaagagccaccatatataagtgaaatgcaatccaaaccataacaaattattttgaaacacatgtgtgtagtttcatctccaaaccataacaaatacaactacatacagaaagaaagacacaaacatctccaatccgcatcacgtaaaggtatcaccaataataagacgcgtaatgtattcatcataaaaactaaactaccaaacactgaaagaattttgagactgcttagttactaattgaatctcccaagagaacaaactccacaaaaacatatcaagattcatgattagataacactttacttaatttgttgatggaaaaaattcttttttgattagatatatgtgcttaattggtatttacaaagtggaaaccaaacaaaatcagtaaaaaagttaaatcaatctaagctcaaatctcaatggaactaatacacaaaacactgttgtatcgccaagtaatgcgaatccaatctatgaagatcctgaaaatgccttaagtttcagatgatgcatatcagctaaccctgagctagatccatcaaaaccttaatggcttcaaactaaaaacattgttcgtttccagagaagaagatagagagagtgaccaaccgtaggcatcttcgacaaggaaattgaaggtatggtgatcgcagttgtaagtgaacttgctgttgctggaggacggaagcttctggagacactgagcagcaatagacgggaaattgcctgtgaattcggtatactcggcgaggatcatagttcctctggcgacgaagctatagataaacgattcttgacccattttgagtcgccaccgagtatggaaccgagttggctcagacagagagaaagagaaagagaaagagagtctttttattctttctttacctttgctgcaaagaaaccaagtactttgcccgtgactcaactcaactacatttcttagtttttatttttaattttcctttttgtatactaaattaaataattttttctttttttggtaggaaaattaaatattttttttcttcatattaaatttgtgttattatttataaatctaatacaattcaaaaaagcgaagatgcatcttaaatttcggcaggaaataagtgtgaaatactcacaaagtcaatatcaatctatgaaaacaatagtattttgatgctttttaaaacacaaaaaaatgtaaaacttatgcatagtgaataaatgaaaaagaaatgaatatacagaataaaataaattctggggaaaacaaccctatcacataaaataaattttgaaatgttgtcatattttattaattttttgttttttgaaattttgagtgtggctcgcaacgacatcactaatttattctcatgtttgtttgtttctcactttaccaatctcacttacagatcttccttcttcttcctcttcctcttccttcttccttaaaccctacaagcttctactctattgacaaatttgattccgagtttacatcgata

SEQ ID NO: 6536 - DNA, 3000 bp, Unknown
  misc_feature (1)..( 3000): cDNA_ID_1814734_gDNA_ID_1621096_Annot_ID_55698 3000 nt of promoter + ATG
tgtagctatttttgacttgaagtgcatgcaaagttgagcttgtgtagtataactatatggaatatgctaactagtcttgaagaggaaatattttgcaatcttcagcttatcttaaaattttaggtgctgctcaggattctgagcaaagacgaccatcaaacgaagttaagaagtcaagaatatctggaaatcgagtgggcggaacaccaaatatgaaagctggttctggatttggtagcacttcattgtcagagaaacatggagacgtcaggaaaggaacaccattgagaagagcaaaggagaaacaatctgagaaagagaataaattgtggtggctcaagcttccctatgtgctggtaggtaaataatattggatttttggttaaaaagctttctttgccagatccaattattaattcacaatcaagaacgaactatcacaaaatattatgagccagacacttaccgttttctcttttcttcagagaattctcatgcggagtaatatcgatcaagacatatctgagggatattttaccttgaggaccgaatctatggaacaaaatgagggtcaagtttcacatatgattgcatttgaagatcaaagtgatgctagaaacttctcttatctgcttgaatcagtttttgaagacttggatgatttcagtgccgatatagctcccgtaacaaccaaggtagatagttcatttctttaccaacttgattcttctttattaatgtctgtatctgtgaagtttacttgtttaggagaattttgttccttaaacccttaatttctcttcatgatctgagagtatactgaattctaagagcagtgagatcgtatttttatttataggatctttatgaggaagttagttctggtggcaagaatgtgatagttgtgaggaagaggcagcttacgttgtatgctggacaaccatttgaagacgttgaaagagctttgcgaactctgattcaagaacgaagatgaaaaaagtaacaacattacttcggactgaaaaaactagagagcccagagatgatcaatgtggagatgacaggggcagtaagaacaatggttccacaacaacaatttttcatgaagcttaaagaaccactgagcttctgttgtattatggtagtagcattggaattgagaggacagatccactagaaataaaaaagattgtttatatcatgtaaaaacgtattttacatgaatcagagagaacaacattttcatcttcagaattttattgagatgcaacgatcttgatcatggcttgtgcattaagccctgttacattcttctcacaaaacttcttccaagcttcttgcttgcttccttcttcgtcttcttcttcattccatgtaaatttctcgaaaagcgagttcaccatactccttgcagcttcccttgcctctggcaacttgtcactcaactgatccgcagccatttgtgcgagcagaatcatcccaaattcttccatttcatttacctcctgataacaaacatagagacaaatatatcaatcacacaattcaagaaaataataactttgctctgagcattttaatcattgttgaagaattcaaaataccattttagaaacgcagttggaagtagacacagcagctttggccctgacacgagggttactgtgacggacataactctgaagcttacgcagaagcggcaagcgagccaccgagttaaccatcgtgttcagcgctttctctgcttcttcacacacaaacttcttgtcttgtgaagctttcatcagcaactgcaacagctgttattttcaccatcaagataccaaaatcaaactttattattaaatcaacaatccatagccaatcaaaaagctaaactaaccggaaaaaacaaaaaacaaaaatcaattttaccagatcgtccatagatttcaaatgaggtccttccagcaacttttctccataagcagtgaagatatcagaacaagtcataatcgaagtcttgcacaatgcacttctaggattcttcatcgccttcaccatcacaactataagcttttctctacaaattgacaaaaacaaaatcatcaccaagaaactccataagatttcagattctggtcaaaaaataaaaaatactcacagaattggtagcaacagagaagagtgatgaattgcaaatctccttgtgttgttcaatgagtcacatactttaatccaatcctttgatgctaattcttcaagtaatctctgtgatagattgaatcaataatcatcaaaaacaaattactacacataaattcagaatcaattgagaaatttaattacctggacagaagattcaggatctgaaaatggtttgagattctcagaagcaacgtattcgacggtcgattcagccacagcgacagggttgttttcgtcatttagaccaatctccggttgctttgagagtttggccagcttcttaggtcgttcctgtgagatcggaagagcgttttcaatgttcctcaacgccattagagataagagaaagagagagattttgatttgaaattcgttaggggaataataatcaatggtggggttgaaaagcttaatataaagagaaatttttgttacctttttcgcattttatattcaaaaattcaagaggaaaaaaagcaaaagaccgttggtaaggttttggctccaacggtcacaagcatcggttcggtttacatgaattagattcggttatctggtttattgttcaattcacacgacgtcgtttcataacttttaagaaacgacagcgtctaagttatcacttttgcgccacacgcgagtgagagctaagctaattctccgtcttcaatggcttttctcttttccccaattgaaattgaatctattccctagaacaaattgattgtgaatccggcgtcatttttgatggaccaagagtatcgaaactctagaacgacggtgacgcaccaccaacatcatcatcaaatgaga

SEQ ID NO: 6537 - DNA, 3000 bp, Unknown; identical to SEQ ID NO: 6528
  misc_feature (1)..( 3000): cDNA_ID_1814730_gDNA_ID_1621096_Annot_ID_55699 3000 nt of promoter + ATG

SEQ ID NO: 6538 - DNA, 3000 bp, Unknown; identical to SEQ ID NO: 2906
  misc_feature (1)..( 3000): cDNA_ID_1814718_gDNA_ID_1621096_Annot_ID_55703 3000 nt of promoter + ATG

SEQ ID NO: 6539 - DNA, 3000 bp, Unknown; identical to SEQ ID NO: 2905
  misc_feature (1)..( 3000): cDNA_ID_3070480_gDNA_ID_1621096_Annot_ID_55704 3000 nt of promoter + ATG

SEQ ID NO: 6540 - DNA, 3000 bp, Unknown
  misc_feature (1)..( 3000): cDNA_ID_2108258_gDNA_ID_1621097_Annot_ID_55707 3000 nt of promoter + ATG
aaggaaagaggaggaggcttcttaattgggggaaacgtgacttgaagtcttaataatgtttttattttatttgttcacactataatgattcaagtatgcaagtgtgtgtctattggtgtgaatggatagtatcggatgaatgaatgacaagaaaacaaaattaatgatttggttaaagtataatagaggaatgaagtgaaatagataatggacttttcttatctttctaaactggagattgtttttcatgttatgaaaaaagtttactggaatatagatttacctcactctgtagcaaattgtacccttttagtggaatataaaaatataattttctacttctttttacccatcatttttatttatataaactagtataagctacatactagttgattttggtctataatatccagatttgagactaattttggcaatcaatatgagaaaataaatttcatgcaattagttgcaccatatgaataggattggtaaaagtgatatagttttcttcttaaatcacccataaatcttaacctaaggatgggcattgaagatatgtaagtagttaagtcaatttgattacccttttctgaccggagtttgattctactaaatcgcgttatcttgcgtagtatggattgactatacatcgagtcttgtggatccaaaaatgtatataaaataaaagatgggcacaaatacttggtaattttcctttatccaccttgaaaacataaacactcatcattattaagataactaatactcattctatttcatattagttgtagtttaaggtttttacacacatattaagaaagtttttaaaaattcatttaatatatctcttttatataaaaacatcatttattataaccaattcaaccaataaaaaatatataattaagtatagttggttaaaaagtattgaatatatttattatttatacacaaagttgaaaacaacagttattgtgaaaaaatataaaaacctttaaattacatttatattgaaacaaagggaataataagtaacataactttgatacttacaattaatttgcaaatagttttacaaaaaacacgtaatagaacaaagcaagtaaagtaaaatatttttagcaaatatttgaaattgaagatactcgtttctcacaagtcaaatacgaatactaattttacccttacaaaatgggtcaagtagcaaatacttgtcctgtgcccatccctaatttttgcaagcaagatgcactaagtatgagagagttttgtagaacctagtgttttatagcaaatctgtaactaatcctaaaatatggaattacataagtagtaaagtagcaaccaccggtttactttctgaggaattagcaaactattaatggaatgaagaccctttctggggaattagcatacaaaactaatatgagaatttcatgtggtgattattggccaaggcaaaagtcttgactacataaattctaccttttattcagactgaacaacagctcttttaatttttacttcctgcgctagttttttgttcctattaaaagagtcattcaagatttcttaggtaaattcttaaatgaactaaaaataaattttgttaagtaatcagaatcaaaggaaaacgatggtataacagtctggtatcatatcccacttggttgctactcgctagtaaacttcaaccacaaccctctgtccctctatgacgttgatgccacttttaagactaacaacaataatattgtcttttttttcttctttcgaatccacatctcttgaaattttgttaaataatttaaaatatgtaatctatatgtctgtgtgtacatatgcataaatcatactccctctgtttctaaatatttgtagtttaaaatttttgcacacaaattaaaaaaccatacaaatctcatttaatttatctctttcctataaaaacatcattaattacaactaatccaaccaataaaaaatatgatgtaaaatacaattggttaaaactattaaatacatttaatgtttgcatagaaaagtaaaaacaacacttatattgaaaaaaataaaaaacctttaaactacacttaattagaaacagagggagtaatacggatctacgagaaaaatttagtgaagtcgcggtcgaaggaccttaggttggtggctagaccatttcgttcaaatcaatcccactttctttcatcaagataacaaagattcacaaacatccttaccaaatgatacaaccaaatgaccaaccaaatgataaaaactacctaaggtctatcatcaagtttttataagttctatttatcacttaatatcacaatggtgcattcgagaggatacaaccaaatgaccaatacacatgtatttttaactgcttgtaagtatcacatatctcatgattttaaaacaaaaatattgatttacttgtttattattattattattttttctatacttatttggtttgatagtagatgtttttatatatatttaagatatcattttatatatcttgagactgtatttatacctctcttctttattctacaaactacctgtcaaaatagttggttttgaaatgtaacattggtgatgatttttcttttgtctttaaatgtaactttggatgacaaaattcagtaataataatgggcctgaggttatgaatatagaattccactttatcacattggacccaaatttgccatgatataatataaaacgacgtggtatcaagtgttcagtgagtgtgagtcctccgacacgaataatctagaaaattttactaagactagtgtcagtatttttctaccacactcgtcgccttgctttacgctttattctctcttctttagctttttatttcttcagcaaatctgatttcaaaaaaatttcatcgaggaaactgaaaaaaaaaaatgagtgacgggaggaggaagaagagcgtgaacggaggtgcaccggcgcaaacaatcttgg

SEQ ID NO: 6541 - DNA, 3000 bp, Unknown
  misc_feature (1)..( 3000): cDNA_ID_3048545_gDNA_ID_1621097_Annot_ID_171147 3000 nt of promoter + ATG
aagatacatgtactaaaaaattacccaaaagcaaaaatatggcttcaccatccaacttcccattttcttgacaatacatcttcaccgctcgctgaattccaaagataaaggccatcagtttttgcagtccaaatgcaattcttccaaccgcatctatggaacaagataacatcatcccaaaacacgtttacattcatatgaccattatctttgttcatatagcaccaaaaaaaagttgagtgaagcatattttctccgaagttccaagaaaatctatttctaaacttcagattaatttcacctagatcatcttctttagatttacaatggatgaaaagagtttcaccagttgtcaaaccgttaacaaccgtgacttgccactcagaaatcttcgggactataatgtctctcgtggtggtgccgccgactaagacatggtcttgacatgttagggccagagaaaagcaaattgccaagagaaattgtttgatgcaattcatacttttttcaggcaagcaaaatctttagggagaacttttttgttacttctttttataatggaagagtgaaacggtaattgacgtttaattaaattttgatgttattacattgcattaatgaagagtcatgctgcaaatcatttaagtgattgcatgttaattagaaatgaagctgaaaggttagtacatataataatccaagtacgtagatgattgtggcataatatattaagattaaaaaatactaatttatattgtggtgtaagctattagttttgaatttattatgtgaatcaattttaaaagttattagtttttagatttagattatgacccaagaattcgaagtatataatcgaaaaatttaatgtataaaaataataattcaacatggtcgatcgggtatttatttctagtaaaatagtatttcataaacctaattttagttaactatataaattataacactagtaaagtattctgccttttacgttactttattgggattaataaaaatatattggattcgttgaaatccaataacaaattgtaattttgatctttgattcatagaaacaaaaagttacgaaattaaagaaatttttaaacaaaagagtactcgaccagaaaaatatgtttttttttctattttctcactcatatttttcagatagagaaagcaattttcagtacaccgaaattaaaatccgacgactaaaaatagtttcttctctctctcaaatccttctgagaggagaggtttcttgtcgatggagtttgatttcggttttgtctggaattttatatatttccgtgtatatacaaacaaaataactgccgaccttttatcggatttccgttattagctttgttcgatttatcaaaattttatatacttttgtgtatatacgctctagcgaaattgatctctcttccatctgtgtccgttgatgtctccgtttttcttctaaatcttatacgatctctccaattttttcgaggagtaacatctttgtcacttccttttgctaagttcatactacatcaagttaggtgtatatagtggtggagtttcctcggagtttggtgttgttcgaagaatttcgaacaatctctttcaatagatctagagattaattgacggttggtttggaactgagatcgttagaaaggaggaagtttctcaaaatgacttcattaagcaaatgctttttctttgcattcttgtgtttcattgctctcttgactccatgaatggcaaaattaaattacctaggtgattatttacgctatcctacagatattttcgattttttttgttttgttttgttttattaaatattatgttttgataaatttagtttctaatttactaagcactcactcatccattcaacaaattcaacaagtattcttatttcttagtgtcaaagtacttttcttatcaaccttatcaacaatgtatcacactcacactcttcagaaataaatttctatcctaaaccaagtttaaagatgataatgttgagattatataaaccagtaagtatatggttaaagtgaaaatagtgctatatattatttccttcaacataataccgtagtttctaatttgattttctaagtaaatctaaattgaataaaaaatttacttttatcactaattttaattttaactttttataaactagatatcttttttggtaatatatttttaattgtaaatcattgactcatattttcatttacctaaatactaaaccaaaacaatcttttcaactatatattttccccatgtacttaactaaaatatcataaacaaataccatacgcagcgttttgaagcatacgtcgcatttctctttaatcgttaatttcctgatttaggcttcaccaattttttttttttccctgataaaaattttagcttcaccaccaccattgttcgtttgggtgttttgaacattgatgaatcgttgcttctgagatctcgacgaagataaaaagctcttcggctacttcaggtaaatttcaatttcgatttctgtatcaccaatctccttgcgaatgaggttttgtaaaccctaaatccagttttgaacctctttctctcttccctagtagctctctttctctatccactaattctagcattttgcatcagtattcctctctgcgttcatttctgttttgatgtatgtgattgccctaatcgtcttggccgttactcatttcgttttccttttactctggttctaggtttcgagctcactctgctagaaaccctaaaaatttgattttgtgaacttcccgtggtaaatttgaaagggagatatctcagaacccctaccaaggacgaatcttgatcagagcagacttgatttttgaggtgagaagcttagggaaagttttgttaattgtgcgttcgaatttgagagttttgatagacagtgtttacattggaggttttagattgggtgtaaggaataagtagataggt

SEQ ID NO: 6542 - DNA, 3000 bp, Unknown
  misc_feature (1)..( 3000): cDNA_ID_3090457_gDNA_ID_1621097_Annot_ID_171141 3000 nt of promoter + ATG
atacgaatctcttcgttttttttattttgggggtcaaaacgaatctgttctctgctcttttatactagtcttctgaaattgaaatttgggttttcatttcttagctcatattgaattatatattgtacccagttctcttaagtctctaattgtcggaattttagttttggatggtttgcttatgttttctattggattaaagctccaacttttctccacttttgcagcttatgaacctttgattttgtttttttttgaaatgttcagtaataacattctatatcccaaggaagacaaggagcaatcaatcctcctctatgcgtgccgtaattgtgatcaccaggtaaactttgtttactatgctttcttttataaaattaggtttccttagtgttaatggaacaatgtggtgttgaaacaaagctagggctgaaaccaatagactttagttgttcacttgtatatgatttgtgttgatatttatttaagctctgatgttttactctttgtaatcgcttatacggttaaaggtcgaatgtctgaacttgaagtaaaccaaggaatgataatttaatgagtttagatcattttccttgtctctcatatcatgaatctgattggttaagatagtagtgcttatcagtataaagagttctttgagaacttctgaacaaacgcaagaccttttaaaaaccgtttagagggtttctgcaacttaacttctaaaaccatttgagtttcaacaatatccattggtgttaccgaatctgagtttttttttgtttctactgtttgtgttatgttttgttattacaaagcattatgcctttgttagctactgaaaaccattctagatgaatctctgtatgggatctttagcttaatgcccggacttgctaaccgaattagttataaacttactgagttactgttagctatttatcgtcctgttgatagaaggtcttgaaatttatattcttttatttggctttgcaggaagcagcagataacaattgtgtttacagaaacgaggttcatcactctgtaagtgaacaaactcagatcctatctgacgttgcttccgacccaactcttccacgtaccaaggctgtgcgatgcgccaagtgtcaacacggtgaagctgtcttcttccaggtgaatcattatcttatatcttaatctttaattcgtcatcaatcaaggagtaaagaaacattctttcgtttttctctgatctaacttaaagatcaaaagagatttctttctcttgctttttaatgtgcttatggctatttcggtttgatatagctcgtgtgtgtcatcgaattttcaggccacggctagaggcgaagaaggaatgactctgtttttcgtttgctgcaacccgaactgtagtcaccgttggagagaatagattgatagaagactacatttttcaaatgtaacgtgtatttgtgttccgctttatgagttttatacaattcaatttggagttttctgtgtaaaaatatgaatactatgagactgttctcgggtttcttgaattgtttcagggtcttttatgatcattttggtttttatgtgggtctaattataaatttgtcgttttatgcggggccgatctgaaaattcgtccataaaccatgatagtgttgaaaatttgtatacgtggagtctagccgccggctgctataactttgctataacgtgtgatattataaaaagttgataaatctaatcttctaaaccaaattgttttaataatgctgtgtttacttcgtcatcgtatcgaattatacggctgctcttgttaagtgatgacaatatcttcaaataaagttttttcttttgtaagcaaatatgataaaactacgttagctaatagccaacttggtccatcatagttcataaagtcaaaaaatcagtaaccaattcatgagtggaattatacttgattcaatgacactgtttaggagcttatctaaattgcacaagttttgttacacgtaaaacacaaatatgccaaattagacatgtttctcgtcattctaaaacattaacaaatatttacatagacgcagtcaaataaatcaaatttcgtatgataaaaaaaaaacaaaaaaaatagcaaggttgatttgtcaatgctggcaaaaataagcaatgtcctaatttctcaagttggaaagtgacatttctctacccattttttgaaaagatattctcttttgcatataagatttgataaattgaacgcatatttgcactcaagctaacgttatgtacttgattacttgacccgactaatgacttattgactttgattaataaacaaagatattagccactccattctacattatatacaatctatacgcatctatatatatctactaaaaaaattgtaagtacatacatatcaatgttaatttgtatataaggagctaagaacaaacccaattaggcaactagcaattgctaaaacacgtaagatctcaaatatgaccacgttattcctccttattgctctattcatcacaaccatcctcaacccaacaagtctctctctctctctctttaatctcacatgatttattctcattttcaatttttatagatatataaacttaatcataattaaccttaattatgttatatgataaactaggtggagaatcagtaggtgtatgctatggaatgatggggaacaaccttccttctcaatcagacacaatcgctctctttagacaaaacaacatccgacgtgttagactctacgatccaaaccaagccgctttaaacgctcttagaaacacgggtatcgaagtcatcatcggcgttccaaacaccgatcttcgttcactcactaacccttcttccgctagatcatggctccaaaacaacgtcctcaactattaccccgccgttagcttcaagtacatcgccgtaggtaacgaagtatctccgtcgaacggcggtgatgttgtgctccctgccatg

SEQ ID NO: 6543 - DNA, 3000 bp, Unknown
  misc_feature (1)..( 3000): cDNA_ID_1814892_gDNA_ID_1621097_Annot_ID_55710 3000 nt of promoter + ATG
aaatcaattcctggcgttttcatgaaataacagcgatggggatggacctctgagcaccgagaataggcctcctcgtcgaggcacgccaccacaaggtggcggagtaatggcttagtcccttttccgacatgaaaactgtggagaaacaaatcaaacgtggagttcggctcagaccaagccttgtttaaggtggttattatcaccgtcttatcctccgtcgctgcttccgtcaaaattttccccaattttttcagatcttcttgatgatgctgtccaataattaaaaacaagattcaagaacagataattgtttattttcgtttcgttcctttttaagctactcatacagtggtaaaaggaagagtacttgccaaaatgaaaaaccaattaataacaagaaaatttgagcaaataaaactgatttaaagttaaagttaattgtacagcagcacatacaaattagttggaatcataagcgaatggtatgtaagaaaaaaaaaacctatgattccgttaaattcaaagattttataaaagagattagaaagagaaaaaaataagcaaaagtttttttttttggtaggaaaaaataagcaaaagttgaaaaagaggatttgtaaaagtatagaaaaaatagatattcaaaaacaaatatacacatacatacatgatagatcaaagatgataaggtgaatcggagaagaatactaacgacatcatcggagaagtggagaaacagttgtagtggataaacaccaatttggtagatcaccaaactcagatcggcaacgaccagcaacacgactcatagatcctcgtagcaacatttgcgccatcttcctcacagcctttgacgctggtcgtggtcgttttgaatggctcatgaactgaatctcaagtcaatgtacttatgggtatacatatacagtacatgtaaaattctagattacaacaaaatagataagtttaattgtataagaaaggtataattcggggaaaacagggaaacaaatgtttaaatcctttaacgctagtcgttttgaatggatcatgagagtcagtatacttataggagaagataattttaattgtgtaagaaaggtaaagtatgaaacaagtattaaatgagaaagcctattgaaggaaataaatccgcctccggaaaatatagagcctttagacttgaacttccacatactaaaaaaaactaaataagtaaataaatctgtgctaataaataaaataaaataaaattagtactatgtagttaagaaattatgataaagattaattattaagaaaaataaaggaaaatactttgatagttttaattatttagataatataatttttaaatattgtagttattattatttaattatttttaaaatgattttttaagaaaaatatattattaggcaattaaaaatccaattggtactaaatttttattgtcaatttgttttcttaacaatcttcaaatattaattgtaataattgttgtttgtgcagattactcataatatccgactgtggagattatcaaacttgtacgtactcattgaggctcagtaagaatgccctacttacttatatttccttgttttcttaacttttttttcccaaggatctatctcttttggtaatcaaaatgtaatcccaaattctctttcatttatatgatattaaccttttagcgaaaaaaaaaaacttgtacgcaagagacggtcaatgtcacttgggacattatgtggactcttccaaaaaccctttagaatgttgtcattagagcttgaggttctaacggttaagagcttttttgagctttatatatattattttggatgttatccgggatgatataattttccatgtaatatctataagattttactttcgttgtatttcgaccccaaatctttggatgcatggctcgaccacttattatcgatcttccatcgtggtagcacgtatgagttggtccatcgggcattggcttcctgctatgtggtatggagtacgttgctccagtgcacgttggttggagtatgtcgcttctggcctcttcatcttttttcaatggttttttgctttggactagtcgattaattcaattgattggttcgcatttagtttttagtgggtttttgcaactctcttaggatgtgcttttgatgaaacaatccgatctattcattaaagaaaatcttacatctaaatttatattcttaaccaaacaaacatgtgttatattattaaccatataaacgtaacaaatttttgttttatcaacacaggtaacatatttattgtttatcttaaacataaaaaaaataattatttctacatgggttttaacttttaactcaattaattgaactgccggtctgattttccctgacttcaccaaacctatatacacaattcgttagattgactgatatcattagttttcgacataaattttctattatttccactctcacgttgtttaatcggtccgtgtttcaagagtttttgaaacgaatgaaaaaaaaaaagaataattagacacatagattttccgggtgacacgcaaatgccggtttagctagcattcgaaggtaagtgatgaaatgactaaagaagaaacgatgataccaaacctaaccatcaagcaaaaaggttgatatacctactatttagatgtatcctcctagaccttacattattgtatccactttaagaatttggctttcgtttcaaaagaaatacaaaagaaatcctaacattattgtatccactctaagaatttggctttcttttcgaaagaaatacaaaaaaaaatctgaaacactttcgaataatttgttgattaccttcttcttttatattccttgtgatctgctttacagttttatacatacacatttgattggaccattggttcggtattcttaaacgaccggagatttatccacacaacgtcttctcgcagccaaacacatcaaactacacatg

SEQ ID NO: 6544 - DNA, 3000 bp, Unknown
  misc_feature (1)..( 3000): cDNA_ID_1814888_gDNA_ID_1621097_Annot_ID_55711 3000 nt of promoter + ATG
ttatataaaaaattaaaaacgtaatcaaattcacttgtcattcaactgtataatatttatttaaatttcttactttaaaatcatattattcgttttctcctcttttatatgattccattgatctttctttccatcgaactaaccaaacttattgatttggtatacggtcctaattttaaagattagggcagcaaattaattacctgaaatctgcagacataataatcatcaccgaacacgtgtctcagtgtcggaaccggaactcgaacagggttcctcggagagaagagtacgctcatgttgaccagagccttgactttctcaggtcggtattgacacaactgccacgcaatcatcgctccccagtcatgaccaacaacagaaaccgccttgtctccgccggtcacggcgacgattagtgcgaccacgctccgtccacgtttaagtaaggtgtagtcttcaactttctctggcgcttctgtgtctccgtacccacgaagatccggcgcgatcgtacggtatcccaaggaagagagcgcaaccatctggtgtcgccacgtgtaccaaagctccggaaatccgtggaggaagagtatgatcggatcttctccggatccggatccgggtttctccgccacgtgcatgtttatgccatttacctttagggttttgtgttctacgccgtcgagtctcgacttctctggtcgttttgtttgattgtcgggtaatgtagagaaatgggtagttggatttgggttttccccaagaaaacgacggagtctgagaggaaaatggtgtcggaatcgtgaaagtgagagttttctacacaagaagaacatgtgtagtttgatgtgtttggctgcgagaagacgttgtgtggataaatctccggtcgtttaagaataccgaaccaatggtccaatcaaatgtgtatgtataaaactgtaaagcagatcacaaggaatataaaagaagaaggtaatcaacaaattattcgaaagtgtttcagatttttttttgtatttctttcgaaaagaaagccaaattcttagagtggatacaataatgttaggatttcttttgtatttcttttgaaacgaaagccaaattcttaaagtggatacaataatgtaaggtctaggaggatacatctaaatagtaggtatatcaacctttttgcttgatggttaggtttggtatcatcgtttcttctttagtcatttcatcacttaccttcgaatgctagctaaaccggcatttgcgtgtcacccggaaaatctatgtgtctaattattctttttttttttcattcgtttcaaaaactcttgaaacacggaccgattaaacaacgtgagagtggaaataatagaaaatttatgtcgaaaactaatgatatcagtcaatctaacgaattgtgtatataggtttggtgaagtcagggaaaatcagaccggcagttcaattaattgagttaaaagttaaaacccatgtagaaataattattttttttatgtttaagataaacaataaatatgttacctgtgttgataaaacaaaaatttgttacgtttatatggttaataatataacacatgtttgtttggttaagaatataaatttagatgtaagattttctttaatgaatagatcggattgtttcatcaaaagcacatcctaagagagttgcaaaaacccactaaaaactaaatgcgaaccaatcaattgaattaatcgactagtccaaagcaaaaaaccattgaaaaaagatgaagaggccagaagcgacatactccaaccaacgtgcactggagcaacgtactccataccacatagcaggaagccaatgcccgatggaccaactcatacgtgctaccacgatggaagatcgataataagtggtcgagccatgcatccaaagatttggggtcgaaatacaacgaaagtaaaatcttatagatattacatggaaaattatatcatcccggataacatccaaaataatatatataaagctcaaaaaagctcttaaccgttagaacctcaagctctaatgacaacattctaaagggtttttggaagagtccacataatgtcccaagtgacattgaccgtctcttgcgtacaagtttttttttttcgctaaaaggttaatatcatataaatgaaagagaatttgggattacattttgattaccaaaagagatagatccttgggaaaaaaaagttaagaaaacaaggaaatataagtaagtagggcattcttactgagcctcaatgagtacgtacaagtttgataatctccacagtcggatattatgagtaatctgcacaaacaacaattattacaattaatatttgaagattgttaagaaaacaaattgacaataaaaatttagtaccaattggatttttaattgcctaataatatatttttcttaaaaaatcattttaaaaataattaaataataataactacaatatttaaaaattatattatctaaataattaaaactatcaaagtattttcctttatttttcttaataattaatctttatcataatttcttaactacatagtactaattttattttattttatttattagcacagatttatttacttatttagttttttttagtatgtggaagttcaagtctaaaggctctatattttccggaggcggatttatttccttcaataggctttctcatttaatacttgtttcatactttacctttcttacacaattaaaattatcttctcctataagtatactgactctcatgatccattcaaaacgactagcgttaaaggatttaaacatttgtttccctgttttccccgaattatacctttcttatacaattaaacttatctattttgttgtaatctagaattttacatgtactgtatatgtatacccataagtacattgacttgagattcagttcatgagccattcaaaacgaccacgaccagcgtcaaaggctgtgaggaag

SEQ ID NO: 6545 - DNA, 3000 bp, Unknown
  misc_feature (1)..( 3000): cDNA_ID_1814884_gDNA_ID_1621097_Annot_ID_55712 3000 nt of promoter + ATG
tagtagagtcaggatccgccttgaagtatccaaaccgacaatccaaacgtttttatacccgattgaatggagccatgtccagccgcatcagagaaagaaaaccaacaacggacaaagccttgatcgccgtgtcctgcaagcatccgtctatggccaaaaacctcatcgccgcacctccacgtcgcggccggtgccactgccaagctccaatattccctcattgaagtaaaacgaagtgttttgttttgacttttaagtaccctaaaggcctaaacctaataccgacgcccgaagccaatatatacacgttttaaacgaactttctaagggagaacgaatccagcaaacagaagagatagaaagcagcaaccaaagagcctccttagggacgtctccaaacaaagcaactcgcctccaagctttagatttctttttcactttgcttttactttcaagggataagatcttacatctgtgtatctgttatcgagaagtaatctctaaacctgcttgtttactttcttcatacttttttccatatatatttctacaattcgtttcttttacgttgatgtttttttagccatgattgagtagttttcttgtttctgtttctgttggcgtctcttatgaaatacacggaatatagtttatgattttttctttcttattgatatagttttttgaaatttttcccttcaggtagaaccatgagtaagttcatatagaagaacagtatgaaacaaaactattaattatagagcgaatgatggtcatcttaaattgagttcaaatagtcaatttgcagctaagtaatatatatatgagataaatttaacatgtgatatgttaaatctgtaaaatataagcaatcataatatatcatatatgggaatgaaaggaaaggatagggcagaccgtcaaaccgtccatggctttggaaggagatatacattattgagggaatagtgattatttaaattctttgatacgaatgattattaaaatttgattccatctttgtgatgattacacgtatcgatatttttcataattaggaatatatcagaagttacaacttcatattaaatatttgatatagtaaaagaaaacgagtgttcataagaaaatgcaagtggatagaaaagtaacgaaatgctcttgttaaaagaatatgttggtttctttagaagatttttctatataaacggcattggcttccttttcaaatcaaactaaaaccaaagaaacaaagataatacactaaaccaaaagacctttcttctcttctttgtgcttcaccaatggctcaaaaggataggaatacaaggatagctcaaaaggcttttgaaatggtcgataaggtgtatggtaagtccccaaacctaaccactaaaccatatgatcctaaagacgagtccccttctcgctttacccaaagtgcttacaaatatggtggtccaaaaatctataccgtaagagaggcgactagtacttatagttatggtcgagctatttatatgtacgcacctgagtcaactataaaagaacctgttgtttctcaccccacagaacatattcaatactatggtggtacccgtccttttgttgccaatcccaacaggtttgagaggccgaaaggacgggttattaactgcgatgaggcggtccaactctatggaggggtgcttataaaggaatttcgtaaataagcggtgaaaacctcaagttatgttgaagatccatggtgagtttgtaaataagtgtgatagtttttgtttctgcttgcgaaaaaagttcagaccaacacatatgcgaaagcttgttgcaacggttttgacgtagaataagctttagagcacaactaagtgtgcgtgtctgttatctatctagaagtactttatgttgaagcttatgcaatgtaaaatgttacggtactatgtaaacatgtgtgtcttgactttttgtaacataatttaataagcgtatgttaaaaaaaacataaataagcacgtcatattttagaaacgctaagcagaccaataatagactcccttcaaggcggctgtgcatatggatcatgtgtacagaaattctaatcttatcggaattatgaaatgatttgtatatactacaaacaaaaaaaatcataaaaacatattaccagatataagttaatcatgttttttcatctcacattaaatttagtttgctttaacataattataagatgatgttttcgcggatgaatcgggagccatcacagtcacatgcaccatgaataccctaatatcttgtgtgaattccaacatcaagtcgtggatgatggtcgaaggaattttccaaagtaaatggtagttttgaaaatgaggtgacaatagatttgggcgacgacaagaaagttgaaaggaaaaatatgtggtcaccgaactcttaaatatcttatactattaaataagaactagttattagcgaatatgaatatgaatataaatgattagaaaagaagacatgtgctaatttttttatttatttggtatggttaattttaaaaaatgttgttcaatcctatctctttttttttttgtgtgtgcccctgttctctcaatgtttccatttttgtcattatatcttaagtttacagagaaaaaagggtcccatgtgatagagaattagcaaacacaattttttaaagatgagttttatacattcaattttgtgaccaatcacctccaatggtataaaaagaatatgaatttccccgcaagtatagcaaaatccactggaaacaaattttaaatattttgggatttttgagaaactaatgactgcctcaagttttttaacggtaaaaacctaactttccctcccttcttccacatataagtattgacttcgaaaccaacttacttttagcaattgatattctaaaaaatcccaaaacattccccgaaaaaaaaaaaaagaatgtggaatggatggaattattcaagcaagatg

SEQ ID NO: 6546 - DNA, 3000 bp, Unknown
  misc_feature (1)..( 3000): cDNA_ID_1814877_gDNA_ID_1621097_Annot_ID_55715 3000 nt of promoter + ATG
aaatcaaaaatgtaatcttataatctcatgatacaatatattttaggaatgttagttcatggtccataaaattaatatatagaaaaatattttactcactttcaaaaattttttataaatattttactctttcggtggggtttcagtcttaattagtacttgtaagaaagaagagaaggtttaaataatttaatactgtactcagacgccagccatttgtaaacagaaaaacttcacgagaccaaaagaatcaaaattttcgtttcaatattatgtacctaaaacattatgtgtagttgaatatgaaggaaaatagtggaaactagagaaaccaattgactagagaaacaaattgtttattcaaaccaattagtgaccacatattttactgtcatgaatgaaatataattcgataataagtaaaccaaatatcttttggtaaaattggtagacaacgaatgctatgttctcttacaaacaccggttcatgaataccattagaaaaaggggcatacttggatatatgttatattctgagaacaaaagactgaaagaagtctttaaaaatcagatagagaggaatatataattgtagagttgaaatataccaaatcttaaccgacctttctcttttttctcccattgttgctttaaccttccgaaagcaggattccatatcccttctctcccaagatttctgaagatttttttcttagtcatgtacattattaccacataaatatacttacttccattacacgatgcatatatatatgatatatttagatatatattccctataaagaagatcatgttaaaagtctatgaaaatattgctaccagagtttcaacttgcatatttgaaagcttggttgtcttgtcgtagaagagtcttcttgtatctatttttctaggcttattaatgacaaatcaagatcattttcatcccaacttatatatatgccaaaatgttcagccgaatccatcaaagcccttagtttatttatgtattgggcgttaatcacaggttggatacactcgcaggtttcactaacgttagtgaaaagaactgggctctaagaaatcatatcttcaccagccacatgatctgtcaaaaccttacggaccaaactagtatattgcaaccattcttataagaaaaccaccaatctaacactctagtcataacatataacacatacacaaaactaacaaaatctggcagatttcattttgtttttacttaattttaagtttaatctctaaaaagttcgtctatatatattgattagattttcaatatcctccaccaatacgttaatagataaaatgcatcaaatacattcaagaaaagaactaaagtagaattttatgaatatcgtatattaatataatggtaataatgtcctgcccttatgacaattacaccctcagtctctgtctatataaaaggcactaactctgttctatctcctaaccaccctaatcagcaaactctcaatacattcttaatatctctcctccactcgctctttctactaccatggaactttctcgaaaggaccaccgtcatgtgatgattgcagaagatgggtcacaaaacctcaacagaaacacttccaagtcaaatcctaatcttccttatccttataaccccaacccctcttctctctatacacataatagtttctacatctaccacggtccacaagttcgtaccgtcaaagagtccataatatcttccaccaatgcttcttttttggtctatcaatccaactagttagttcaatccatttaaaacagccggtcattttggtcaatcactctaaaaagaaataaaaaatagaaagcaataagcatcaacgttccagttatgctgattttcgtagctaagggatgaagtatggtgtgtctcttttgcagtttttttatttatttagatatgttgtgagtacagatcggttcaaactttactctcttcagagacttgttgtaagattgccacaacttgaatttgtagcatgtaaaaggtacatatatgaaacccttatctttatgtatatgagtacaactttatatgtactttatatatgtagcatgtaaaaagtacatatatgtaacccttatctttatgtatatgatgagtatgtatgtttctatatcactccgatttaataagaatctaacaaaaaaatacgtacgccaaatttttaaggaaaaattccaataacaaaagtcagaaattacttgtactgtacaatttccaaaactatatataacataaggaaatataccataacatattttccagttaaataaagggaactatttaccggagtatatagtataacaacttgcaacataatcagcttatattaattctgtgtgatatgacatttcaaaaaaaaaaatccttataaaactatttttagtacagaaagtttatattgtagttatatattgatttaaatataaaaatacaaaattctcctgcgtatgttcttttttcttctttctccaaaatttttgagtcgaatttaaatttgggtggatctgaatgaggtgatcctaatcactagttgaagttactagaccactgctccaaaacgacatcactcctgcaagtggacctgcaacagaaacaaaagtgttgggccaaaacacacttaagcccaaaccatttaagttcaagacggaaacgacgacgtccagctctcaacgttcgtcttcaatgttcctgcaaaaagacaaaggaaacagagaaacagagatgacgaaagcaaaagcttgtacggagacgaccaagctttcaaaccaattctcagcccttgatgggttagagacaacaggatgaagacacctgtaagggtttagctagggtttcagttctcaagtgttcttgtataaaagctaaagcttgagccgcttgtaaaactcttaagaatgaatgaaatctgaaagttaagttacaaagcttctcatagattcataaatctcttc

SEQ ID NO: 6547 - DNA, 3000 bp, Unknown
  misc_feature (1)..( 3000): cDNA_ID_2173891_gDNA_ID_1621097_Annot_ID_55717 3000 nt of promoter + ATG
gtttgcacatttcccgaaggcagaaataaatactatatcatacataattagcttcttataattaattgcattttcaacataaattgcattttatcccccttaattacgaaattcctttataagaacccctccatagagctgaaccgccttatcgcagttaatagcccgttcttgtggcctctcaaagcggtcaacatggccaataaaaggacgagcaccactgaagtattgaatacgatccgtgggatgataaaccaccggttttacaatagttgactcatatgaaaactgagaaatgactcggcgagcagtaatatctagttgcctcttttacagtataagattttggaccaccatattcgtatgaattttggttaaaatacgaaggaaactcgtttctaggaacatatggtttaggggtaagtttatgagacttaccatacatgttatcgactatttcaaaagccttttgggcaattcttgtattcctatcattttgagccattgccaaggaagaacaaaaaagagaagaaaggtgtttttgtcttagtgttatctttgtttcttcggttttagtttgctttgggaaacaaagccaatgagcttccttatataagaaaaggataatgaacctacgtactcatctgttgacttatcttttaggaattatcccttcactttacatgtagtctttttttttgtctaaatatttaattcattaatcaaaagaggatgtacaaagatttttttttttatatgtacaaagttacatagtcatttttattagattatccctttttttagtggttaattgaacataaacttaaatttgacattacaaaggggtccttttttcccaaacaaatactgtttcggtaaaggaagacaagaatagacagtatatgtagtagatataaatctgacattaaattccttttgacccaaaaaaatgaacattgtattactttataaagaattaagacagtagtaggcggtagtggcgacaccaatttgcttctcatggtacgacatatatatcttgtccgcatttgacttatcgatatcagagagtcatcacggaaccatgttcactcttaaaaatagggggttaaataagcggatccttcacaataaattagttcagttctatagaggcctaatttagtttgtttttattggtggttgaatcatctaccttatgcaaattatttcaaagcaaatggtgtttccccactacaagcaaattcaaccattcataggttcttgaaaatttgatccgaagagtaaccatgcgatgaatgtatttttttagaattaacaaaagactaataaatcaaatttaaatgaaagaaattgctcaaatattataaatttcatgtttgacaattgattattcatattcttaaaaaaaaataataggatagtatagtataaaattataaattatttgagttgttaattataaattatttcgaaacgttagttgttctgaaaatgatctcttaaatctacgtaactatcaatattgactctatttttaatagagtcataagattagtttaaaacgaattatttcagcaagaaaaacattttccacaaatatgtaataaaactatgaaaggccctaatcgtattaagaaaacagatttgaaattatttaacaagaaaaaacgtttatgatttctgttcctaaaatattctcttcaattttggagagaaatgtttttgttttataatcatcaaatggtaagcttttaagaataatgtagggtcctaatatctgtctaaaaattgaaatatatatggtgaaaatttggaggaataaagagaaatatcattctttcttatattttttgaaacggcatgggatgctaaatgaagtctatactctatacatcaaggataagcaatgttgaggaataatagaagaaattaacgggatgctaaatgggaagaaataatagagaatataacaatgagaccactggtcttttttgcctagtgcaattaactttcgcaaaatagattccctatcaccaaatttgcatatatacttccattacacgtttcatgcctatgtagactgttaggattacaaagtccaacaaagtatctttttaattaaaagtgcagagtcgaagtagcagagagaggagatacggctccactctatcttctcattcctctaataatatttacgccacattaggccacaaatatttccacgcatctcaatacataaaattaaggaaaataaaattacgtacaaccttcattttgtaagaatttacatctcactaatcatttatactataaatcatatcataaaattcccttataagtatcaattcctctatttttttgccatgatttattatatattatattctatttatacgatttaattagtaataataaatatatacttctagaatttttttatataattcgagaaccaaaaagagtacacatttgtaatttattgttcttacattattatgaaaactttttttttagattaatttaaagagacgagttagagtagggcttataaacaaatataaaacaaaacaggtcgtttaggcccatttatttgttaaggaaacgggtaccgcgagaaactagggggaaagtgatagaccaaaaaccctaaatctattataatcactcttttataagtagtccatttatttcaccgccgaatatgacaaagaggtggagctaggtcaaggagataagaaatggtgtcgatccatttccactcacgctctcgtgcaaggagaaagtgtcgtcacactggttacggtaagtccgaatgaaaatgagtatccaataatctttgataggtctcttcattttggtactttaataaacagtttgtcttcggtactactctagttttttggactgcaacgtactctggtttggtggtactgtaatattatttatgatcgatgaaaattatttagaaagtttttctggttttcaggtaaggataca

SEQ ID NO: 6548 - DNA, 3000 bp, Unknown
  misc_feature (1)..( 3000): cDNA_ID_1814861_gDNA_ID_1621097_Annot_ID_55719 3000 nt of promoter + ATG
tcatatctacataaatctgcgaaactggctttcccgtcttcactggatccttcttcttcactattggatcctgcgaaactggctttcccgtcactgccttgtcgtcgatcatgattggcccaccgggtgtgacactcatctttgctatgagcataattgatgaaaacaaaatttacatcacttaaataaatggggagacaaaaatagcaaaaaaaaagtcttccaaaaatagcaaaacaatccacaaatagcactcaaaacataagttgctttagatgttgagatcaaccatgagagagaaacacaaattttttcagttaaaaattaaccgtcggatttcgccattggatggatgccacatcatggtttcttaagagccctcgattaaaaaatttgtcaatgttttcatttatttttgcttgatgattgcttttaaggttttttttaattttttaactcccctcaaatttttcagagacaccattggagacaaagccactagataaaagggatcgaaattaaggatattgcaatagtcagtctcgtagaccaaataaatttagttacttgcttacattcatggtttcatatttacaaaatataagctttattaaaaataataatactataaactcccttatatatatatatatgcttatatatatatatgcttggagttcttattatatactattaataactatcacttcactgtattcttgattttccaatcatgtcttcttcagagcatctataaccaccggtgaatctaacggccccgtcaccggctttccgtcgatcattatgggtccaccattggtgacgcttatgtttggcggcgtcatcttagttcccgtctgcatgcagaaccggtccgccatgtaagaatgctttatgcaaataaaacatttaggccttctagttcttttgtataatcacaaataataataatatataaaagtcatactaaaatttctagaacattttttaattatttttaagcattttgtaaagaaaaaagaggaaaaaaaaacaaaattaaaatttttaaatatagctttattcagatttttgtctgtaaaactattcatcaaattcatgtaatcgagcttttcaaccattaacttaatggatagcaaagtcaactcattatttgacccaaaaaaaaaagccaactcatttatttgattaattaaacaaagtttatattttgtaatcaaagttcaaccaccttacattagaaagtctttgattttttattttgtaatcaaagttgtaaagtttaagattttatttttcttaaatttaaaattttactaatctaaattcattaacacgatattttataaaaaaattcccacaaatagcacaatttcaagtttttaagacaaaaatagcacacaaatattttgaaaaaaaaatagctgtcaaataattattttattttcatttattaaaattaacaattaagaaaagtacaaaaatacacaaattcatcaccagaaattcccaacaatatttttccgccaaaacaatttccatcaaaaaatttccgctaaaatatttttcgacaaaaaatccttcaaaattttaacaaaaaaagttggagagaaatatttacttttatttatttattttgattagttaattacttatatttaatatattaagtttgagtgctatttgtggaattttttgttatttttggaagaaaaaactttttgggtgctatttttgtcaatccccttttatttttagtgtgtttatcattgtttcttttgttttatttgctttggaaactaagtttttgttctaaaaataccattactacaaactttttatgctacaaaccctagaatgatttttaagactttctaatttaatagttggggtttaggtttagtattttggatttatcttttagggtttatatttagttacttaaaatttagttttagttttgtggtattttcagaaaaaaaaatagttttatttttgaaaaagaaacatagtgatggtatttttggaacaaaaactcattttactagtattttaaaattaaccatatttatatatgtctagagaaagaaatttaaatttgacgacgaaataggattacaaaatggaagatttctttttcgaaaaagatttgtagatcatgtttatcatataatagtataatgttatatttaatagatctttctgtaactgattgaagaatattactctgttatgctagtaacttttctttcccttaatttgttacttcgtatatcttttttttttataagatacttcgtatatatcttacactactgcgattaagctttttctctctgctctgctcttcgtgtaagtgttcttttctaaattttaaagattgacttttagggttacagtttactggtaaggtgatgtgagatttttggtgttacgatttaatctataggtttgtctaataatattatggttttatattatctttgtttgataatttgacctgtgtcatgtctatacgattatttgtgtcatccttaagatccgatatacttgcttaatctttaatttccgtagtttgaaggagatagatatgtccgagatcactaataatgaaacttctggagaagggactttaactaacaacgtgaatgattgtggttagtattttgattgttttattctcaaatgactctagtattttagttgatgtaccacaagtatgtgttttcgtggtgtttaaattacttgatatcgttacattacataggatcaaatccttctgaactatatgggacatttacatggaagattcataaattttcacaaatcaatgagcgatccgtagcaatgtttttgagattggtggccaccgatggtaaatgacatcattttcataataataaagttgaaactttctgaatatatatgttttttgtttgctttattataatcttacctatgactatgataggtatttgttaatttatccacgaggggttg

SEQ ID NO: 6549 - DNA, 3000 bp, Unknown
  misc_feature (1)..( 3000): cDNA_ID_1814853_gDNA_ID_1621097_Annot_ID_55721 3000 nt of promoter + ATG
acaagtcattgcggcgttagtgatagcttgttgttggatagctataggtttaccaaggggatgcaaaggaatgcttttgacagatttggagccacatggattgtagtagtcagtaacatatatggctttatattcattataatcacacacggccttgaaaactccccaaccatgggacattccgaccagacaccctttacgcaactccattggtaataccttgtctcggacaataacttcatcttccttcaccgggtcaaaatagtggatattacttgttacatgaatatcatccatagaacttccatagtttatgacacgatacaacaagtaagggttggtggtagaggaggaaaacatccgaagagtgtggcatctctggtgaaaagtaagaaatagacatcagaagaagaagacgaaggaaacagagattatatacaaaaactagaagagatttaccagaggaagtttacggagagaggccttggaagagaggcttagaagcagagacgacatagcttttgctttgatatgtgaaaaaatcaaaaagaaacaaaagggttttcacataggtcatcaaaggaaaagtaaagaaaaaataattggtgcaaagtaaagaatcttgtgcacaaatttgataacaaagatatttcgtttccattttcataagattatataataagggaaaaaggaaatgtggagaaacgtggaaacaaagataaaaacgagagagacattattcttgtggccaggcactttggtcttagatcgagtcaagaagggactttcttggttgactaactcgaaaaccctttctttatttctttttgattcttcactatcaacgcaaagctatgtcgtctctgcttctcagattctcttccaagtcctctctccacaaacttgctctcgtaaatctcttcaatctctctctgtttctagtttttatataatctctgttttattcttcctcttcttctaatgtctacttctttactcatcccacagagatgtaacacctttaggatgttctcctcctcaacaaccaacccttttttgctgcatcatgccatcccttgtggtgaagaagcccaaagaacagagtccctcatgttggacccggccaaagaggattatttcaccaccgttgataagccacttcccaaaaatttgattaagtctaagctagtgggaagttcccatggatggggtgtttatctcagctcccctgattacatactaatcagcaactatccctcgaggtctaaatcaaatcccaagatcattgatctgcctcctcgtcctagtctaaatggttctcaaactgaattggtaagtggtgtggcaatgtcctcttctcctgaagaggaagaatgcattattgctgtcaaatacatgggacgtccggtgagtatatatacgcctggtcaagacagtcaggggttcctccttgctatgtccactagattattcgattattttgagcaatctaagttgatgtattccaagagagatcaaaggttctacatgccaagttctggtggccaccacttgtggtcttgggttggtctcccatccaccacgcctcagtaccatgagttaaagtttcataaccttcctcagttttcgcattccgagttgcagcttttcgattcttgttacagggcacacgagcttgtggagtctccttcaggacaacgtttcttactcaaatggtacgaggtttcatgttagggttgtctgtttgcttttgcggtttcatgttataacatgttctttctttttggctctgcttggtaggtacgttgaaagccctgcgaacaagtcgttagtattcaattgtggcggcacaaagcggttcatggtgtttagagaagaggaagacatgaacatgtgttacacagaagacattggtgatctctgcatattcctcggcaacaacgagcctttttgtgtcaaggccagctcattcccgggactaaaccctaattccatctatttcctcggtgaaggctacggtgtttatgatatcgccactagatccccacgttccttcacacccaagtctacaccaagttcctcctcggaacaaatagtcctcccttactggatccccccaatgtctctctagactctagttacatgtccttcactagttatgcaagattatgctgtgtgtactcaaatttattattcgtcgttaaactatatgttatcttacatggaaaagaaaattatgaggttctatttttgtttaacaacgcactggtcgtggtcgtggactcaagaacatatagatacattaatagatttaagttcttcattttgttgttattggctagttgttttatataaatgtgaagtaaagtcgtgaaagcaatggatatttttgttaatacattaaacaagaaacaccgttgcgtactcaaaagccatcgtgtttgatcgtgtttatcttccaccataaattcgattatattattggctcgtggagctaactatttaggttatatgaataaaatgattagtgtactaatcctgattagagtgttaatatcattggattgctttacgtatatattattcctaacgttcttctttcctcttaacttaaccttaaatggttacctacttatctaaataatgacgataatacccttgattcacctgagtagatgccgacgagttcatgtccttattagtaattttaaaccttaaaaagtaaaaaaaaatcatgaaacattgatatcataacgattctcgctttccttctctcaacgttcccggggaattcccaaatcggcttgaaatttttggagaaattggagcttcgattcattcatttatgaggatctctgatgattagtttcgaaattcgtgaagacatcttcgtccttgctttcgaatcgctgaatcgtgttacgttttctagattcggctgaggagtgaaattggatttttgaatcgatttctgaataaagaggaagaggatcggagatg

SEQ ID NO: 6550 - DNA, 3000 bp, Unknown
  misc_feature (1)..( 3000): cDNA_ID_1814842_gDNA_ID_1621097_Annot_ID_55724 3000 nt of promoter + ATG
agtcccttcttgactcgatctaagaccaaagtgcctggccacaagaataatgtctctctcgtttttatctttgtttccacgtttctccacatttcctttttcccttattatataatcttatgaaaatggaaacgaaatatctttgttatcaaatttgtgcacaagattctttactttgcaccaattattttttctttacttttcctttgatgacctatgtgaaaacccttttgtttctttttgattttttcacatatcaaagcaaaagctatgtcgtctctgcttctaagcctctcttccaaggcctctctccgtaaacttcctctggtaaatctcttctagtttttgtatataatctctgtttccttcgtcttcttcttctgatgtctatttcttacttttcaccagagatgccacactcttcggatgttttcctcctctaccaccaacccttacttgttgtatcgtgtcataaactatggaagttctatggatgatattcatgtaacaagtaatatccactattttgacccggtgaaggaagatgaagttattgtccgagacaaggtattaccaatggagttgcgtaaagggtgtctggtcggaatgtcccatggttggggagttttcaaggccgtgtgtgattataatgaatataaagccatatatgttactgactactacaatccatgtggctccaaatctgtcaaaagcattcctttgcatccccttggtaaacctatagctatccaacaacaagctatcactaacgccgcaatgacttgttcacctgatcaaagcaaagattttgcagttgctgtcaagtgtttaggacctatgatcaatttcaataggcctggtggcacacacaaggactcgggttcggtcatctttaaaaccccttttcaatattttgatcaatcaaaggttatgtattcaaagagagatgaaaagttctacactcctagttttggagggcacttcttggttttttgggattctttcttcggagaggatatgaccggctctgagttggttgagttgcggttttgcaacgttcctaagttgacccagtccgagtgggagctcttgactcatgttccaagactgtataccttgtggagtctccctcaggccaacgtttcctaatcaagtagtacgctcagaaccaccaaccaggtgattcgatgacattcctgtgtcgcggaacaaagcgtttcatggtgtttagagagctggaagaagataaaaggaccatgtgttacacggaggacattggagatctctgcatattcttaggcaataatgagcccttttgtgtcaaggcaagctcattccctggtctaaaccctaactccatctattttgcaggcgatggcttcggtgtttacgatatcgccactagaaaaccacgttccttccgtcccaagtctccctcagccttctcgtcagcatcactcctcccttactggatccctccaatgtctctttagtttacttgttcttcactagtcatgttctgtaacttttgttttttatgcttataattgttcttttgcgagcccttggacgttggccgccatcttcatacgagttaataaattttggtgtgaggaaatatacgagtcaatttatgaaacgaaggtagtaactttcgtaattccttttttttttttttttttctctggttgtatgaatcattcatcatcgatatcttatacttttgtatcatgatcgtatggatcattcatcatggaccttgaggggttactcaatagagagcagtagtgtggaagaccttcttggtatgactaagctcagaactctcacggtccattcccttgatggttgtacgttagaaactctgtctgcatctctctgtgaatcgagagaactcgggcagctttcattgtacgaggtcatgcatgataggcataatgaaggaaaattagttcttgatttgattcaactcaaatttttaacggtgggcatgcatatgcctaggttgcctgatcaacatcgattccctccaaaccttacgaacatatgtcttcggtattgttgcatggaagatgatccaatgccgattctagagaagttgctccacttgaaattggttgaattatcatatggtgctttcactgggaagaagatggtgtgttcaaaaggtgggtttcctcaattgtatgagctaaatttatgatttggaagagtggatagtagaagaaggctccataccatgtctccatactttgactataaatgaatgcagaaagttgaaggagcttccggatgaggtcatatacataacatccttaaaacaactgacaattggaggaaggaatagtgaatgggtgtggaaattgtctgaaagaggacaagatcactacaaagttcaccacattccttgtgttcagtttatttactagacctttgtctaattttatgtataaaaattataacaatgtagaaaactacaacacaaatgagatcaaattctgatttttaaaatccggttgtgatgattattaatcgtggaaaaaaatcagggattataacttttgttaaattgtgaacgtacaatattgaactgaaaatgccaaatgaattggttattattactttgatgaaaatgaattgatcgtttaattttttttatatttataacaaaaatgcgatatgctctttttaattctttatttctatttttgcttcagaattttttttcattttatttttggtcaaaaaggttattaatttccttttcaatttgtacgaatttaaacggtgacgtttttgtttaaattatcaaacaaatcaaaacaaaatcaataaaatctaatctctcatcatgaggcatctttgactgctctttaattcactaaaaaagtctaaaaccctaaccattgccctttttcaaacgaagaagaagaagacgaaacgctaccatcatctacacacacacacccaactacttttttccatcgccggcctgtacaa

SEQ ID NO: 6551 - DNA, 3000 bp, Unknown; identical to SEQ ID NO: 6540
  misc_feature (1)..( 3000): cDNA_ID_2108258_gDNA_ID_1621097_Annot_ID_171083 3000 nt of promoter + ATG

SEQ ID NO: 6552 - DNA, 3000 bp, Unknown
  misc_feature (1)..( 3000): cDNA_ID_1814838_gDNA_ID_1621097_Annot_ID_55725 3000 nt of promoter + ATG
atgaaagaaaggtcgaaacccgtaaatcaaggttcgagtacggattaacaaacgagtggctcggatttacgaggagtgactcggatttaaggcgagtgatctaacccatggatcaagattcatataaagtatatatagacttgaaatgatcttagctgataaaccatattctatacttttaaatctaaatttgcttcataatcataactgcaagaattaaaaagtaattggtatattttaattatgggattttgttacaaaatatatggtcaaatcgctgatgcatatatatagttcaaaaaaaaaaatctaatgcataaattgtttagaaaaatgtataagtgcatggaaggaaggccacacatttgatcttttacatgctccaactagatcagtaacttctaaagcaaacaccactctattcagcttctagctatgcaagaatttgttgctattacctattgggggttatacctttctaatatttttgttaacgattaagtttacgagcgaatacacatgtgtacgtacatatatgatatatactgtcaacatataaatagttgtgtgtatacatgtagtgttgttagaaaatgcgttgccttaatcatatgctagaatgtgcgttgatgtattattctgttttatttaagatagcatatattataatgtattttgcccaataatttaatacttgtaggtcatagtctcataagatgtaggaggcatggtttatacttaatactttatagtctccaaataaaatcatggtatagacctaaatttttgggaggataatttgataatgtcatgcctttggggtttcgtaactaaaaaaaaacttacaagaaaattataagatgattaaagaaaataagtagaaagaaaatatattttatatcttttaacaaagtaaaaacatattgaagaacaaaattaacaatattttgttaaggttgagtttataaaatgagttaatttatgttttcatgtatgagctggatccacgtatcaagggtctctggtccaactttttctcaattgttatttagtttcgtatcctgtagtttaaaacaatataagatcaaccctgcaaagttaaaaatcttacagaaaaccccatgttttgagacattacattaattgttccaaaaaaggctgtactgtccgaaaatgttgcattattgcaaccaattgtgttatatatgtgttttacatatgatatactaggaaaattaaggatacacatgatttatcataacaatacttaaaaaataaataatattatattttcatctatttatatcgcattatttaaaactcatatactgtcaaattatatcgaataaataatagaaattttgttacataacattcaaagtagtactatgactaactaaatacacactacataataagagtcaaaacccaatatatcttggccaatgccttaggaaaatgcacaaacaaactcaaacacattgaagtcattaaaaaaaagtggtacagagaatattggatgaggaatattcaccagacaatgatcctgagtagaaagttgaagaactagagcatgatttggactagtagtatacataataactagattttaacctgcggtacaccgcgggaacaatttattttttaaattaatatatataaaagtttgtaaattgtatatagttataaaatgtttttattttatagtttacaattgttattaagtaacgtcctgccaaacccgtcccgccaacccgtcctcttaaaaaaactcatttattttattaatgttgatcttatttatgatatgtttatgaattattgtctaaatattttgtaattttgtagtaattaaatgctatcaaagatctctacggtttgatgattataatcatgtagaaaagcaatatcaaaaatgataattttgtagtaattaaataatattaaatattttggaagttttattttaataattaatcgtgtagttaaggtagagagattttgggaagattattaaatgtcaaatatttaattagaagattttctttctaattatcaaaaataattattaaatgccagtggcagccgctgtaaataaatcccaactccaggatttatttcacaaagtggctgcaaaaatgtatatatagataatttaaaaagttatctttatcaaattttaaaaatcaaaattttaaatttataatgtattatagaaattagtataaatttaatatacaatagaccaaaaccataaaaggatacgagaaaagaaactcaaaacaaaaaaaaaatcatgaaatttaatattttaacgattattattttagacaaaataaatcaaatctgaaatttattttatatcagattaaataatagtaattatataaagtatgcgacaaaaaaaaaatctacttaaagcatatgagttgtagacttgtagtgaaagaaaatgtgtaccaataatctattttaagttttcactaggtttgaatttaggtttggtaatttagcatttagaaaaatggatctaaaagtaaacttgataaagtacatggtctatatctggagaaaagaaaaatgtaaaggacatctctacaccaacgtatatacaacaaagtacaaacatagacagacatgtataaactatattaatactgtttaacattttcacatttaaacctttttcaaattattagttcaacttacttcaaaaaaagaaatgtaacagagaaatccgagctttcaagctgtgaaacaatagccatgcccctcataaatctttctactaattattttttttcacgtaagattctcaaaacaaatcaaaatctcatcttcttggtatcaaaaattttcttactttttttggttttgttatcccgaatttttagaatcaaaacccacgtcaattctttttcaaaggcatatattctctctgtttcaaactttgtgtctcttcttctccttctctgatcgttcgttttctggacgagagag

SEQ ID NO: 6553 - DNA, 3000 bp, Unknown
  misc_feature (1)..( 3000): cDNA_ID_1814830_gDNA_ID_1621097_Annot_ID_55727 3000 nt of promoter + ATG
atataattggatgaatatgatctgaccacatcgtacatgatagtgaggtctccatcttttcgtggaagaaactcattatcaatgatctctctgttatcatagtctgggtcaggaatgcaacatacttgcagaacatttgtacctgacaaaacagagaaaaaacacagaaaataagcaagcacggactccacctgtaaaaaccttcaaagttacttatgctttacacgccacaacacaacatagattcctaagatcaattagaaagaattaactctatcttgtcaagtcatttcttttatcaacagattcatatttagaaatgtgatgaaagtggatcgactcatatactagctattcgattacttctgcagaagatcttaaggctcttatgattgaatccagatcaatcacaaagaatgtgttgcaaagactctcacatttgactaattcaaacattaggtgtaaaaggaagctaacaagtaacatacataagacttttatcaacgagtgagcacatgggacttaaacaatgcaattgttgctagcatttgactatctctactaatctgaaattcctccttaattatagggatctacactagatacttcatccttaacataccaaaactcctaaatatagcaaaccaagatcagtcaaaagattattaagccataaatcaagtaaaccaaaatcaaatttaaacctttttgagtagctttgggacatttccatccatcagtagcgagagtgatgttcttaggaagcggcacattcggcggcgcaactccgaactgagtcccgacgagctcaacacgagcttgcatctgagtgacatcaccagcagtctgaatagctgatttcaaatccgacgaaggataaccagcgaaaacggtaccgttttcgacgctcaccggtaagctcgagccgtctgagagtacagcgtttgaagcagagacgaggatctctcggtgtgcgaatttgacgaagacacgccatgatttgagctcgtcgcggccgtggttgagcactgttatcacagattcgaaccggtagggttgatttgcggtgtcgttgggtgggatcttagatcctttagtgtgagtgtatgaaacgaatacaccgttgcatagatccgaatctgacggtggtgacggtgacggattagtagtgttggcgtcggattgtgatgatgttagaggaattgatacgatgagaagtgatagtagaagtaaccgagggatgaagttgggagctgaatccatggaaccctaaaatctcgctcttagtcaaaaagagaagttttttgaatttgaattttgtttgggaattgagagaagttagaaaaatggaagcttttgaagagatgatgactgataaagcgaccgcgatagtgcaagctgtaatgaaaaatgtttgtatttgcaattcaaattttcccctggagcattttttgttggctttttttgctttttcttttgttgaaaatctaagaaactttatggataccaatactcttacattattacataattattttcttaacaaaaataatgtatggatataatttcttaaaccctattttataagaaaaataaagattaaaaataaaataaaaaacacctaattgcaacaaaaacttcattttgtattcaatttttagatatatttaaaacgcactaaacaagtgagagcacatgagttctgtcgcaacataccaaattcttattttctgttcaacggtggtttgcttacttataaatggtatgagcatgagactatgagagcatcaatacatattccttaaaaccatccttgtacaactttccgagtcaatgagttcgtagactttctcctgaatagtgaagaaaatgttttgtatcatcgccaaattccactctttgcgatattaagctgtgttcagtgttctcgttcatagtcaggtgattaaaacaaaataacttcagaacatataagaaagcccaaaataataaaaagcccaaacccaaaataaaacgtatagcccgatacaatagacgatacatcactatcactagtactaagccaactagacataagacatctcccgtgaaatgtttgcttggtcttaactcttaagcttaattaagaagacaatgagataatcctcatgccaagttagatcactaatacactagtaacctccaatccattattaacagtatttctaatcatcggaccagacaagaatattaaacattcatgctactgtcttgagtgtctatgatctctttcccttaaactctcttgctgctgctgctcacaaatgattcgtccaacagaaaacggtgccgtcttttcagaaactttataaataatggataagaatactatgttttttactacttgggttttgtcacagatatcatctgcctcgtcagaaaggtaacagataaaaaaaataaataaaaaaaatgatgaccttatcttcaaccgctactcctacaacttggtaactgctgctctagatagataaatttgcatcttaaaaaattgtactatatttagaaagaattatacaaatactcagagattagttacaaagatggagaatgttgagagttaacttgcaattaattgaattgcaatcaactaaattacaatataccaaacgatgatcatatcgacatttgcggataagatcaattgtagttataagtccaaatcatatgatattggtctttcctttcttattgtcctagagagtttagataagaaaacatatatagtacttttaattatttctgcaatccattctttcccaatagtgcaattttcagtgtggaatttatatcccatatataaaattcatattcacgaaattcgttttatcttttttcttgaattgcggtgttacgtaaccatccttcgcatcataataaattattaataatttataacgattttaaggaagaaaaaaaagcttttaaaatcggagaattaatttcggttagttcagattt

SEQ ID NO: 6554 - DNA, 3000 bp, Unknown
  misc_feature (1)..( 3000): cDNA_ID_1814826_gDNA_ID_1621097_Annot_ID_55729 3000 nt of promoter + ATG
gaaataaaaaaaaaaccaaaaagccgattaaaccgatttaaccgaactcaaaaacctacataaaaagcgtttagtttcattgttcacctattatagaacaaagacaagaaagagaggttaacaataccttacaacagaagaatttcaaacagtttgggcattccaacgcataaatattatacaatcttgtatgctcaacatattcatcacagacaaaagccatttgggaatcaacggcagcaactgagtagaattgaagtaagaaaaggaaaggaaatgaaagtaataggtcaatagtattggtttttttttctactctttgtaaaatagatcacccatcgaaaaaattaatctttttacataacactaaactatttatttaagtctgtttaaaattacttataatttaaatatttttttcaataaaaagataagacaaaaaaagttaaatgcattgaaaaaaggaagttgaacgcaaatagaatcaagtcaccttattattattggtaaatctaaaaacatctagctactaattttataagacatgttgtgttttggttatcacagtaaaagtgatagcaaatacatattttgttacctaaattcttctacacagttttaatttttttgtacaactattgttctaagtgtgataatctaactcattatctattttttgagaagatttgatattagtagaatagattatttgattatgttttattaactaatccaatttgctggtaaatccactatatattaatagagaaacacttaaaagaataacatctagctacctatttatagaaatgtcatgctaacgagtcaaccaaaacaattttcaatcaatataatttattctttatttactagattgtttactaaatcaatagaattattttgcaatatttatttgacacatttactttatttgattctatatctaatttttacttttacgggtcaatatttttcaccaaacaataattaaatgacaattcaaattaaataattcaattatcttaattacggacaatttagttttaaattcaattttaatctgacccatttatgattcacacttgtcttctagtagtataggtatttttataatgccactttgtataatgatttatgattttattgcttcaattattctcgacaaaaagatattatttattgattatatatagttttttaagaaacacatcaaatataatctacatatatatttttgcagctattttgtgaaataaatcttggagttgagacttatttacaatggctgccactggtttttaattattatttttttttgtaataaattgattaacaaacgaaaaatattccaaatatatttcaatcccatatatcacacagatttctctaaaatttgaactagatttcgacaactatttaaaacaaaaaatgtttgacaaaccaaaatacaattgcaattccttaaaatgagcaaaacgcacctaaatacattctttatcgatccaataaatcttatttctccaaaatttgaattagattttggcaactatttaaaaaaaatatttgtttgacaaaccagaatacaattgcatcccgtaaaatatttattttaattatatatttaaataagcggtgtaccgcgggtttttttatgggacaagtttggcaggacgttacttaataacaattgtaaactataaaataaaaatattttatagatagatataatttgcaaacttttatatatattaattaaaaaaaaatttgttcatggagtgtaccgcggattaaaatctagtattgtaacaatcttggacatcgtaaaagtctgaagaaattaatagttaatcaacgaaaacatataaaacaaaacatgaaatgaaatagaagtcggcaaccaactttaattggttaaacattagcttaactcgtaactttaaatttggaaactaatgtacactattaatctaaattcgaaatcttaaactcgaaaatatgtattcttagttattaatgaaatttttactagttgacaaaaaaaaaaaaatttaaaagattttttttatatatttgtgtcttattagaaaaacttggaccgtccggttaaggtgtctttttctggttttttttaattaattaattaattattttggcttctttcggaccagtcctactgtacatcgtatctttcagtatttgtcaactagtttaaaggggcaagttcacaaatgggacctgcatcttgtcctagccaataatatcgttccacgtcgtactctatattgtttgtcacacgcggaaaattaactgtgcacatttgcaggatgctattttttactattagtgaaattgcttcattcactttggcccgcttctttattttgttgtaacatttaccctacagagttctcgaattatcaatttggtacttaatgaatcattttttcaattatcgtacctattttcattgaaataatattaaagcataaattcagtaccgaagtataattaggtcaaccgatgtaattttacaaaactatatttgaaaatacaaataattataaagagaagttttaatcgaattccaaaataaatccattaattttaaaccaaaaatcttataaaggttataaaatacgtataaaaattagttttgtgaaaacatatatcaaatgttttagggggtcagggtgtaaactgtgaataaaaataaatgttatggtaaaaaaagaatattttgtttttatgcgagttaacgcataatgtaccagttccgttgaatcgtcaacacaagagtcacaaacaaatttatcttttaacaaatttctctcttaaaaaattatttataaaaactctgagctcgaaatcggatttttttttcgtctctctcatcattttgctgatttctcaatttctgtgtttacactactccatcgacttgtaatttcactttcttagggttcttcttcatcggatcatcggccgtatctgaaaccggag

SEQ ID NO: 6555 - DNA, 3000 bp, Unknown
  misc_feature (1)..( 3000): cDNA_ID_1814815_gDNA_ID_1621097_Annot_ID_55732 3000 nt of promoter + ATG
ttcgatatatataaagaccatcgagatagcggcggtgataacaagtgcgagagcgacaggtgtgtgtggaagataagaagaaacggaccttgtaggtttaacgatgaaacgaagcagtttgatctttgttatccttggaataaatctttgtattgacaacaatatgctgatgttctgtcttttacgactcatggagtttcattgtttgaaacaataatataaaacatataaaatttctattattccaagttccaacttataataatttgataatcatatcatattatcatcttaagcattcaatgctacaaagataatacccccaagctattttacattaaaagctgaaacagagacacaatactaacgataaaagttcgtagtatctttatgcaaccatacatacatatacacaaagatagacaggtagtgtcctaataattctacttgggtgaggtatgaacagcagcaacagtagataccattgtatccataccacacatattatgaggccctctgcagattttgtagtaaccatgctctccccacatcgctccccacgagttcttgataatccaataaggcttctccttaagacggattggtgcataacccgatgaaccaaatccaaccaagagcactccatggtcttggctctttgaacatacatacgggcacgagactcctcctatgtatgtttgcatccacatcgcattgatagcaactgtaaaagagaccatgttgtgttaatatctaattcttaaattagtaacaaggtaaacagattttccaaacttactagctagaggtccatgctggactagattagcagcgatttggtcttcatccgaagagacaacgctgaagttagacacactcgcaacaatcttgctcttgtcgaacttacaagcggtatggtcacgtcctgtataaggatagtcctcttccttcattagaccaccagctttaagagcgtactcaaaagcgttgttcattagtcctccactgcaaccagaatcacatgaattggcttgtgctggatcacactgcaagaaacatatataaattagtcacaaccagttcttcaccaaaaacacatatcaaatgagaaacaaacctacctcatggtcacaatctacgagctgctgctcactgaggctaacaagctctttagtggctagaaaatgtgctccttcaagagctcctatcgcactaaatgaccagcatgaaccacacataccctattcacaatcaaaacacacaatcacttcactctctataagctccatgaacgattacaaagctaatccatacgaatttgaaatctctataaacctggtttttaacaggtgtgacggctccttgttcacgccaatcgaactccgtcggaagatcgctagtcggaagaataggcgccgtctgagtatcagtaggaagacgaaaccctcggcgtttcagtcctaaaaacttgcggcggaattctttcggagtaagatctgagaactgcgtgacgccgtggacggcagacggatctagaagctggttacgcctagctcgtcttaggttagctttgaagacacggaaccgatgatcgtgctctacctgagtcgcgtaagtcttctcgtacttggatttgaatagagtgaagtgatgttctgcgttgaggagttgttcatcgttctcctccgggacgacttgcctgatcgggttaacgaaaccgtcggtaacctcgccggagatgacggtagatccgagagaacctgctagtaacgtagctgcgatgaggaagaagaagaccacacgatccatgcttcttggtttccaagagataaggaagaggagactttggggacaagaagatgaaacagttacgagcttgtttaaaggagtgtgagtaaacacgtggcattaggtaattgggtgttagtttggatatttcttggggaaaacgacgacatgagaagtgacacgttgcttgttgtttctaatttcttcgtcagctgtgacgatatttttcagctaaaatatgagggtaaactagtagtttaccattcattctccattttcaatttggcgactaaagtttttatatacgtgagattctactaatttaaacattttgcaaaacttgcaacgtagacgtagtatagatgaaagatttccgaacgccacatggaaaaagtcaatgcatatcatgatttgaaatggaaaccatatctagaacgattgccgaattgcaacagcaaagaggagtggctcttagtcagcaataaacataatgattggtatattattgcctgtatacattctctaaagcattgaatttacatcagtaccaatcacatctttctattcattccagattcaaatcacaacattttaacttatctaccaatcaacttgttcatagccatccaaaccagagcttaatgtgagagactgctacagcatcaatggaaacattgcaagttgttgtgctcacacagtgcaagacaagatgacatacaccggtccattaaacaggacagctagcgtttaacatactcattgaaaggcatttcctacaacaaaacaaccatctgagcatgtatccgtttcccatttgtgaaatctttcctctgtttgcattcctgcaatggcacagcaataagtctcacgctcgacttgcgacccgctacaccaaaatggcccaacagcttcctttcaatctctcccatatagtgtcttattcagcttcaatttctttctctgattctccacctgaaatatccttgtgattataggtatcacatatagccatataggcaaagcaggtcacaatatcacatatagacagagcaggtcaggtcaccttaataataaaacttgagggtaaattagtaattagccttaattttcccatttctgctccctcgccgtaagcgacttgtagcgactctcgccagtccagtccaaaatcgggaggtgagcgaaatctccggttgttttttttcagtcatg

SEQ ID NO: 6556 - DNA, 3000 bp, Unknown
  misc_feature (1)..( 3000): cDNA_ID_2993916_gDNA_ID_1621097_Annot_ID_55733 3000 nt of promoter + ATG
gtaatttgtccatagtttcccgcagcaagaatagaaaaacaaagatgagtttacctgcctgatgcaagccaaacttgggatgctcctccaccattgtatctatatcgataaatataatctgcctcttgtttctccttgtctgcatcactaagctctggtagctttgcaaacatcaagctgtctagatcaatctctgtatttttaggatccattcttacctgaataatgagtaaagaaaagaagggggcaattaaagaatccagcaggatagaatcaattactgaacaaatgcaaatatgacaagaaaaaaatcaacttcaagaacagagaaatatgacggttataaagccaagaaggcataaaaaatctttcaatcaaaacaaagcaaaaaaaatacaagaacagataaagcatttggacaatctgcataccatatgcaagattcaagaagtaagaagagcactggaagccataccttatcaaaattcactacaaatatggcacttggtataggtttatctgccgttgcggctgatccagaacccacatcaatatcaaatatatacgagtaaagctggttaaatgcggactccacttttattgcctctacgtcataggcaggtaagtgtcttccaaaatcagcctaaatccaaaaatatttttgaagattagtatcataaacattaagatgtagtttttacagctatgaaatccacattttcatcgacatatttttatatgtaattaggttcgttatgagaaacagttaaatttgagatgataaaattacagcaacctctagtgcagttccagcaggcaccatggcttctttcactgccttctccagagctattaattcaggttgcccactctagagaaagaaaaacaaagatgaacatttaggtcaatgggggaaacaatgaaattattggcatcagaagtcagtaaaacttaatattgagtgcaaaaaacttcatgtacaataataatcagctcgagacgcaaatgcaaatcagctaaatcaaatacaagaatccagaacttgaatagaaatcttatcctacatatataatatcggatgttgaagcaggtaaatcataaacaacacaaaattcgtgaagactggttaaaggtttataaaattactcacaggaaagatattataaacaactcgatgctcaatatcaagtggctcgcccgtctcttggcatgaaggcctatgtgttgaaaaactggctcttaggaactcttctagtttttgaggatccactgaatacctgtaacctccatctccattcaaacccacaagcactatattcacttccaaaggaacctgaaatggtacctaaacaaaacaagcttcatagtgtgaaattcaattctcgatgtgtcactcaaactcagccaatctaacaaccatatgcacgaaaaaagctatgatcatagtcgtgaagcaacaagaacgcttttaatttcacttcggtgattctacagaaccaaattactcaacgatttcttctccttcttcttctagctaaattcagactaactgatgatgatgatgatgattcacataatttaagctggagattgtacctcggcacgggagtgaagcatacggcggacatcggatcgaacactctctcgtacgtcaaggaaagcactgtgatgccagtgaggatgacctggctcgcgacggaaaggttgctgagccgagtcggtacgagaaacgagtccgcatagaaacaagagaaacgcgacgaataggagagaagaaaacgaactcgatcgtgaatccgatctcaactccatgactgaaaaaaaacaaccggagatttcgctcacctcccgattttggactggactggcgagagtcgctacaagtcgcttacggcgagggagcagaaatgggaaaattaaggctaattactaatttaccctcaagttttattattaaggtgacctgacctgctctgtctatatgtgatattgtgacctgctttgcctatatggctatatgtgatacctataatcacaaggatatttcaggtggagaatcagagaaagaaattgaagctgaataagacactatatgggagagattgaaaggaagctgttgggccattttggtgtagcgggtcgcaagtcgagcgtgagacttattgctgtgccattgcaggaatgcaaacagaggaaagatttcacaaatgggaaacggatacatgctcagatggttgttttgttgtaggaaatgcctttcaatgagtatgttaaacgctagctgtcctgtttaatggaccggtgtatgtcatcttgtcttgcactgtgtgagcacaacaacttgcaatgtttccattgatgctgtagcagtctctcacattaagctctggtttggatggctatgaacaagttgattggtagataagttaaaatgttgtgatttgaatctggaatgaatagaaagatgtgattggtactgatgtaaattcaatgctttagagaatgtatacaggcaataatataccaatcattatgtttattgctgactaagagccactcctctttgctgttgcaattcggcaatcgttctagatatggtttccatttcaaatcatgatatgcattgactttttccatgtggcgttcggaaatctttcatctatactacgtctacgttgcaagttttgcaaaatgtttaaattagtagaatctcacgtatataaaaactttagtcgccaaattgaaaatggagaatgaatggtaaactactagtttaccctcatattttagctgaaaaatatcgtcacagctgacgaagaaattagaaacaacaagcaacgtgtcacttctcatgtcgtcgttttccccaagaaatatccaaactaacacccaattacctaatgccacgtgtttactcacactcctttaaacaagctcgtaactgtttcatcttcttgtccccaaagtctcctcttccttatctcttggaaaccaagaagc

SEQ ID NO: 6557 - DNA, 3000 bp, Unknown
  misc_feature (1)..( 3000): cDNA_ID_1814811_gDNA_ID_1621097_Annot_ID_55734 3000 nt of promoter + ATG
gtatgtatgttcaaagagccaagaccatggagtgctcttggttggatttggttcatcgggttatgcaccaatccgtcttaaggagaagccttattggattatcaagaactcgtggggagcgatgtggggagagcatggttactacaaaatctgcagagggcctcataatatgtgtggtatggatacaatggtatctactgttgctgctgttcatacctcacccaagtagaattattaggacactacctgtctatctttgtgtatatgtatgtatggttgcataaagatactacgaacttttatcgttagtattgtgtctctgtttcagcttttaatgtaaaatagcttgggggtattatctttgtagcattgaatgcttaagatgataatatgatatgattatcaaattattataagttggaacttggaataatagaaattttatatgttttatattattgtttcaaacaatgaaactccatgagtcgtaaaagacagaacatcagcatattgttgtcaatacaaagatttattccaaggataacaaagatcaaactgcttcgtttcatcgttaaacctacaaggtccgtttcttcttatcttccacacacacctgtcgctctcgcacttgttatcaccgccgctatctcgatggtctttatatatatcgaacgaatgcgattcatttggccaactaaaactacaaaaatacaacgtccttccaaagaattgacgcccgaaactaaaagaccacgactcacctggttgcagagtccggttacctaaatcatcgtcttttgatttacaatgatacagtaacgttagctgattaccgagatcattattgatttccacggttcttttcgaggtaggaaacacagaatttgttgatgatggatcgttgggaactggaatgtcgtttttatggtcggcttgtgataattttgtagttatgaagataatcaatatgaatagtgatagatattgctttggaatatccatttttttgaataggagagggagtttaagctagcacaatgttgtttgtaaatgtcgaatgagttatatactgtgtgttgtttgttacaagtcaagtagtcaatgatcctttccacttatttccattatattgtatccgaatctaccttttccttaaaattgatgtattgccagtatgtgccatgtggtcaaggcacgtgaattgctgtcaaacaaatgtagattgaattaggtatgtcaattttgagtatcttggtttcgaaaacattggcaattttaaatggaaaaaatgtcataataatctttaatttattaaaaacattgatgtaaatccttatgtctgtcgaaacgaaataagatatcaaatttatgttgacttttcaaataaatatcaaacttacgttgacttttcaaataaataccaaacttttattgacttgaccatttagttacgatgttaaatgggttagcaaatcccgttaatagagttaattttctattaacatacatgtcaactgaaaacgacattgtttcctataacaataatacgatgtcattttgttgtaacgattaaactaaatccccaaaattcaatcttaggtcccaaatcgagcaaaatctctaattccaaggggatgtattcaactggagatttgaaatcatttaaattttaatgagtttttaaatgattttggtgacttttggtaaattaggagatttgttattaaaattctcccaaattctacttgaaaccatgagatttggatgtttgaattcttaactaagaaattttctgcaatcccacccaaaatcactcaagtcattttaaatccactacttaaaatgtttccaataacagtgggtttggttgtacattttaaaatcactaatctaataacacttgattttaaaaaagtttttacaattcatgtttgaaataacatgggatttgtcattttaatacaaatcatttcaaatccttaattgaatacacccccctaaatctttatatgatttgaaactcagaaatttaatgagtagttatgataaaacaatatcgttttacattgttagagaagaatgctatcgttttcaattaacgggtttgttaacagaaaattgtctccattaacatagttttttaactcacttaacatcatgcctaccctcttttgttgaatattcatcttcacttcccccccctccccccctccccccccttctttcataaattcttccagattttttttgtaagaatctgacaagacctattaatttttgaggtacccaaacttttttaaaacaattgaggtgcccaactttacttgatttgttttacgcttatcaagcaaacaaagatatgattgaagacactaataaaaatgtcaactaagataattttattatataaagtatcgttaagtttgatttgttttacgcttatcaagcaaacaaaaatatgattgaaaacactaataaaaatgtcaactaagataattttattatataaagtatcgttttcaaattaataatttataagattgtgccatgtaccatataacaacttttttgattttatattttaacacatttaagaaaaaaagtttcattttattaattttaaactgtaaaaagataaatataaaaaattaaaaattttgaaagtaaaacaacaattatatggaaataagataattataagaacactatctgtctttattaaataaaaatagaaattaaaaaattattgattaattctaatttgaagctactaattgtaaaacaaaaaaaaaatacaataattatggaaattttacaattaattattagttacagaaggaaaaagttttttgtcgtggttaggggattgtcggttctgttgatttgagatagtgtggcgattttgttttctttaaaaaaccaaaatttaggtcaaattcgattctttcgtttctctcgatataatctgattttgatttgaatgtttcttgttgttgaaga

SEQ ID NO: 6558 - DNA, 3000 bp, Unknown
  misc_feature (1)..( 3000): cDNA_ID_1710920_gDNA_ID_1621097_Annot_ID_55735 3000 nt of promoter + ATG
ttcaaatgtagaggtaatggtagaacgattgcttttcgtgtctcttggattttatcttaaatatattagtagtgttatgcttgatattcgtgattgaaatatataaatattttcaaaatataatgtaacgtattattagccaatggatgttagacttttagtgaacgaaatgaaataaaacatttggtggaacgggatgtatgcaaaaataaatgttatcttccaaatggtagtgtaacaaaatatggatttgcgaggattcttttagttttgatgcatttgcatgattttccagttttggtgcattcgcatgatctttcaaacatttggcggaacatctttattctttttttctaaccaaaatttttcgagtgttttaattacaaagatttttttaaggaaacttcacgatggttataatatataataaactttactagctaacagattaacaaatctattaattgatgtctttgtagtaaaatttaaaactttacccaatcaaaaaaaaaaaaaaagagttcactaaccttacgtgtatatacacaaaacccatgttgttaatagtgaaagaaacgtggggattttttttgttcttgcgatagtagagaacttaatgttttactcgcaagactggaatgcaacttcccaccaaactcaaagtcaagccacataataaaaatagcaaaggaaaaaataaaagatgatcaatatacaagcttgtgaaaaattaaatgttgtgtctagactctagaaaatacaatactaaagttggatatcctacgaaagcttttttctgagaaaaaacttagatctgagccgtcgccgcctctccgccgcctgtgacttttgccggcggtgtgagagggcttccccccttttctttttcgttgtcttgtctattagtttagaaataaggtcgactctttgctcctttctccggaggctaaggtgaagctcaacgacgacggtgtgacgatgcggaggcagtaggtagaggagagagctctcggctcgatccttatccaggagactggtggggttcggagctgctccgagcagctgtttcgatccctgtatcccccaggagaaccaagccgacggatgaacagaggcagagtcagagtcttccaggcgtggggatggagctgtggtcgccggtggccgagataatccggagatctagtgaaccgtctcaatgtctggtccagtccggcgatggagcgaggcaacaaggcatgtgcggcgagatcgttccggcaatgcaccgtttaggtgaggtcttactaatccgggctccaatgtgttatccttaatcgattagtagcttacggttgattggttagctcgggaaaagctctagccttgctggtttgccttgtatcattggtcgggtcagtcggatatatggtccgcttttggtttaggaccggaacaacgaaagccggggatattgagtctttctgatgatgcgtctccgggtggtaatgctattgggacatggattacattctgatcaatagggactaatagtatggatttactttgtacttcagactaggttttggtctcttccgttttagtagttgttctcgtgtcgcttagagtctgtgtaggtggtcaaagagatgataatattctgatttgtggagtattatctatctcattgtggtttaaaaatgcaatggttcctcgatcaggtagcgctggatccgatagtgtttcagcgtgatactagatcaaaccattgcatttgggtccaatttgatagaggagaatgttatgtaccttcaattggatgtaatcatttgataaatgaaagttgatgttgagcaaaaaaaaaaaaaaaaaaaaagaaaaaaaatacaatactatatgtttgtttgtaacatgttaatagatagtagtattaaatagagtagtaaacaacaaaagaagcaagaggtggattttaaattaacaaaacaacttgttatcaagataagactatacacattaattgtttcatgatgataatagtaattaatagtcaataaaacgtgttattaaataatagaagctcccatgaaacatgcactatcggttacttgtagaagtaatacaaaccgttgacgtggtagacgattgtaattcgttatctttgacctaacgtataatggtgattaaaactaatgcttgataaattaacggatagtggtgttagctggtatcctccaaaggaggttgaacccaatgtctttagtttgaacttttgctatgaaaggtctcaacttttctgataatagaacaaacgggttaaaaagttgacatcggcaaagtaaattactgatcttggtccgaccttcttttaaaagattaaacaaataaatatttgcaattgtgaacatattaatggtgaaacgaattacttctataaaaataattgcatgatgaatgaagcatcttctctccttttcatggggcaatgtttcaaggagtttcagatcaaggttttgtaccaagtggatgtgtctttcactagttgagatcagatcattgacgtttttaacttactctaactatttttagtaattgtatagagctcaaacgttttgtggtgaaccttatactttaacagaagattgttttttaaaacacattaacgagtctgtgcacacaaaaaaaaaaataaaaaaaaattaacgagtctattatgcaaatggtgcataaaagttttttaacaaaaccatttattaacagatgaacagaaatcagaccggttcgatccggtttactcatggtttgtgtttgtactttctccacttgccgttttcatgtttgagaaacaaaatacgcagcgtctaaaatagaagcaaaaaacgggacgttgtttactaacaacgacaaaacaatggcacacttacccaagttcttcgtcatctcttcctgattgactctatttaaaaacccgatcggaaaattcgaaatccgttcaattgtaatcggaatcgtcgaaaaatg

SEQ ID NO: 6559 - DNA, 3000 bp, Unknown
  misc_feature (1)..( 3000): cDNA_ID_3048559_gDNA_ID_1621097_Annot_ID_171140 3000 nt of promoter + ATG
cgctttatgagttttatacaattcaatttggagttttctgtgtaaaaatatgaatactatgagactgttctcgggtttcttgaattgtttcagggtcttttatgatcattttggtttttatgtgggtctaattataaatttgtcgttttatgcggggccgatctgaaaattcgtccataaaccatgatagtgttgaaaatttgtatacgtggagtctagccgccggctgctataactttgctataacgtgtgatattataaaaagttgataaatctaatcttctaaaccaaattgttttaataatgctgtgtttacttcgtcatcgtatcgaattatacggctgctcttgttaagtgatgacaatatcttcaaataaagttttttcttttgtaagcaaatatgataaaactacgttagctaatagccaacttggtccatcatagttcataaagtcaaaaaatcagtaaccaattcatgagtggaattatacttgattcaatgacactgtttaggagcttatctaaattgcacaagttttgttacacgtaaaacacaaatatgccaaattagacatgtttctcgtcattctaaaacattaacaaatatttacatagacgcagtcaaataaatcaaatttcgtatgataaaaaaaaaacaaaaaaaatagcaaggttgatttgtcaatgctggcaaaaataagcaatgtcctaatttctcaagttggaaagtgacatttctctacccattttttgaaaagatattctcttttgcatataagatttgataaattgaacgcatatttgcactcaagctaacgttatgtacttgattacttgacccgactaatgacttattgactttgattaataaacaaagatattagccactccattctacattatatacaatctatacgcatctatatatatctactaaaaaaattgtaagtacatacatatcaatgttaatttgtatataaggagctaagaacaaacccaattaggcaactagcaattgctaaaacacgtaagatctcaaatatgaccacgttattcctccttattgctctattcatcacaaccatcctcaacccaacaagtctctctctctctctctttaatctcacatgatttattctcattttcaatttttatagatatataaacttaatcataattaaccttaattatgttatatgataaactaggtggagaatcagtaggtgtatgctatggaatgatggggaacaaccttccttctcaatcagacacaatcgctctctttagacaaaacaacatccgacgtgttagactctacgatccaaaccaagccgctttaaacgctcttagaaacacgggtatcgaagtcatcatcggcgttccaaacaccgatcttcgttcactcactaacccttcttccgctagatcatggctccaaaacaacgtcctcaactattaccccgccgttagcttcaagtacatcgccgtaggtaacgaagtatctccgtcgaacggcggtgatgttgtgctccctgccatgcgtaacgtttacgatgctctaagaggtgcaaatcttcaagatcgtattaaagtttctaccgccattgatatgactttgattggaaactctttccctccttcctccggagagtttcgtggtgacgttagatggtatatcgatcccgtcatcgggtaattttccaaccaaaccaaataaccaaaattcattagatttagttatttcccaatatttttcatttctggttacttgtggaatgattatttaatttcttcctatgtggctaattaggtttcttacgagtacgaactcagcgttactagccaacatctatccttacttcagctacgttgacaatccacgtgacatatctctctcttacgctctcttcacttctccttccgtcgtcgtatgggacggctctcgtggctaccaaaacctctttgacgctttacttgacgttgtttactctgccgttgaacgctcaggcggtggatctctcccagtggttgtttccgagagcggatggccttctaacggtggaaacgccgcgagtttcgataacgcgcgaagctttttacacgaatcttgcgtcgcgtgtgagagagaacagaggaacaccgaagagacctggaagaggagtggaaacgtatttgttcgctatgtttgatgagaatcaaaagagtcctgagatcgagaagaattttggtttgttttttcctaataaacaaccaaaatttccgatcacattctctgccgcgagagacggtacggcggttgagtgatgattttatatgctgagatttatgtgaataattgggagattatcccataaaaggttccaaataaagacaaatttcaaataaaacctgttagtccaagttaaattaaatactcggctttgttttggtccacgttagacttggtaaagtcatgcaatatttttatttgatatacaccagaccagaccagacctttgaggacacagacgcccacatgcccacatatatcgtccctcgtatgcccactagtcggaataatccacaacccacgtgatctcggtccttcataaaacatacaaggcaacgaaagtttaaaaatgtgggttaaattgatacctacacaagtttttggaacttttaacgaaattttaatagacgagggagtcaaatcataaagagaacaaggtcatcgtcttctttaatccttgagttcaccacctcttctgcttcattttaattggtttttgagagccttaagaaaaattcaaattggtttctgttttatcattttacaaacttcgccgttaagctagcgacggtgataattcaagcttcccaaaaatccttatgagtatcatttttgagctcttacagtgaagatttgtgaaagtgtggtttcgaatccaatgattgaagaagattttcttcgtctctcgcactaattctttgaaattccaaaaccattaactgagaaaaatg

SEQ ID NO: 6560 - DNA, 3000 bp, Unknown; identical to SEQ ID NO: 6558
  misc_feature (1)..( 3000): cDNA_ID_2990343_gDNA_ID_1621097_Annot_ID_171133 3000 nt of promoter + ATG

SEQ ID NO: 6561 - DNA, 3000 bp, Unknown; identical to SEQ ID NO: 6556
  misc_feature (1)..( 3000): cDNA_ID_3048571_gDNA_ID_1621097_Annot_ID_171131 3000 nt of promoter + ATG

SEQ ID NO: 6562 - DNA, 3000 bp, Unknown
  misc_feature (1)..( 3000): cDNA_ID_3048577_gDNA_ID_1621097_Annot_ID_171125 3000 nt of promoter + ATG
tatctggacctatacctttgtcaatcgctcatctcacaaagctgaaagatttgtaagtagtctatgtagtagtgttttatcatatatatttatctagagtgtttattgacttaggctcaatataattttcagaatgataagcgatatgactggacctgaatttttctttccaccactacagagcatgacacagatgaggcaattgtgagtctttaaatttgactgaattacaaaacaactttactggtgctgagatttaatgttcattgatgtttgtctttttgcagggttttgagaaatataaatctgaaaggagagctcccatcataccttggaacaaataccaccaacttaacactcttgtaagttatatactaacttattttctgatagaggaaatgatacaaaccaaaggaaccccaaaggatgcaagagtgaaacaaactaacaggagcaatacctagctcgtatgaggagcttagagatgtggaaaatatgtaagactatcatcatattatctatctttggtttgttagagatgttgtgttgttgaagtaattgttcatgaaactatcttactggaaataatttgttcttgcaggtatctcagtggaaatatgctaaacggatcaattccaagctggatgtcaaaagagaaagatagagatataatgtgagtttcctcctttgagttccaaacatctgccaaataaacatgtttcttaaacttttttgattttcctgatcttacgtacaacaaattctcagaagatctaaccaccaaaaaatgtgtggaacaacacatgtaagaagacatgcagtattttaatattcatatggttttttaactagaaatctcattgtttttggtaccatttatctcttgtaaggatatgtttgcaggttcgtaagtcgtatttcctcattatttgttgttaaagtctcaactttgaatgtactttttttgttaaagtctaaatttgaatttagctgtgacaaacttcaatttcaccattataacttttttgttggtacattgaaagtcgtttctctattcaatgacaaatattattcaccttcacatgagcgtcaccattttgatttccaacacgaatgtcgtttttgttgttacgctgcctcacgggttattgtctgtgcagcgagcccacaagacccgcatttttatccaaatagataaggttacgtaataggtactactcaagatatatatagtgcaaatattttccaaacagataacaaaacgatctctctccagcttcgagagtttcaggaaaagatcttagtagacctttagcgaattcgttttcacaaaaagaaacataactgatacatgaaacaacccttatgcattaaagcttctaatacaaatcatctagaaaacgctagaaaggagattagcagcggtggaaatagctgctccagtgagagcagactgaaccacttgctcatggcttgtcctctcagacgtcgtcatagccattgccgctcctgtcaatgctccagctaccgcgctgttccgctgtgacacatatcaaattacatactaattaaagatcatgttcatcatttgttcgttgatgaaaacaaaatgacacaagtcaaattaattagactaacccaatcatgagctcctccacgaacctctgtcataccgtaagtgatacctgagtataaccctgccgctagccctaccattcccaaatcattaaatctctttccaacgttaatcgtgaagcgttaacttaatcaaattcatatataaactcaccccattggagagattcttttcctgtgttcttcacctataggccaacaaatttaaacattttcagttaactaacaagaaaccttatgagttacgaccattctttatgtattattttgcaacacttagatatgaacacactagcacactagcacacgaatatttgacgaataataaaaggctaataattagcgattgtaataaactcaccaatgcatcaagagatttgctgctttcccctgattaagaaaacaacgataaaacatcattaagataaacataatgctgattacataagatcatcaaccaaatatgatacaattatgttacggacctctgagattagggaacctatgtttcttgttccctgtaatctccgacggtggacccacgttgttcgagtcaaaacctgcccctaaaatgtataatcaaactaaagtacgttctctatttattcattttcactcttacattacatactcatttcttatacatataaatcataagtaagaagaaacccgccggagtttcttaccgtcaaccacggtaaagtaagcttcccttgacacggcttgtaaagctcccaccttcatagttaatccatattaagctatgttactacatatatgttacatgcatatacgacagggaaacgaagagatatggatgaaaacttactccggcggctttaacgaaggaatctgcgatacggttaagaagaggatgaccaagatcgaacaagtgtgccttctcaaagcttcttatctcatccattacaattcttcctccactcttctccatttttttctttctttcttcacttgttgcttctctctttctctgttaatacttctctcttcaacaacaagtaaggagaagattgtgaaacagaacagcgttcttttgacacgtgttctgcttttccacacgtgtcggagtctgccgtttgaactgttcgccgttctccttccccacgtggctctcacaagataacgtcaggcagaccgagaaataaaaggcccaatgggctcagagttggatattatagccgggaattttgaaatctccggtttaaagacgagaaacgtgacacgtgtcatctccgctttgatatctccgcctccgctcgtcgagtgagactagtacagacttgtcatctccgtcactccctttttctctacacagatctctcattcactctctcgtacacaatg

SEQ ID NO: 6563 - DNA, 3000 bp, Unknown; identical to SEQ ID NO: 6554
  misc_feature (1)..( 3000): cDNA_ID_3048581_gDNA_ID_1621097_Annot_ID_171124 3000 nt of promoter + ATG

SEQ ID NO: 6564 - DNA, 3000 bp, Unknown
  misc_feature (1)..( 3000): cDNA_ID_3048585_gDNA_ID_1621097_Annot_ID_171122 3000 nt of promoter + ATG
atggtatcatgtttattggttgcgttttgtggaattcttctttggttttgggatattgaaacaagaaatgagtctatgagactcaagtgctactccatattaatctgggatgatcattgagactttaattgtgctcctgaacctgcagatcttttgatttcctgcctccaaaccaagcaaccttgtcaagacattcatttctaggtccgaatggtcttaaaaggcaaatggttgcacccaagtcagagataaaggtatagtgctgatcattgttacctttctcacattttctcactctttcttttactcttggtccaattcaatgtttaattatcttagatctgaaggaactgagaaaaatctttattttgtatggaatgataggttcaatatccgagtaatacagattggggttctgcggacaattcagggtaagtactcatcttctgttaccttctaagcttttccttaaagaagtcatggctatttcaaactgactccatgtatttctgcagtttaattgaagctggacctagcagttcctcagcatcacttaatggtgattctcaagaagtctcaacactgaactctgtgctctccttagatgatggtcgatggcagcgtcattctgaggcagtaaattcccagtttattagcgacgcaactgaagacccgtttcagtttgtcggtatgaagcaaccttcccctcctcccgtgcttgctcaagtgcatcaagagttagcccaaatttgcccatctaaagtagctgatcctagaccaggacctgcaattccttccctagaaggaaaagagggcagcaattcttatcagcatttgcatgtggtatgttccagctgtatcttctttcacttttgtgcagtttccaccaattccatagtgtttgtgagagtaaagtggaagggatatgcatatcaagtagaaaattatccatgattagtctaattatttggtatgtgttcaagaatcaacacattaaatcatcgaagtattggattcatgaccattacagcttcttaaaagcttgctagaatcggttctggaaatctttctctttcacctcttcttaatctactactaatgttgtcaccctttatttaaatttgctgaagcctgtgcgcataatggatgatttcctaaggctagctcggtcaaacacagaacggaatttagaaacttgtggagtacttgctggttctctggtgagtagatggaacctttgcatttataatttttgattccaatatcatgatcagctcgccattacttatattctgtctatttgccatgtttacagaaaaacagggttttttcatatcactactctcataatcccaaagcaggagtctacctcagattcctgtatgttcttcatttttcttaaccatttacatcaataacaatctttttaattctcgctggtatgcttctcacacttaggttcatcatcatttgggtaatgtacagtgccaaacactaaacgagaagaaatattcgagtacaggacagactctctctatttcccttgggttggattcatgtaagttctctcacccgaactaaaaaatcttccatttccagataatgacttaccaaaacgttactcagaacaattgtgaatccatatatccactagttgataagctttatcgattcgtcttgctaatttacattttggtttcagacacaccctacacaaacttgcttcatgtcatcagttgatctacacacacactactcgtatcaggtaacaaactccccttatcaatatctctatgttaatcacttatgatgcgattatagtaaaaccatcatctatatctattgtcccagataatgctaccggaggcggtggcaatcgtaatggcaccaacagacgaatcaacacctcatggaatattccatctctctgatccatcaggcgtatctgtgatccgaaactgccagcaacgaggcttccacccacacgaagaatcagaagacggtaacccaatctacgagcattgctcacacgtcttcctcaatgccaaactcaaatatgaagtcctcgatctccgctaaaagccaacctccatcaccatgttattatttttcctggagtcttaactttaaagagacattaaaaagacctcagagatcagatgtctcagccgtacatatatgtgtatacttcttaaaaaaaccttctctttaaagttccaaacttggctgagccgtcttaagtaatgatgattgtgtttatttataacgagtacacttttaaattcgtatgcaccatttcacaaagccagatgtttgattaaaaaaacataagtatttttttctgacgattttttcatttaaattaaaattcattatagtctgtgggaaagacctgataccatgaaagttgaggtgaaaatctgttattagctttcatcagataagaacggagagagaataacagattttcacctcctagataatgctaccagaggtacttgcaatcgttatggctccaacagacgaatctaccccaatatatgagcattgctcatacgtcttcctcaacgtcaaactcaaatgcgaagttctctactctaaactttcttaaacgaatataatatacttttaaaattactttcacaaaaccaagttttgccaaaaaaaaaactgtattttattttaaattaaatttagtcggtgcgaaaagactaatgaataaacaagtcaacttaagtaaattaatggtctctgtatcgaatcttaaaatttagatttaccaaaatgtttttgtaaaccaacgaaattcaatctttctctctgtgccttttttcctcttttctcgttcccctctacttcatttagggtttatcatcctctaccaatccgccgattctatacatacacttttcatatatatacatacatcgtctccactctcgttggctcatttttcattcaccgccacgaagcaagaggagattcgtattagccaccatg

SEQ ID NO: 6565 - DNA, 3000 bp, Unknown
  misc_feature (1)..( 3000): cDNA_ID_3048589_gDNA_ID_1621097_Annot_ID_171121 3000 nt of promoter + ATG
tatatatacatacatcgtctccactctcgttggctcatttttcattcaccgccacgaagcaagaggagattcgtattagccaccatgtctttgagacctaacgctaagactgaggttcgccggaaccgctacaaagtggcggtggatgctgaggaaggaagacggaggagagaggacaacatggtcgagatccgtaagagtaagcgtgaagaaagcttacagaagaagcgtcgtgaaggccttcaagctaatcagctacctcaattcgctcctctcctgttcctgcttcatcaactgttggagaagaggtaatattactagcgatctggaaccgtttcctaggatttgattggtttagatcgattcgattttgattttggttttggttttggctagttggagagtttgcctgctatggttggtggtgtttggtcagatgatagaagtttacagcttgaagcgactactcagttccggaaattgctttctattgagcgtagtcctccgattgaagaagtgattgatgctggtgttgtgcctcggtttgtggaatttctcactagagaggattatccacagcttcaggtttggtggatcgttatgtatctgtcatattttgctagaattgtcttctgatactaattacttgtgtgtgtgtgtgtgatttcagtttgaggctgcttgggcattgacaaacattgcttctgggacttcagagaatacaaaggtggtcattgaacatggtgctgttccgatttttgttcaactattggcttctcagagtgatgatgtccgtgagcaggtaagatatgtgtttatggttttttctcatgactcaatatactgtcaattttgtttgttttcgggaacaagcatgttctaaagcttgtttgtttcttaatcttttcatgtgtaaggctgtgtgggcattagggaatgttgctggtgattctccacggtgcagagatcttgtccttggtcaaggagctttgataccattactctctcagttgaatgagcatgctaaactctcgatgctgagaaatgctacttggaccctctctaatttctgcaggggcaagccacagcctccctttgaccaggtttgtctctcattcctatcttaatctctgcccaaagatgaaggagtttttctttttaattcttgtgatctcttaataacaggtccgtccagcactcccagcccttgaacgcctgattcattcgactgatgaggaagtgttaacggatgcatgttgggctctctcttacctttccgatggcacaaatgacaaaatccaatctgtcattgaggcaggtgttgttcctcgactcgtcgagcttctccagtgagtttcaaatcccatgatttcaccgtgcttttgtataatgaatgttatgtgttaatgaatattatcaattttattttgctgtaggcatcaatcaccatctgtgcttattcctgcccttcgtagtattggtaacattgtcactggagatgatctgcagacacagggtatgttggttcttttatagtgtcattcattcatattattcaggatacatggtccaatactgatgggaagaatgaaatacactggctagaaagctgaatctgagtttgttgataatgacatttagttgtcaaaagttacttgtcaaattcttcctagatgaatctctagaatgggaactgtcaattcttcccagattttatttccccccctgcatgttttttaccctagttatgcaatacctaacattccttttgaatagttagactaatttaaggcagtatgtataatactcttaagaatctcacacatgtaccattcctcacttattttgctttcttttttggttggttctacagtgtgtaattagtcatggtgcacttcttagccttttgagccttctgactcacaatcataagaagagcatcaaaaaggaagcttgctggacaatctcaaatatcactgctggaaacagggaccagattcaggtgaacttttgctaaagattgttgtttctgctcagcttatcagtttctcataaactaatcactaatgttggaagacatgtttcagaagcctttttgttgtttgaagaaagatgttctgtgtgtttatgttctctaatattgttgtggtattgcaggctgtgtgtgaagctggtttgatttgccctcttgtcaatctgcttcaaaatgcggagtttgatataaagaaagaagctgcgtgggcaatatcaaatgccacttcaggtggttctcctgaccaaatcaagtaagattatccgatataaactccatgttctgttgatctcaactcctttagaatctttgttggttatttttcaaacagtcaattaagttattccgttgtgtgttttaggtacatggtggaacagggagtcgtgaaccactgtgtgatcttttggtgtgccctgatccaaggattatcactgtgtgtctggaaggattggagaacattttgaaagttggggaagctgaaaaggtcacaggaaataccggggatgtaaacttttatgcacagctgatcgatgatgctgagggattagaaaagattgagaatctgcagagtcatgacaacagcgaaatctatgagaaggcagtgaagattcttgaaacgtactggttggaagaggaagatgaaactttaccacctggtgatccctctgcacaaggcttccagtttggaggaggtaatgatgcagccgtaccaccaggtggattcaacttccagtgaaggtaaaaaaacctcactacttgggactaatttatctaagcatctaaggctagactagcaaacagagtaaatctgcctgtgtgtctaccttgtgtgaatctgtgagtctggttttgcttccacaggagctgaacatgacgatttgaagagtcgaaggagcttaaagagtttgggggcactggttaaaaagggtatgattagagagtctggtcttctgtgtaaaagtcagatg

SEQ ID NO: 6566 - DNA, 3000 bp, Unknown; identical to SEQ ID NO: 6553
  misc_feature (1)..( 3000): cDNA_ID_1814830_gDNA_ID_1621097_Annot_ID_171119 3000 nt of promoter + ATG

SEQ ID NO: 6567 - DNA, 3000 bp, Unknown
  misc_feature (1)..( 3000): cDNA_ID_3048597_gDNA_ID_1621097_Annot_ID_171114 3000 nt of promoter + ATG
cattggagatctctgcatattcttaggcaataatgagcccttttgtgtcaaggcaagctcattccctggtctaaaccctaactccatctattttgcaggcgatggcttcggtgtttacgatatcgccactagaaaaccacgttccttccgtcccaagtctccctcagccttctcgtcagcatcactcctcccttactggatccctccaatgtctctttagtttacttgttcttcactagtcatgttctgtaacttttgttttttatgcttataattgttcttttgcgagcccttggacgttggccgccatcttcatacgagttaataaattttggtgtgaggaaatatacgagtcaatttatgaaacgaaggtagtaactttcgtaattccttttttttttttttttttctctggttgtatgaatcattcatcatcgatatcttatacttttgtatcatgatcgtatggatcattcatcatggaccttgaggggttactcaatagagagcagtagtgtggaagaccttcttggtatgactaagctcagaactctcacggtccattcccttgatggttgtacgttagaaactctgtctgcatctctctgtgaatcgagagaactcgggcagctttcattgtacgaggtcatgcatgataggcataatgaaggaaaattagttcttgatttgattcaactcaaatttttaacggtgggcatgcatatgcctaggttgcctgatcaacatcgattccctccaaaccttacgaacatatgtcttcggtattgttgcatggaagatgatccaatgccgattctagagaagttgctccacttgaaattggttgaattatcatatggtgctttcactgggaagaagatggtgtgttcaaaaggtgggtttcctcaattgtatgagctaaatttatgatttggaagagtggatagtagaagaaggctccataccatgtctccatactttgactataaatgaatgcagaaagttgaaggagcttccggatgaggtcatatacataacatccttaaaacaactgacaattggaggaaggaatagtgaatgggtgtggaaattgtctgaaagaggacaagatcactacaaagttcaccacattccttgtgttcagtttatttactagacctttgtctaattttatgtataaaaattataacaatgtagaaaactacaacacaaatgagatcaaattctgatttttaaaatccggttgtgatgattattaatcgtggaaaaaaatcagggattataacttttgttaaattgtgaacgtacaatattgaactgaaaatgccaaatgaattggttattattactttgatgaaaatgaattgatcgtttaattttttttatatttataacaaaaatgcgatatgctctttttaattctttatttctatttttgcttcagaattttttttcattttatttttggtcaaaaaggttattaatttccttttcaatttgtacgaatttaaacggtgacgtttttgtttaaattatcaaacaaatcaaaacaaaatcaataaaatctaatctctcatcatgaggcatctttgactgctctttaattcactaaaaaagtctaaaaccctaaccattgccctttttcaaacgaagaagaagaagacgaaacgctaccatcatctacacacacacacccaactacttttttccatcgccggcctgtacaaatgtcgactacccgtaggatccgcggcgagaatcggttttataacccacctccgatgagaaaacttcaacaagagcgtgagaagaagagacttgaagcggaggagatagagaaagagaagaagaaggcaaaggagattctcgatcgaaagattaaagtcgaggagaaggagattaagcaacctgaggagtgctcgacctccgattgctctgtgccgagtcgggtctcctccaccaccaccaccaccggaactacttcttccaatttgggccggtttctggattgcaccactccaattgtttctacgcgcacttgcctttggtaattactccgattttgaagttttacttgaatcgacgactagggtttgggcagttttagaatgagaacattagcatcaagcgttgaaaatgggaactttttatcaattcttgggaacgattatgatctcagtctcttattgaagatagaattggtttcaggttttagaatttatcgctatttaggattgtagatttgagaaacagattcagttagtagaacaattgtgatgttgttgtggtcagtcatagtttctgtgtttttgcttcagacaagtagtaaggggtggagaactcgtgaaccagagtaccgtccctatttcttgctgaatgatttgtgggattcatttgaggaatggagcgcctacggtgtcggggttcctcttcttttaaatgggatcgattcggttgttcagtattatgttccttatctctctggtattcagctttatgaagacccatctacgagcctgcacaactaggaggtgagttcttacattctgcttatatttttgattgtttcctatcaaccattagcagtagtgatcgggttctttgctcgttgattggttcttcttctgatagaaaaaaggatagcagttggcttttttgtcaatttatatattttgagatgaagccacttctttcttgggttgttcttaatcttcggatgcacgttctttaggagataggaaaaccaacttctaagcgttctctgctacaatatctagagatattcatttggatgactaatacacaacaacttttatgctctcaaatactagtcagtggttcaagtttatcatggtgttgaattccaaatttgtttcatctcgttggttttctctttaattcccaattcgtttctgctttctagagtaaaattcgttgttttgatgtttgttcttaaacaggagagttggtgaagaaagtgatggtgattcgcctagagac

SEQ ID NO: 6568 - DNA, 3000 bp, Unknown
  misc_feature (1)..( 3000): cDNA_ID_3048606_gDNA_ID_1621097_Annot_ID_171110 3000 nt of promoter + ATG
cttcttcgtttgaaaaagggcaatggttagggttttagacttttttagtgaattaaagagcagtcaaagatgcctcatgatgagagattagattttattgattttgttttgatttgtttgataatttaaacaaaaacgtcaccgtttaaattcgtacaaattgaaaaggaaattaataacctttttgaccaaaaataaaatgaaaaaaaattctgaagcaaaaatagaaataaagaattaaaaagagcatatcgcatttttgttataaatataaaaaaaattaaacgatcaattcattttcatcaaagtaataataaccaattcatttggcattttcagttcaatattgtacgttcacaatttaacaaaagttataatccctgatttttttccacgattaataatcatcacaaccggattttaaaaatcagaatttgatctcatttgtgttgtagttttctacattgttataatttttatacataaaattagacaaaggtctagtaaataaactgaacacaaggaatgtggtgaactttgtagtgatcttgtcctctttcagacaatttccacacccattcactattccttcctccaattgtcagttgttttaaggatgttatgtatatgacctcatccggaagctccttcaactttctgcattcatttatagtcaaagtatggagacatggtatggagccttcttctactatccactcttccaaatcataaatttagctcatacaattgaggaaacccaccttttgaacacaccatcttcttcccagtgaaagcaccatatgataattcaaccaatttcaagtggagcaacttctctagaatcggcattggatcatcttccatgcaacaataccgaagacatatgttcgtaaggtttggagggaatcgatgttgatcaggcaacctaggcatatgcatgcccaccgttaaaaatttgagttgaatcaaatcaagaactaattttccttcattatgcctatcatgcatgacctcgtacaatgaaagctgcccgagttctctcgattcacagagagatgcagacagagtttctaacgtacaaccatcaagggaatggaccgtgagagttctgagcttagtcataccaagaaggtcttccacactactgctctctattgagtaacccctcaaggtccatgatgaatgatccatacgatcatgatacaaaagtataagatatcgatgatgaatgattcatacaaccagagaaaaaaaaaaaaaaaaaaggaattacgaaagttactaccttcgtttcataaattgactcgtatatttcctcacaccaaaatttattaactcgtatgaagatggcggccaacgtccaagggctcgcaaaagaacaattataagcataaaaaacaaaagttacagaacatgactagtgaagaacaagtaaactaaagagacattggagggatccagtaagggaggagtgatgctgacgagaaggctgagggagacttgggacggaaggaacgtggttttctagtggcgatatcgtaaacaccgaagccatcgcctgcaaaatagatggagttagggtttagaccagggaatgagcttgccttgacacaaaagggctcattattgcctaagaatatgcagagatctccaatgtcctccgtgtaacacatggtccttttatcttcttccagctctctaaacaccatgaaacgctttgttccgcgacacaggaatgtcatcgaatcacctggttggtggttctgagcgtactacttgattaggaaacgttggcctgagggagactccacaaggtatacagtcttggaacatgagtcaagagctcccactcggactgggtcaacttaggaacgttgcaaaaccgcaactcaaccaactcagagccggtcatatcctctccgaagaaagaatcccaaaaaaccaagaagtgccctccaaaactaggagtgtagaacttttcatctctctttgaatacataacctttgattgatcaaaatattgaaaaggggttttaaagatgaccgaacccgagtccttgtgtgtgccaccaggcctattgaaattgatcataggtcctaaacacttgacagcaactgcaaaatctttgctttgatcaggtgaacaagtcattgcggcgttagtgatagcttgttgttggatagctataggtttaccaaggggatgcaaaggaatgcttttgacagatttggagccacatggattgtagtagtcagtaacatatatggctttatattcattataatcacacacggccttgaaaactccccaaccatgggacattccgaccagacaccctttacgcaactccattggtaataccttgtctcggacaataacttcatcttccttcaccgggtcaaaatagtggatattacttgttacatgaatatcatccatagaacttccatagtttatgacacgatacaacaagtaagggttggtggtagaggaggaaaacatccgaagagtgtggcatctctggtgaaaagtaagaaatagacatcagaagaagaagacgaaggaaacagagattatatacaaaaactagaagagatttaccagaggaagtttacggagagaggccttggaagagaggcttagaagcagagacgacatagcttttgctttgatatgtgaaaaaatcaaaaagaaacaaaagggttttcacataggtcatcaaaggaaaagtaaagaaaaaataattggtgcaaagtaaagaatcttgtgcacaaatttgataacaaagatatttcgtttccattttcataagattatataataagggaaaaaggaaatgtggagaaacgtggaaacaaagataaaaacgagagagacattattcttgtggccaggcactttggtcttagatcgagtcaagaagggactttcttggttgactaactcgaaaaccctttctttatttctttttgattcttcactatcaacgcaaagctatg

SEQ ID NO: 6569 - DNA, 3000 bp, Unknown; identical to SEQ ID NO: 6549
  misc_feature (1)..( 3000): cDNA_ID_3048610_gDNA_ID_1621097_Annot_ID_171109 3000 nt of promoter + ATG

SEQ ID NO: 6570 - DNA, 3000 bp, Unknown
  misc_feature (1)..( 3000): cDNA_ID_2173891_gDNA_ID_1621097_Annot_ID_171103 3000 nt of promoter + ATG
tttataaagaagataatgcttgtgatttcttttgttttttacttcgtaaatgatcatacataagatataaggatatgatgtttacaggagttaagccatacaatttcgagagaaaagcatattagattacatactagcattaacaccgtaacatgttatcttaggtaagcttcaaattatattgcttttaatacatagcagaccccaacacttggtagtgatctaaaccttattttaagtagcaaacacatatgtcttggtttgcacatttcccgaaggcagaaataaatactatatcatacataattagcttcttataattaattgcattttcaacataaattgcattttatcccccttaattacgaaattcctttataagaacccctccatagagctgaaccgccttatcgcagttaatagcccgttcttgtggcctctcaaagcggtcaacatggccaataaaaggacgagcaccactgaagtattgaatacgatccgtgggatgataaaccaccggttttacaatagttgactcatatgaaaactgagaaatgactcggcgagcagtaatatctagttgcctcttttacagtataagattttggaccaccatattcgtatgaattttggttaaaatacgaaggaaactcgtttctaggaacatatggtttaggggtaagtttatgagacttaccatacatgttatcgactatttcaaaagccttttgggcaattcttgtattcctatcattttgagccattgccaaggaagaacaaaaaagagaagaaaggtgtttttgtcttagtgttatctttgtttcttcggttttagtttgctttgggaaacaaagccaatgagcttccttatataagaaaaggataatgaacctacgtactcatctgttgacttatcttttaggaattatcccttcactttacatgtagtctttttttttgtctaaatatttaattcattaatcaaaagaggatgtacaaagatttttttttttatatgtacaaagttacatagtcatttttattagattatccctttttttagtggttaattgaacataaacttaaatttgacattacaaaggggtccttttttcccaaacaaatactgtttcggtaaaggaagacaagaatagacagtatatgtagtagatataaatctgacattaaattccttttgacccaaaaaaatgaacattgtattactttataaagaattaagacagtagtaggcggtagtggcgacaccaatttgcttctcatggtacgacatatatatcttgtccgcatttgacttatcgatatcagagagtcatcacggaaccatgttcactcttaaaaatagggggttaaataagcggatccttcacaataaattagttcagttctatagaggcctaatttagtttgtttttattggtggttgaatcatctaccttatgcaaattatttcaaagcaaatggtgtttccccactacaagcaaattcaaccattcataggttcttgaaaatttgatccgaagagtaaccatgcgatgaatgtatttttttagaattaacaaaagactaataaatcaaatttaaatgaaagaaattgctcaaatattataaatttcatgtttgacaattgattattcatattcttaaaaaaaaataataggatagtatagtataaaattataaattatttgagttgttaattataaattatttcgaaacgttagttgttctgaaaatgatctcttaaatctacgtaactatcaatattgactctatttttaatagagtcataagattagtttaaaacgaattatttcagcaagaaaaacattttccacaaatatgtaataaaactatgaaaggccctaatcgtattaagaaaacagatttgaaattatttaacaagaaaaaacgtttatgatttctgttcctaaaatattctcttcaattttggagagaaatgtttttgttttataatcatcaaatggtaagcttttaagaataatgtagggtcctaatatctgtctaaaaattgaaatatatatggtgaaaatttggaggaataaagagaaatatcattctttcttatattttttgaaacggcatgggatgctaaatgaagtctatactctatacatcaaggataagcaatgttgaggaataatagaagaaattaacgggatgctaaatgggaagaaataatagagaatataacaatgagaccactggtcttttttgcctagtgcaattaactttcgcaaaatagattccctatcaccaaatttgcatatatacttccattacacgtttcatgcctatgtagactgttaggattacaaagtccaacaaagtatctttttaattaaaagtgcagagtcgaagtagcagagagaggagatacggctccactctatcttctcattcctctaataatatttacgccacattaggccacaaatatttccacgcatctcaatacataaaattaaggaaaataaaattacgtacaaccttcattttgtaagaatttacatctcactaatcatttatactataaatcatatcataaaattcccttataagtatcaattcctctatttttttgccatgatttattatatattatattctatttatacgatttaattagtaataataaatatatacttctagaatttttttatataattcgagaaccaaaaagagtacacatttgtaatttattgttcttacattattatgaaaactttttttttagattaatttaaagagacgagttagagtagggcttataaacaaatataaaacaaaacaggtcgtttaggcccatttatttgttaaggaaacgggtaccgcgagaaactagggggaaagtgatagaccaaaaaccctaaatctattataatcactcttttataagtagtccatttatttcaccgccgaatatgacaaagaggtggagctaggtcaaggagataagaa

SEQ ID NO: 6571 - DNA, 3000 bp, Unknown; identical to SEQ ID NO: 6546
  misc_feature (1)..( 3000): cDNA_ID_3048618_gDNA_ID_1621097_Annot_ID_171101 3000 nt of promoter + ATG

SEQ ID NO: 6572 - DNA, 3000 bp, Unknown; identical to SEQ ID NO: 6545
  misc_feature (1)..( 3000): cDNA_ID_1814884_gDNA_ID_1621097_Annot_ID_171094 3000 nt of promoter + ATG

SEQ ID NO: 6573 - DNA, 3000 bp, Unknown; identical to SEQ ID NO: 6544
  misc_feature (1)..( 3000): cDNA_ID_2173870_gDNA_ID_1621097_Annot_ID_171090 3000 nt of promoter + ATG

SEQ ID NO: 6574 - DNA, 3000 bp, Unknown
  misc_feature (1)..( 3000): cDNA_ID_2173859_gDNA_ID_1621097_Annot_ID_171087 3000 nt of promoter + ATG
aatcccaaattctctttcatttatatgatattaaccttttagcgaaaaaaaaaaacttgtacgcaagagacggtcaatgtcacttgggacattatgtggactcttccaaaaaccctttagaatgttgtcattagagcttgaggttctaacggttaagagcttttttgagctttatatatattattttggatgttatccgggatgatataattttccatgtaatatctataagattttactttcgttgtatttcgaccccaaatctttggatgcatggctcgaccacttattatcgatcttccatcgtggtagcacgtatgagttggtccatcgggcattggcttcctgctatgtggtatggagtacgttgctccagtgcacgttggttggagtatgtcgcttctggcctcttcatcttttttcaatggttttttgctttggactagtcgattaattcaattgattggttcgcatttagtttttagtgggtttttgcaactctcttaggatgtgcttttgatgaaacaatccgatctattcattaaagaaaatcttacatctaaatttatattcttaaccaaacaaacatgtgttatattattaaccatataaacgtaacaaatttttgttttatcaacacaggtaacatatttattgtttatcttaaacataaaaaaaataattatttctacatgggttttaacttttaactcaattaattgaactgccggtctgattttccctgacttcaccaaacctatatacacaattcgttagattgactgatatcattagttttcgacataaattttctattatttccactctcacgttgtttaatcggtccgtgtttcaagagtttttgaaacgaatgaaaaaaaaaaagaataattagacacatagattttccgggtgacacgcaaatgccggtttagctagcattcgaaggtaagtgatgaaatgactaaagaagaaacgatgataccaaacctaaccatcaagcaaaaaggttgatatacctactatttagatgtatcctcctagaccttacattattgtatccactttaagaatttggctttcgtttcaaaagaaatacaaaagaaatcctaacattattgtatccactctaagaatttggctttcttttcgaaagaaatacaaaaaaaaatctgaaacactttcgaataatttgttgattaccttcttcttttatattccttgtgatctgctttacagttttatacatacacatttgattggaccattggttcggtattcttaaacgaccggagatttatccacacaacgtcttctcgcagccaaacacatcaaactacacatgttcttcttgtgtagaaaactctcactttcacgattccgacaccattttcctctcagactccgtcgttttcttggggaaaacccaaatccaactacccatttctctacattacccgacaatcaaacaaaacgaccagagaagtcgagactcgacggcgtagaacacaaaaccctaaaggtaaatggcataaacatgcacgtggcggagaaacccggatccggatccggagaagatccgatcatactcttcctccacggatttccggagctttggtacacgtggcgacaccagatggttgcgctctcttccttgggataccgtacgatcgcgccggatcttcgtgggtacggagacacagaagcgccagagaaagttgaagactacaccttacttaaacgtggacggagcgtggtcgcactaatcgtcgccgtgaccggcggagacaaggcggtttctgttgttggtcatgactggggagcgatgattgcgtggcagttgtgtcaataccgacctgagaaagtcaaggctctggtcaacatgagcgtactcttctctccgaggaaccctgttcgagttccggttccgacactgagacacgtgttcggtgatgattattatgtctgcagatttcaggtaattaatttgctgccctaatctttaaaattaggaccgtataccaaatcaataagtttggttagttcgatggaaagaaagatcaatggaatcatataaaagaggagaaaacgaataatatgattttaaagtaagaaatttaaataaatattatacagttgaatgacaagtgaatttgattacgtttttaattttttatataacagtaacatttatgagtgattattttgtaattaagaaagctggagagatagagacagagttcaagaagttgggaacagagaatgtgttaaaagagttcctcacatacaaaacccctggaccgctcaatctccccaaagacaaatatttcaaacgctcagaaaacgctgcgtctgcgttaccactgtggttaacacaagaagaccttgattattacgtcactaagtacgaaaacaaaggcttcaccggacccattaactactaccgcaacattgaccggtacgtttaatcaccacacggttcaatagtatcatcacataattttcatattttaaccaatcggttcgcagaaattgggagctgactgcaccatggaccggtgctaagatccgtgtaccggtgaagttcataatcggagatcaggatttgacgtacaattttccgggggctaaggaatacatcaacggtggcggtttcaagagagatgtaccattgttagacgaaaccgtcgtgctcaaaggattgggacatttcctacacgaagaaaaccctgacgtgatcaatcaacacattcacaacttctttcacaagttcctttaaaatcataaactaaggaatcgttaaataaaacaaaaataacattcgtgtgttttaccggttagtgaaaatcttatgtccaataaataccgggaaaatcggagtaaaccggatttaatcttgatcggaccgattaatatgaaattaagaattttcctccaaatttgggatttggatcatctcttcttcttctacgtcttcatcatcagtcatcactacgaatg

SEQ ID NO: 6575 - DNA, 3000 bp, Unknown
  misc_feature (1)..( 3000): cDNA_ID_1814807_gDNA_ID_1621097_Annot_ID_55736 3000 nt of promoter + ATG
aggaaccattgcatttttaaaccacaatgagatagataatactccacaaatcagaatattatcatctctttgaccacctacacagactctaagcgacacgagaacaactactaaaacggaagagaccaaaacctagtctgaagtacaaagtaaatccatactattagtccctattgatcagaatgtaatccatgtcccaatagcattaccacccggagacgcatcatcagaaagactcaatatccccggctttcgttgttccggtcctaaaccaaaagcggaccatatatccgactgacccgaccaatgatacaaggcaaaccagcaaggctagagcttttcccgagctaaccaatcaaccgtaagctactaatcgattaaggataacacattggagcccggattagtaagacctcacctaaacggtgcattgccggaacgatctcgccgcacatgccttgttgcctcgctccatcgccggactggaccagacattgagacggttcactagatctccggattatctcggccaccggcgaccacagctccatccccacgcctggaagactctgactctgcctctgttcatccgtcggcttggttctcctgggggatacagggatcgaaacagctgctcggagcagctccgaaccccaccagtctcctggataaggatcgagccgagagctctctcctctacctactgcctccgcatcgtcacaccgtcgtcgttgagcttcaccttagcctccggagaaaggagcaaagagtcgaccttatttctaaactaatagacaagacaacgaaaaagaaaaggggggaagccctctcacaccgccggcaaaagtcacaggcggcggagaggcggcgacggctcagatctaagttttttctcagaaaaaagctttcgtaggatatccaactttagtattgtattttctagagtctagacacaacatttaatttttcacaagcttgtatattgatcatcttttattttttcctttgctatttttattatgtggcttgactttgagtttggtgggaagttgcattccagtcttgcgagtaaaacattaagttctctactatcgcaagaacaaaaaaaatccccacgtttctttcactattaacaacatgggttttgtgtatatacacgtaaggttagtgaactctttttttttttttttgattgggtaaagttttaaattttactacaaagacatcaattaatagatttgttaatctgttagctagtaaagtttattatatattataaccatcgtgaagtttccttaaaaaaatctttgtaattaaaacactcgaaaaattttggttagaaaaaaagaataaagatgttccgccaaatgtttgaaagatcatgcgaatgcaccaaaactggaaaatcatgcaaatgcatcaaaactaaaagaatcctcgcaaatccatattttgttacactaccatttggaagataacatttatttttgcatacatcccgttccaccaaatgttttatttcatttcgttcactaaaagtctaacatccattggctaataatacgttacattatattttgaaaatatttatatatttcaatcacgaatatcaagcataacactactaatatatttaagataaaatccaagagacacgaaaagcaatcgttctaccattacctctacatttgaactttagagttccattggcgcagctttggttattcaacgacacgttctctcgactctctttgtgtacaattaatagtctttttttttttttttaacaattaatagtcttatctcaacaaagaagttgattacataattcaaaaacaacaacttgtttctattcgttttactctatttcatactattaacattttttatacaacatattgtatatattgcccagataaaatattcattttcagaagctttattcatttttcctcttctattatatgactaagttggtggaagttgcaccgcagtttcagagtgcaatattaacttctctagaatctctactgctggctgctccaaaaccaaaatattcccacgttcatttcatcactatggttttgtgtatatataaagtaacatgtaaggttgatagagagattaatgagagtttacaaaaatagcaagatttattgggtagttagtagttatcattaatctcgtcaaattattgattaagaaacacctcgtggagtcatacaagtctcatgacccaaaaaataccgttctattatgaatgtatgattaaccaaaattgagtgattcattttacgttatgttgcatttaatggacattaaatttgacattatgtcaaacacaaatcaactaatacttcaccgtgacatgatgaagaataggcatacaaagcggataaggttgggttggttagaagaatttcggactaaacttgaattcaaatgtctccccgttcgtttgagtccaaccaaattgtatcggagacttttgacaaatgcaaaaaaattcatagattaatcttgtttcggataataacattattcagcaaaattattttattatttttcatattacatacgctcatgcatggagctttgtaggtatagagctagccatcaatatttaatactaccgcagccaacttttgcagactctgaaggcctaaccttttcttatataaaacagtgtggatctatataaacatgactctacaattcgttattggtcatttccaaagtaatttaattttaaaagttctgagtgaaactaagagtggttctgtgccattctcaatgaaggactctatttgtgacaaacccctaatataaacctttccttcgttaactttcatatatcttttcttcccacacgcatctcttcttcaatgttctcttcttagaaaatcattattattcgtctttagttcttcacaaaagagtcccgtttttctagttgatattttgtccgggaaaatcagtttaaaactgaaaacatcagta

SEQ ID NO: 6576 - DNA, 3000 bp, Unknown; identical to SEQ ID NO: 6559
  misc_feature (1)..( 3000): cDNA_ID_1814798_gDNA_ID_1621097_Annot_ID_55739 3000 nt of promoter + ATG

SEQ ID NO: 6577 - DNA, 3000 bp, Unknown
  misc_feature (1)..( 3000): cDNA_ID_3090457_gDNA_ID_1621097_Annot_ID_55740 3000 nt of promoter + ATG
atctgacagaagttagtagtatataatgtgcttaatttctttcatatttttaatagaacagaacttatataatgaatatcgaataattttcacaatgatataaaggtgcatggggatatgcatgtggttgttaatgtaagaaaaagtacactagtcttcaatgaagaaagggtcaaatttatttcgtattgtcctcttcgtatttctttatttgtatttttttctaccccacaagttaaattctgatatgggccggcccatgggctttacgcatttattgtctaaatgcccgagaaagttcatgaaattacatccgattgccactacgcagtctttagtctttactagagcttgacctcttctctctcatgtccgagtgaacaaatcccgccaaagatacgaagagactgattgtgaaatcaaagaagcattcaaaagctcgttatctaaagattctgcgaagatgagtactatgaaattttgtcgcgaatggtaaatacgaatctcttcgttttttttattttgggggtcaaaacgaatctgttctctgctcttttatactagtcttctgaaattgaaatttgggttttcatttcttagctcatattgaattatatattgtacccagttctcttaagtctctaattgtcggaattttagttttggatggtttgcttatgttttctattggattaaagctccaacttttctccacttttgcagcttatgaacctttgattttgtttttttttgaaatgttcagtaataacattctatatcccaaggaagacaaggagcaatcaatcctcctctatgcgtgccgtaattgtgatcaccaggtaaactttgtttactatgctttcttttataaaattaggtttccttagtgttaatggaacaatgtggtgttgaaacaaagctagggctgaaaccaatagactttagttgttcacttgtatatgatttgtgttgatatttatttaagctctgatgttttactctttgtaatcgcttatacggttaaaggtcgaatgtctgaacttgaagtaaaccaaggaatgataatttaatgagtttagatcattttccttgtctctcatatcatgaatctgattggttaagatagtagtgcttatcagtataaagagttctttgagaacttctgaacaaacgcaagaccttttaaaaaccgtttagagggtttctgcaacttaacttctaaaaccatttgagtttcaacaatatccattggtgttaccgaatctgagtttttttttgtttctactgtttgtgttatgttttgttattacaaagcattatgcctttgttagctactgaaaaccattctagatgaatctctgtatgggatctttagcttaatgcccggacttgctaaccgaattagttataaacttactgagttactgttagctatttatcgtcctgttgatagaaggtcttgaaatttatattcttttatttggctttgcaggaagcagcagataacaattgtgtttacagaaacgaggttcatcactctgtaagtgaacaaactcagatcctatctgacgttgcttccgacccaactcttccacgtaccaaggctgtgcgatgcgccaagtgtcaacacggtgaagctgtcttcttccaggtgaatcattatcttatatcttaatctttaattcgtcatcaatcaaggagtaaagaaacattctttcgtttttctctgatctaacttaaagatcaaaagagatttctttctcttgctttttaatgtgcttatggctatttcggtttgatatagctcgtgtgtgtcatcgaattttcaggccacggctagaggcgaagaaggaatgactctgtttttcgtttgctgcaacccgaactgtagtcaccgttggagagaatagattgatagaagactacatttttcaaatgtaacgtgtatttgtgttccgctttatgagttttatacaattcaatttggagttttctgtgtaaaaatatgaatactatgagactgttctcgggtttcttgaattgtttcagggtcttttatgatcattttggtttttatgtgggtctaattataaatttgtcgttttatgcggggccgatctgaaaattcgtccataaaccatgatagtgttgaaaatttgtatacgtggagtctagccgccggctgctataactttgctataacgtgtgatattataaaaagttgataaatctaatcttctaaaccaaattgttttaataatgctgtgtttacttcgtcatcgtatcgaattatacggctgctcttgttaagtgatgacaatatcttcaaataaagttttttcttttgtaagcaaatatgataaaactacgttagctaatagccaacttggtccatcatagttcataaagtcaaaaaatcagtaaccaattcatgagtggaattatacttgattcaatgacactgtttaggagcttatctaaattgcacaagttttgttacacgtaaaacacaaatatgccaaattagacatgtttctcgtcattctaaaacattaacaaatatttacatagacgcagtcaaataaatcaaatttcgtatgataaaaaaaaaacaaaaaaaatagcaaggttgatttgtcaatgctggcaaaaataagcaatgtcctaatttctcaagttggaaagtgacatttctctacccattttttgaaaagatattctcttttgcatataagatttgataaattgaacgcatatttgcactcaagctaacgttatgtacttgattacttgacccgactaatgacttattgactttgattaataaacaaagatattagccactccattctacattatatacaatctatacgcatctatatatatctactaaaaaaattgtaagtacatacatatcaatgttaatttgtatataaggagctaagaacaaacccaattaggcaactagcaattgctaaaacacgtaagatctcaaatatg

SEQ ID NO: 6578 - DNA, 3000 bp, Unknown
  misc_feature (1)..( 3000): cDNA_ID_1814790_gDNA_ID_1621097_Annot_ID_55742 3000 nt of promoter + ATG
aggtaatttaattttgccattcatggagtcaagagagcaatgaaacacaagaatgcaaagaaaaagcatttgcttaatgaagtcattttgagaaacttcctcctttctaacgatctcagttccaaaccaaccgtcaattaatctctagatctattgaaagagattgttcgaaattcttcgaacaacaccaaactccgaggaaactccaccactatatacacctaacttgatgtagtatgaacttagcaaaaggaagtgacaaagatgttactcctcgaaaaaattggagagatcgtataagatttagaagaaaaacggagacatcaacggacacagatggaagagagatcaatttcgctagagcgtatatacacaaaagtatataaaattttgataaatcgaacaaagctaataacggaaatccgataaaaggtcggcagttattttgtttgtatatacacggaaatatataaaattccagacaaaaccgaaatcaaactccatcgacaagaaacctctcctctcagaaggatttgagagagagaagaaactatttttagtcgtcggattttaatttcggtgtactgaaaattgctttctctatctgaaaaatatgagtgagaaaatagaaaaaaaaacatatttttctggtcgagtactcttttgtttaaaaatttctttaatttcgtaactttttgtttctatgaatcaaagatcaaaattacaatttgttattggatttcaacgaatccaatatatttttattaatcccaataaagtaacgtaaaaggcagaatactttactagtgttataatttatatagttaactaaaattaggtttatgaaatactattttactagaaataaatacccgatcgaccatgttgaattattatttttatacattaaatttttcgattatatacttcgaattcttgggtcataatctaaatctaaaaactaataacttttaaaattgattcacataataaattcaaaactaatagcttacaccacaatataaattagtattttttaatcttaatatattatgccacaatcatctacgtacttggattattatatgtactaacctttcagcttcatttctaattaacatgcaatcacttaaatgatttgcagcatgactcttcattaatgcaatgtaataacatcaaaatttaattaaacgtcaattaccgtttcactcttccattataaaaagaagtaacaaaaaagttctccctaaagattttgcttgcctgaaaaaagtatgaattgcatcaaacaatttctcttggcaatttgcttttctctggccctaacatgtcaagaccatgtcttagtcggcggcaccaccacgagagacattatagtcccgaagatttctgagtggcaagtcacggttgttaacggtttgacaactggtgaaactcttttcatccattgtaaatctaaagaagatgatctaggtgaaattaatctgaagtttagaaatagattttcttggaacttcggagaaaatatgcttcactcaacttttttttggtgctatatgaacaaagataatggtcatatgaatgtaaacgtgttttgggatgatgttatcttgttccatagatgcggttggaagaattgcatttggactgcaaaaactgatggcctttatctttggaattcagcgagcggtgaagatgtattgtcaagaaaatgggaagttggatggtgaagccatatttttgcttttgggtaattttttagtacatgtatcttgttgtttttggcaaaaaaaaaattgaaataataaaaaacatttgttttaactttctctcttattttgtgtatttttcatcaatgatagattttttgttttagttctttatttataggtcatttaattattagattaatttcctgagataataagatcatagattaaataacaatattgtgtttgtgatatatagagattacattttacacttatatatagtggtaagatttctttttgctttcaaaccattaaaaacctgttaaacgattaacttgactcaagacaaagccattgattattgactcatgaatctagtgactcatgatgaaggagacgaacagtaaatattcatttgattattttaggtaaaaggtagttcagacctagtcatatatcctctaaattcatatagtgatgcaagtattttgcattacttagaactttatattattgatcacccaacacatgatttaataaacgccatgaaatgcatgtactatatcaaaatgtttctgaagcatatagttgacatgagaattttggattggacttaagaatgtgagagttacctgaaatgtcaatttttttccctttgttaacgaaaactcattggaacaattgtatcccccttttggcagtatataaatatattgatggcccaagtagctgtattttccgttatcagccaagactcaataaagtctaccggtccaaatttcaactgaatcaccggtccaaccactattaccgtaactagaccgctttttcttttttacattcggacaaaaaaatcaaaatttcgagcaactaaattgatctcatcttcaatcaaattcatcatcttcgatactcgtttcttctctctttggtttcatacagatcccaaatttctagggctcctagtcctttgatttcttcgactggaatcgcaattccccactacgtcaagctggacagacaccgaagggatcgccatgagagtggcggctacgaggattcctaccataaccaccgagcccatcccagaggtccatctcgtccctcagattcacgcttcgaagaggatgatgatgattttcgccgccaccgtcgtcgtcgtggaagcagccctagcaattatcgaattggaattgggggcggaggaggaggtaatggtggtcgacgctgggaagatgacactcctaaggattttgatggtcccggagatggaggtttccggcagatg

SEQ ID NO: 6579 - DNA, 3000 bp, Unknown; identical to SEQ ID NO: 6541
  misc_feature (1)..( 3000): cDNA_ID_1814786_gDNA_ID_1621097_Annot_ID_55745 3000 nt of promoter + ATG

SEQ ID NO: 6580 - DNA, 3000 bp, Unknown
  misc_feature (1)..( 3000): cDNA_ID_1814783_gDNA_ID_1621097_Annot_ID_55746 3000 nt of promoter + ATG
gtcaggtcaaagccgttgaatcaactagtgagggtaagaaatgtgctctccaaaacgatgaaagggacttggtaggatgtgcgacctcggaaatgttggaatctatcagcaaaaaatgcgaagcaagcattattgatgataacaaacgttctgtgagcatgaatgctttacaggatagtactgcatctaatgttgaaaagcatcctgaaacattttcagtagcgaagcctgctttgtctagcacactctcctctgcacatagtaatcaaatgagaggaagggactgtgttccatgtgaggttatagatgagaagaaagttatagtaattggagctggtcctgctggattaacagcagcacgtcatttacagcgccagggtttttctgtaaccgttcttgaggcaaggagtagagtaggtggtcgtgtatttacagaccggtcgtctctttcagttcctgtggatcttggggctagcataattacaggcattgaggctgatgtgccatctgaaagaatgccagatccatcggtattggtctgtaaccaattaggtctggagttgagcgtgttacatggattctgtcctctttatgatactgtaacagggaaaaaggttcctgcagaattagatgatgctctacaagcagagttcaacagtctaattgacgatgtagatttgcttgttgaggaaataggcaaggaaagagcaaataaaatgtctcttgaggatggtctagaatatggccttcaacggctgagaatgccacatgacaaggtgaacattgacaaatttgggcttctcaattcaagctcaaaaacgggcatcagaggtccctttatgcaggatgaaagctggaaagatgattttttgaatcctttggagcgaagagttatgaattggcattttgctcacacagaatatggttgtgctgctgtcctcaaggaagtttcgcttcctcactggaatcaagatgagttttatggcgggtttggagggcctcatgctatgattaagggtggttatagccgagttgttgagtcgcttgcagaaggactggacattcacttaaacaaaatagtttcagatgtatcttatgtctctgatgtatctgccatggataacagcaagcataaagtcagagttagtacatcaaatggctgtgagtatcttggagatgctgttctggtaactgttccacttggatgcttgaaagcagaaactattaagttttcaccacccttgccggactggaaatatgcgtcaatcaaacaacttggttttggagttctaaataaagttgttttggagttcccaacggtattttgggatgatagtgttgattactttggggcaactgctgaggaaacagatctaagaggtgagtgctttatgttttggaatgtcaaaaaaactgttggtgctcctgtcctgatagctttggtggttgggaaggctgcttttgaatatacaaacaagagtaagtctgagcacgtgaaccatgcaatgatggttcttcggaagctttttggtggggatctggttcctgatcctgtcgcctcggtagttactgactggggcactgaaccttacagttatggtgcctactcgtatgttgctattggtgcttctggtgaagattatgatgtattgggaaggcctgttcagaattgtttgttttttgctggtgaggcaacatgcaaagagcatcctgacactgttggtggtgcaatgatgactggagtccgggaagctgtgcgtataattgatatacttagaagtggaaatgattacacagccgaaatagaaacactagaaaaagcgcagaggaaatctgtacctgtaagggatgaagtcagagacctaataaagaggctggaagttgttgagctgtctaatgtgctagccaggcaatcattgctacgaaacatgttcttctctgccaaaacaactgtcgggcgtttgcatttagccaaggagttgcttaacctacctggtgaaaccttgaaatcctttgcaggtacaaaagaagggcttgcagtgctgaactcttggatcctggtaagctcagtgagatagttttttttaccaaagcactaaattcaacttactttcgcttatatgttttgttccacgaatttctattggctattttacatattcttgcttatataaaattttctgttaggattcgatgggtaagaatggaacccagcttttacgtcactgtgtacatattcttgttcgagttacgagtgacctctttgccttgaggctatcaggtattggtttttcttccaagtacactttttgtcccaacctaatatatcacatgcaatcagttctgtcttaagactcgacatcatgtgctatctgttttgggatttcagccctgtttgattttctctaagttggttactttccacttgctgatgcaggtattgggaagactgtgaaagaaaaggtttgtgcacacacgagccgtgatattcgtgccattgcaagtcagcttgttaatgtgtggctggatctataccggaaagaaaaagctaatagtggaaagaaatcgttgagacaagcgaatactacaaacaccccctagaataagaagaaaactgaatagtccggacacagacagtaagggaaagctgagcaatggcaacgatgtgaaaacagatgaagagtttgaggacaaccagctacctatgtcagaggaagagaaggctgtgtttgctgaagctgaggcggctcgtgcagcagcagaagcagctgcaaaggcaagttttttttaatctctaaattagtgaaaggcatttatggatgcttactgaatgtttttgttttctctgaggccgttaactctttatttatctgtttgttaacgaataaattatatgtttctgtcttgcaggcattttctgaggcctatcataatacttcattgcagcttcctaagatcccctcatttcataagtttgccaggcgagagcagtatgcaaag

SEQ ID NO: 6581 - DNA, 3000 bp, Unknown
  misc_feature (1)..( 3000): cDNA_ID_1815008_gDNA_ID_1621098_Annot_ID_55751 3000 nt of promoter + ATG
atgtttgactgtttgtaacatgatttcttgtggaaatttatgtaagaaatcttaatctttgaataattgaccgtttgtaacatgctttattcagtttctcttcatacattatcatcagtttctatttatcataagtaagttaattaataagtgggtacatatcatccatataagtaacattggcaataatgggatgatatcattgtttagtttagacttagaagatgagaagtacatcttgtgtgaggtcatgctaataatctactatacaataccccatcacttgctctcttatgtaaacttccaagttccacttaaatctgctatctaatgctatttttagctgcttaacatgtacatttaaaaaaatgtttagttatatgttttcgaccgtaatgttttctttgtataaatcaattatttgcaatgtagtagatctagtgggaagtatacgatttaggcgaaacagattgacaagaatatataatactgaaagagacacacagaaatatacaaaataaggagtcgtctctgctgaaaattcaaagagaattaataatgagatcggaaatctattgggtcccaatcgcaactcaaaagttaggaagacttttgataagattctgtccttttgatgtgattgccaagatatagcattctactttgtgtggctccgagacatgtactacttcgatactttctaccctatctatatccattcacacattacaaatttgattggtaactataattattcttttttgtatgtaacaaagttgtggtaaacagagatagtacggagttgttgatatctcactaaacaaaattttgtacctctagttttgtaccgccactattttgtgacggcaagaatacgacaattgtattttaattttagttttaattttcaaaagtgtataaaactggaagtgaatatattgtatcataactattaaactatacttttttaatacattaaaaaaaaagtttattttatcggaccacaatttttattcatactccatatatctcttaccctatcgtttagtgcctctaattgcaccatcatcgcttatccccaaaagaagattaacgtttcatgtcaccaatttgatccgacaaggtttaatcttaaagtagcatctttcacctcaagagcatgtttgatggaactatatacatatatatattgaaaatgtaaagttggtccgagaacgacaagcacttcagacaatgaaaatgtttaatggaatggaagaaattcgttttggtcgatgcagaaccaagcccggcccgcatggtaatgtctcgttcactatttgctttgacgaaaaaagttatgaatggtccaaacgaaatgattgctgtaacctgtaaatttggtaatgcgtaatcattcaatttatggtttgtgaacaaacaatgtatacatatagtattggttttaaatttcatgtactaataaggaaaagaaggagagaaacgatggaaatataaaaagaggctttttagggtttaagcctttaagagaataaagggacaaataacaataaggaagtgtcgttttctgtgtggaaggagaataatgaatagagtgtgggcattgtgtattgtgtcattctcctaattccaaattcattgcttcaaaactactcaagaatcatatttgcaagtagtggtgtttggctctacaacgttctctctttaccatgccatggaattattccttgaaacagaaaaaaagagaacaatcatcaatattccttttgttaaagatcttgatcattgggtctccgttagactctcactcaagtctcaccaatcagctaaaggtggaattttgataatcgtttttttaacgcttattaaaacccaagagagattcatgcatgttataatccttattcatataagttttcaatgtaatatgttttacacgtcactgaatttggtagaagtttgtttatgaactttgttgctcagctaacatagactgtgtttttccccccttacaatatctacccaatcaatgttttcttatactagtcaggacgttttttaaccaaaacgattgaactttcagacatatcactctcttttgtttttgtgcagatagatatatcactctctaatccatattagttctcttttactttattttattttatttaagaacaatttagttttttattcatctttattccatgtcctaagaatcgaagtgaatagttaacagtttgttttaatacaataatattagttgccgtcgtttcttctttaaatcactgttttctttggactttttacggacaaccaatagaaagtgcaaagaagcatattcaaaagttcaaaatccattcggacatgtccacgtgtgatctgccactctgtaaaaattccacgttagcatgacggacacgtggatatagttatgttctgcgcacaccacgagctaaccacacctaggcagcacgacctccgtcagaatactaacggccgttctcttccactcgcgtagttctcaagcaaaacactcacggcgttggaaacgtggaacgttgcgtcctagtccagtgtcaaaaaaacgggaccacatgagacaagctttgatctggacagagttctgagtgtgtcagaccttcaacggcacgtgcgtctcacacgcgtggaaaatataggaaagcaaatccatttggaacctcccaatgtgtcttgcagatttcatcttcctttttctttttcctttttaccatactcctcttaataacattggtcaaagatcagtatataattagttgtaattatatgaaaaagatattttaacatgggtttgcgtgatagagcgacacgtggataaactaacgaataggagaaaaggggtaataatgtaattttgtaacagcattcactttctgccagtagttccactgtcttgtcctttggttatataaacaagaacaacgcaactttgtctggtacttcagaagaagaaagaaaatg

SEQ ID NO: 6582 - DNA, 3000 bp, Unknown
  misc_feature (1)..( 3000): cDNA_ID_1815001_gDNA_ID_1621098_Annot_ID_55753 3000 nt of promoter + ATG
tttacataagagagcaagtgatggggtattgtatagtagattattagcatgacctcacacaagatgtacttctcatcttctaagtctaaactaaacaatgatatcatcccattattgccaatgttacttatatggatgatatgtacccacttattaattaacttacttatgataaatagaaactgatgataatgtatgaagagaaactgaataaagcatgttacaaacggtcaattattcaaagattaagatttcttacataaatttccacaagaaatcatgttacaaacagtcaaacatttgcatacctatgtaattataaaaatagtcaaatacatatgttctcctccgtaagtgccattgggcctcctcatgacttagaagacgcgagcgtttcagctgaaaaccaaaaaattctcatcagattcaatcagacaataatgtcaaaagttatatattaagtacataatcagttttatttcagaacgttcttagctgtaaaatgtaggatatgatcctcttttggtttaaacctcatgacgtggattcaatttttttgctaaaaatgtaaatatttcatagaaaatgaaaacagtttaggtttacaatcgatatttctatcatgatcgtggattccttttcgacatttctgtcaacaacaactgagtactgatacaaaggccaacgaccagcagtatcagcaacttgagggggatatcctttggctttcaagtgaacctttcctagttattaatctttttggcctcatatcgcttccaaagtgagttatattcattgtaaaatttgtaagggttagtacatccaccaccgagacttaattttctctattcaaaaagaatgtgaaatggcctactggacctggagagtaggattggagattctgatctaaagaatgaagtccattaagaattatgtttttgtacttcgaaatacccattaggtttcatgacccatctattaaaattcatataccaatattcatcaaaaaaaaaaaaagatttctattggcttttgtaaaactcccaaatataaagtgttttattctaccaactaaactgcatgtgacgaatcttccagctatatttcttgttgttttctctccttctatcttcttcttacgtatgaagaattaatgatgatgatgattgctcaatttgttcgttagtgaaaatattataagatacgcatacaaattaacctgtttcttctatatatagatgattacaaagcatgtgatgtgggagttggactattggagtagttgattaatcgagctggagagaaacaattacaaagattctttacaatttttaattaagcaaattagtacagacaaaaaaaaaaagtgtagaaggagacaaagagttgcgttgaaggaagaatgattgagaaattgaattatgccgactcacgccccactccttccataaatagtttagttttattttttgcatgttaatgtattaacctagtaaagaaacattgaatttaggataagcagtaaatttcatttggtgacaaataaagaaagaaagattgggttaagtcaaataatggcaactatgaaagttagagatgtgaaaagggttctggtgattccattattgtacctggctgctaacatttttgtttttcttttaaaatcaagaaaaaagttttgattaatcaaaatcgacgccaactaaaaacacgtgtcaaaacgtggttggtgacagtgggatatgagactgtattataaaaagctacatttctcaccaccacccaatctctctctcccttgaagtagactctaagctaaagccaccgtcagattttcagatctcagatctcagctcttcattcgacgccatggccgagaagggcaaaggaaaggttttcttcttctcttctcttcttattcagttaatggtattctcttattattgttttttttttaatttgtgggtcttgaggatatattcaatctttatttattattaacctgaggaggtttttgtatatgtgggtttatgtttgtttgtttttgtgtggattaaaaaaaagagttggctactttgtagaaactatgagaagaaatcagattctctttaaaccccaaaaaaagtaagaaaagaaaagaagagatcagattcttcttctctttttctattttgtgtcagaggtcgaatctgttcttctgctcccttcccttttttgttgtttctttcagtaataagatcttataaacgtcaaatccattagtacatataattttttatcaaaaaagcaaactatggaagaagcagaggatttagtgatgttgatatctgaaaaacaggtaactatgatgaagttgaaggtggatcttgattgtcccaaatgttacaagaaagtgaagaaggttctttgcaagttcccctcgtgagttacttctctctttttcttaacttttttttggtgaatttgattttgattggttttgtttggaaatggactgagtggatttacttgtgtgattgggaacaagagaaataagagaccaattgttcgatgaaaagtccaacattgttatcatcaaggtggtttgctgtagtcctgagaggatcatggacaaactctgttccaaaggcggcggctcgataaagaccattgagatcgtcgagccacccaagcctcctcagccacaaccccaacaaccacctcagaaacctaaagatgctcagcctaaagctccttagaagcctaaggaacctgaaaagccaaaacagcttgaaaagcttaaagagccagagaagcccaaacagccagaaaagcccaaagaacccgaaaagacgaagcaacccgcacccgctccagctcccgcaccagcacccgcagccaaacccgcacccgctcccgctccagctcccgcacctgccccgaagcagccgggaccgccaccgcaagcgatcccgatgatgccgcaagggcagccagcaatgtgttgcgggccctactacg

SEQ ID NO: 6583 - DNA, 3000 bp, Unknown
  misc_feature (1)..( 3000): cDNA_ID_1814994_gDNA_ID_1621098_Annot_ID_55756 3000 nt of promoter + ATG
cttccacatggtttagagcctcttctcttccatttgctggttttctccctctcttcctcggcttttgctcgtcagttagatacaatgtctcatctttcccttgctcataaccatacacttgattagagcctccgatcgcttgcacctcatacgattccaatgagaaacccgtgtcatcctcggtcttcggggagaaattaatactcatagaccgaggttttgctccaccaagactcagctgtcgaccaaagattttaggagcttctttagcctgaacaaagtcagacccaccaaacactgatttcaccatctcaatcacactcttatcttctggaatatgtcttaaagaaccaagctccacaactccagaattcactggtacagacaacacagtctgaaaaccagctgacctagctaagaaagacctaaccctataataactcaagcagctaggcaaatctgcagcccaaagaggcttcccagacacataggttccagcaggaccgtacttattggtatcacacctaaaggaaaagtacaaagaagccagataaaacatgtcgagatcagtaagagctcctgatttcaccaaacgatgatcttcatctgaaccaacgaacgacaagtgaagcttgcgaagcacacgtcttttgatctcatcttgctgagagtaatcctcacctgaagcaccctttttgacacggcaatgaccatctccccagatcaagacacaaccatcagagctattaacgttggacgctagccagaaaagagcataatcccaatcagatccttcaacaacgtgacgtaacccttgttggagattggaatcacttggtggtgagacaagcttggacaaggcagtgttggaagctgaagctgttgagatgaaaaagtcgcaagcttcagagcctatggtggattcaaccatcgctcgatcttcttgattctcccaaaacttttgacccatttctcctgaaacgttcattgacatggaatatacaaaaattagggtatggaatcaaataaaattaaaggtatttggattgagatcgctgcttacaaatgagatagaagatgatgggtttcgtgaggaagaggaacgagaatcacgtgattcttgctgagacaccgaatttagggtttgttggtgaaaaagcaaaatcctttataaaggatataactctaatttatattgctgagaaaggaatgatcaaagagaagacaaaacctgagcttggttcacttcagatctgtagtgacttgttctgaaattgacgaagaaagaagaaaagaggaagagactatgcgagagagagaatatgggtttaatcgtaatttaataccaaggacatcatttccttcagttttttaactgcaaactatacttttgccttttcttacataccaaaccacaagtcattgtggtgtaatatctattcaactacaagtaaacccatatcactggatttttgtcgagattatgtgtacatgttgggaaattatttcgtagtacaacctattatgatgggagaatcgaaactcgtcttctgaattaacttatcgcaaatcaccgttaataagcggaaaaggaatttacacatcttacaattatgcgcaaatacaattgttaattggatgagtcatgccatattcttgagatggtatgataggtatcattacaccatgtagtcaatcacgatttttttggataatgtggtttagaagaactaatcgcgtctaatatagacaaacttattcgttcagcaaaacaacaattcgatatttttattcgattgacatgagtcttataaaatttatcactagatgtctaataaaaaaggttcaaacatttctaataattcgattttcgaccaaaataagaaactttaaattagcatcaaactatcttatatggttgtttccttgcttaaccttcttccaaatcaatttttcaaattagcatcaataagattttaaaatacatcataatgttgttccgatagtgtgtgacaacactaaccatttattcctatacaagtttatttacttgctaattcatttactgaaaatgtccatgaacaaaatacctaaaaacgaataaccataacccaaccaaatattaaagacatctccatcaagaagaaacccaaacagtttttcaaacaaaaagaatattagtattttattataattttatatatgattaaatttttattttagcgaaccaattgaaaagagaaaaatattatgatggtttgtataaagtatttcatagtttaacgagaaacattctacactctctttcttttccttttattatttttattattttaataataaaaaattaccaataaaaatggtctatcttagcttttttttcttcatttttttttccctcaaccaccattcaacaattaacataaaaaataatagttttttaagttgaagttataagagtcaatttagtttaagtcatatgctttagtaataagcatgaccgtctaatcccaaaaaatctaaaaagtacagtgccttagaaatttcctttacctcgacttccctaattttaatcttctcggtcggaacttctgaataatattagtagagatccaaaacctcacaaatttcgaccgagttttgttgaattccgattagatctttcttccacgaaacccccccaagtacccattccatcttctccggtgagtctcccatgttggcattacgctagggttcttcttctctgtggtttcgcataacccaataatccaattttctacttgggcatcaatgggtcgctctcgagggaacttccaaaatttcgaagaccctactcagaggtttgttcctaattcactactctaatttccgatttggggtttttgtggatttctcttttgtaattgccaatttgtgctgaaattgatttgaatttcaagtttctttgagtctgtgttgtgcaattgtcattgatctctagttgggacaatgagcatg

SEQ ID NO: 6584 - DNA, 3000 bp, Unknown
  misc_feature (1)..( 3000): cDNA_ID_1814986_gDNA_ID_1621098_Annot_ID_55758 3000 nt of promoter + ATG
cgaagatgtttgagagtttataggtagaaactgaaagaaaccgaaactagtgggttcgctgtaatattgcaagatgttgtcttggtggttaggtttagggtttaggagctctcgttcagctcttaactctcttgctctctgaagttgtctgaatctttcttgaagcaagacgattgaagaatggatcaccatttgttcctttcggtctcttgctattgaactcatgacgtaatgatatgagtcttagagagagtcttgctagggtttggggccatgttacgtgtgttgagcctatttatataaggaggaaaaaggtgtatattatttcttattatttaatctgcatgagaatactttaaaaacaataaaagtatatagggttgttgagtagttcgatgaaattccgaaaggaagagaatcaggagtaaagtggtaagagaacaagaggaagaaggcaaaagtgacaatctaaggattgtaaaaagagaatgtataatgtgtgagtggaaatttgcatatttttatttttatttttaagaagcaaaagaaaaaaagttggccaaagtagaaaatggttgggaggaaaatgacaagaagaatgtttgaagggaagcacatggattggtttgtttggatgattattgagatatataaacccttttttcatgccccccacttacctccctttaagggctctttttatttgaaatggaaactttattacatcccgagaatatagggtgtatataaatatatataagggatggtcttcttaaacgtttgatttgattgtatgcataacagagttgtaattcaatgataaattttcaatatgttaaatacaaaaatcttgcaaggacatgcctaaccataatatataaaagagtaatctaatcaaagatcatattcgtatgttgttatattcaagaaaacttgcatgaggttttaaatattccttggaaaaaaagtgaatatgagaaaagggagtgacaaaagggtttaggagagattttggtggcttgggagatggtgaattggagccacttctttgtctctacgtcaaatcttctcagtggaatttaaagttatattattggcattcaattaaaaatgaaacacacattaaagaagagtgtcaaaagttgttaatggtttctataaattagttgatccacttttaagttttaacttcttatgatttggcaaggaggaaaaagtatataaaaagtgggcctatctattgataaaaagacaaatggagttcaatagactagggaataatgatatcaacatatatgtatgagatgtgttttgattgataaataattgtgaaaaagaccactcatttttacacaagacattctctctcgatctcctcgttttctctcgatcaaaatgctactctacgctcccttcccataatgaaaacatccatgcatgtacattatcatatttttactaatttagggatcgaaaagattaatttataaaaaagtagaatactatatacgtatcaattaatatatgtgttcaatgcaaagccgatgcaaacttatatatttcctatcgtgataatcttatataatagatattagttgtgtttgatatatataataattgcagtacatataattcttaacacccatataatgtaaaattttctgatacaattctaaaccacatgtgtgcattttgagtttcacttcatagtcggattctgcaaactccccacattaattggtccacaaggtacaaaacttatctcacatatattcaccaatatatacaaatgtcaaatgcctttataatgtatcactcttgattgttgatattagataagaatgttgatatcattacaaatgaaatgatatattagattaaattggtaaatttattgttacacctctaacaacgaaaaaaagtgagacagtatagctacaaaacggagcgggttgaaagaaagaggaagtggacaatggggatacaaagtttgaaaggcacatcaaaagtggtgggagcaaaagtttgtcgtcaagtaattggaatataatggcatgcatacacgaaagctgaagatgctacgacgtttaggatttggacttacattgtttttcttccttttttcagcttcggtatctgcgatgttatcgataatgctctgatttggtgataaccccaattagatagatgattaacataattaagtgggatcggatgagacaaaacatatagtgtctttagattagttgagaaagattagagacaacgcgtgccatttctggtaaaaccattacaaccactccacgtaaaaagaatacattatgtttgttaaattttcacatttctaatttcttaccctccattttgtagttttactacatctctactatttatatctatttttatcctattcattctaaatttggatacttttactgttgactgaaacttgtagcctagttgttgtttcttttcacatgtactcatgtatacccaagcttaatgaaattttaaagaaaataaacaagcggtttagttttaatttaatgggccgtttctttatttcaacgaagcccaatagagcctgttgaaaaagggtttagttattgttgtttacacataagggcttgagttttatttatttcacgaaacgagtagaaacttttgttttatcaaaatcagaaccctcctcttttacagattcaggccaattctaaattcccatcgttcgttcaatttcagacgttaacctcggcttgaaggcttcaaatttctgtgaatccacgacggagattgtaagttccgatcatactcacgacgatctcattctatatgcactagaatcttttcctcctccattgattagatgatatgtttatccagaacatgatggattcaattaaggcttttattttgttgatctgaatggtactgagttatgaattgttcgagcagattggtgaattacgttagaatcagtaatcagcaaaagggttaatg

SEQ ID NO: 6585 - DNA, 3000 bp, Unknown
  misc_feature (1)..( 3000): cDNA_ID_1814975_gDNA_ID_1621098_Annot_ID_55763 3000 nt of promoter + ATG
ctgttgttattttaggaccattagctttatgatagctagataataaattaaactagattaattccaaaagtacacccaattttgtacaaatttttggaattagtataggcttcttcaacttatagttcaatcggtattagttattttttccttcctaaatgccatttaaacaaattttccaaaacttccacaaaaggttaatgaaagacacttgaaagcgtaacgcacaagagtgactcctcatttttgaaaaatgcattcccacctcagtactgctcagaggtcttccatgttcatatacaaaagcccttttgtaattccttaaattaggcattaacaatgtaaaagactcttcactctcaaatgaattttcaacctaaactatttgcagccttgatgccatttatagaccttttgtattaagatgccgaattcctttttttttaacacgagactaacaacatgttgaaacttctttccatataatgtttgtcatgacgaactctttgttacattaattaaacatctttatacataatgtcattatttgccatctgccgaacctagccaacatgtgtgtcatagggatcgtaaggggtgactagtcaacgaggtgagatatacattactgttaaatctcacctgcgagttcttcacaatgcatgatatatccatttagaattcgaataaattggtacacataataatagctagagttcgaaatatttaacaagcatcggttatcttgcacctttttgtcatcttctgagttttccggctagtcacatggttttgcttgtgttgattttttttcaaaagatgttcaatgctttgattcttgatctttcttaatacacacttgtttcgtttgctctccaaagtcgactcaaacacacgaacgcttgctcaatttttccgaattctagcaaccgaagattttttccaaaagttatccaaacgtacttataacctcttctcaaaaatgatttatattttaaaaaacagtcatcgccattcatgcatttagttttggaaaagtatctcaaatgtctaaagatatatctatatagccaaatatgtaagatattcaaattcatggtaatggcatacacaaatatatattaaaccagatatctcaatcaacaatttgttttttttttttttgcttgtcaacttcaacattttatttagatagcagtaatcatttattaatatatttaacatttcgtatggattattgttatataaaactagtgaacataacatgtacgcgtagacatacaattatttacagattaatgtacatacatacacccaactttgcagaaaatgacatttagtgatggaaacattcatcaaatttacaatcttaaaactgcaaaaaacgacaaaaatggtctacttatagtttaattaatagacacttgagaatattaattaattaaggattacataatcttttatacaatagtagtattttcctattttggtcgccgtaataaggatatacctactctatctctacggctgtctaaattaacgattgttagagtgaggacaaacacaatctttacaatctcatttatttaataggattattaatcattttagattctagttggggtgttgaacaactcaccatgctgtataattagacatcacattattttaaaattgataacactgagattgtttgccttcgaagcaatacagagtaatatgctaaatcattaaacttaggattatatataacctttgacagacaaaatttaacatgatttaattgttagtacgtcgctttggcggttgattattaatgtttaattaatcgttcgtacgtgcactagcttattcttgtttttgactacaagatcacgtattagttattgcaacaagttgatgtcttactcaattgatctaagaatagattaacggaacctattgaaatatgagagttttcataacaccgattcactggaaaaatcacgaagtagttatttcctgaacctattgttcactaaaagataaaacatgcagatttttttatagagaaaattgagtgatgattatgaaaaaatgttgtaaaagataagaatttagctcgaaaaatcagaatcatattattttgttaatgagaaaagggtctttataaagtattcttgtccaatactactatactagtccgcaagatattgcaatctctagaaattataacgagtgattatgtagcatcctagtgatcatgtaagaaaacatgttttttacatctttatgagtggaggatcgtgttgatcaaagtcatatccacagatgtcttgagccactaataacctcacatttcttcgttttgttggtacgctataaacccaaaccgacctaaatcaatcaaagatcacaatggtaaagacactgaagagtaaaacccaaggcattggcccatgaatgaatctatgtcgacaagctctgcacgtggcaccgaggtgtagaatttaaagctctaacaaccgttggatcatccaatctaacggtgtaaaacaactctttctcaaagccgttcataactctcaaagacctcatcggcacagccgtgtatcggaattaccaaaaaagccaactgtccccacgtgtcttgtgaacttcattcttctgtttgcaggggcttttttgtagtttaacctggaccccctcctgactacacctaaaagtcacggtccacatggctggtgacacagacatgcgaccaatacgcttctccttctaaaccgtcgatttaattacatccacctctagatctcgccacgtgtaacattgatttagaaaactcgtcacagtcccgtgactgaagaatcaccagataccaacagctacaagtttttaaaaaccttctctcatcctcttcctcaagcctccctcctcctctttaatctcaccagtcaccatgaaagtttagagattttttgaaagaacaaacagatatcgaattcgagttttgcaaaaatg

SEQ ID NO: 6586 - DNA, 3000 bp, Unknown
  misc_feature (1)..( 3000): cDNA_ID_1814966_gDNA_ID_1621098_Annot_ID_55767 3000 nt of promoter + ATG
acaaagaacgaagcttttctgcgatcaaacacttctccagagcacaacgctatcgttgaagataacaacaacaattaacgaaaaaatatgaaagaaaaagcaaataagcaacctacaaaaattctgcaaaacattaaaaaattatgcgataaggtcagagattctctacagatggtgtatggtaacatctaaacacttcagctgacgttgtatgcttaatctgttcagtgagaatctgacggtagatattagctatttactgaaataggaatctcaaccgtccattttactgaaggtgtacgaggtaactgtctacgtagatattgcctccaacaaaggataaagaagaaccggatatgctgggatcacgtttctgcatacgatatgacacgtttacccctagaaaatgtgtgttaggtgaagagttcggaagggtaatagttggaaattgagaatgtcgcttataagctttgcctcttctaacaaaatgtagggcctagtgcagtaatgggccttgcaaataaacggatggaaatatgaaaactaataaataaagtataggcagaagtttttttatgactgttatagagatctggagatgtaggtcttggtgtatggacagcttaggatttcaagcttaggcatttcgaaatcaagggttgaaagcaattactgtatttgagaatatatcttcaacactgcacaaaactcattttgtaatttattaaaataccggaattgagtgattaatgtcaaaaccgagaatttacaggataacaaagataattaatcaaaatgaatcttttatcaaagtaagataagttttctaacaagttttttacttatagatataaaatattatagttgtgaaaagacataaacatttttaaaagttaagattgagttttctgaagttgaaaaaaaaatcaaaattattttttaatcattatccaaaatcattacttaatccaaaccgatgcccaccctaattatttaactatattaataaggtttgtaagcaatagtatataaaaagctaaaaaaaatataagggtatctcactacgtatgacacttatcaagtttgttagagcatatggggcacatatgtgggagtatgcactttttcatgtttatttcactgcactttttcatgtttatttcactgtttcaaaacaatcaatacaattatatccttactctcgtaacctcaggtcaaatagcatggttaagaaatgcctttgacgaatgatttagctgtgcagcaatatatagtactttgaactgctctaatgggagtggattgtggattttcctttcttctgtttcttaatcttgacattagatttccactccaccccatcttcgtctagtaccttataagtcgttccagcaatgtagaaggtgactttcttctcttcaaggtacctcacaaaacgtttagcaaactcaatgggtgttgaatggcttttgtactttgataaaagactcacagcaatctcctagttaggcttgaaaatcaaagtcttgacaactcgttatgcctcatcaatcacttttcctctagccaagccgtctaaatatgtccccattatttcaatagttggttctatccatagagtcttgactatccttgcaagaagataatgcccatactcagtttgtcgagcatgtgtacaagttaccatcacgttccaaaatgttgagtgagttttgatcaaggtggaaggaatgttctcaaagacttggattgctttgaagcattcactatttgtgcctaaggttgatataaatgcattccacatacctatacatgtagctccagatttaccgcattcatgaaagagtttttctgttaagaagagtttcaaactccaactcttaagattggagagatatattagtcacatggtaactttgttaaggaaaacaaaaactcaaatatttttaaaatttgttaatcaaataattttaaaattgatttcttgtataaaagtattgtttttttgtgtattttaaattatatttttatttttattaagttattatgaatcaaatatttaagaattaaattgaattttgatttatacttatattccaatcttgtatataagttagtcagattgaaatatatggtcgaaaattggtaaaaaataatattcaccattattttggtcattaagttttgaccactttttggtaagatgttttcgaccactattctcggtcaaaaatgtcaaccgatcaaaatatttctaccatttttattggtctaaaatattcgaagcaaatgtttaattcagtataaacatgcaaccaacaatttacaaatggtcaaagaatttctaccaattttattggtcagaactcaacttgcaaccaacaatttacatcaacttcgttttggtaaaaaaaatatcgatcgaagataggtgtttttgaccaaactgatgaatgtatcaattctaatcgtaatacattttcgacatttaccacactgatgaatggtttttactgttagggtcgaacaaaaaaaaaatccaaattgatgttagctgttctgatgtctctaatttcgattaattctaccaaaacattaataacttggactacattttagttgaaatttaccccttaaaaacatccaaattgggtgatacattggtgagagagaaaccaaacctcatttaaagtcataagttataataatgcagatgaggacaaatatagattaggatatggtgttgctggtaaaggtgtgaagcgactttgcctccttggtaccttgagaaatgtaatgatgaagatgatagtgttcgtggtgaggatgatgatggtggatatagaggttatgaagctgagtgggaagaagagttattggcccataattctaaaaatatacgacagccattttgaatgatttcaactaaacatacggttagttccggtttatattcagtttcgtaaccaaagaaaaacgcaaatcccaaattttccggaa

SEQ ID NO: 6587 - DNA, 3000 bp, Unknown
  misc_feature (1)..( 3000): cDNA_ID_1814958_gDNA_ID_1621098_Annot_ID_55769 3000 nt of promoter + ATG
cgaccacacccgtcagtgttggagggatccacgagtgcttacgagacaaagcagctctcaaacggtggtctgtatctgcgaattgacatgcctggtgtccctagcgacggcttcattgtggcagtggacggcaatggtgtcgtcaccatcatgggacgagctcctgcgactatgcacgactcaagtgggcgtagttacgtatgcaaggtcgccattgtccctagaggctatgctggcgtcggatcaagataatcgccaaacatggtgtcatccgtctcactatccctccctactaattaatgaatcggctcttaattaagatcatgcttttggaattaatcatcatgtttaaaacaatattgggacatgcatatgtttgtctttttcttttggattcccgaatatttcaagaacactaattaaatggactttaatacatatgtacgtataagacgtgtatgaaaatattcactcgtatgttttttttttgtcgcactcgtatgtttttaatcttcgtctaatgcatggttaaaatgaaaataaaataaaaaatgatgcactagaaaatgtcagcaaatgaaaatagaacacgtgtcagtctagagactgtttgtcgtttctcacctgacaccgccatactctcaccttcatttactttatgaaagcttcgcttcattaaacatctaaaaaccctagaaccagagagagacagagagagattgagagatctcaaaaagcaaaagaaaaaaacccaaaccgaaatcttcggccgccgaatcatcatcatgcctatccgccgccgagtcagaatcaacatccctaccagcccccgaatgatcacgcctatcacgcccatagctccggcgcctcacgctcatagtaacgatctttaaacccaaagtttacaattacttcaccatttcttaaaaatcttagatttttctccactgatatgcatacatttctggttttttggtgtatatgtgtagatggtttttacgctatgaacaatccgtaccaagcgaacggaccaaaagggtttgctgagttcaagtatctggaagatacccatgatctattcgtgaggcttgatttgcctggagtcaagaaagagactgtggttacccacttacccttctcgaaccatccaaaaaagctgttactgtgaccggagacgcagctaagagcagcaaacacgatgcttctaaccgcaagtatggaacctccgtgggactactctgtgactgctgtgaaatcagtaacaacattcatacctttgttgaagatggtgttgttagactcatcctctccaagaagaagatctatcctcatgctcctaatttctgttcttgtaaattcatttttttttttgggtaaaattacttctgacattttgaaagataataatttattcaagacatttttgttgttgtattgttttcagttggaggtgcaacaatccctactggtgatgctcctggttaagtctctatccatttaatcttttgattatttgttcttaacttcttatacgtcattatctatggtttgtttatattaatgatgtgttttatatcttctattattttccggttaatagatcagagatatttgatatttcttatcatttgagattcttttagaaattagtcttggttgttttatttagtaacgtgtatatatatatctgacattttttcatgggtttattgtgtttgattccaattggtgcagttgcagatggcactccttatggtatgtaacatcaacttttgactaatcctttttagtttttaccatttttttttctttttcctttgacatgttttctaaaatcttcttctttttaattttgtagtgaatctcttagctcattttcgtggacttatcccaaaaggtatatatatatttgatttgatatttttaccactccataaaactttgtggttgattaattaactaatctacttcattatttgtttcatcataggtcgccgttgcactgaccctggtggtatgaacttaatctctccactgtaacataatttcccaatatattagtttcattatagtatgtttatatcacatgcatgatttctataaatagattcctctatactgaaacaaaagacttaattaagggaggcttaatggtatatgttttgttgcttcacgttggacagatccagcgttcactggtccggtcgtactaccacacccgtcagtgttggagggacccatgatgccttacgagacaaagcagctctcaaacggtggtctgtatatgcgtgttgacatgcctggtgtccctagcgagaagttcatggtggcagtggacggcgatggtgtcgtcaccatcatgggacgagctcctgtgaccatgcacgacacgagtgggcgtacttacgtagccaaggtcgccaatgtccctagaggctatgacgggggtcggatcaaattggtccccaagcatggtgtcatccgtctcactatcccttccaactaatttataaatcgcatcttaagatcatgcttatgcatggagcatatctatctgtttgtcttttcttttggatttccgaatgtttcaacaactttaatatgtacctaattaagacgtttcactcgtatgtttatgcatgttaattatgcttaattttgtcaccatctaatgcatatggttaatagtcctggtaaaacgaatttgctacttcactattagtactgtaattgatttcaagagagattgactcaaagtctagagtggcgcgatacagctcaactaatacgtgtgcttctagattgctccaaaaaatagaacacgtgtcagtatagagtttttgtcgtatttcaccataatactctcttcctcactctctcattcatttgctttacagctttcgcttcataaaacctccaagaaccctaaagacacagagagagagatctcaaaaagcattaaaaaaaaaccctaacgaaatcttcagccgcctaatcatg

SEQ ID NO: 6588 - DNA, 3000 bp, Unknown
  misc_feature (1)..( 3000): cDNA_ID_1814954_gDNA_ID_1621098_Annot_ID_55770 3000 nt of promoter + ATG
tgagaattgacataagtcacagtaaggtgtaactcacctatctcagaatttgaatctatccacctgggagcggtagaatagaagattgttccttcactatcaagctgcagcacccacctgaaccaaaaaaaaaacgattcttcatatcatactggtaaaacaggtcaagtcttgagccctctgccaaggccttttaggtggaatgcatgataatgcatcaccaaaaaagaaaagtgtactttttcgttgtagagtactaactactaatatgtgaagatatatgcagttcaaacacctaaaaacgaaaagaagaaagccagtaaaggatacagtaccatgatataatagcatgaacactacccgtggtttttgcttctatgtgcacatcaagctctccattactttctggccgtttccaaaagtcaaattcaaatattttgacgggctctgacaactggatgaatatatgaattgagtttataaactaaagctcattgcaaaactgtagggagaagttcaggatactagtaccagtttgatctctttctcaatagcatcaacatgcatgctatactgttgtgacttgataccaaatagactctctaatccaggaggaactagacgaacaccatcggatgttttagcctcgttatttcgtagatcttgcaagttacataagaatgtgctttcaacaagcttgaaaatattgtaaagacagagcaaagggaaacaatgtgagaatgaattcaatcaagctaaagaatgaccaaaattcgattagactaaataacgaacctggcaataagtagtagctcgatatggcactgttttgggattatcaaccagcaacatgtcatgagcgtgttgtaaacttgggattagaccttcaccaagtaactcagagtccaatatttcactaacctaatgaagaagagagacacacttatggttatttccttctgaaaaattaactacaaagtatagatctttgtatactcacaagaacgtcagctcgtgaagcaatgtcttctgatccaactttgagttcatcggatcgtttgttgataaggttaatgttcttagtcattccattcttatgcataaccttcctcataagcttaaccatcggtaagtaagactcacacgccgtcaccattccttttgaatcacctctcattgctctcacagccatcattgatagcaacccagttccagcactatacacacaaattccacattctcctttatcaaaatctgagtgtttaaaccaagaattgaatcaagtttatggaaatgactcaatgagaagacgaacccaatgtccaggacgtggcaaggttcagtgatggttttctcgatagcgagacgataagctatgttacggcgagaatcattgagcatgtcgagatacgacgtcgtcgcgagtaggccgtcagtggaagttccgggttggtcattgtcctcaatgacaatccattcggaatttccggtgagagggtcttgtctgagctggaagacgcgttgactagactgagagctcatggttcgagcagtgacggaccttcttaggcgagtcactgagtggcaatggaaggaggagataaatgttttgggaggaagagaagacagaggcgacattaacggaggagagcttttaaggtttttattagtcgtgagaagaaactttccggcgattgtttatgtttattgtttatttaggccctcatcattttctttttattgcaaatgaaccccagactttcgaaattttaaatacaagtaaaacaatcccaactgccaactcttttgtgatgccaaataggccaaacactattattactaaatcagagataatagaatttcaactttcccatatacctttgttggaacaatataccaaaaatatttaaactactctacaaatgtcatagaatcaccttatagcataattattgtgatctaatattaaaataaagaatgaaaactttaacgaaaataaactaaagctcttgatgtataatattcgttgaaaatatctacatatattacaattgaaaaacaaataaggacttatacacatattaaaaaatatttatataaaataaaatacaaaaaaaaaattgattatacggtacatttatatttaagagtaatcaaataataaaataaatattacaaaaatttgagaaatacaaaataccaaatcctggaagcccttctatcaattatacttatattaaaacaaaattaatctacaaaaaggacaaatcaaatatagatttttttcgtcagttagaatggttattcggtggtgtagcgcaaattttccatatttttgaaaattaatacaagtaaagactatactaaatcggaacgtatatgagttaagggtttaacttagcaataaaaatatttgtggggttaaaatgaaagatccaaatatttagtttcggagaaaaaaagaggcttttggccggagaagacaactttcccatttccacaacttggaaatcgaaatccatttcgaattttggttagcagcgatttcaaattccaaacgtaagaattatggcgggagtgaatcaggcgtgtatcttctgtgagatcgtgcgaaatccaaccactactcgtctccttcacaccgttatcttcttcttcccttctcttgtttgtttggttcatcatcagaggctaaattgaacaagttttcttacgtctgcgattatctttttttcaggatgagaaagtcatcgcctttcaagacatcaagcctgcagcccagaggtttgtgtctctgttcactcactttgctctatcgagttttgtgaattgagtttgattccgtttacttaagcttgtccattgtaatcaatttgcatctccttgcttacttagctatcatttactggtatttatgaacaaagcactgatgatgtaggcactatttggtgattccaaaagaacatattcctactgtgaatgaccttcagagaagagatg

SEQ ID NO: 6589 - DNA, 3000 bp, Unknown
  misc_feature (1)..( 3000): cDNA_ID_1814950_gDNA_ID_1621098_Annot_ID_55771 3000 nt of promoter + ATG
caagaatctcaattattgcaattccctactcatttagaacataacaccattaagaagttttgttgctttgttatctcatatacttgacttcttctagtggttcctatcaaacgtccccagaatgttataccataacaaatctcagaaaaaactatcttagaaactgtattcccgcatccaaatcatcactcaaagaagctaaaggcagtgcaactgcaagctgtacttctatctaactacacaagttgcatgtgaagtgtgaacagagaagatttggtctcaatggcatctagtacttagataagctcaggtttttagttatgatcacccaaaagtcttatccatgctattgatacctaaggatccccctacaagggaaaacgagtaatctgaaccgcctgagtataggcgatagtctgaaacttaatgctagattttcaatctcttttgttcccctaatcacagtgcttaatacctcctaaaatttgttagcatgacctatactgtttccacctcacacgatcacaacacagaaaggtcactactaacgtacaagttcattcaagacgtgtttacctgttatgtggataactatgatgtcgcaagaacacatctgcaccagttaagctggaataggatgatgatgatgatctcatgcactgcaaccagtacaaacccctacattttagagatgacatagcatcaaagcaacacaagaaggcccacatataccagagatcctttatggaagtaaggggtctaaatctctgattaagtctaaatttcatggcaattattccagagcttatatcagaatccttcatgtatacgtctcatacccataaagcatggaaacaatgagattggtgttaagtgttaactattggacaatggcagaaattacatataattacttgacacatccttctttcatatacaaaatctctaataatatttggcatttgttcacagatttgccagcaaaagaatagaaaagagatattgcacagttttagcaaagagaagcaacgcaatgcggttaaacaagttgggttcagttacacctttgaaagaagaggccttatcttctctagcagtgtctcggcttcaataaatccacccaaaggtcccaaagacttgtacttgatggctttccatctgttttgatgacaatattgataacaaagcttattatctcacagttttcaagccatgggaaagtaagagagagacgcaaagaatttcccaaaaaagatcaacgagtatgaagcatatatatacctgggcacataaggcaatgcaaaacagtggagatggagatgatcaacactgttaaatggtggctggtgaaaaccaaatctgtgagaagaaagtacaaatcaggttaatgctacagaagtcaccaaaaggagccttacttactccaaattcataattgatttcattgagtgtatgtaaccaagaaagctcacctatgaatgctttgaggagcatctttctgcaacagttgttgtcccacactaagcatgtgtcttactgctcaaatcataaaacaaacatcctcatcgaaactttacataggcacaacagaaaatgaagtataaaaatgtttagataaccaaccaagtgagtagtcttcatctcttctctgaaggtcattcacagtaggaatatgttcttttggaatcaccaaatagtgcctacatcatcagtgctttgttcataaataccagtaaatgatagctaagtaagcaaggagatgcaaattgattacaatggacaagcttaagtaaacggaatcaaactcaattcacaaaactcgatagagcaaagtgagtgaacagagacacaaacctctgggctgcaggcttgatgtcttgaaaggcgatgactttctcatcctgaaaaaaagataatcgcagacgtaagaaaacttgttcaatttagcctctgatgatgaaccaaacaaacaagagaagggaagaagaagataacggtgtgaaggagacgagtagtggttggatttcgcacgatctcacagaagatacacgcctgattcactcccgccataattcttacgtttggaatttgaaatcgctgctaaccaaaattcgaaatggatttcgatttccaagttgtggaaatgggaaagttgtcttctccggccaaaagcctctttttttctccgaaactaaatatttggatctttcattttaaccccacaaatatttttattgctaagttaaacccttaactcatatacgttccgatttagtatagtctttacttgtattaattttcaaaaatatggaaaatttgcgctacaccaccgaataaccattctaactgacgaaaaaaatctatatttgatttgtcctttttgtagattaattttgttttaatataagtataattgatagaagggcttccaggatttggtattttgtatttctcaaatttttgtaatatttattttattatttgattactcttaaatataaatgtaccgtataatcaattttttttttgtattttattttatataaatattttttaatatgtgtataagtccttatttgtttttcaattgtaatatatgtagatattttcaacgaatattatacatcaagagctttagtttattttcgttaaagttttcattctttattttaatattagatcacaataattatgctataaggtgattctatgacatttgtagagtagtttaaatatttttggtatattgttccaacaaaggtatatgggaaagttgaaattctattatctctgatttagtaataatagtgtttggcctatttggcatcacaaaagagttggcagttgggattgttttacttgtatttaaaatttcgaaagtctggggttcatttgcaataaaaagaaaatgatgagggcctaaataaacaataaacataaacaatcgccggaaagtttcttctcacgactaataaaaaccttaaaagctctcctccgtta

SEQ ID NO: 6590 - DNA, 3000 bp, Unknown
  misc_feature (1)..( 3000): cDNA_ID_1843013_gDNA_ID_1621098_Annot_ID_55773 3000 nt of promoter + ATG
ctgaataacgaactaaacatgttatggattaggccctaatagctagtccagttaggattttaagattttccgatgtatattaagtgtcaatgtgtcatacatgagcctctaataaacacacgcccaaaatcaatagaactaactaaccctatacaccgaagtaatatagaaccagcacgaactctagatctggaaaatataaatacaaaatatcttttaaaatgttttctaaatattattgtaattatcatatgaaaaaaaaactattcataaaaagtaattatcaacatatgtaatctttcaaagatgcacttgatgtgtgtatcttgttggttagaattttaatttattaatcgataacttggaaggcaaataacagtaaaaataataatctaactgtagtaaatatctccccacacgtcattttttttatttttttttattttttattttggcaactcacatggtttgattcattgataagtcagtttcaattttatttttctcaaatttaaataattctccatttctaaaaataaaggggcaaggtattggtacgcacatgagactaacattcatacctttttatgaaataaataaaacaaaaagggacacaagaaggaacgcaagaattttaaactgaaatgattgtatctctaaattgagaaaaatcccaaaaagaattagtaacaaattaaataactaagcggtgttgttttattcggaggtaaaatatatatatggagggtatagcgtcaactcgcttttttactacattttgatttctctcccaaagttctttaatttttgtttgggtatcacatttgtagtcagaaacaaaattgttgaatgaattatcgacgactattttcactcgttggaatagtcgggattcaatttattaaaccgtcgtaaggaagctaaagatgtaaaaatgatgatatacagacaatttggctagctcattcactttttaaatgggcaaaccaatcatgaatgctagtttaatttatcgtgtgattgattttttttttatataaaaaaatagaagtaaaattgtaactttttatgaaaaccgtcgtaatcgtacgtcactaagctacaaaaatacaacaaacagtgactaataagaaaatgtagagtgatattagatgaatttaacacgtggaaaaatcatgaggaggagatgattttttctgttgcattcccttctgtggttaccagctacgataacgttcacgccctcctccacttaaattagaatgtgagaaaataaaatagcaagaaattggagatcacaacagtattgagtgtaggacatattacaaaggagacaaaatcagtcaatagtaaaaaggtatcacaataaaaaaaaatgtcaataaaaaggggccattgtatgacatgaaagaacaaaattaagtgatcatcacttctcctcctttatcgagagcttcagttttagagcaacaatgtctctatttctgaagcccttcctcttcctatacgacaccactcttagtcttctcttacttctggtactttatagctcgatctctctatatataaatacttaaataattactgtgacattaagttaattgttatttctcatgcatgaattagttcaatggatggagtcttgaggatacagcagcagcccaaaagaggcgtgaagcagacaaaaatgctgcagaaactgaatggatccaactccaatacttgtggaccaaaacaaggagtgttgtactacttcccgttttcaagggtttggtggttatgtgtttggttctatccattatagtgttcttcgagagtttttacatgaactttgtgatactcttcgtcaagttatttaaacgtaaaccccataaagtgtacaaatgggaggccatgcaagaagatgttgaggttggacccgataactacccaatggttcttatccaaataccaatgtacaatgaaaaagaggtatacgcatatatatactacctttattaattacactcttttattatatggttgatttagtagttcaagttgtagatgattttacggatccggccgtaagggtaagtagcttgttcgaattccttttttttcttatttattaattagatattacaaaaaaaaaactaaacaattcatacaacatgttaaaaacaatggacaaaccaatctaaagttcaaaacgcattggttaaatatttattcaaccgattttttgacctagaccgctctaattacttggttaagaacatcagactaatatatttttaaaatttaaatttatttaataaataaccacaaaagtggaaaaatattttgaagatacgaatatataaaaataacatcatgttttattttaatttgaaaatagaaaatatattgaaacatacataatttctgtaactatcatatatattttattaattaaacaaaaataaaataatatgaaaatgtttccgaaattttttgtttaattagttaggtgttagacttagacccccttcaagcgcttgattagtgcctaatttttttgcacaaactttattttgtgtttcttatcttttattggagaaacaaacaatataattgtttgcttaattttttcttttataatacttttaactattaaatttaaaatttgtttgaggtttaaatagttctccttatatatagaatttccgataataaatagtatagtgtgtaacacttttctcacaattttttcacctaagatgtttatctttttcctataattgaatcttcttttgatttacaaatcaaagatatatcacaaaattttgatatagacgggacttctatatcgatccatcacatattagaatgcaaacattgtaatttgtatatatagtatgatgaatgtgaaagtgtaagcaggaaggtgtggacgtagagattgcaaaatggcaaagccaaggcataaacataaggtgtgaaaggagagataacaggaacggctacaaagccggagct

SEQ ID NO: 6591 - DNA, 3000 bp, Unknown
  misc_feature (1)..( 3000): cDNA_ID_1814935_gDNA_ID_1621098_Annot_ID_55776 3000 nt of promoter + ATG
ttcgagcttgtgaaactctcggatacaagaaacctactccgattcaggtccaattcatcccacaagagtgttctaattcagttactaattagagtttttatctgaatcgcttgtgttgcacaatgcaggcagcttgtatacctttagcacttacagggcgtgatctttgtgccagtgccatcactgggtcagggaaggtgagtactagattgatggttttgtgtaatactgagattttgtttaggtatttaactaatgtatagagtttttgattatgattatttcaatttaccttgttgtaatagactgctgcattcgctttacctactcttgagaggttgctgttccgtcccaagcgggtctttgctactagagttcttattctcactccgactagggagttggccgtccagtaagtagcattactttgcctcccataacaataataaactttcaagtccttttgattcttgttgctgaaaaagctgatttgtttctttggaatggttgcaggattcacagtatgattcagaatcttgcacagtttactgatatcaagtgtggattgattgtaggagggctttctgtaagggtatgtatttatctttctctaaggatgtatttgtctgtgtacactatttgatgtttgagaacaagcttattttctctctgagaatcgtttcttaaaatgggaatagcaagattgctaaaatctttaatgtttcttgtgtaaggagcaagaggtggttctgaggtctatgccagatattgttgtggcgactcctggacgtatgatagatcatttgcgtaattctatgtctgttgatttggatgatctagcggttttaatccttgatgaggcagaccgccttctacagactgggtttgccactgaaatcacagagctggtatctttctgatttctttgcgtttatctctttcgtacggtcggttcctgtgacacctagtattgaattgtagtcaataacttcttgtctttgttagtttctaatctgaagaagtggacactatataatttgacttaacaggagagattatgttatgctgttcgttatttgatttatatttgagtccacatctatatgcaggttcgcttatgtcccaagagaaggcaaacaatgctcttctcagccacaatgactgaagaagttaaagagctagtcaaactttccttgaacaaaccgttgcggctctcagctgatccatcagctagaaggccaccaggcttgactgaggagtatgtcagccactacttatcattttcaaccttttcaagagccaaaatatttatccacaaatagcttatgaatatacatcatgtatgccaattagctaactcgtgatctcctaactgtagggtggtaagaatacgcaggactcgtgaggcaaatcaggaagctgttcttctatcattgtgcacaaggacttttaaatcaaaagtcattatctttaggttagaagccactataaatatgatgcctttcaaatccaagttccataaagtgcttgcatagtttggcattttgtatttcagctgagagaattttttgtcccttcttgcgccagtggaacaaaacaagctgcacatagactgaaaattttattcggattagctggcctcaaagcagctgagcttcatggaaacctaactcaagcacaacgtcttgatgtaagaaacttgggcacatcagctttatttgtacatgaatatttctgttctctgtttgcaagtacttaatggtatcattttgcagtctctggagcttttcagaaagcaggaggtcgattttctcattgctaccgatgtagccgctcgagtaagtataagaagcaaaaaacttattttcaagattctcttctcagtagctctgctatttaacctcttgaacactgtctgctttgatcattccagggacttgacatcattggtgttcaaacagttataaattatgcttgtcctcgggaaatagacaggtaaacaagatatatttcctgtattatgattaaattaaaaagctactagttttgttctctttaactgatgtgaggacaatatgttttcctttgattttgcagttatgttcacagagttggtagaacagctagggctggaagggaaggttatgctgtaacgtttgtgactgatagtgaccgatcccttttgaaagtcattgtaagtgaatcatcagacatacatggatcttgcttttacccaattcattatcgctttgtttagacatttgaatcgactttgtttctttgtttaaaggcaaagaaggtgggttcaaagttgaagagccgagtcatcccagagcagtcaatcgtcaagtggtctcagataatcgatgaaatggaagatcaatattccgctgttatttcagcagagaggtttcattcacactcatcaaagaattatggtatcccaggagaattggttgatctgtatacttaagctttgaggtgttttcatcaatttcagggatgagcgagctctaaggaaagctgaaatggaatttgcaaaggtaggcagctttggttcttgtctttgttcaattattgtgggaataatttcaaattcgtgattatgggcttgtttctgcaggcggagaacatgcttgagcacagagatgaaatatatgcacgcccaaaaaggacttggttcatgacagagaaggagaagaagctcgtggcacaggctgaaaaggtgttcttttaatttcctgaggttgttgttgtagagagagggatacacttgtctgaatcattctttatactttctctgaataggattctgcagggaaccctgctggaggcgaactagttagtgctgatagagcagaggacctcaagatgaaggagaagagaaaacgtgaacgcgaggtctgtttatcaagaagctcttcactattcagttgcattatcgttctagtttagtgttgattgcttcttcctagagaacttacaattctcttgaccatg

SEQ ID NO: 6592 - DNA, 3000 bp, Unknown
  misc_feature (1)..( 3000): cDNA_ID_1814931_gDNA_ID_1621098_Annot_ID_55777 3000 nt of promoter + ATG
aaatattcacgtagtcatatacatgatacggtgatcacaaatcgaattgaatcgtgtagttaattgtcgtattatataacaagtaaggaattattacaaatgtactaggtaatcacccgcgctacgttgcggtattttcaaatttttttatcgtttaatttaaatataatttttaattatctaatcatttacttatataataagtaattattcttagtattaaaatatattttttttaacaacattctcaacaatgcattatacacacaattcctaaacaatgttcgtcttaaactaattaaatagagggtaatattgggattctcgaaacctaagaatttgatgattaaacttcttacatactcttcaccctcgacgatttattatatatatatatatatatatatatatatatataataatatgcaaactattcaaactattaattaatccatgactactatacactcataatttgagttaagattacagaaaaaaatcttttgagtatgagaaaaccaatcaaattattttattgaaaaacatttaataacaaaataaatttagtattagtataattaaatatgtaaaattaaataataaatacatcattaatctataaattaaaagttgaagagcttacattaattattcagtggacacatggcaaatgttaaagtgatgatgtgtcaatcatatggagagagttggccaactttcatatatatgattcttaaacctgtaaaagttcagttcacccgacgaaccaacttccaagtagtagtccaaatcatagattcttttgaggttttaaatgtaccctcacgtcagaatctacttaagtctttcccctttttctgtctctctttcaccttttcttctccatcgatcttacctccacggaacttcttatttaaatcaaaaaaattcagaatcttttaatctcacgcaggcaaatgtctcgtaatttaatctatagaagaaacagagctctctgttttgttttaatcttgttctgcttcccttaccggtttggcgctagaaacacgccggaggcggaacaatccacagcaaaagcaactcaaataatacacgtcagcaattccacgtggcatgatttctctcgtcttgtagatgtccaaataggtagccacgtcagcggcgtatcagagctcaaaagatacctccaccgattcggttacgtcaatgatggctccgaaatattttccgacgtgttcgatggtcctctggaatcggcaatctctctgtatcaagaaaatctcggtttaccaataaccggaagactcgacacgagtacagttactctcatgtcgttaccgcgatgtggcgttagcgatacgcacatgaccatcaacaacgatttcctccacacaacggcgcattatacgtatttcaacggtaaaccgaaatggaaccgtgatacgctaacctacgctatctccaaaactcacaaactcgattacttgacgtcagaagacgtcaaaaccgttttccggcgagctttttcacagtggtcaagcgtgattccggtgagtttcgaggaagtcgacgatttcacgacggctgatttaaagatcggattctacgctggtgatcacggtgacgggcttccgtttgacggtgtacttggaactttagcacacgcttttgcgccggagaacgggaggcttcacctcgacgcggcggagacgtggatcgtcgacgatgacttgaaaggatcttcagaggtggccgttgacttggagtctgtggcgactcacgagatcggtcacttgttgggattaggacatagctcgcaggagtcggcggttatgtatccgagtctccgaccgaggaccaagaaagttgaccttacggttgatgacgtggcaggtgtacttaagctatatggtccgaatcctaaactacggttggattcactaacgcagtcggaagattctattaaaaacggcaccgtatcacatagattcttgtcggggaattttatcggttatgttctgttggttgttggtttgattcttttcctataggtttataggcataaaaaatactgtttttattcatttatttttaattaaatgtacatatatttttcaactatgtaaatgtaaatatatagttgaacaaaaaaagatgtacatatatagttaggcttataattaggtttatggtcttgatgatagcttcctctaagggattattattctttgattcattactttttgagtttgtgtatatcattatctcaaaaaattgaaagatattgatgtttatggaactatacatgattggtcccacccctaatggcactaatgactaattcataggtgatagattactttatatatgtgctccaagtaaatactgtttttttcccaatccaaactagattgaggaaaaaatgtagataaaatatctgatctactttcttaagatcctaccttcatttctttttcatagtaatcttttctccatatttacaagctatatacattagtttcttgttcagacaaaaaagaaagaatataattccattagaaaaaaaaattcattaaacagaatcttattttagttaagaaaacagaaaactgttttaagtttttttggctaaatatgtacacattatacaaaccttttttgaaagaaaataacatcttggtgttttgtatcatcattttttctttaacatcattatacaaagttacaacaacttgaaaaaattaattatataagcccattaaatcttgtatcataagcccagcccaaagttataaacttttcaaaatgcaaggagctaaaaaacaagttggttttgttggtttcaaatcaaaccaaaccgtttttttaagattacgaatcgaatggtttatttttgctaaatcggttcggttttttctccagacctattagtaaacctcttgcttcgattaggcggtcgtctctctgaaattttctgaaacctcttaaaccctagcaatg

SEQ ID NO: 6593 - DNA, 3000 bp, Unknown
  misc_feature (1)..( 3000): cDNA_ID_1814927_gDNA_ID_1621098_Annot_ID_55779 3000 nt of promoter + ATG
tactagttcagattcttcgttattgggaaagtttgtctgaagaagaaatccttagaatcatggagagggttacgtgtgagaggagacaactaacagaagagtctcctgttgaacaagatagggaggttgaaccaaaaggataaacaattctaccaattagcttcaattatttaattagttttgtagattagtcctatcgtattcaaactctcttaagcataccattgttttcttcgttggaggctgcctatgtttatctactattattaaaaactatagatacgtcacataagaaataaacagatgtaataagattaaccaactagatgaattacctttggttgttgaaagggagataaattataactgatggtgatgtaatgcattcggagaaattctgagagagacatggacaatggcactagaggtgtcccaacaaattatatttccacacattattattcgattagggttccaaattccaaccacttgttttttttatccatattgatttattcatataaaacatatcattatcgtattttatagcgataaaaacatgtggatacttttaaagaagataaaaagattaaaataaaacgttattcagtatatttcgtaattctttgtagtactagggacttacctggacgggatcaactcgtgatcaataagacaagtggcctaggctagtgatcgcattgcacatatcgtttgggtgctatgcttaaggttttcctttaaggaagagtatgtgtcattatttgtgacagaggagatttgcattcgcgcaatgctactgattttcaattttccactcttgtcacgagtactgttgagagttaaaaggttcattgtcaagaacataatcggcattttagtcttttggactcaacatttgcattaattgtattcaatatagatggaccatggaggcgtgaatattgttctaactgctaaggacatcatatctcgatatactagcttgaccaaatggttgagctctttacatactcttcctcaatcactcgtaaaattgaacaaaaaaatttcaaatcccccgtttcaaggaaattatttaatattctttcatccttatttcaaactcactatataaattaaaatattgcttatttataagctcattatacaaattccatatagattctcgtccctttgattaataaacgtcaactaattaacggtaataacttattatatagtaccttacaaatctctagattggtggtccaacggtatttggatcaacaccattgaaataatttagtttattgccgatttaaagtagattaattatcctaatgacaaatatgattttttttttcttctttttgtcatcacaaatatgaattggtatcctcattggcctgattaacatttctaattacggatcttacctcttcgtgccaaagaagacatttggaaatatatgacccccataaaccaaatatatgtttcttattaatgttgtggaatttgggacattttttaaaatggacaaaagaagacagaaacaattttcctacccaaaatggcgtccttaattttttcattaaattgtaaagcctgtttcaaaagaaaattgactttttgttgtgatagtataaaaaatgacatttgactttttaagtgacaccaagattctgacaataacgaattatatccatgctaattaattgatagcttaattaacaattgcgcaacataacgtgatcaaattaattaagctacatatcaggccttgatccgtggtccaaataatcatcctactaaagaaaaccagcttgttatagtaaaaagccgaattcgtgtaaaaatcggtttaaaatattcggtatagactctaatctcgatttactccggtttggttatcgtgtgtgtgatcgtaacttgccggtggatttgcgacggacacgtgggatgttgtaattgtctcacgtgactcatcgtaactacctttaaattcgctactgtgattttccagattcttatgtacatttgtgacttcttcggtctatttttgttatgtttccaaaaagacatgaatgaagaaacattattacagtttcttttcttcccttaagcctatttaaaattgatatttctaaattcgaactatttattcactagtcgaagccttttaacgcaaatctgagctcttaagtggcgcaaaaaccggtttaatatgtaaatagtaactcggtttagattaatttcgggttatttttgtgattagtgtagttaactaattaattcaggtgaataattatattagagagaaataaatttcaggacaaaaaggcaaagctttggtactgtctcttctcttctccgtcttcttcaccatttcgaaaaatctcaaaactttacagagagaaagagagatcctttacatatacttcactgtcttcttgaaaaccctaatcctccgatctgtttaacctccgatcaagagagatttcttcagcttgtgtgtatcagattcctttggattccccgattcttcgtcgtatcgaatcgggggatggcatttccgtgaaatcagtgatgaaattggaggtgagaagaagttatttctatctatgggcgtagtagctgaggtttggaggtcgagcgtgaggctattaacgaactcgcctcagcttaacggtggctctcacaagagtgcgttatggaagtggcgatttttctctgctcagcccaaaagaaccgtaatgtggacatgggtttgtggtttcatgcttttctctttaggagtcatctcacttttcactggtcacgttgtctcgcaccttgagtggtattctcagcaattaagcaaacggagcttactggtaccttttagcttacttagtgtttcgtttgttacttcttctgctcaattttgtaaccaagtagtgaaattggatgttattcttcaggatatgagccgtcgagaaccaattgatgtatggaagtcaaaatattcgaagtttttct

SEQ ID NO: 6594 - DNA, 3000 bp, Unknown
  misc_feature (1)..( 3000): cDNA_ID_1814923_gDNA_ID_1621098_Annot_ID_55781 3000 nt of promoter + ATG
tcgttgaagctgtgctaacacttgacacaacagctcacgtacacacccaattcaatccaaacaaataaaatacaattccgaaaacataagttttatttgtatatatcgtaagaaccaatattaaactgaaacataacttttcttgtaaatcattcaagttcaaaatatatcttacttaaaataagcagatatatatgttaaacttatgaaccaaacatatactgcctataaaaatttaaacaacccatcctattattgtgaattctatgaagtaaattcggattaaaacatcccatcgcaataaaccaaaaatgtaaacacaaaaagaaaagcatctctagtatatttagagacccacgtacagtacttgatctactggagcattcatcgtatgttataggtgactgctaaactaaagagaagaattatttttcttctagtcccaccacatattggatcaaagaagtagaaagttttctcctacatattatagtagaatgaaaaattactctgaattcttctcttctattcttataccagtcacacccatagattttatggtaaacgagatcactcctatatcagctcctagtaaataacaaagaagttttcagtactgaattatatcaatctttatcgtgaatgtttccgtacgtatggtatttgtccttttttcaaaataagaattatgagcttgttgattgattattcaaggatgaacttatgaaatatccttttgccagagcttggttaatcccaaaacatttcgtattgtagttctaaaaaggtaaaagaggaatgaaaattataattgggtagtaaagtttggtgggacttgcaagtttcattcaataaggtttcgtttattatgaatgcaccgccatattgtgaaagtgaaaatgacgttgcaccaaactaaacaattaattccccctcatgcaagatattgatcctcttcaagtttttcttctttggtacggtgaccttcctcaatgacaatgagtcaataacaaaaagaaaaactttgcgtttcatttactaatttattttccaattttagtttaatagatatatcatgccaaaacgttgggaatgtatatttttcatacgtgcgtaatttttattcttccggttaagtattcccaaactttaacaacaaattccgttttcatgttttacacaaaactattgtaaagttgattaaccacattagctatatgactaaattattatttttggttcagttgactaagaaaatagaaactgtctaacctatgatgggaccagacaacagtatctcatagcattattgaagtttggttagttttcattaaatgaaaagaatatatatgcaggttatcttctagtcccaaagtgacaatgacttgtcttgtttggaattggactgattaaagataaatacaaaaatatttactatatgaggatacataatgtgtaagtttataacaactgccaatataactatcaaaatatcatacaaaagcatgatcgcaaattaaaaatggtacgtaacatgtaagaaaacgaattagccaccagttgatagtagtctcatttgacatctattgttctattagaagttaaaaaaaaaaaaaaaaaactatatgaaaggtaaaccattcccaatataacgtaataaacataaccatcgagtatcaaccaaaatcatgaccacaatatgtcaagatgaaagtctattagttatttgtatgttagcttaagtgaaaaaagtggatgtgggtgagtgagcggttacaatcgatgatgaatgagtaaccgtacgaattgatattgtcaactatcaaacgttaaattttcaactcaataattaatcaacatttgatattcgtgaagtaacttttcacaaaaagtactctttgataagatgatttatgtccataaaactaattgcttcaactacattattgtcaatatttgatatcaatcaattctctatgcttccatgtgcaagtcttatcgatgtgattgaaatttaacttatggtgtaatctttttgtaacaatcgtttctatttcatattttaaatgtgaaatttatcaaataggaatcatactagaaggtctcatatatattgaaccgaataaataatatttaatcatttttatgatatatatcaatcgcttaaatccgcaactaacaactttatttacaggtagatgtctatcatttacacaaatttttgtcttgtttgcggttcgatctcctgcctagcaaggattccgatgagataagaaggcaatctttatcgcataacgtttatggtaatttaatatgtcatcacaacattatctacgatctgaaatcgacatagtatctctgaacctctgtaaataccacgtattaatttttttttaatattaaccttcgtagaaatcacgttgatcgtttatataaaaatataaatgaacaaaaatttcttgacaaagatataattttaataaaatgtttgtacatatatataagtctgtataggaaacaacatatgaagacatgaagataataatgtagaggtagttataattttttgtgtcttaagtcttcaccaactcatggtgaaaggttcacaatataagttgatcgatcggagttcgagttattctactaaatatggcttcaataaaaatttggttactctaaatagtttcaatgggaaaaatatgtaacaataattttcacaaacctcaagattgattttctaattattaaaataaagtacaccatcaaaaacaaaacagggacaagatccacgtcttgcaataaaacgtgccttgtcaaagatgttctctttgactctttagtgtagccatctctttctctatatataaaaatcaaccatggtgtgtgtcagtgtgtgcacatatttttataagatatcttcacatacacaaaaacatttattgtacagtgcacaagtgatcgaatatttgattctttttcataatcagagatctgatctaa

SEQ ID NO: 6595 - DNA, 3000 bp, Unknown
  misc_feature (1)..( 3000): cDNA_ID_1814919_gDNA_ID_1621098_Annot_ID_55782 3000 nt of promoter + ATG
agttaatagctttagaatatattaggcatttcaagaaaataatactcagataattaagattccagttttgctcagatacttggaatcttaattatctgaaatttaaatatttctttttaccttaacatctaattttctttttgtgtgctttacaatatcttttttacaaatttaaaatgaaaaaatggaaaattgagctggtagcaaaattaaatacaaacattagacccttttgaaaaaggaaaaaaaggatcgtacgttacgttgttatctccaaactgtggaccaaaactgcataacgtgttaaaaggtgagatagtgtaaaagcattgatcaagattcatgcaatgggaggagaaggtggtgctgagcccgtaattcactttgtgtttgttcatggagccagtcacggagcttggtgttggtataaactcaccactcttctcgacgccgccgggttcaaatcaacctccgtagatctcaccggcgctggcatcagcctcatagactctaacatcgtcttcgactccgaccaatataaccgtcctctcttctctctcttgtccgatctccctcctcaccacaaagtcatactcgttggacatagcatcggtggaggaagtgtcaccgaagctctttgcaagttcactgacaaaatctccatggccatttacctcgcggcttccatggttcaacccggatccatcccttctccgcatctttcaaacgtgagtgtgactcttttactaactcacctctcttcttcttcgtttttttttgtaatgtatagaagatatatagaaccactcgctagctatttaactcttgtgagtatttgatagatacatgtgggagaagaagatatatgggagtacacatatggtgaaggtaccgataaaccacccaccggagtcctcatgaaaccggagtttatacgccattattactatagccaaagccctcttgaggttaatctcttaattactagtatacataaattatatttcaacactatagtattattattattgtttttgttaatatgtggtgaattgagtatataaataaaattggttatattgtaggacgtaactttgtcatctaagctgttgcgtcctgctcctatgagggcctttcaagatcttgataagctacctccaaatcccgaggccgagaaagttcctcgagtttacatcaagactgctaaggataatctatttgattctgtgcgtcaagaccttttggtggagaattggccaccttctcagctgtatgtcttggaggatagtgaccattctgctttcttctctgtcccaactaccttattcgcgtatctcctccgtgcggtttcttttcttcaacgataaacttcaacttatccttcatacattccgatctagataacaaactaattgggaataattagatgatttgtttggaaggtgattgatatgatattatgattctattaagtaatttcctttatgttatttgatttgagtttgaataagctttacatgcgaagcaatccagggtaagagagatagaaatctccttgtaaaggaatgttatttgtatccttggtttctttttgtcaataaatctatcatagtagctaagattaattaagtttcatggagaaaaactatatggtgctatctttgtttttgatggatgaggtgataaagatatccttgaacgacaacatgaggtgaatactatgacatgtcatctcattatctcaacactatgacatgtcattatcctcaagcttttaacaatttttgtgacccttcgatgccttagcgtatagttcttgttgttttgttttggttcagtttagattcacattttaaaaaaatatatattattaaaagtgtagagatccgaaatttatataacaggatggcctaaagcaaaattttgtttttattattcataaggcatgtgtacgttattttacggataacctcaaaacgtatttggaccacagacgagagaggagattaagttcacgtctctttttccttttttctgcctttttccttgaaattgtttgagtgaacactagcttgtttgaaagacttgtcagctagcaagaaaagagagtacatatgttggttttgtccaacacagatagacgtgtaacgttatgatatctccagtatgtggactaaactgcatacatttagtgttaaaaattgagtggattagcattaataagcacacacattgattgagattacgatgggaggttacggtggtgatgagtccgtaattctctttgtgtttgttcatagggccagtcacggagcttggtgttgggccaatatattacgaaatcctcttgaggttactctctttactcacttcaaattgtattcttggtttctttgtcaataaatctatcatatgctagactaagtatattttatgattttatctctaacaaaatcttataactttattttttaaacaagtaactaaaacttttgaagtaattaactacaaaaattaatgtgaagatatattatcttatcatatcatatcaatgaaggcgttcaaagtaagatgaaacatggtaaaattacatgtcatgagaatcttacaaatatctctgatattaattggacaaaatcataaaaacataactatgtagatttcatcaaaattttaattttcatgttttaaaagcaataaagtttgcaaattgatgatgtggtctagtatacaatttacacctatatattatttaaatttattcttgcttatcacgtttagttgacctatttcattaaaaataaggaaattcccaaaccaaataggaaactctggcccgcacgagaattctatatatatatatatacgatttgtttcttttggtaaaacaaatcgaaacaaaaattagatttcagagctaactctgagaattagggttcgtctctcgacaaacaaaaatctcagccccgtggaatctattctggtgtaaatcgaagaatg

SEQ ID NO: 6596 - DNA, 3000 bp, Unknown
  misc_feature (1)..( 3000): cDNA_ID_2999815_gDNA_ID_1621098_Annot_ID_55783 3000 nt of promoter + ATG
tgtaccaaccaaatatgtctggcattttattgtctccaaacattgatcatcagctgttaatacaacaggttgtgctagaagggatatggaaagaaggttttatggcacttgctgctgtaggcgcgaccaacattggatccattgaggtaggtgtaatgaaaatcgaaactcataagcctcagacattaaggaacttgctaaaaattgcttttatagcttttcattgaacctgagctaagaacaaacaagccaaagaagaagctatttcctacagagccaccagaggagcgggtgtatgatccagaaggtcttggcttaaggctcgagaaggggaaagaggtaagagtaggttcaaaagagagaataaaaattccagtttaagaaatgtaacaaagttcttttgttcgtatgattggtaaatggtcacatgtatgggtcgatgcaggtagctgtattcaacatgggatcaaccgtagtgctcatttttcaagcaccaaccgcaaacacacccgagggttcaagcagttcttcagattacagattctgtgtcaaacaaggagacagagtccgcgttggacaagcattgggaagatggaaagaggaatgagtacatggcgttatgcactaacaacatataccacactgttgtttttcttttgttagatctgaccaaatcttcaatcagttattaaaattatttatgcatgtctctacttgagagtcgaggctacttataaacagattttgtaattgccctaatcctacctattgaatcccatatctactattttttagtgtcttgaaactttgaattcaatcctaatataaacacgtcattagcatttcaattaccaaagaaaagcaagaagaagatgaaagagcaaagctcagtattatacagatctgtagataatgaaaactctggccatcgaatgatatctttccaccaaagagaagaggttgtgtacataaaagacctttgaattaacctaaataagaagataagagaaaaataactcacattttatggtttatgaatttgatatcgaaagatctcttacaagccatgtaaaaacaagaattcccccataattttacagtcgtccaaatcatcaatatgtcatcatccttctcaatttagtgttgaaatcaaccacagcctctggccccctatatcaaaactttgttcctgaaaagtagatataagtacagattattagtaccaatcagtgagaagatgataaactccatggttacttgactagcacaaaaggatcaccttccaatttttagcctaaacaagctttaacgaagaggagcaactataatttttgatcatctatcaaccatggattccccacctgaactcgatccaaacacacaaagtacactaaagcattcagtctctacaaagcattgacaggactaacatttacaaacaaagctttcagtcttctttcactggaaacatacatatcattttacatctcttcaacgttcacaaatagtaaggattagagaacaatgctaattcacttccctaacttattcaaaacttttagtagacttcaagcttaaaacccatggttatttgatatcctacacaccaagcttaggtttttaatttcagggcaaactaaaatgatggttactgatctcctacacaccaaaacaagtcgcaatactactcaatttagatcattcttatacgttcatgtaaagcaatcaacaactgattctaattgtgattttaactatgactacaacaaacgtgaagatacctagagctatgagttgtttcagcagatcagatgaaagaaacacagaagagtgaaagaaaaagcacacctacgtctgtttagagtacgaagatgagaaggggacgcgtttgttgcgaaacatcatgtaaccaaccggtaatacaacaccgatcatcatcaccgccgatccgatcaagtaccgtaacagactcggaggctccacttctatcaccgtcttaaactgcaaatccgcaggacgagacaagagaattatgaatcagcaacaaaaatgtggagcgacgcaatagcaaacaagcggaaacgaataggagaaaaagagaaagaaaggaaattagatctctgagatctagaattacacattgcgtgaggaatttaccggcattatgacgtcggagaaaggattcgccggtgatgaaccaaacttcgttgtggaagagaagagatctagactctccggtgagattcgtcaggtgagtctctttttttttctgtttctggttcctcactacttataatgggcctttgctttacggcccaatttattgcttactgagcctaaaaccttacctaaatttaatgggcctctgcttatggcccaatttaaatttaaatttagagaactaaagaagacatgacactaattacaagtcattcgattatgtgtcatactcgtaaaatttatcatattaatctagtagaatagttaaccacataataaccacattaaacttcatatgataaaaatatatttcaataatctccgttaaatatatctatgtataaatcacatattttaatagcaagcaagttctccaattagaatcttcatataagttaataagtaccaaaataattattagggatcccatagttaatagctttagaatatattaggcatttcaagaaaataatactcagataattaagattccagttttgctcagatacttggaatcttaattatctgaaatttaaatatttctttttaccttaacatctaattttctttttgtgtgctttacaatatcttttttacaaatttaaaatgaaaaaatggaaaattgagctggtagcaaaattaaatacaaacattagacccttttgaaaaaggaaaaaaaggatcgtacgttacgttgttatctccaaactgtggaccaaaactgcataacgtgttaaaaggtgagatagtgtaaaagcattgatcaagattcatgcaatg

SEQ ID NO: 6597 - DNA, 3000 bp, Unknown
  misc_feature (1)..( 3000): cDNA_ID_2108377_gDNA_ID_1621098_Annot_ID_55786 3000 nt of promoter + ATG
gcttgtaacatgttgaaatcaattgctgcaaactctagcaagagagggttcatttcatgctttttttcgtacacatttatgtaccatcttgcttctaatcttcgtatgctccaatggtacggcgtctctagtgctcgtttcaccatctctaatatataagtttcatcttctctgcaaatagttttgctactttccgcgacaaactcacttaaccgcttgtttgcataaattctagtctccttgagtttaaactccgaatccattgaaaaataagaagcttcgtatagagagagtaaacctttgatatcgctgtgtaaagtttttctgaattctccggtctcacttatgaaaacgtcaaaagcatctgcaataggaaatacgaataattttattatttatacgaaagaatatgaactactcaactcctttaagttactatttggtatagaaacgataaattacttgattagtcacatagttgtgactaataaaaaaaaagtagctgatttagtgtcgcgggctgcaatacgggtttggtgtcactatgttaattaaaaatggttgtttaaataaaatgaggtgatatgtaaaaaaccttgcgagacatcaaaaccatgttgccttaagagaataaattcaagtgatgtagcatgaagatcttgtgtttccctctcaatttcgccgtgttggtcatgaatttttctcaaaatatcatggatttcatgtttatagtgatacgagattccgagtctttgcagagaatcgatcatttctagctgctcaatagaaccttcaatttcatttaatgtcttcctcacctcttctttaaacaatatagctttctccgcggtttcaacttctttctatatacgtatcaagagagagcattgtaagagttactataatatactaatcaggttcgatttaaagcatatgttaaaaacaaataaagttctagcttcggcaccagacttgtaacgccaatttttgggaaaaaaaattggattttaattatcacacaaacaaaataaaaatcagaagtggtataattttaggtcatgtgttgagtctttgaaacgttagattgtcctgataacatgtttggatgaattgtgcacgtataatatgatatgtaatattacaatttaccacatatatatattctcgagcgagaggagatattgatgatcccatagaggtggacgataattggcggaacggcggtggaaggtgacagcatgggtcgaggtcgttttggagacagcgttacaaggaaaatgctgagtcttttgatgatgaacgttgcaaacaaaagctgaattgaagcatagattatgagcagccatatatttgtaaaggttaatggagctgataaataaaacacaaacactttggtggcttattttttgtcactctgtcaaacaatacacttgatgtacatatttatagacgtagaggccgataagaagttataccatttaaatcaattgttgttctgattttaaaaattactaatataaaacaaatgatttagatatctctcactttctaattaagtttttttagaaaggttgatttcctcacatgaggtatacaataaggttaattacatttgtattcatcatatttaacatattactattttttcattttttttggccaaacaatattaaaatttatgttcatcatatttaacaatgaaaatgatattaataagaaaatacacacatacactgtaatttgagacacgtttaaaacatgatcatgcctattttgtttgatataacattgaaaattaggtcataaatcgatataattaagaaaacaaagtatatctccattaaccaatgataatagctgaaagcatcacatccatcaccaaatatgaattcgattggtcactacaataactatgaaggataacgattttaagaagattaagacttcagtggacaaaattacttcatgattataccaatgcaaaaaacgaaaaataaatgattcggaaatatgacaaaatacgggccaaattctttttaagattacaacctttgaagtttgaaccagatggtttcgtatttatttgattctccatgacaaaaacaaaaaacaaaaagcgtatactctgttttgcatattcaactagaaaagtctaaaacatacttgtcgagttgttacttgttacttacgtcttagtttcggtaactctcgttgttcacaataaacatgtcttttttgctagtgatcgttgtattcatttatacttgtttgtgtcaaagccaacgaccaactatagtcgttgggacaatgattttttttttttttttttttgaatttaatgctaaattatattcaaagaaataaaacgttctttacactaaaatgcaaactgattgaaacttttatgaaaaagaaacttctctcctctaagcacgagatgcaaaccaaactctcattccatccttatacttcagaacaccaccaccactcatcgtagtcaaacgatttctgacgtttttgtctatcaaacttataagtctctccggctgggatgggctctccccgtgtcttctttggttcctttcattcctttgacaatgattttttgcatcactctaaaaaaaaggataaaattagtgaacttttaatcgatcatcatatgaaaaaatagtttacctttttgtgcagaaaatagtttactatttatacataataatgtttttctaattttgtcaaatgatgaaatatttttttgtactcaatacaagttttgttttgtgtgtgtgtctgttcgtctgaaaaagaaattaaagggccttaatccgaatttcaaagcccaatagtggaagtcttttatgggcctttatttattaattcaagtagcccaatttcgtataatataaaggtccattggagataaaaccctaatcttccactttaaatcaggaacaaacccttcactgcgccagtgttgtgcggctctgcgaatcttcgaaaatg

SEQ ID NO: 6598 - DNA, 3000 bp, Unknown
  misc_feature (1)..( 3000): cDNA_ID_2174182_gDNA_ID_1621098_Annot_ID_171239 3000 nt of promoter + ATG
ccaacccaatatccgaaccaaaaaaccaggttagggcgggttaaaattttaggaaatttccttattgggtagagttttagtaaacccgtggatatccgattggtccggaaattacccgttacccaaaaagagtattcaaaaacccaaacattaatttaatatctaaaatattaattatatttaatcgtaatattatctaattatctaagattataattataaatctaaatatgtcaattaattttggacctaaatatccaaaacaactaaactattcaaaaattatttgttatgtttgtcaaaatttagtaaaatatattcaaatataattaaatttattaaaacttaacaaatttaaaagttttttttgtttggagatccgctatctacatataaaattcccgtctctatttttttggggtatttttagggtctgaaactttttatccaaactaatacaaacccaactggatcctacccgaaccagacccgaatatttagaattatactattgggtagtaaatcataccgcatgtaggcttatattttagttaaactaaaaacttttattgtaaagatgattataaatatatgatattattttatttaattttaaatgtatagtaaactgcgagttgtatgtgttttttttgatattatttatattgtttagtgtttaaaattatacaattgtattttgattgttaattttagagtttcacctgtaatataccatcttgtattaatatcgatttaaacccgtcaatcctaggattttccagcttgtattaaaaattgaatcacatcatacacataaaaaaatctaatgtgttattaattattgtagtatataagattataaatttttaaaataatatatatgaaattgaatacaaatattcaaattatgacccactacttagtagaaacttttcttaaatctatttttgactcgttataatattttttcatgaattgaacaatttatattcgtttttaaaaattcaaattatggcatatgcaaaaaaactctaattattcttttataacgatgatattattttttcgcaaaaatagaatcatataaagatgagagctgaactataataattaataaaaaattaaatatgataatttagatatcaaatctaatttgtggattttaattggttacttttttggaattaataatgtatttcgttttttaattaaattagtatttgactttttaatttttaaagagatgaattaatttactatttaaattttatttctaatggcatacctatgtaattacttataaaaaataaggttacatttaaaatgtatttcccaaataatatggtgggattagttgatttatgtaggagtatgttatataaggtggtgcgaccaattcaataatcagtcgagatttgcaatgaatcaaatgatggaagttgtcttttacttaaaatgatggaagttgtcccccacaaacttatatactgattgctcataatatatagaaaaatacacacatactgtataaactatatgaaatttatattatattctgaaagtaatttttctagagtcttttaagctatttttcccccatcttttggaatcagtggctaaattaaaattagtatgagtagggcaaaaatcagtatatagtactctacatatacaataatcactagtgtgtataaaaaggtaatctgttagtgtttaaataaaattgcacggacagagacaatgcgtgatcggtacgatcattaaaagagaagaactaatagtgtaccctcttatattgtaaatttataatgaatcgtaccctcttatacaaaattttatgaaatggtgatttctattaaagttttttcttttcaaatctttgaaatggaaatgattggattaattaagatgtagtattgaatgtactaatacttaataatgtgatagaaggaggagaggtccaatgatggagaccatgttgatgaagcaaaaagctaaagagaaaacgtgtttgggcaatgtcttctgtggactgtggccttggaatcatcaaaattagatatatggtccacctgcatttgttatgtaaatcttccattaattaaggaatcactgtcctaagatctttttccttttctaaacattgtttaatttgaaatcgtacgcaatatgtatttatgtacaaacctttttaaatcaggtccatcgcactagtggacaaacaaaacctattgcaatgatgatatcgatcaaaatatatagtcggaattccacaagaatatttatgtctatacatacttgtatagtaacgttctagttaaaactacacacacatgacacaccagttggtatgtttggctctttttttttttttttttcgaaaagttaatttattaggttaactagtatttctttttccaaataacacgtcaagataatgtttttttttaaaaagtaacaagtaaaaatatacatctgttttttttttaacatgagttatcaacggtgtagactcatgatgtctcgactcttaactaaattaattaatgtaggatcactttttttttcttttggcaagttaaatgagtataagttcgtattattatatcttataaaatatgtgtcctgaaacctaattaaactgctttacataggtcttgagtttctaatattttattcattaactattatcattattttgttaataaatcgctttatatatgtctaatttttattattaactattatctttaattactgtaggattgatcacattggattgtttgagctaaaacgataacgacgtggacttggacgattatctaagttttatgggcctaaagcccagtatatcaaaatccgggcccaaagttaagatatgaaattagaacacgtcgtactcacataatctgacaagttcagacagcggcttaaatataaaacacaagcgagatgagagaaatccaaatgaaatataatagggataaaaagaacaaaatg

SEQ ID NO: 6599 - DNA, 3000 bp, Unknown
  misc_feature (1)..( 3000): cDNA_ID_1814899_gDNA_ID_1621098_Annot_ID_171236 3000 nt of promoter + ATG
gttttttgtttgctgagctagtctataaagttgatatttccttgttaggtgattccaaggaaagcttctattttggctctttggaaggtgttctagctcaacgttaccctaaccaatggccttctgaaggtaatttcttcctaactgtttcattaatctgttttaatttcaatctctcacggtcacggattatgtgtatgttaaaggtatcttgccatcatggaggcaaaccatggaaacttactacaagaatgtcctgtaagcagttgctctcttgtcgttcttcttcaaagtgaatctcaaactaaaacttcatacctatattctcagttgagaataggtttcaagttcatttcaacagttagatttaaaccttgatggtaggaataaatatagtctattttagccaagtacatcggtagtacaaatgaaaaattcttttcaggtcataaattgtaagtagattaggctgtttcatgagtatttcctctcttttatttgcaatttccatattactttcctggatcaacttgctagttgtgtgtttgcattcctgctttaaggtccgtgggtagaaaattgcttggcttgattgccttagcattggatttagatgaggacttcttcgaaaaagttggagccttgaatgatcctacagcagttgttcgcctcttacgatatccaggtgtgtctatgtacatcaaaaagttctggttggcttgatattaatcttaatgaactttggtcagagttagatcgtaacatatgtaatcagtggaaacttaagccacattccgggagtttgagtcaggttttgatctctgcacttgttatgattataggtgaagtgatttcgtcagatgttgaaacgtatggtgcctcagctcactcagattatggaatggtcactcttcttttgactgatggagttccaggacttcaggtcaatatctctgaatttctcgtcataatcttctattagtaaccttatgttcttacactgtctttgaactgaactcttaggtttgtagagacaaatcgaaacaaccacacatttgggaagatgtccctggaattaaagggtaagtctagcttttcttagctactagtttatgatgagaaatgattgttgaaatccggggactttctgtaaccgcagggcgtttatagtcaacattggtgatatgatggagagatggaccaatggattgtttcggtaaacttaaaccagtttacctagtcgtgagtgcggtttttatgcgttcttcacatttcgtattttcttgtaatgggtttaggtctacattgcacagagtgatgccggtgggaaaagaacgttactcggtagctttgtcttgtttctttctttctaatttctatacaaattgataaagttttgagttatttaaaggaaaagttttttgtaggtggtgttcttcttagatcccaatccagattgtaatgtgaaatgcttggagagttgttgcagcgaaacttgtcccccaaggtatttcttcttgaatcttaatccaatttaagggtgtgaggagaggcacgttacacgtttgttaaatcatttggtcttcaagtgtaaaagaataaaagtttagtccttctctcataaagatttagttccatcggtgcagattcccgcctattctcgccggcgactatatcaaggagcgtttcaggctaacatacgccacttcctagtcttatgtttgtgacgaaatgtaagaaaaaaatagtgttcaaacttctacgtaccataatgtttaattagtgaaacttatggaacttgaaaatgattagtcagtcaaagtctcaaagatagacacgtttaaaagccgtggaacttgaatgggcgtttacgtgtttggaccatactcatacacatggcgaattttctgtggtttatagggacattactgtttcaattcaaaagacaaacattttaatatttacgagaataatacggttgtatacaagtgtaattacttaactatactttgaaggaaacacaaatattaatcaagttttaccatacagttgacaagcaaatgcatttgacagacacaaaaacacaaatgaatgttgacatagaccatacccaaaatcacatttcaatatcaaaatctatatatatatatatatatatttatgtattttcgttattatttgaacctgcaaaacgcagtcaccattcgggcccttaaatcttatttttattttcttcgaaatgtgcataacgctactatacctgcaaagttggaacaaaatactattttaaacacaagataacaaaacattatcttatcttcaatctaactattttatcttctttttatcaacatgttcttcagatgcatgcatttactaattcatatggaaacacatatgggaaaaagaaaaaaaaattatccacacatctgatttaacgatattttaaattttattttagtacacaaatactgaaatacaaccactttttgtctgtcaattatcctttgttatacagcatataaaattttctatacgtagatatcctttttttcttagtcaaatatatatatgagggggaaaaaatcacattattccatacttgcgaggttttatttgcaaacaacttaatttgttttcaacattcgttgactaattaacttatattaggaatatataatccaaaatttattattttccacgtgggttttatctatgtcggagagtggatctgagaaaaagataaacccaaaatatattaattatagaaagaagaaaaaaaagagtctatatttaaatcaatttgtctttctcttcttttatctccgaaataaaaagcttaattgttcttccaactactctgcaattaaatcggtagagtgaggcattgtccttctttttctccctctgttttttttttttttttttcctatcatctctgagagttttctcgagaaacttttgagtgtttagctactagattctgaattacgaatcatg

SEQ ID NO: 6600 - DNA, 3000 bp, Unknown; identical to SEQ ID NO: 6597
  misc_feature (1)..( 3000): cDNA_ID_2108377_gDNA_ID_1621098_Annot_ID_171229 3000 nt of promoter + ATG

SEQ ID NO: 6601 - DNA, 3000 bp, Unknown; identical to SEQ ID NO: 6596
  misc_feature (1)..( 3000): cDNA_ID_2999815_gDNA_ID_1621098_Annot_ID_171224 3000 nt of promoter + ATG

SEQ ID NO: 6602 - DNA, 3000 bp, Unknown; identical to SEQ ID NO: 6595
  misc_feature (1)..( 3000): cDNA_ID_1814919_gDNA_ID_1621098_Annot_ID_171223 3000 nt of promoter + ATG

SEQ ID NO: 6603 - DNA, 3000 bp, Unknown; identical to SEQ ID NO: 6594
  misc_feature (1)..( 3000): cDNA_ID_1814923_gDNA_ID_1621098_Annot_ID_171222 3000 nt of promoter + ATG

SEQ ID NO: 6604 - DNA, 3000 bp, Unknown; identical to SEQ ID NO: 6592
  misc_feature (1)..( 3000): cDNA_ID_3090508_gDNA_ID_1621098_Annot_ID_171219 3000 nt of promoter + ATG

SEQ ID NO: 6605 - DNA, 3000 bp, Unknown
  misc_feature (1)..( 3000): cDNA_ID_2174128_gDNA_ID_1621098_Annot_ID_171212 3000 nt of promoter + ATG
acgctttgaaacaagagaagcagaatgacgatccacaaacaaagacttagaacctaaactcgccattgatttacacggatccgaaagcaaaagatcaatgtgatatccacagacctgaaaggccggaccagatacagaaggaacagagaaagttcgagaaacagcaccaataacagaaagattcctcctttcgttaatcaacaacaaatcagagctagctggttctaaaaacccgttagggttagtaaatctagtgtacaatcctctataaccaccaaaccctaaattccctaatccaatcaaaatcttaacttgtttctgaagactttctctcacaggtaacatcttaagcacaagaatctcgaaacccagtaataaccagagatagagaagatcatatcttccaaagcatcacttttttcgtcgatttaaacgctttcaccaacgaatctaaagattgatccaacacaaacccttgaaactcagagctcaatcaaatacgaattcggaacttaccaggacccacaaattctcttttcacctccttctggagaagataatgtcaaagtcacaacagaaattggctagaatccagataagtttctgaaagaagagatgacaaatttcacgaaagaaccctagccaaatctgatctttaagacaagaaacacaaaagctggtggtcaaaagcaactcgcttttttcttttgttctaaaaaaaacaaaaccagtgaaattttgggatgtctcaaaaaaaatttctgtatttgaggtttttgtgcgatgggtacagattatcagaaattcagaatgttcctctcacatctttttggatataagtgattttcagctgttggatcatacatttaacaatctcagccgtacattttctgtttttataaaatagactaataacgagaaaccgagtcgtggagattaatgggcgtacaaaagcccattagagtagcaatcaaagcccatgcatcggcatcaaattgtttttgaggatcatttgtcaattgtcaacgagtagagccgtgcataccatacaacataaagggaaatagccatagctaggccacaaaaaaaattctactacttaaaacgccacattttttatacaaattatttgatttttttggttacactaagacttttttccactaaaatagattacttttacattagaaatatgttataaagttgtaattttgtgaaaataccattcctataaatattttaagatgcttgaaaatcatattttgtcaaaataatagaataacgtttctaacgataattagaaatcataaaataatatacatgttaaaataaaataaaataaataagtagtcagtacaaaagaaagtttacacgtataacaatttgccataggcctccataaatccatcatatcagaccactctaatgtttttacttgtaaatatttgatggacaaaaacaaatgctgggcctactatagctactatcatatggatgttacatgcagaaacaaaacatgcttttctctctgaataacgaactaaacatgttatggattaggccctaatagctagtccagttaggattttaagattttccgatgtatattaagtgtcaatgtgtcatacatgagcctctaataaacacacgcccaaaatcaatagaactaactaaccctatacaccgaagtaatatagaaccagcacgaactctagatctggaaaatataaatacaaaatatcttttaaaatgttttctaaatattattgtaattatcatatgaaaaaaaaactattcataaaaagtaattatcaacatatgtaatctttcaaagatgcacttgatgtgtgtatcttgttggttagaattttaatttattaatcgataacttggaaggcaaataacagtaaaaataataatctaactgtagtaaatatctccccacacgtcattttttttatttttttttattttttattttggcaactcacatggtttgattcattgataagtcagtttcaattttatttttctcaaatttaaataattctccatttctaaaaataaaggggcaaggtattggtacgcacatgagactaacattcatacctttttatgaaataaataaaacaaaaagggacacaagaaggaacgcaagaattttaaactgaaatgattgtatctctaaattgagaaaaatcccaaaaagaattagtaacaaattaaataactaagcggtgttgttttattcggaggtaaaatatatatatggagggtatagcgtcaactcgcttttttactacattttgatttctctcccaaagttctttaatttttgtttgggtatcacatttgtagtcagaaacaaaattgttgaatgaattatcgacgactattttcactcgttggaatagtcgggattcaatttattaaaccgtcgtaaggaagctaaagatgtaaaaatgatgatatacagacaatttggctagctcattcactttttaaatgggcaaaccaatcatgaatgctagtttaatttatcgtgtgattgattttttttttatataaaaaaatagaagtaaaattgtaactttttatgaaaaccgtcgtaatcgtacgtcactaagctacaaaaatacaacaaacagtgactaataagaaaatgtagagtgatattagatgaatttaacacgtggaaaaatcatgaggaggagatgattttttctgttgcattcccttctgtggttaccagctacgataacgttcacgccctcctccacttaaattagaatgtgagaaaataaaatagcaagaaattggagatcacaacagtattgagtgtaggacatattacaaaggagacaaaatcagtcaatagtaaaaaggtatcacaataaaaaaaaatgtcaataaaaaggggccattgtatgacatgaaagaacaaaattaagtgatcatcacttctcctcctttatcgagagcttcagttttagagcaaca

SEQ ID NO: 6606 - DNA, 3000 bp, Unknown
  misc_feature (1)..( 3000): cDNA_ID_3048697_gDNA_ID_1621098_Annot_ID_171207 3000 nt of promoter + ATG
agatgtgttcttgcgacatcatagttatccacataacaggtaaacacgtcttgaatgaacttgtacgttagtagtgacctttctgtgttgtgatcgtgtgaggtggaaacagtataggtcatgctaacaaattttaggaggtattaagcactgtgattaggggaacaaaagagattgaaaatctagcattaagtttcagactatcgcctatactcaggcggttcagattactcgttttcccttgtagggggatccttaggtatcaatagcatggataagacttttgggtgatcataactaaaaacctgagcttatctaagtactagatgccattgagaccaaatcttctctgttcacacttcacatgcaacttgtgtagttagatagaagtacagcttgcagttgcactgcctttagcttctttgagtgatgatttggatgcgggaatacagtttctaagatagttttttctgagatttgttatggtataacattctggggacgtttgataggaaccactagaagaagtcaagtatatgagataacaaagcaacaaaacttcttaatggtgttatgttctaaatgagtagggaattgcaataattgagattcttgggttggcattgtcttgaagtatttaggcccacaaattataagcattttttggatggatctacttgtaatcctcaaccacccctgtcaaataccaactctttgtttggttcttgctctgttttttagttcataaagtctatatacgacatatagacatcaacaaagcttcttattttcctgatattttaaaccgggttggtcatgtccttataattttttttgtattgtaatgcctttgaacaaagttgcagggtgatcatgcacttctaaaagagagaatttttacaataaaatatcaatttgttttgttgattggcaatgattatagatgaataggttggtgagttcgtcttcttgtctgtttggttatacaactcttagggctctcaataagttatgattcctcccatgtctcattgttttgttacagttgtgtgacttgtgttatgatgatactacctgtctaaacatttgctgattccagtagtttataggatcatcatattcgcagatgaaccacttggaagtgtatgcagtttatggaaataagtagtgtatgcaattaatggaaataaatggtaatctcatgtaccgacgactagctttttgatgaaatcaaatctctagtaacctttgtgttaatggtgacacaagaaagctataaaaaaaagctaaagctggtgcttgtgaggacaacagctctggtgaagaagacaggcttgagccttttcttcttgtagcgacgaaccaacgtattgattttattttttttgccgtaaaactacaaagctgcaataaacgtcactctcaagtctcaaacctcaggtttgcttttgcttcattggttccttcttctcgttttttgtattttcagagtacagctaatttaattttcctacataatttctcgaaatcgcctctctgttaacagctgtatccaaaattttagatttaaaagaaaacaaaaagaatccatgctctctttaattaagagctgacgaatcccatcatatccaaaaccattgacacggtttcgtttcgtatttcaaagtttccaatacttttttagtaaaataagtcaaagtatttttgatgttccaaattttcaatgcgggaaacttatcctataaattactttttcgtattttaaaatcgaaaaagtatcggcttgtactggaggaggttggtgaattttataagaccatttgtcctctagcgattctctctacctaatctagcttcaatacaacatagccactggcattttatattaatgcttttaattgttatctaatctttttgtgatgattgattagtttagattatatgttcatgaaaatcggtaacaagatatagtctcttgggataaacaatgcatccctttttatcttttacaaaatccataaaacccatgatatcatacacttgtaacgaatatgtatggaatgataaagttcggctgcatgatagatgattattcaagctgcggtcggcaaattggctaggtgttgtggttcggctcgattggatgtttgattaattggttaaatgtttggttttttggttagacttcatattagcagagcaattttctaaagaaatgcagtaaaaaaatagaaaattgtcaggtgagacaataccgaagaggaatttaagttgtatttgtgtgtggagaagagtgaggtacacgtacctttctctctctcttcgacgctttaaccctgtccatgccatggcaatatcccacctggcttggactctactttcttctttgctttttttacaatttccactatttatgttttttagcgtctcaaggcttttgatatttttcctttaagttgagattatccgagggtgtggattggatatgttataaaccaatgaagttgaattttaataaatgaaacataaacaagagaagataacaaacgtaggtttaataaatgtatcatgtatggttgcatgcgaaactcccccatctcatcaatgtacaatgcagttgacttttgagttttgccaatcatcaaagactagctagacaatagtattactattacagtgcaagtttcaacatactgctgcgttttggcatatgtaatggtgttggtttcctgtctaaatctaattctttatctaggactaaaactctgcatgccactcttttcatcgctcaagccttttctttagtttcaaaataattatgtaaatatctttttgtcaaaagcataaatatctatatttgctgaaatgaaagccaacaataatttattttttaatcgtctcacaatatgtctttgctctgtcctataaaaacactcgacctcctctgcttcaaaaattcaaaaccattccttggactccactgttttattatccaccatg

SEQ ID NO: 6607 - DNA, 3000 bp, Unknown
  misc_feature (1)..( 3000): cDNA_ID_1814958_gDNA_ID_1621098_Annot_ID_171203 3000 nt of promoter + ATG
tattaataaaactatgtgctttgtatatgacttttggcagctaacatcattcgtggttataacccagaaggtatatgattttttatgtttctttcttcttctattattttctggttaatagatcagacttatcagttgagcttcttttagaaactagtcttcgttgttttagtatagtaaacgtatctgacatttttcatgggtttgtgttgttgattccaattgttgcagtcgcaggtggccatcctcttggtatgtataacatcaacctttgactatacctttttaccatttctttttttctttgacttgttttaaaaataaaaatcctcttttttttctgttcttgaatcttgcagctcatcttcgtggacttaatccagaaggtatcatcttgttattaattcgtctaaagacagacaacttcataaattgttttgattgatttcattaattgttttatcatcgtaggttgtcgtggcactgacccttttggtatgaacttaatctctccattgtgacataatttccaaatatagtaattgtagttatatgtatcaattactatgcgcaaacaaaagacttaagagatgcttactgatttatattttgtgtttgaacgttggacagatccggcgttcactggtccgaccatacgaccacacccgtcagtgttggagggatccacgagtgcttacgagacaaagcagctctcaaacggtggtctgtatctgcgaattgacatgcctggtgtccctagcgacggcttcattgtggcagtggacggcaatggtgtcgtcaccatcatgggacgagctcctgcgactatgcacgactcaagtgggcgtagttacgtatgcaaggtcgccattgtccctagaggctatgctggcgtcggatcaagataatcgccaaacatggtgtcatccgtctcactatccctccctactaattaatgaatcggctcttaattaagatcatgcttttggaattaatcatcatgtttaaaacaatattgggacatgcatatgtttgtctttttcttttggattcccgaatatttcaagaacactaattaaatggactttaatacatatgtacgtataagacgtgtatgaaaatattcactcgtatgttttttttttgtcgcactcgtatgtttttaatcttcgtctaatgcatggttaaaatgaaaataaaataaaaaatgatgcactagaaaatgtcagcaaatgaaaatagaacacgtgtcagtctagagactgtttgtcgtttctcacctgacaccgccatactctcaccttcatttactttattgaacttcgcttcattaaacatcttaaaaccctagaaccagagagagacagagagagattgagagatctcaaaaagcaaaaggaaaaaaacccaaaccgaaatcttcggccgccgaatcatcatcatgcctatccgccgccgagtcagaatcaacatccctaccagcccccgaatgatcacgcctatcacgcccatagctccggcgcctcacgctcatagtaacgatctttaaacccaaagtttacaattacttcaccatttcttaaaaatcttagatttttctccacgtgatatgcatacatttctggttttttggtgtatatgtgtagatggtttttacgctatgaacaatccgtaccaagcgaacggaccaaaagggtttgctgagttcaagtatctggaagatacccatgatctattcgtgaggcttgatttgcctggagtcaagaaagagactgtggttacccacttacccttctcgaaccatccaaaaaagctgttactgtgaccggagacgcagctaagagcagcaaacacgatgcttctaaccgcaagtatggaacctccgtggggactactctgtgactgctgtggaaatcagtaacaacattcatacctttgttggaagatggtgttttatagcctccaaactacaaaatatctaaaatattttaatcctaagtctagagaggtcttacataagatctagattacattattcaaattatctagattattctattagagtatctagatttttatgtttaaggaggtggaagatgatgatatttctagagaaaactctaaaacttggatttggccataattaattattggataattgatccaataattaaacttgattcaaaatcaagtttaactttcaacacgtgcttcgtttggtcatccttcctgtttgatgatctcgtggtgaaactttgtgtttgggtctgttaaaaatctgtttttctagagtggacccttttttcgggatagtgtcgttgtcttaaggattattatgtcgtttcatgttttagttctttggttggatatgtctcaatgacaaaacatatttggatgtgtttcaacgacacaacttatttggtctataacccactgccatttatgagtctctaaattgtttatcagtttcaaaggtcactattgaattgcaaaatgaatttaacattacttttgtcaaccaatacaataaaatgcaaagcaacgtacgacagttgtttcacaaaaagaggacaacgcgtgtcaaactaatactggtgcaaatcacaaatgcaaaagagacacgtgtccccatagtattgtcttgtcttcacctgacaactccgtcctgttgccttccctcccataaagatcccaaaaaccctaaatgccaaaacccagagagaaagcaggaaaaaactaatcccaaagtagctaaccagaaatctcagtcgaatcatcatggtcgtccctctcagagctattccttcatctcgcggtactaacatctttctaaaccaaatctcaaatctcacttacactacatttgctcttttaacccaaagtttactcctttttttggtgttgattggaacagaggggttttatgcaataaacaaccagtttcaagcaaatgggccaaaagggttcatggagttcaaaatgttggagaacgaagatatg

SEQ ID NO: 6608 - DNA, 3000 bp, Unknown
  misc_feature (1)..( 3000): cDNA_ID_2174100_gDNA_ID_1621098_Annot_ID_171202 3000 nt of promoter + ATG
tctttggttggatatgtctcaatgacaaaacatatttggatgtgtttcaacgacacaacttatttggtctataacccactgccatttatgagtctctaaattgtttatcagtttcaaaggtcactattgaattgcaaaatgaatttaacattacttttgtcaaccaatacaataaaatgcaaagcaacgtacgacagttgtttcacaaaaagaggacaacgcgtgtcaaactaatactggtgcaaatcacaaatgcaaaagagacacgtgtccccatagtattgtcttgtcttcacctgacaactccgtcctgttgccttccctcccataaagatcccaaaaaccctaaatgccaaaacccagagagaaagcaggaaaaaactaatcccaaagtagctaaccagaaatctcagtcgaatcatcatggtcgtccctctcagagctattccttcatctcgcggtactaacatctttctaaaccaaatctcaaatctcacttacactacatttgctcttttaacccaaagtttactcctttttttggtgttgattggaacagaggggttttatgcaataaacaaccagtttcaagcaaatgggccaaaagggttcatggagttcaaaatgttggagaacgaagatatgtacgttcggattgattttcccggcgttccaagagatggtgtgagggtttttcttgaccagtcgaagaaagctgtttgtatcttcgccgacgcaccaaaggaacacaaatacgactactctgaacggaactacggtacctccaccggactcgtctgcaaatgctgtgaaatctccggattcacttccttcatgtctgatggtgttcttaggcttctcctcaccaagtccaacatcactccacaacgctcctcctgcatctgtaattacctttattattcagtcacttcaatttatggaaccttttttggtaataaaaacttttgatgaatttgtgtttttctacagcgtttcttgctggcccagatttcagagaaggtactttattcgatctgtcgttttcaccaaactttctattttgatatatcgtctctcaacatttattacaaagtcttcatttttctttgggtaaaaaaaaagtcttgattttgccttcattaacgtttggaaaatcttgtcttttctaattatggtcatagatctgcgtggcaacggtcctcacaaatttccccatggcacggatcctaatggtacactcatatttcccttctccaagcttatgctatacatagcaagagtattaaataggaatcaaacactatatatagtagtatatagtagtgagattggttagtctaaatgggaatagttgttgttgttgttgtgttttatgtggagcagatccgaaattaacgggtcggatattgatgccacacccatgtgtgaactatggatcagagatggcttatgagtccaagcagcttcaaaacggtggtctatacgtgcgtgtagacatgccaggcgttcccaaagagaacttcactgtcgcagtcatgaatgggagagtgagggtgaccggtgaagctcctgccattagccacgactcaagtggacgtttctacactggtgacgttgctatgctctccactcctttcgacattcccatccgtaagatcaagatcattgctaagaacggtgtcattcgtctgatcatccctcccgtttgattccataattattaaattcgtgacatcttgtggacttctcctttagagatattatgtcgtcattttgggattaagtttttatcaactttggatatgtttcaaaaagacaatctttacgtgtgtgtctagtattagtctctaaattgttaccaatttctcaaggtctctattgatttgcattaggtaaaattacaaaaaaaattatctaagaatataaccaggagatatactaataacgtgtacaaatactatgcaacaaaacaattaagtataacttcttaaataatctttaagtgtgaaagcagataatattggacggctgtgattttggtttcaatatcagctaataatatggaccgtcagattctctttcatacatttcgtcaaaggtcaaaagtaaacatgccacgtcaggtgagaagattagatatttccatttgtagcatttccattaggtctgggcaaaatattcgttcgatccgctttgactcgctattcaatttgatttgattcgaaaaatccgaatatccgtaagattttggagcaaagcaaataggaaaatgtagtattcgtaaaaatcgaagcaaataacaaatactattttttctaaactcggatattcgcttcgaaccgtatatatatatatatatatatatatatatatatcataatataggttgtgaatttgtatatgttgggatttgggcttgtatttgtatcctttgggcatgtgtttttttttgtgacacaatttttattagataagtggaattttttaaaataaaattgtttcatattttatattttatcctaaaattgtcgttttagttttcaatccatcaaatataagagcgacgtttctgtttcctttcttcgacttttcactatttttatcactcaatttggttacataatttataacaagaaaatttctagttgctctcaatctcacactcgtaagccataaggtaagaaatttgaattatgttaaataattttttttaaaaatatttgaatatagcaaagcaaaggggatatccgacaaatatcacacaaaaatccggatattcgtatttttggatattccggaaattttcagatcaaagcaaataataaaattaagtattcgattaaaacgaatcgaataacaaatatcccaaattttccggatattcgctgcccaggcctacttcccatgcccataaagttcccgaagccactaaatgctaaaacttgctacaaatgcaaaaacccttaagcactgagaaagcttgaatctttgttggcaatg

SEQ ID NO: 6609 - DNA, 3000 bp, Unknown
  misc_feature (1)..( 3000): cDNA_ID_2174090_gDNA_ID_1621098_Annot_ID_171199 3000 nt of promoter + ATG
cctttaccagcaacaccatatcctaatctatatttgtcctcatctgcattattataacttatgactttaaatgaggtttggtttctctctcaccaatgtatcacccaatttggatgtttttaaggggtaaatttcaactaaaatgtagtccaagttattaatgttttggtagaattaatcgaaattagagacatcagaacagctaacatcaatttggattttttttttgttcgaccctaacagtaaaaaccattcatcagtgtggtaaatgtcgaaaatgtattacgattagaattgatacattcatcagtttggtcaaaaacacctatcttcgatcgatattttttttaccaaaacgaagttgatgtaaattgttggttgcaagttgagttctgaccaataaaattggtagaaattctttgaccatttgtaaattgttggttgcatgtttatactgaattaaacatttgcttcgaatattttagaccaataaaaatggtagaaatattttgatcggttgacatttttgaccgagaatagtggtcgaaaacatcttaccaaaaagtggtcaaaacttaatgaccaaaataatggtgaatattattttttaccaattttcgaccatatatttcaatctgactaacttatatacaagattggaatataagtataaatcaaaattcaatttaattcttaaatatttgattcataataacttaataaaaataaaaatataatttaaaatacacaaaaaaacaatacttttatacaagaaatcaattttaaaattatttgattaacaaattttaaaaatatttgagtttttgttttccttaacaaagttaccatgtgactaatatatctctccaatcttaagagttggagtttgaaactcttcttaacagaaaaactctttcatgaatgcggtaaatctggagctacatgtataggtatgtggaatgcatttatatcaaccttaggcacaaatagtgaatgcttcaaagcaatccaagtctttgagaacattccttccaccttgatcaaaactcactcaacattttggaacgtgatggtaacttgtacacatgctcgacaaactgagtatgggcattatcttcttgcaaggatagtcaagactctatggatagaaccaactattgaaataatggggacatatttagacggcttggctagaggaaaagtgattgatgaggcataacgagttgtcaagactttgattttcaagcctaactaggagattgctgtgagtcttttatcaaagtacaaaagccattcaacacccattgagtttgctaaacgttttgtgaggtaccttgaagagaagaaagtcaccttctacattgctggaacgacttataaggtactagacgaagatggggtggagtggaaatctaatgtcaagattaagaaacagaagaaaggaaaatccacaatccactcccattagagcagttcaaagtactatatattgctgcacagctaaatcattcgtcaaaggcatttcttaaccatgctatttgacctgaggttacgagagtaaggatataattgtattgattgttttgaaacagtgaaataaacatgaaaaagtgcagtgaaataaacatgaaaaagtgcatactcccacatatgtgccccatatgctctaacaaacttgataagtgtcatacgtagtgagatacccttatattttttttagctttttatatactattgcttacaaaccttattaatatagttaaataattagggtgggcatcggtttggattaagtaatgattttggataatgattaaaaaataattttgatttttttttcaacttcagaaaactcaatcttaacttttaaaaatgtttatgtcttttcacaactataatattttatatctataagtaaaaaacttgttagaaaacttatcttactttgataaaagattcattttgattaattatctttgttatcctgtaaattctcggttttgacattaatcactcaattccggtattttaataaattacaaaatgagttttgtgcagtgttgaagatatattctcaaatacagtaattgctttcaacccttgatttcgaaatgcctaagcttgaaatcctaagctgtccatacaccaagacctacatctccagatctctataacagtcataaaaaaacttctgcctatactttatttattagttttcatatttccatccgtttatttgcaaggcccattactgcactaggccctacattttgttagaagaggcaaagcttataagcgacattctcaatttccaactattacccttccgaactcttcacctaacacacattttctaggggtaaacgtgtcatatcgtatgcagaaacgtgatcccagcatatccggttcttctttatcctttgttggaggcaatatctacgtagacagttacctcgtacaccttcagtaaaatggacggttgagattcctatttcagtaaatagctaatatctaccgtcagattctcactgaacagattaagcatacaacgtcagctgaagtgtttagatgttaccatacaccatctgtagagaatctctgaccttatcgcataattttttaatgttttgcagaatttttgtaggttgcttatttgctttttctttcatattttttcgttaattgttgttgttatcttcaacgatagcgttgtgctctggagaagtgtttgatcgcagaaaagcttcgttctttgtagtctacaggtttgatcactgagttcttaacttcttttttggtttgattgcgatcctgtactttcgtttagattacttaaaggttgggtctttaacatgatcgactgatagatttgtgggaattttgataatctgagttccagagtttgggaattgatgatttgatttgagtgttaaatttgttttgatggttgtctgattggtgtcacctatttgttatgtgtgtgtaggcgtggaaggaatg

SEQ ID NO: 6610 - DNA, 3000 bp, Unknown; identical to SEQ ID NO: 6585
  misc_feature (1)..( 3000): cDNA_ID_2174083_gDNA_ID_1621098_Annot_ID_171195 3000 nt of promoter + ATG

SEQ ID NO: 6611 - DNA, 3000 bp, Unknown
  misc_feature (1)..( 3000): cDNA_ID_3048701_gDNA_ID_1621098_Annot_ID_171185 3000 nt of promoter + ATG
ctgtagtgctcaagacactgttctttactcttcgttcccacgtgctccgcaacctctgcccagtttcccaagccataaatttcaagtccctgaataaagacattaaaagaaattacttttcactgaaagaatcagacattatagacttcatatcagtacgataaaagaagtagtggtacctccaggagaagcatttcatcatccgcactccagtcaggacaaataagcgggaaagttagatttccctaacaaagcaaatgaaacatatattaagctttggtagaattcaaccaaaagatattttcgctaagtataatgaatcaaactctttccaaactaaaaggtaagaaaagtaaatgaaaactaaccataactcggtatgggtgatcacatttgtgaggagtgatctctgctccaacagacatacattctatacagagatcaaaatctggacagacagcacactttatcctaatttttccagtaatgtctttctggcaataatcgcagttatacttccctcctccctcagcacctggtactgtctccacaaataaaaaatgttgagtaaaagaagaatcttgacaggagaaacaaaaaaaaaaaaccttgataagtatttttttacccaaagaagtagactcaaagttctccacattagccgcatttttctttttcctcgttctgcaacaaacgcataacacgattctttcatgtcagcttcaacagtgaaaaaacaattacacagatgaaaacagagaagagactacatagctactgaaagttttcaaaagcaacaaactttaagcgatgctcattgtcccaactgaaaaatcaatgattgttgcacaaagcagatgcaaagaaacttcaaaatcaatcaatttcagcagaaattggcacaattacatagatgaagatagaggagactatagctactgaaagttatcaaaagccacaaatttgaagccatgctcattgtcccaactagagatcaatgacaattgcacaacacagactcaaagaaacttgaaattcaaatcaatttcagcacaaattggcaattacaaaagagaaatccacaaaaaccccaaatcggaaattagagtagtgaattaggaacaaacctctgagtagggtcttcgaaattttggaagttccctcgagagcgacccattgatgcccaagtagaaaattggattattgggttatgcgaaaccacagagaagaagaaccctagcgtaatgccaacatgggagactcaccggagaagatggaatgggtacttgggggggtttcgtggaagaaagatctaatcggaattcaacaaaactcggtcgaaatttgtgaggttttggatctctactaatattattcagaagttccgaccgagaagattaaaattagggaagtcgaggtaaaggaaatttctaaggcactgtactttttagattttttgggattagacggtcatgcttattactaaagcatatgacttaaactaaattgactcttataacttcaacttaaaaaactattattttttatgttaattgttgaatggtggttgagggaaaaaaaaatgaagaaaaaaaagctaagatagaccatttttattggtaattttttattattaaaataataaaaataataaaaggaaaagaaagagagtgtagaatgtttctcgttaaactatgaaatactttatacaaaccatcataatatttttctcttttcaattggttcgctaaaataaaaatttaatcatatataaaattataataaaatactaatattctttttgtttgaaaaactgtttgggtttcttcttgatggagatgtctttaatatttggttgggttatggttattcgtttttaggtattttgttcatggacattttcagtaaatgaattagcaagtaaataaacttgtataggaataaatggttagtgttgtcacacactatcggaacaacattatgatgtattttaaaatcttattgatgctaatttgaaaaattgatttggaagaaggttaagcaaggaaacaaccatataagatagtttgatgctaatttaaagtttcttattttggtcgaaaatcgaattattagaaatgtttgaaccttttttattagacatctagtgataaattttataagactcatgtcaatcgaataaaaatatcgaattgttgttttgctgaacgaataagtttgtctatattagacgcgattagttcttctaaaccacattatccaaaaaaatcgtgattgactacatggtgtaatgatacctatcataccatctcaagaatatggcatgactcatccaattaacaattgtatttgcgcataattgtaagatgtgtaaattccttttccgcttattaacggtgatttgcgataagttaattcagaagacgagtttcgattctcccatcataataggttgtactacgaaataatttcccaacatgtacacataatctcgacaaaaatccagtgatatgggtttacttgtagttgaatagatattacaccacaatgacttgtggtttggtatgtaagaaaaggcaaaagtatagtttgcagttaaaaaactgaaggaaatgatgtccttggtattaaattacgattaaacccatattctctctctcgcatagtctcttcctcttttcttctttcttcgtcaatttcagaacaagtcactacagatctgaagtgaaccaagctcaggttttgtcttctctttgatcattcctttctcagcaatataaattagagttatatcctttataaaggattttgctttttcaccaacaaaccctaaattcggtgtctcagcaagaatcacgtgattctcgttcctcttcctcacgaaacccatcatcttctatctcatttgtaagcagcgatctcaatccaaatacctttaattttatttgattccataccctaatttttgtatattccatgtcaatgaacgtttcaggagaa

SEQ ID NO: 6612 - DNA, 3000 bp, Unknown
  misc_feature (1)..( 3000): cDNA_ID_3048705_gDNA_ID_1621098_Annot_ID_171184 3000 nt of promoter + ATG
cctctgctggagttatctgattactctccctcctcttcattatctgcttctctgtttcatacaccctgattttcttctgcatatccgtgatgtaagtgattgcgtctgcaaggagcgaagccttgtccatcttggagatgttaggcaccaccgctctcaaagcgtagaatctctggttcagcttctccctcctctgccgttccgcttccacatggtttagagcctcttctcttccatttgctggttttctccctctcttcctcggcttttgctcgtcagttagatacaatgtctcatctttcccttgctcataaccatacacttgattagagcctccgatcgcttgcacctcatacgattccaatgagaaacccgtgtcatcctcggtcttcggggagaaattaatactcatagaccgaggttttgctccaccaagactcagctgtcgaccaaagattttaggagcttctttagcctgaacaaagtcagacccaccaaacactgatttcaccatctcaatcacactcttatcttctggaatatgtcttaaagaaccaagctccacaactccagaattcactggtacagacaacacagtctgaaaaccagctgacctagctaagaaagacctaaccctataataactcaagcagctaggcaaatctgcagcccaaagaggcttcccagacacataggttccagcaggaccgtacttattggtatcacacctaaaggaaaagtacaaagaagccagataaaacatgtcgagatcagtaagagctcctgatttcaccaaacgatgatcttcatctgaaccaacgaacgacaagtgaagcttgcgaagcacacgtcttttgatctcatcttgctgagagtaatcctcacctgaagcaccctttttgacacggcaatgaccatctccccagatcaagacacaaccatcagagctattaacgttggacgctagccagaaaagagcataatcccaatcagatccttcaacaacgtgacgtaacccttgttggagattggaatcacttggtggtgagacaagcttggacaaggcagtgttggaagctgaagctgttgagatgaaaaagtcgcaagcttcagagcctatggtggattcaaccatcgctcgatcttcttgattctcccaaaacttttgacccatttctcctgaaacgttcattgacatggaatatacaaaaattagggtatggaatcaaataaaattaaaggtatttggattgagatcgctgcttacaaatgagatagaagatgatgggtttcgtgaggaagaggaacgagaatcacgtgattcttgctgagacaccgaatttagggtttgttggtgaaaaagcaaaatcctttataaaggatataactctaatttatattgctgagaaaggaatgatcaaagagaagacaaaacctgagcttggttcacttcagatctgtagtgacttgttctgaaattgacgaagaaagaagaaaagaggaagagactatgcgagagagagaatatgggtttaatcgtaatttaataccaaggacatcatttccttcagttttttaactgcaaactatacttttgccttttcttacataccaaaccacaagtcattgtggtgtaatatctattcaactacaagtaaacccatatcactggatttttgtcgagattatgtgtacatgttgggaaattatttcgtagtacaacctattatgatgggagaatcgaaactcgtcttctgaattaacttatcgcaaatcaccgttaataagcggaaaaggaatttacacatcttacaattatgcgcaaatacaattgttaattggatgagtcatgccatattcttgagatggtatgataggtatcattacaccatgtagtcaatcacgatttttttggataatgtggtttagaagaactaatcgcgtctaatatagacaaacttattcgttcagcaaaacaacaattcgatatttttattcgattgacatgagtcttataaaatttatcactagatgtctaataaaaaaggttcaaacatttctaataattcgattttcgaccaaaataagaaactttaaattagcatcaaactatcttatatggttgtttccttgcttaaccttcttccaaatcaatttttcaaattagcatcaataagattttaaaatacatcataatgttgttccgatagtgtgtgacaacactaaccatttattcctatacaagtttatttacttgctaattcatttactgaaaatgtccatgaacaaaatacctaaaaacgaataaccataacccaaccaaatattaaagacatctccatcaagaagaaacccaaacagtttttcaaacaaaaagaatattagtattttattataattttatatatgattaaatttttattttagcgaaccaattgaaaagagaaaaatattatgatggtttgtataaagtatttcatagtttaacgagaaacattctacactctctttcttttccttttattatttttattattttaataataaaaaattaccaataaaaatggtctatcttagcttttttttcttcatttttttttccctcaaccaccattcaacaattaacataaaaaataatagttttttaagttgaagttataagagtcaatttagtttaagtcatatgctttagtaataagcatgaccgtctaatcccaaaaaatctaaaaagtacagtgccttagaaatttcctttacctcgacttccctaattttaatcttctcggtcggaacttctgaataatattagtagagatccaaaacctcacaaatttcgaccgagttttgttgaattccgattagatctttcttccacgaaacccccccaagtacccattccatcttctccggtgagtctcccatgttggcattacgctagggttcttcttctctgtggtttcgcataacccaataatccaattttctacttgggcatcaatg

SEQ ID NO: 6613 - DNA, 3000 bp, Unknown; identical to SEQ ID NO: 6581
  misc_feature (1)..( 3000): cDNA_ID_3048711_gDNA_ID_1621098_Annot_ID_171178 3000 nt of promoter + ATG

SEQ ID NO: 6614 - DNA, 3000 bp, Unknown
  misc_feature (1)..( 3000): cDNA_ID_2174046_gDNA_ID_1621098_Annot_ID_171175 3000 nt of promoter + ATG
gccggcaagttcagcagtgtcatttgtaggtgcgggggaaccacaggcggttctttagagtagtcctcagctccgagaagcaagttgctgtaactattctctggagattgcggagggtcaaacccagatatgctttgaatgtcttcaggaacatagtcctgcataacatcaaagtatctctgctgttttcacacgggaaaatcggaaaaggaactacaaagcctggttttttaacttgctaatcaacatagatgtctttcccattccctataaccctgatttagcagttccagtagtctctcattaaccgtttcatttctccaccaaccaactaaccaattcgaaagagaatggagttacctgaagatccaaaatgttgaaagtgttcccagcatcatctctagctaaggggagctcaggggcatgcctccactgtccatccacaatgaacctgtactcatagactcctgaaggtaacactttcatgatagtgaagtccttcccagatctctgcagccgacttctgatcaaaccccccaaaacaacaaacaacaaagatgagctcagatttgaaatgatgaaagaagccattaaatcaaaacaaacattcagctaaaaaccttgtcttccaattatcccatgatccctccacagcaatctccttgcctccatgacaccaagtgatcatcgtagggattccttgttcgttagaagcttcttcatacaacgaagatggcgattgcatccacgaaggattagggatatgaatttcatcaggtctttgaagtggaagcaccggaacctaaaaaaagacacaaactttaaaagctacagatctctctctttcatcacatcctccagattaagacatcgaatctgaaaccaaaacaaaaacctgaggagcaaacatgagaggagactgagtagctcgagggctatgaggaggagattgacccataagctcaggaggagcgacatggttaccatcagaagcagcagacatagcttcacgaggaacaaatctcagcgtcttcgtctttcaacagcagaagcgttgttactatttcggttttcttttggcgttcacgttacccatatcacacaaacaaaagcgataaaatctaatctcaatctcttccttattaaaaactctttttttttaccgcaatctgagaaaaaagaggaaacttctcaccagatctcaccacaaattcatcacttacacaacatactcgattacaaggacatgcccgggtttaaagattggtgctttttcccgtagaaattgatcaaaaagagtagtagggacggagaaattgagggcaaatttataaaaagccttcctgagagatcagaaactacaaacaaaaaaagcaggaaagagaaaacgaaaaaaaaaggaccaatctttgattcaactgaagcaagactctctactctcacacaaatttcttgctgttgttgtttgtcatagcatcaattgttgttgttcccataccactctccatcttcccccactcacattttctgctctctctttactttcatctctttgttttttctttattgcatttattaccctatagtttgatttggttgaatttaccccccaacaccccacatttggtctcagtctaatcagtggtaggcacatcaatggtcatcattctcaccaattattagatagatgttgtattcaattcattaactcactcgtttggtaatgctctatgtttcaaaagatgtaaactttgaagtggccagatttatgtttttgtggtcaatgtctttcttttcccaccagttgagtttatggctatatcaagttttctgttttggttgatatttgttttccaccactcaactattcctcatagatgatggaaacatataacaaccaagataagagatagagatagagaaggaaataatccttgagtacatatagagagagcctagcctagttagttaatatctgtgattcagagtggaagtgagattgtgatggtcttgcagtataagcctgtgctgacttgggaacacttatttcaaactaatcccaacaaaacaaacaataaaatttacatcataaagttgaatggtatgttgtttggtatataaaaaaagaggaagcaaatttaacatctttaccattcacttttgattggttcgtcttcagaatccagagacttttgttggtttggccgtatcaactagaaaaattgaacctcttatatgcgagaagtcgcttgtgttcttggaaccaacatttatcttttgtctcgtcaggtttacaaagcgcttcttggaagctgactcaacagcttgctgttaaataattacaaaggacctgtgaggaggaagaggtcaaaaagaagaaacagagaagatcaacaaagtttgacattgaaaaacatagatagttggtggtcagaagggctggattcattctttgccaaagcgtatcaacttcaccttcaggcttgttttgtgaatgttattccctaaaacagactttttttggtcttctgaatcttgttagttatgatgaatgaatcatagtatctcccttttcctctctctctcgaaatgtcaacttgttagagtggtcaccaactaagagttgacttatttacgccaacgaacttgtagatcctttcccatgtctctgtagccaacaaaaacttttatggagagagagaaatatcagatcgtggtcaaaaaaataaacactcttggaacaagtcgtgatctgaagcttctttacacgctaacgagaaaaaaagaataggtatattgctttggttcatcttcttctcttctctcaaaaaagtcaagactagattcatttgatgtctccattggatcggcaaatttatgttcgattcttgattttttttcttgatgccatatgtttagagggtttctgttgacattcaatggatttaaccttttttctgtttgtggtaggcatggacatagtgacttttgggagagatg

SEQ ID NO: 6615 - DNA, 3000 bp, Unknown
  misc_feature (1)..( 3000): cDNA_ID_2174042_gDNA_ID_1621098_Annot_ID_171174 3000 nt of promoter + ATG
cttgggaacacttatttcaaactaatcccaacaaaacaaacaataaaatttacatcataaagttgaatggtatgttgtttggtatataaaaaaagaggaagcaaatttaacatctttaccattcacttttgattggttcgtcttcagaatccagagacttttgttggtttggccgtatcaactagaaaaattgaacctcttatatgcgagaagtcgcttgtgttcttggaaccaacatttatcttttgtctcgtcaggtttacaaagcgcttcttggaagctgactcaacagcttgctgttaaataattacaaaggacctgtgaggaggaagaggtcaaaaagaagaaacagagaagatcaacaaagtttgacattgaaaaacatagatagttggtggtcagaagggctggattcattctttgccaaagcgtatcaacttcaccttcaggcttgttttgtgaatgttattccctaaaacagactttttttggtcttctgaatcttgttagttatgatgaatgaatcatagtatctcccttttcctctctctctcgaaatgtcaacttgttagagtggtcaccaactaagagttgacttatttacgccaacgaacttgtagatcctttcccatgtctctgtagccaacaaaaacttttatggagagagagaaatatcagatcgtggtcaaaaaaataaacactcttggaacaagtcgtgatctgaagcttctttacacgctaacgagaaaaaaagaataggtatattgctttggttcatcttcttctcttctctcaaaaaagtcaagactagattcatttgatgtctccattggatcggcaaatttatgttcgattcttgattttttttcttgatgccatatgtttagagggtttctgttgacattcaatggatttaaccttttttctgtttgtggtaggcatggacatagtgacttttgggagagatgatgatgcaatgtttagatggattaaagcacttagccttaattctgttgacttgttgtgatgctgatcctcccaaggttcgtcagaaccctaaggatgtggctagaggcactgtgtgtatgtgtctacccctacatttacttttactatttttatttgtcacaaccccaacaatggctttatgtaccaaatgcagttacagtgaatgagattgaagctctttacgaactgttcaagagcattagcaaaaacgggcttatcgacaaggtatgcaagaatccatagtcggacacgagtactatatctctctgttcctctacattcactaggatcctttcaaatatattgcaggaacaatttcaattggtactattcaaaatgaacacaacgagaagcctttttgctgatagggtaaattagatagacttgtaactcacttatatgagtttccttgctgtacactcatacttcaagctttgcaggtgtttgacttgtttgataccaagaatactgggattctagattttgaagcctttgctcgttcactttcggtctttcaccctaatgctaaatttgaggataagattgagtgtaagtggtcgagagagacttgaccttctttttttttgtcatatccaaaccttggatcaagctcatcttttgtctctgcagtctctttcaagctgtatgatctgaatcagcaaggttatataaagagacaggaggtgaagcaaatggttgtgcggactctagctgaatctggcatgaacctttctgatcatgtgattgagagcatcatagacaaggtgggtttggttgatctcctccattgacactaactaggattctcatatttaatctttgacaagagatgtaaaaactgattggtgtgtgtagacatttgaagaagctgatactaaactggacgggaagattgataaggaagagtggaggagtcttgtgttgcgccacccctctctgttacagaacatgagccttcaacatctcaagtaagctagccatgttatttgccttattatcttcttcgtgcgggactaacatgtttttgtatgttgtgttttgtgtagagacgtaacaaagacgtttccaaattttgtatttcacactatagtgacagacactcctagtgagctggatggatgatcagggatgtgaagaaagaccaaaaccctttacaagatcattcatacttgattcttatcttcttctccattactctattacaaccctcctctttatttttaataaatacgttctgaaagcagcattacctcacatgtttgtgtatccgcaaacttgttcggtttatcttatctgttggagtgtgcaaattgattcttttactcggcattagttttattttgttgcttcttctttctttctatctaaatttgttagttggagtaaaatccggacaaccatattttacagggaacccaaatggcgagatagttttaacatgagaaaggaaagattcatgtgaatgagaaactggttaacttgaatctcatagatcattgtatacttggacattttcccaagattagaacaaacaatactagatctctcgaaaatatcttcatcacagttgcaaagagccgtggagaacccaactcttgagctcaaaattgtatcagctagtgacgtcaaccatatcgaatatgtcacggacaaaatggacgtatacgccgtcgtttcaatcaaagacaacacaactcaacagcaacaagcggccaaaactcccattgatatataacggaggttctaatccgacttggaatcacacaccgttaagttctccgtcaacgagagagaagccacgaagcccaataattatgttaaccagtgtaacgttttttcacccacttaattttttggctgggtctgcctaacattctaggcacaagttaaagaggtgatcaatttttagaaattataaccctaatgctaacatgaatgatatataaaaaggccgcaatggtagactataatggcaacaactctgaaacaatg

SEQ ID NO: 6616 - DNA, 3000 bp, Unknown
  misc_feature (1)..( 3000): cDNA_ID_1814911_gDNA_ID_1621098_Annot_ID_55787 3000 nt of promoter + ATG
ccagactcataaaggagccccaagctcttgagattgatcgcagaggcagaactccaaggaacgaggcctagacaaccacaatcccacaaatgaacacattgagatttaagaactaatggccactgaagttgaagagaacaagagcaaaaagagttatactttgatatctgggtggaactcaagttcgattcccttctcccgtttctcttcgatctgtgtatcagccagtagaaaacgatgctaagaagaagtaccaaactctatgtaaagaaccttgccattgtggagttactacttactacattaccttcttgtcttcatagaggcggcgagcatgaagagctccaagcataaggatagtagccattgttgctccgggcacaagaaaagcattgcctacattgagtgaaacaatgattcaagctcaaaaccatagaatcgatctaattgcaatctgattggaacttcacaaagtgtttcctacagaacaaaatgctcaaaacttaaacttagaatcttttcaactgtaatctaactatgtaaaggagcttttcgaagcatatatatatatgaattacctttggaatctccggttccacctcctccggctccggctccggctccgctgctgccgccgagaggcgaagcacgagcaccggaataattcgaacggatattgttgaggaaagagctgaaggttcgacgttgactatgctgaaagcggcggagatatgaatagcgagccaaaaaatagacattttgaggaaaacgaggtttcatggcgtttttccggtggcagtgacaccgcttttgctctggggttttagggttgtttgttgactgtttgagtaaactaacaatttttcaacgacaggttaaacgacagcgtttactcctcttgacttgttgactacgttctttctgcgctgacattttatcccaattgggcctttttagctcttttatagcccaccatccttttttttggacagcagcccaccagacatttttttttgtcgaacccgaaacagagtagtttgccgtcgatgatcatcaacagtggagtgtaagcagagaaattacgccatagatcggagcgattttggagcatcgccgaagctaaagaggaattggaggtttctgtagatcggaaaacacttgttgttctctctctcgattcatcccaaagcaagattcttggatctgcctcttaagatcgatcggtgcttttgtatcctcaggtatgtgttgatacttgatcgtatctatctacagagattaatcgtatcgtagtctgatttggtagatttggaattgggaatcgagaagtttaaaaatggaggaggatagagagaatgcaaagagagtagtgtttgtaactgtaggaacaacgagtttcgatgctcttgtgaaagcagtggttagtcaaaatgttaaagacgaactgcagaagagaggatttactcatcttcttattcaaatgggtcgaggaatctttttcccaactaaggttcttcttaatcatcttctccactcacacttctttacttgattgagatttgattatgaaaattggtgtacacacacaagagatgttgttctactcttctcttggtgtacacacacaagagatgcttctcatttgtgttttttttttttccattactgatctcagtgtgatggagcggatggatcattagttgtggattacttcacattttcctcaagtatcgctgattatattcgatctgcatctcttgttattagtcacgctggttagttattgcaatagttgagcacttttacatttaatagaatcaaaaccagagacacattttcgaaatgctaggatataatgttgttgactctcactgatgtaggatctggaagtatatttgagacactgaaactagggaaaccattgattgtggtagtgaacgaagatctgatggacaatcatcaatgtgaattagctgaagcacttgaagagaggaagcacttgtactacactcgtcctcactcccttcatcaaaccttgacgaaaatggagttggggtctctggttcagtatactccaggtgatggaactcctgttgctcgcattatcgacaggttccttggattccctgatgattaaacacaacacatacatgaaaacaagtgtttagtttccaaatacaacataatatgcagtaactggtgcttttgccagtagacattgtgtcaaagatatccatcataatagcaaagcttttttctaacgtttgacagaggataatcaattttgctcagtctgtatcatttcaaacataataccaaagaatatttaataatcagatcatcttaattttattaacaaccaagtgtaaacacttagatatttgcagaaaataactactaataatctcttagaactggacatttatgttttgtatttaagttagaaataaatgctattttttattgttactgggatttggattgcaaaggggcctcgatatattccaaaaccagactgagatcaacaaaaaagcaaagcaaatataaaatttaggttcaaagcataattgtatagtctccaaaatttgcaaaaacaagtcatcctgagagagataaaagtgcaacaacatggaacctagaagatgataacagtaataataaaagcaaaaggcaatcaacggtaacgacgaaggctgagagagttgtttttcttccatgtagccctgcgagatggacggttcttgtggttgttgtgaccctttccgcggagacctctgttcttctttccctctgaggtaagtcctctgagctcacggtgcttgtgaactgggttgcagatccagttgattctcgggtcattacgcacagcattgtgtgctgggtcaaccaagatgatctcgtagtacttgtaggtcgaatcctattaaagaaaaatggacaagttaaaatatctaaccagaataatcacctaaacgaaagagtactgaaagaaggtagtaa

SEQ ID NO: 6617 - DNA, 3000 bp, Unknown
  misc_feature (1)..( 3000): cDNA_ID_1814907_gDNA_ID_1621098_Annot_ID_55788 3000 nt of promoter + ATG
aactggacacaaaccaagtttcgaagaatacatgcaaaacggtgtgatctcgagttctgtcccaacgatactgctccaccttttctccgtcctatccgaccacatctccgaccaaaccctaaccgatgattccaaaaaccactctgtcgtccggagctgtgccaccattctccgtctcgctaatgatcttgccacctcaacggtacacaatttactcgttaattagtttcttttattcttctagcccaaaacatgttcaacatatccaaatattattagtgatgaatgatatataccatttatttatgtttcacgttttgaaaaatgtgattcctttatattatttaccattcagaacattaaataatttccacgttttagaatatgatttagctatttataatacatattttaaaatatataaattcatttatttacaatagtcagcttttcagtgttaatcttgagatatcattaggttttaacactaatttgttgacaaaaaaaaactactcatagtttcatgtataaatgattcaatttttccccacacaaaaaaaataaaaataaaatcatgaaaacactaaattataatgactcacaggaggagatggcaagaggagattccccaaagtcggtccaatgttacatgtatgagacaagagcaagtgaggaagaggcacgtagacacatgcaaagtatgatcagcgactcttgggacattataaactccgatttaaaaacggcacacacttcttctcttcctcgtggttttctggcagccgccgcaaatcttaaccgcgtggtacagtgtatctaccggcacggtgatggccacggaagcccagaaaagaccaagaccgttgattatatccaatcagtactcttcaatcccgttccgttataggattgtaaatttgtatttgccgcattatagatatgtttacataattaaaaggtatttggtttgccggaaaaatgatcattttattttccaaactatttgtaattaacacaattattttttaattatatgtgcgcaaaattgatttttaatttgtcgttaacttaacaatttggtccaaaatttgatcaatgtttactagttgatatagaaacgttaaattactcgattaaaacctaataaactcaaaaaatcctaaaatttctcccaaattgaaagctaagtcattacttcgaataaaaaaaaaaaatcttcatctattcatcgtacttcgccaaaatatgcgaattcgattttattatttagctgaaattcatttattactattttctgcatggcaatgtttcgttaattttttactttcaattttattgtaattttaattcaaattataatatatgtacataatttaacaatgtgtttgataactttctctaaaattgttgtcatttattatttatacatagatatcaggaccggtttagagtgtgtgccaagtgccaatggtgcatttgtactgtttaagcaatcatggtcctattttctcaaaaatatataataaatgtccaaatccatacataagatataaacatgttttttataattagatacagggttctatttttctctgagtcggccctgatagatacatactatcagattaggcagaggtatggactatggagtaatttatgggggcacatccatccgttggtatgatcaaaatttagtataagtcttcagaaagtattttttagatgggatgaatttgcctctctattatcccaagattgaatccccatttccttcagaagcagtaaatacaaattaaactactgagctacaaattcgcgtaaagctacatgtgtatttttaatctcaaagttgctgtaattatgaaatgtgaacgaaatagaagtgacaggagcttgagtgccccatgagataagaacttatagatgtatattaatttaaactgtactgtctaaacctagacaacgccgtgacgtctttgcccacatgtgattattcgttaccacctctcttagtgtggtccaacaaaattggcctctcagttttcattgaaggcagggatagagatatacaggtagtcacatggacaccgaatcgatatttattccttggaatttcattaaggtttttcgaaccaagacaagacaagctatgcatgaaaccatttgccatgccattaacgtggactaagggtggacactgatctatctcgtacttgttattaataaaaacaaccgatttgtttttgtttttgttattatatctcctactttttgttataccatgcatgtccacacgtttttttcaatttgttacatgtccacaactttcacaaatatttttaccaaaaaaacaaaaaaaagtttgacaaatatctttagattttttttttgggcaattagtgacaaagcaagggacgttgaaagcaagaaacgtaaatgtttggatatcacaccacaccaatatgttttagccattacttctccaagtttttttgttgtgtgggaataatacttctccaagatatttaagaaaacgcaaatgcatggtcattgaattatatagcgagaaaacgtcaaaaactaaactgattaaaacagatattcttttagtaaaacagaaaaaataaaaatatcttcatatatataacctgtggtccgagacccaaaccttaaatcagtataaaatatcatagcggagtctaaagaagagttcatccaattatttaactctttagtgtaatcattagcaacgcaaagaaatgcctaaacgacaggctcaacggcgtttcactcgcaagactgactcgaaaacaccatcccagcctctggtatcccgtcgctctgcaaactatcaaccgtctctttggcagcacgaatatctcctctcgctcggtaatacatatgtggtacgtataagaatgtacatgacgttgtattaaataaaattatgtgacatatattactatttaggaaattatatatagtgataatatttatatc

SEQ ID NO: 6618 - DNA, 3000 bp, Unknown
  misc_feature (1)..( 3000): cDNA_ID_1814899_gDNA_ID_1621098_Annot_ID_55790 3000 nt of promoter + ATG
ttattttggttgtctcatgttataaacttttgagtttgactgttttcatccatcatgctgggggtgatttgtgataactagaaagtttttgtcttttattggaaaaacaaaaaaagatgatttgtcaatttcttgcctcaggtttccaccggtccgggccagagattatttccacgagcgattcagtcaaaccctcgcctcgtactccggttccgactaaaatatatgagaactgagaagctccaggttttctaaataagacatgtgtcaaatgtttgagtttcacttttgcgtggacatgaaatagctattataaaccaaaaggtgataaaacacttaaaacagtataatgtaattaggtgtattttcgattgataaatgtattaattgtagactatgatcccgtataaatttcaaatagtgtgttcatgacttgtcttgcttttcataagaattcctcaagtgtgatgaaatgccactatcaatgtatgaacattcccagctaattgataatggatatcgaacaatgattactctttgttgaagctggatgatgtacaaggagcagagaagatatatgaagagtggaaaccggaaggaccaaagctggatatgagcataccgagtttgctgaaggcatggaaatgaagattcaccaaatggtaaagtctgttagaaagaagaggtatgagatgcattttaagaagataaaagaacgtttgatctctataaggggggttgatttttggcatgggattaaaggttgagcaaatagtaaagtcgattagacaaaagaagttgaaagaacctttgaaattactggaggcgagggaagcaaacgttatggaaatggtaatgttcattaagaagaagaggtttgggatgcatttacacaaagttaaaagactctttgatcaaacttgggcagattattatggtggtggggttgattgttgcagttttagtaatcattgttggtggtctagtactcgatgtagcttggaatgagttgctcattcagcagcatctctccccacatcatatttcgaggtgcggattttaagcgacaatcctatcttatattatttttgttcgttcgtaaataggtttgagttttcacttgtcgccgagatattagttcatctatttcacttttctccgaaaaagtttctgtaacaaaagtcaaaagaaaatacatatatacaaagatatgagttctccagacaattttagtattttgttcgtatgatgatatggatgatattcaccttatttagggttgccacgttacgtttattacagttactgttgcttaaccatcggttacgattataatttttaatcgtaaccttaccactacatatagggtaaaataattactgttaattacgataataattatttgatgattacaatacggttaatattagaggcgagatcttacaaattaccttacttttaatactacttttattaaaatgaaaaagtatgttataaaccaattttcttcatttcgagcagtatacattacaacatatttagtggagaaaatacctgttttctaatgtagattttttcattgacggtatcaattatttttctgaaaatctctgtctgaacattcaatatatatttttgcattatatgcagttacaatgatattgttaaagtttttaactgcgattgatagtgcggttaactgttcggttaccatatagttaactaacggttttgatacatttacaaaaaaaattttttaaccgaactaatttatttttacagttaactgtttttatagttaaaagttacaaaattttaccagtttatatggttacggttgagaaactgtccgattaaaatcggaaatcacggttattgattagcttttggtcatgccttattgcttatgaccaatgtgggcttaatctgtgatgtgagattgaatgagcccattaaaccccacttctaaattggcaaatattttatattttaatttccaccaaattcataattgcaagcaccgtcgtatggtccatattgttggaatctcatctttgatcaatcctggcacaagagaaataagtgagagtataaagagggttagtagttgcagaaggatgtaacgaagaagagaatcaaagagagaagaagaagaagaagtaacgaagaggatgaagacgaaaagaaagaaggaaaaaggacattgggccataaattgtctaaagcccaattacagtgggtttcggtagttaaggtaaagtttagttaatgttttaagtggacttgagttgtgtcttaattaggtcaaaactgaagtagtatatatattccgatgtaatgatcttatcaattaaggaaagtaaggaagttaaaaaggcttaagcgggcaaggagaatttcaacacatatcagtcagaacgatcagaggcagagcaaattcaatttcgaaacagtgactattacgagaagcgaaatggatacgtcgcttcttcttccgatcatcgatctttcttcgccggaaaaaatctccactactcaattgattcgtcaggttcgtctcctgcttctactagtgtagaaacattgcttctcctgcttctactagtgataggattttagggaattcaattttcattttcacttgttttttcgccgataggtaagtgacgatgatgatagaactagtacctgtagcatcaattgacgaagattggtttatcttttttttttttgttgaatcgctctaattggcgttttaagattttgagtatctcaatttatggtctgtgttatttatttggaggaggtctttgtgtatagacaatctttgtttgagatatgtctctatgattgctggtgaactgtttgcttttgttacgtatgtaaggcagtcttgaacatggattcttctatgtcaggatcatgatccggaagaattaattggaaggggtttttaaggagagcaaaggcttctttaatctcccattagaggaaaagatg

SEQ ID NO: 6619 - DNA, 3000 bp, Unknown; identical to SEQ ID NO: 6598
  misc_feature (1)..( 3000): cDNA_ID_1808227_gDNA_ID_1621098_Annot_ID_55791 3000 nt of promoter + ATG

SEQ ID NO: 6620 - DNA, 3000 bp, Unknown
  misc_feature (1)..( 3000): cDNA_ID_2993912_gDNA_ID_1621099_Annot_ID_55792 3000 nt of promoter + ATG
cttctatttaaaaaaaatatagacaaaagtttttaaagtaaatttaagtaaactaataagatctacgaattgtgaaggtttatagaattaaatctcaaaattaatttataatcttttggataatttatactttatttaatagagttacatcggagttttcttcgaatatgatataaaacttctaacaatatttctatataaattttgcaattttaaactaccaacttcataataataaagtatcggaagatacatcttttcctaataatttaacaaaacaaagtttactcaaatctcaactacacacgttttcgaatttaacattgcgtatcaaattcgtcgaatcgtcaactaattctagagtaaacaagatcattggcaatactcttaaggaaaaatggatccatttgattatgttacaagtgataagagttttgaactcgttttgtgtcaaatgttccggtctccaatatgtaaaagtggaaggtttctcatgcttctcttttgtttgttccaatcttcttcctagtattgccatggaaaacatcaaccatatcgtcaaaatgacccgttaaataactaaatattgtaaaaactatttttaagttttcctttcatttcatggtaacaaatatatattttccagttatttctgtttaaagaaagtttcatttgagatctgattggtgggaaatagaagaaaaaaaactcaatctgattttaaacctttaaaagcataattcggttgatttttattttattttattctgattgatagaaactggaaagtaagatgaattggacattaaaaaaaaaaaaaatccctttaaatttgagctaattatagcaactagtcagatccttcttttttttctttgaacagaaaaagaatcgccaaaaaaagaaaaagatgtacttatttagcgaaaatatttttcgtagtaaaaaaacttctttcaatatctttgcttgaatgtgaccatttctattgcacatacaaaaaaacgactataaaaaggacccacagtgattatgaaaatcagattgacgaaaagtttgtgtgtctgattccaatcatattgatccaattcattcatcatattcgatggttgtcaaagcatatagctggattaagtggggcacaacactgaaaacgtttctcaaccgtatgatgtcatttcagcctttggttttctcaacgtttaatcggtgaccgtcaatttcttttcaatctctataatcatttcttcttttggcgtgtcactgggaccttcactgtcaatgctgaattaatctcctttaaggatttgaaggcaagaaaaatcttgttgcaactaataaaaggaatcgattttgatgctcattaatcgacctttatgaccaaaatgggtctatatgaaataattatatgatttgacaagtaaccatttgatttacaaattattcaacgatttagcattacaaaaacatctaaccatgcttaatgtatgatgttattcattttaaaaagtcgaatgaaacccatgtttatctcaatgcatgatttaataattttattatacatgcacataattctacatttttaattaattttattagtttaataataataattaattttctttttttacacttgttataggtgagaaatgaaagttatcataatacaaaacatcagtttttataaaaccaaataaaactcaaaaatcattcagacaaataagtttatggacttatggtatatgatgatactctctcaacatcctcattaacatcatcactattaagttaacaaaaagaaaaagaaaacatcattataagttattaataagtttaaatagtagtattttatattctggtacaatgtactgtttttggtcattaagtggttcaacgacaaaagtaaaactcatgcggtcgacccatgcgttagaagaagaaaatctgaaaagaagtttgaattctttaattttttcataaaaagaagtttgaattcaattcaaccgtttttgtttagttcttctttaattaactttatcactaatgtttaaaagtaaaaggtttttaaagtgtgcaacaagcgtgactctttggcctttagagtcatcaagaagggtaatcattttttttactctttctcgacaatagcaatcaaattatcattcccacttttaataatctcataaaataaagtcaatcatagttaaaatttgataaattccatggaaatgataaaaatttgattttactattgttggatgtgcaattgttcatggtaacttactaatttatatgctttattagttgcagatagtgatatatatcgaaaaatgaaagatctaattccaataattgtcaaagaggatttctaaatttctgtttgactaggtcatatattctcacgactcaacgatctaaccaatcacctacaacagaaaatttggttgaaataaaacgaaaagtgataagtccaaatgtttaaaacaaaaaaaaagtaaacaaaaggcaaaataagataactacgattagattttgttctcgccttatgaatatcctaaaaattatctattagtgatagtttgataatcatctttgactgagaaaattgatgtcacataaacattaatatagtatcaacattaatcattaatgatgcgactataattattattttatcacaatttcttagatttgataatttgtttaggtttgagagagttatatagagggggacaaagaagcaaagtttgtgattataaaattatttccattgaactaaagttttcaatagtttattcttgactttaataataataactattttgcccccagctagtcacatactcatgattgcaaaatctctctctctctctgcctctctatatattaacctttcttcttcctttactttctcatcttctatctctcaaaagaaaagcagacaactttatttgcaaaaacagagtttttttttcttatcttgagaaagttcaacagaag

SEQ ID NO: 6621 - DNA, 3000 bp, Unknown
  misc_feature (1)..( 3000): cDNA_ID_1815129_gDNA_ID_1621099_Annot_ID_55794 3000 nt of promoter + ATG
cgtttttgtgaatttgttgctgaaatttctggacatttagctagggttttgagtttgaatttctctcttaatattctgtagcaggaagatggatactccgattcaacatctcccatttccggtgagtcattaataactaggtttagttaatatctctcttaagcggccttttgttgcagtttctaggttttttctaacattttttattttgggtatttgttacagaaccaccagatattacgaattggtttcccagttatgtatatgaatcgttaccattgtcttcttcaatcaatgaaattgaaatcgaagtagatgtggtcaacaaagcaaatcctggtggtgttattgatgaatcacttccttctggtagactctcttttggatgattattgtgaatgtatgtgctattgatggatttgtttgtaactttaatctggtttggtccatttccttctcagaacctcctgatttaggtaaatggttttcgagctatgtctatgaatcgccgttgctggatacaagtgatggacttgaattgtctgttcctggagaaagtgaatgtgtaaaggagacccaaacagaaaatgagtcaccaaaaattgaaggaaatgatgtttgtccgaggttattagagcaagaacttgtctcttctacaaaggtattgcttcctatgccgtagttacatcagtaaattttcttaactcttatgcctgctcatgaattagtctccttgcaggttacagatttctctgagtcgcagtctgttctttcgggtgagtaaaaggcacttgtttgtatatgttagtgatgtttgctttcttttaatgtgttattaaagtgactcaggtttatagttagaacggccagagctgaatcttacatgttttgtttcttgttctatcagagcctcctgatctcagaaactggttttcaagctatgagtatcaatctcctcagctttcagacattcaagaatttggatttttatattctgagaaagatgagttaatcattgaggagagtgacactgaggagggaattagttccggtatatttcgaaaaattaagagcaggcaagagactgttggtcttggcaggttagattcaaatgactacaaggaaaacatagccacagacacagtaagttatgttcttgtcattactgcactttaaagtctacaagcttgccacaacatccgtagtctaaagaaagaaacttgtgtggatcactattaaatgagatgaaatccagttttcacttttcagttattttcaatggcacaattttgtgttgactttagattctgttagttcccactgactctttctcgattctacattttaggccaaggaggtttctttagacaatgcagtttcagaccaaaaaatggaaaagaggtcatcagttagattgttaaatgcctcaaagaaagatgtgaaacaagaatcaagcttcaagcaggaaccattattatgtgaactacaagaagaagcaaggtttagccccagagtttccagatacaacccaaaactcaaatcaccttcgaagaacgacacttctttacatgagttgagaccaatacatattcaagaatccatctccatgaactccaacagacaaaagtctcctccaatagaacaagaatcatatgacaaggaaaatgttcacggacaaagcaatcaaactggatttgtgacgatgaaaaaggcaagtttcagagaagcaagagaccaatgttccctgaagaaaccaaatacagaagttctggtgaagtgttcgagtagtaaagagttgaagacaaaagctggggaggataacacagaagaaagagagaaaaagagaagagttttgggagaaatgtcaaatcaactgtcctccgttgctaaagagatcgcaggaaaatggcgctgcccgcaaaagaacaaaaggaagatagttccaccattgaagcagcttcgacttgacgcatggatacacaaagtctgagtctttgagtagtctactcttcaccaacaatgtaatttgcattctttcccctctcttttgtatatcatctacatgttaatgaataatgaagttgagctgatatctaaaccgatattttttagagtgaagaaaccccgtgttcactaaatggaaccggaattgaaaatgagcctagatttggaaccggttatgtcccggtacagcatttatgtttcagataacaaagaagagttttttcggacagagcaaatcttttaaagcaaaaaggaacgctttttatttttaataatcgaaacttgggtcagagacggtgaagatgagcttcgtcaagtatctccgccgagacaatttgctccagttagctggaaaaccatctcttagccgaaattacatactccagacctgtcggactctcatcattgaaacctctccacctgaatttgtcaagcttaatcgtctatctggttccgattccggtaatttcacatttccttaagagtgatctatagcagttcgctcagtctcttagggtcgtttataccttgattttgttgtttaattgtgttcgactttgcaaactgattcttgctttactgatgatttgttagtttttttttcactggatttgcttctctcagtcatgtcatttttctcttttctttagttacttgcatggctttaaatttgttctgatcttgaagtgttttgcacattttgtttaagaacatgagttttttttatcaggggatttgaaaatgtgtcaccgtggttcttaatatacttgcttgtttactaatgactcaaactcaaaacagtatcatctgatcaatttatgatcttttaatgttttgaagctttttgaatgtacatcaacatctgttatcaacgtgtttgaacaaaccgatgctaagggaacgttacaataatgctgcttgtgtttatgatttaaaggtataatcgaggtcaatctagataggcctgtcaccaaaaatgctattaataaggagatg

SEQ ID NO: 6622 - DNA, 3000 bp, Unknown
  misc_feature (1)..( 3000): cDNA_ID_1815121_gDNA_ID_1621099_Annot_ID_55798 3000 nt of promoter + ATG
agtctcatcacacaattgtttgcaatgcggttctaacatttatccacttcatattttttttatataaaaattgtttatacgtttccaacacgtaaacacttctcattgtacattttcttttttttttttgctataatgactgaaaccatgcatgaaaagtcttctaaatagaatcgaactaaaagaaaaattacacttaaaaaaacaaattgcaatattttttggttttatttggtttaaaactatgtatgatctagaaaaaaaatattatgagcctaaagtgaattattctgattctatataaatacaaacggtaagtattaagttagaaaactaaatagtcttatgtatacaaatctcttcataattcattaaatatattgtaaattgtaatgagtattttcatatacatagactgatagaagcactttatcgttaaaattgcaaaataaaagtagttataagtgggcataaatgaccaaaatttgctaaaatagattgtttttttttttttttttttggtaggggacactggacagggagataatccaataatgaaatataaacttttgtttagatatgccgtcggtttaagtattctgataatcaccaccgtttttttgcctattccaaatttccacacattttattttcatttcttaatatttatttccttatcatttctttctctcaccaaccaacaagttctcctttctacccatttcgtctccttcattttgacgttttctttagatctgttaataatcccatccatggcttggtctagtcactagtggtgttatctctctgtgtggaataaaaagcaaggttttttaatcacttggattgttttaagatatggcaactttgaacccttttgatttgttggatgatgatgctgaggatccaagccagctcgctgttgccatcgagaagattgataagtccaagaaatctggacaggtttcgagcttgcctgctaagtcagctcctaagcttccatcgaagccacttcctcctgctcaagccggtgaggtttcttctcataaatcaatatttaatcagaaaaattcgatctttattactggagtaagctgtctgtgttattgtttggattctcttgattattcatggagttgtgttttgtcggttgaatgattgagattagtgtatgattagttttgatgctgttgactagtgagagaggcaaggagtgatgctccacgtggtggtggaggccgtggaggatttaaccgtggtcgtggtggttacaaccgtgatgatggtaacaatggatattcagggggatacactaaaccctcaggtgaaggagatgtttcaaagtcttcttacgagaggcgtggcggtggtggtgctcctcgtggttccttccgtggtgaaggtggtggacctggtggtggtcgtcgtggtggattcagcaatgagggtggtgatggggaacgtcctcgaagggcctttgagcgtcgtagtggaactggcagagggtcagtcttattctgttgttgcataatctgccattgaaatgactgtgtcaatctcataagttggagtttatcttttggataggagtgacttcaagcgtgacggatctggtcgtgggaattggggaactccaggggaagagatagctgcgtatgtaattgtttatggtttattgcatttgtttaaaaaagtatgtattaatgtgattgtgattgggaatttggactaaaagaagttttctctggattttaagtgagactgaagcagtagctggtgttgagactgagaaggatgttggagagaagccagctgttgatgatgtagctgctgatgctaacaaggaggatactgttgttgaggagaaagagcctgaggataaggtaaacagagaatagaatagaaatgctaggctcctctttactatactggtatcagttttttttattttcacttattgtttattgacttgtgtttctacaggaaatgactcttgatgagtatgagaaaatactcgaggagaagaaaaaggcacttcaatcattaactacctctgagaggaaagttgatacgaaagtgtttgaatcaatgcaacaactgtcaaacaagaagtctaatgatgaaatcttcatcaagctggtaagacatatcatgtatcatttcttcattgtcgtctattaacttgcgtcaatgattctaaacctttcctttgacctatttcccagggttctgataaggacaaacgcaaagatgacaaagaagagaaggctaagaaggtttaaatcattgtctgaattgaaacatattgtagaaatcaataagtttgcttattgatgtgtgttcctgattgtaaacaggctgtgagcatcaatgagtttctgaagccagcagagggtgggaactactaccgaggaggtcgtggtggccgtggacgtggtggtcgtggccgtggaggtgtttctagtggcgaatctggtggttaccgtaatgaagctgcaccggcaattggagatgctgctcagttcccatctcttgggggcaagtaagatccatccatgataacgtccacactcgtgcatcctcctttaggattttgtgcgaggatttactgtttactggtctctcgttgtcagatgtaaataattaggtgtcgtcgtcagtttttagattttatgcaaaactttacacttgttggtgttctttacttttgaaacagtacactcttcttaattttaccattttactcgttttgtgtttgttgttttcttatttatgaaacatgttttgagacggacatatctaatgttatcgggtttgagtctttactctgtctcctcttttctcattcgtgatcgtgttcatagatgttttagaatcagtaataatttgacatgagttatgacttatgaatgattgtcgaataacgtggttgctattacatataccaatgattctgtaggatttaaacatttttttgtgttctgtcgtaaaccatgtaaa

SEQ ID NO: 6623 - DNA, 3000 bp, Unknown
  misc_feature (1)..( 3000): cDNA_ID_3090557_gDNA_ID_1621099_Annot_ID_171311 3000 nt of promoter + ATG
ggaattgccaaaggcaggtagccaaaggccctcgcatctcatactgcatctgaagagttttcggaagtcagagagttttgctcaggttataaaatgcagcgtgccagaagacttaaatggactagaacctcaagctgtccgaatctgttcagtagtgcgcaaaatgtggaaagcatatcagtctaacatgaaaaatcttgtgctcaaggttattgctatcactattctcattatagttatagaattgataatttggctatgattcaagtgaaatttacatttgaaattactactcccaagatgctttagtcttctattttatagtaaaaatataatgagaaaacatgttttaagttttctggtttatattccacataacttactaaccagtgtaaattatgcaaatattgaagctcataccagtgcaacacacctaatgaattttctttcttctcattgcaggttccttcaagccagagacatgtgtattttgcttggaatgaggctgatggaagagactcaaaaacatacaaaaacaaagctattattaaatcgagagaactttcttcttcaagctctgtctcagatgataaaaagcttgtcaaacatagtatcaacttctcaaaaatctggagtagtgagcgagaatccaaaggtcgatgttctttgtgtaaaaagcaggtaagttcctttccatcccaatctatatctttgagcttagaaaggggtttccctgttagtacagaaaatttctgattttcttgccttctagattttatttcttttgatgacactcgaaaattttgggttctagcctaagctaagaggtggagaccaggatcaaaatcttaaacccttgtcatcaatacatgtcaataagaatccttgatttataactttatgagacgaaacatgtataattcaccccccacatcaaccgttttgaggttttctttacaattatttcctttttggctttcaggattctgaagatggaggagtttgcactatctggagacccagttgtccagcggggtaagtatagccaaaagagatttaaaattccaaaaatctagtttattatttcttaacttggttatttagtaccctaatggtgatgctgtagctgcattgagccgttgaaacttaagcagtttcgtcattgttgtttgccagattcgtgtcagtgggtgatgtagctcacgtgggtagccatcccccaaatgttgctgctgtctacaataacaccaatggagtgtttgcacttcctgtgggttatgacctggtaagtatctctctaacattttatttcaaccgtaatccgtggcatttaaccgcacagtattttcaacctggaactcatcgtatgcattaagtgctcaagcatccaaattttgagcaaacgcaaactctatcaaacctgagtttttagcatgatacatatatgtttattcacttgtcaggtgtggaggaattgcttagatgattacataagtcctgtatcgatctggcatccacgggctcctgagggattcgtctctcctggatgtgttgcagtggctggtttcatcgagccagagctcaacacagtgtattgcatgccaacgtctttggccgagcagactgagtttgaagaacagaaggtttggtctgcacctgactcgtacccatgggcttgtcaaatttaccaagttcgaagtgatgcactccactttatggctctgcgacagaccaaagaggactctgattggaaagcaattagagttcgagatgattacaggtccatagaatctgaatcgggaaagaatttgcgtttagaatgaaacttttcacttctttttttttgggcttttgggaaactattacttcatgcaacgaagtagacttgcaaacaaagagagtgtttttttgttggttttttgtttggcgtgaaaagagagcttttatgttgatattttttgtacatttgtggataaaattacttgtgctttctaggaaggatgtatctgtacaagttattattattacagaaatttgtcttagtcttaataataataagattgttagaagattttaatttataattaagaaaacagaagactatttctaatttctttttattgttttggtatattttagctcacatctttttttaatcattatatgtaaaaaagcttgaaccaagactagttggtaacatttcagagctctctactgattgagtaatttcgattactgaacagaagtatcaatatcgtgtggtgctctacacaacacaattgcgtctaatattataagattgttaggttgatttttaattattacatgttgattgttgataaagtttaaaagcctttagttgtggcgggaacgtgcaaagcttaatacacgaccaatgcactactagagcttaacgcgctactttggcgagtcaattacatcgctcaaatttacatcttgagagtaaacggcccgcgtggacggaattttaggatcaagatttacagagacgagtcttatgattcattgagtcaactctcttgcatctaaaatgagaaaacaatattttagattttgtttttgattatagaaagcaggttgatcactatgtatatatatttctctatattaccctccactaaaataactgaaaagaatagtcaattttggccataaccttctttttttaactaaaatttacgaatcaactattatttgtcggtaggagcgaaaaaccgttatgagagcatagtgctactagtggatcggtaaacaataaatgccgtaataaaaatctaaacgtcacgcgcgtgatgaaaaaacaggaagtaaatcgtcgacgtcgttattcaactaccatttctggatcacaactcccatacactcttttaaatcaaaacaaaatatctctttcctgttagagacaatggacggattgatcagaggtttggtcgactcgacgtggctatcggaggaaaccaacgccgcggcgagacgatg

SEQ ID NO: 6624 - DNA, 3000 bp, Unknown
  misc_feature (1)..( 3000): cDNA_ID_2990093_gDNA_ID_1621099_Annot_ID_171310 3000 nt of promoter + ATG
tgggtccatacaatgtcaatgtcaaatgttaccgacttggcaacaaccgtatcgcgctcagctttccccattgcagaatcttgaaacctctcttgatggctctggtcacaaaatatctgccccttgcgcagtactgtattgaattattgtgattgtcagatctttctgtctacatgtgtagactagaaatatcttcatgtgatatttatgggaaaccatgtcttgtcctttctgaaaatgatacaacataagaagagatgtaagagaaaatatcttctaataatttttatttcaaagagatatttaatttgttttggttacagataaactcgttagcttatatatctacacttatgttcacttatcacatcacaaagcaggaaaatatcttagcgacaatgacaaaccaaagctcaactgttactacacttgaatttctttagttttacaattaagtctagacgatgatactctttgaccattgagataaccacaaaaccaaatcagtttgccatatacagtctaccttcttgcattcacaacacagaaatatttctacacacgcgttaaacaagactacaaaatattagcttggccttaacccaattgaaaaaaaaaaagcacaatcactaagccctaacaaatttacacatctcatccatgaatgaataccaccaagttttaccattgtttcatagctcacaagtcacacgagatcatacgatttctaacccaaatcctagatttctaactataatgacagaaaatattgttcagaagccttagttagatatgttaaccaaattggtacaagcaacatttaaagaacagagaaagaaaaaggaaccaagaaaataaaaaagatgtgccagagattgggttctagaatatcctagatttttacaatgatgaaatctaaagccaaaacaaagaagcactaatcaaatgtagtcgaccaaataagtgaggagggtaaaaaagagaagtggggagggtaagcaagtaggttacgtggaaggaagatatcaacgcacaaaaagagaaacactcaacgttaagggaccaaccacaaatcttggatttttgctgatgcagtgtgtgaaaacaggtccacacgctttgtacttttttcatcatcggtctacaataaagctcaagtctttccatggacagagataagcaagaaaaagtattaacattgttcacctcaaaataatttaggaaaatgacaatgagatttttacctcaaaagccaaaatcaacatctacccattctttcactcgtcacaatcatgagtttcttacaatgcttaccttagagtttagagacatattctcacaaaaaaagcttgtgtctatttcaaattcttgaccgtagatgtcacaacatgcatatatcattgaaaacagagcaacacaggaaaccaagcatatgtatctagatatacttagcaagacataactatagtctttgaatcaacatagggattaatgatagagaatgaggaagctcaagattttatactcagtttcttacaaaacaaatttctctctaactgcaaaaacaccaattaggatttgaagagcgtacctgtttgagtcaatgtccaatgtcgtccccccgccttctacatttcttagcctgctgaataaaagcacaagccaaaatgagaaggtgccaaaggcgataaggatcaatttctaccattcaaaaaactaatggtgagaattagaaacgagagaaaactacttgttgaggaaatagccaaaagcgcaatcttcgtcacctgaataaagaccaaaccgtcactttcaatgagtcagcaagaaaaagagagagagagagagagagattctctataacatttgagtcgacatggattctaatgcatcaaaagtcatctccaataaacaaacacttgaaactcacatggctaatagaacaagatcaaagccttaagtattaagcattacagacactactggctaacttttgacacatgttcttaagtaacatagtatcaatatccgtgaatcacatcgaacacacacaacaagggcttaatgcatcaaagtcctgttatttccatataacaacatatttcatttacaaacagaatgcagcattcaggcagtccaaatggaaaggttgacaaaaaaatataatcttgtaactctacatatatggcagaatgtaataaccaggcaagaaaaaaacagaataaacagatcaatgagtatgatataaaaaaaagtcacaaagaatgtgccacagtgaacaagagggccatgagaagaaattttcaaagaaaatattagcattgttagaattttttgggtcaatggatctgtcagctgcttagttggaaaacacaaatcttacaggaaggaaagtccaagaaaaagaaaataagcaaagttaatagccaccacaagaaatttcatacagaaataattaaatcgttgcacttatcttcttattcaaactaaaatcaagagaacttaataattttcagccacacgaaccatgtgttcaaagccaaaggtgagaagccaaaattatcagcttatctccattaacaagggaaaagcaagactagatttaagagttctctgtaactaaaaactgcaggagtgagtaagtaaataattcaccaacaggaaaacaaaactcaattatctatagctgaatacacatgtaaatgagaatttattaactaaaacatcttcctttgtaactgatgtgacatttacaatttttcattttgaggtgtaagaaccgtgtgacaagtgaaaaggttaaaataagcaacctttgtgatattttctctccactttttgaaattgggtctccaaaccacagccaatcaatattctttataaatacaaacacacaaacagcatctttctctcaaacacaaacatatcttctatcaaacaccaacagctctattctctacctcatttctcatcataacaaagagagagaaaaaaactatg

SEQ ID NO: 6625 - DNA, 3000 bp, Unknown
  misc_feature (1)..( 3000): cDNA_ID_3090561_gDNA_ID_1621099_Annot_ID_171308 3000 nt of promoter + ATG
tcgcggttcggaattggtgttttttcctcggacttaggatggatgctaatctcttatgcttagattgtcgtagtttttttttttttgttatagattcggtcattttggcttttttgtttcttctgtattcgttgttgcaattagaaaattttcgaaaattttggcaggtcatgctcaatctaaaaccacgttggaaattgagttccatagtgatggcaatgcaatgtttggttgtgaagctactaaatggttttatttgaaggagattgcaatttacgtgtgggctttatgatcaataagagggcaatggactttggttttcactgctggataattagtgaagactttgaagttggatgatgaaaaatgtgatttgcgaatgtcaaattcacgtggatctctcgagattcaaaccaagcggcaaacatgcatgaaagaaaattctgaatttctgaacatgcgaacgtctcaacgcatttcgattgtggtttgttttagtttatttatttttaattcaacttttttttctttgttgtaaaaacatgcacatcaatttcatcaaccaactacaattttattaaaattccttttttatttttttcaatcactcagtgttaaaacacttcatcgaatctaatttctttttattttgggaaactacattgaatgatgatctttataattagccacaaatcattgtcaccgatcaccatgacaccatatatagctttaattttgtttgttctgtaccgcttgtttctgttttgtatactaaattactaaccacaatatatttccaaatccactattttatttgtttctgaaagcaaacacttagtaatatgattggctaaaacgctcctataattgtcaagaaaaggggaatgtattgcgacactaaattaatttatccacaagaactatgaccacacaactcgaatacaaaatcaacttgttcatttatgtttatcttgtgtgtaattttcaatctttatccttatatatatatatatatatgggaaaaggaactattgaatttgaagcaaactgttgagcaacacatttaattaagtaagttttacagagttattttgatcatcttaagaatgatagatataattagttaaccgaatttaatcactttaatttaatcattattacgttgtatactttgtatttggctatttgctttgttcgttccaaaactttagtatattcaccacacttcttcaccttatctcgttagttttgctttattacctttcctctttctattttttttttattgttagggtcaaagctttgttaccctttttatcattcgatatttgtatatggcctttgtttgatatagataacaattatctacattggaaagatgcgtttgcgagcccataaaaattggatagagacttgcacttttggatgatatctaaattatagaaattagaaagtcaagttgccaaaaacttatccctcaaattccattggatcggtatcgaacggtgtcgtttatatcatctcgaggcaatgctgatattagccgctttctcgctgacacgtgtccagagattagcagctcaaagaatctagtgactcatctttcctcttatcatctcgttattacattactaccctttgcttgctaatgtttctttacgtgcactggaagaaaaatagaattatcaaaccaaacgactaatgactaatctatgatgcatctaaataattacaggacacaaagttgaatattctgatttaacttaaggaggtttattattattttaattaaaaattgatcagatgactctgtctcgtctttcaaaactattacttgttgataatgatttttctctatgactaattcaaacattttctatattaaattcatactttttaagttaattactcattagggcctattattagttatatataatgaatgttttaaatatagggagttgaaattccatcttaatcatagttggatttctttagttaggtgagtttatgagtgagttttttttttttttttttttttttttttgtctttcagtttggttgttaaattgttaattatgattaaaacgattattatctaaaaatattatttattatactatattggatgtatgacctcacttcttaaattaatccaattgctacacggcaagaatcaaacaaaaataatatgtgaaaaacttattgttgtgagatcatacttaactatatagaaaagaaaatgttagaatcaaataatttaagaggataaaaagagtagttgaaataattgattgtcgatatgcgaccagtacctaaaaatattagaattatgcatgctaaatattgtctgacttgaaggttattagtagtaatagattttatgtgatatgtttgcttaaaacaatatcattaataagaattaaaatcatgacaagggtaacgtttgccacgctagtggcagacacgtagaattaaaccgtacaagcataaatccttgtattagtctcaaaaccatccgggtaaacataataaaagttcattttcttgccatttctacaagcaattgacaccattattacctagaatagtactatttaatatgagagtttaaaagacccggaattttaaattttgatgtacggcattaatgcattgaatcgtaaagtatattactcttgattattaaactaaaagtgagtcatttggtatcttaatgacgagagagatttaactaatctcacattaaactaagcttaaggatcaagtgggggcaagcgaatggcataacagtaaataaaacgaaacacgagggctttatttgacaatgcctctaccttagcttcaaaactgagctcgttcttcatcatttcctgaaaactagaaaacacagtttaaaggaacataaaaagcaactcttttgagagatcacagaaaccctaatttgctaagaaccctaatctcaatttccatcttccaaagttcagattctgtatgtaa

SEQ ID NO: 6626 - DNA, 3000 bp, Unknown
  misc_feature (1)..( 3000): cDNA_ID_2173832_gDNA_ID_1621099_Annot_ID_171306 3000 nt of promoter + ATG
aattgcttgtagaaatggcaagaaaatgaacttttattatgtttacccggatggttttgagactaatacaaggatttatgcttgtacggtttaattctacgtgtctgccactagcgtggcaaacgttacccttgtcatgattttaattcttattaatgatattgttttaagcaaacatatcacataaaatctattactactaataaccttcaagtcagacaatatttagcatgcataattctaatatttttaggtactggtcgcatatcgacaatcaattatttcaactactctttttatcctcttaaattatttgattctaacattttcttttctatatagttaagtatgatctcacaacaataagtttttcacatattatttttgtttgattcttgccgtgtagcaattggattaatttaagaagtgaggtcatacatccaatatagtataataaataatatttttagataataatcgttttaatcataattaacaatttaacaaccaaactgaaagacaaaaaaaaaaaaaaaaaaaaaaaaaaaactcactcataaactcacctaactaaagaaatccaactatgattaagatggaatttcaactccctatatttaaaacattcattatatataactaataataggccctaatgagtaattaacttaaaaagtatgaatttaatatagaaaatgtttgaattagtcatagagaaaaatcattatcaacaagtaatagttttgaaagacgagacagagtcatctgatcaatttttaattaaaataataataaacctccttaagttaaatcagaatattcaactttgtgtcctgtaattatttagatgcatcatagattagtcattagtcgtttggtttgataattctatttttcttccagtgcacgtaaagaaacattagcaagcaaagggtagtaatgtaataacgagatgataagaggaaagatgagtcactagattctttgagctgctaatctctggacacgtgtcagcgagaaagcggctaatatcagcattgcctcgagatgatataaacgacaccgttcgataccgatccaatggaatttgagggataagtttttggcaacttgactttctaatttctataatttagatatcatccaaaagtgcaagtctctatccaatttttatgggctcgcaaacgcatctttccaatgtagataattgttatctatatcaaacaaaggccatatacaaatatcgaatgataaaaagggtaacaaagctttgaccctaacaataaaaaaaaaatagaaagaggaaaggtaataaagcaaaactaacgagataaggtgaagaagtgtggtgaatatactaaagttttggaacgaacaaagcaaatagccaaatacaaagtatacaacgtaataatgattaaattaaagtgattaaattcggttaactaattatatctatcattcttaagatgatcaaaataactctgtaaaacttacttaattaaatgtgttgctcaacagtttgcttcaaattcaatagttccttttcccatatatatatatatatataaggataaagattgaaaattacacacaagataaacataaatgaacaagttgattttgtattcgagttgtgtggtcatagttcttgtggataaattaatttagtgtcgcaatacattccccttttcttgacaattataggagcgttttagccaatcatattactaagtgtttgctttcagaaacaaataaaatagtggatttggaaatatattgtggttagtaatttagtatacaaaacagaaacaagcggtacagaacaaacaaaattaaagctatatatggtgtcatggtgatcggtgacaatgatttgtggctaattataaagatcatcattcaatgtagtttcccaaaataaaaagaaattagattcgatgaagtgttttaacactgagtgattgaaaaaaataaaaaaggaattttaataaaattgtagttggttgatgaaattgatgtgcatgtttttacaacaaagaaaaaaaagttgaattaaaaataaataaactaaaacaaaccacaatcgaaatgcgttgagacgttcgcatgttcagaaattcagaattttctttcatgcatgtttgccgcttggtttgaatctcgagagatccacgtgaatttgacattcgcaaatcacatttttcatcatccaacttcaaagtcttcactaattatccagcagtgaaaaccaaagtccattgccctcttattgatcataaagcccacacgtaaattgcaatctccttcaaataaaaccatttagtagcttcacaaccaaacattgcattgccatcactatggaactcaatttccaacgtggttttagattgagcatgacctgccaaaattttcgaaaattttctaattgcaacaacgaatacagaagaaacaaaaaagccaaaatgaccgaatctataacaaaaaaaaaaaaactacgacaatctaagcataagagattagcatccatcctaagtccgaggaaaaaacaccaattccgaaccgcgaaactcggacatttgcatgattgcctcaactctaaaaaactcgaataccatcgtagttacatatgataattgaatctaaactttctttcaaatgcatattgaatctaaagatgattcattgcaaaaaaaatataatcatatgtgattcatatttcatatttcatatttcatatttcgtaagcataccatttaaaaggtttaggtttgctaaaacgacagcgtttcaattacttgaatgttataacttagaaggaaaaagaattccaaagaaagtacaacagacaaaagaagagatcacaatcatctgccatgaaagttcaaaggttccagagcggaagcgcagccacgaattgactcaccaacaacactctctcttctctttctctctcttcattattattcaaaaagattccaaatttttcaatttcacatg

SEQ ID NO: 6627 - DNA, 3000 bp, Unknown
  misc_feature (1)..( 3000): cDNA_ID_3048723_gDNA_ID_1621099_Annot_ID_171305 3000 nt of promoter + ATG
atccatatgtagaatgacagtgagcaaattttagcttttacctgttaatcatgggatttcggaagacagttctgacattcaaatgagttgtgcctttttaaggtcagacacaactcctctgtcttggctgcccctttcattgtaaaccacctgcacacagattacagaaagagaatgattcaatcatgcagaagataataactctatgttgacaggaaaacaaaatcgctcatacgttttacggatttttctgacattttatcgtaccttatcaatgatcccatattcaacagcctcagtgggactaaaatatttcgggcgtttcatgtcagcttcaatctgctccggggatttaccaatatgctttgaatacagcttgaccttgagcataacattacatagaatagagacacatctttcagataagtttgaaggtaaaagtgaaaagttgcggacagagaatgatagcatgatttgagatttgctagcatgtgcatactattaatggctaactgatgaatattaagatgtctgcaagtatatacacccattgcctgcaagttccatttatttatatctcccccttaaaagacccaaataacacacacaactggacactgttgcataatgaagatcaaactaagatattctacgtacatcacaagggtttgattctctactatgtgaattcatatcaagtttatcttctcaccatttctgtctttatgtgcttgatttctttccttgcaatttcaacatcagttgcttggccttgaaatcgagcaatgggctacaaagttaacatgcaagagaaaatatattgataagtaaaaaggtgcatgcacagaattaagaatcataaaccttagattcttccaacttgaaaaagaaaaccaaaatcttctagcagggggaaaagacgccacctaatatttaaaagaaacgatcagaaagaacctgctttatcataatagttgatgagggcaacgcagatcgatttccttttgcaccagcagtcagaagcaaagcagcttcaccccaagcattcccgacgcaaagagtaaagattggtggtttgacatacctgaaattcaaagataaggtaagagttgattgttgcattgataattggtcgttctccccaaaatatgctggatatgaaaactgtctccaagtgcaattttgaatatttgggaaagcagtttaagtatccaagtcttgttatcgatgctattacgggaagaagtaagttgaggaaagagatgaagatcaattaccccatgacatcatagattgcaaaagcctcagtatcatagcccaacttttcaccattctgaaaagggagaagataaattctcttaaaaacagtttgaacgataggtaatgatttctaagcttttagtcattcatttgaaacaaaccacagtttcaattttactattcagtatgcgttcttaatatgatggactacataatggaagcccaccttggttgtcccagtcgagtttatgtaaaggtaaataggcttttcctcgtcttcatactgaaggtaaagaaactccgcaagtatcaactcagtaactgaaggtacgagagacattcccaaatatacaattcggttcttgaacaaatatgatgccaaatcaggaggaggttgttcgtgtgcacttccctttgagaaaggtataacctgttgataagacggaagcacgaagataagaatcatataataacaacaataaacaaaagactatatgtgaagaatatagcagcctccaaattctctatcataatcataatcagagcaattgatgcatattataagtggcacacacaatcaagtgaaacctctgccacataataactcaacttcttccttaccagccaaacacacagcataatttcttccgaaactgcattatttaatcttcatactcaactctctaactaaacatgtaccatttccgatcaattaaacaacagaaatgaatgagccgtctttgctatctaattgcatatatcaatagtaactctaatccattaattcgccgtttaaagctaagtagcaaccgttggtaagattcgacccataaattttccctcaattcaccaccacagaagcataaatctcagctatagaatgaatgagcattactcccccttgcaatctaatagcctatatctagagtcaatctaatccattggttcaaaactaaggaacaccatttctcgacaaatacaatttctgaaaattcactaccacagaagcataaatctcagctatagcaacgaaaacctcaatttcaaaatcctaacagaatagggagctcgttaattaagaaactgaaaaaaagtataaattcgagtaccatagtgacaactccgcgtttaggcttggaactggaaaaatttaacggattaagcgattccgcacgaagcttagcgccgcataagtcactagagatgcttcctccggtatacggcgaaagaaagccattcgaaagagaagctctgagagatgaagatgaagaaaatctcggtttagatctcagattacgtgtagaagacgggataatcgctgacgtacgagctcgaagcgttgtgaagctcgtcgcagtcgctgctgctacctccatttcttctttgttgcagagagagagaaagagtgaaagtccctgtgaccccgaaacgataacgatctgtctcaaatcgggcttcataacattatttatgggctcaacaaataggcccaatagttgtagttttttttctctgaaaatattccggtttcgactataatagtaaccaaatcaaaccgaagtaaaaccgggaatttctcatttttcgaaaacgtataatttaatatgaggctaccaaataaataatctactggccactgcagagaatcatctgtcgtgttctgtttgttctcacttctcacttctcagatttttataaacatgaatgaaacctgaattgttccactaactctcagcaaaa

SEQ ID NO: 6628 - DNA, 3000 bp, Unknown
  misc_feature (1)..( 3000): cDNA_ID_3048727_gDNA_ID_1621099_Annot_ID_171304 3000 nt of promoter + ATG
taaaatcaatgcacagttccaatagaaagttgtattcttgcaaaactttcatggaagagagtagaatttttcatgttgtgtgacaacagtctcttaccattgagggacaaaaggagccatccatatgacatcaccagcctgaactggatacctaatttaaagacaagaagatcacataaaagttataatcatttcttctattctgtggaatatagctgtgtttgcagttttcttttggaacatgcttctgttcactttacatgaccgatgtagaaaactattgttcttggttgtgcatgtggtgtgttgctggaaagttatcaattatattcacaatttcgtttattaataatacagtgttgcgtaccagttatcacccaagcgataaatgccttgcccctccagaagcaacaaaccatgctggttataatgaacttcctgctcacattgcaaaatcattgagaagacgaaatggaaaaggaacagttaaaaaatctgcttatggtgtcaagtcaaactgttatgtaccttaacattcagaaactctccaggctgaaaatccatagtctgcagatgacagacacatcagtaattaagctttagaggtctcaaaaagcgaaaggattaattcaatcaagtgaagtgcttacatggatgttgaagtcataagcaacggacatcggaagaagtttccgcagttcaaaaacctgtaataataacaaaatatatcttcagagatgactaattttaggaactagaacttgcattacaaatgtaaactgaaatactttcagatgtattctgagaaaagtggagaacttttgcacacttacctcaccaggagtctcgagtagtggttgcttgtctgtggagccaacaataagctctgtggtgtgacttcctagatattcatacctagagatgtagcagtattgggtgactttttaagttaaaacagtagagagaactcaaaattttcttgtcatattaagggaaaggagaaaaacctccgctcgaagacaacaagtgttgcagactcaacacagtccaaggaatggtgaaagtttggaggtaggtacgcatatgaatcaacctacaggaaaaatggattatcagcagaaaatgataaaactaatggagaaatcttgcaaccatttcaccatcaaatctgggcagaacgtgatgtaaccagaagaatactgtggtaaattttcctttgtacaaatcataccgtcaatttttttgaagaactggatgtgttagtgagtgtcacagcaccctcgaccacgaatataagacttgaaaaagattcagaatattgaaaggagttaaaaagcagattatagatcataagtgcaagcatatgttaaagatagagctcatataagtaataataccgctctatgtcttgtggaggcaaacctgaacttgacatttctgcaagagacagtagaatcagctagatgatctccaaattctacgagtagatcatataaaacagcaaatctttaaacccttaatcactcgacttgttctgcgcaaagcaagaacaagtgaatgttctaataatgatgagattggtgtagcagcacactttaggacagcacactttaggacataaaggtagttcctaaaagattgactctattatcgaaagatagaagaaaataatcccaagaacttgacgttcattacttgtgagaagagattggtttcatacctttcattttcgccaagtacatgacaaaatgggaacccgttgccggtgtgatcaaatacgcccctaatgtgtttgtcctgtaaatttgagcaacagataagtgcaagagcttgccaagtttagacttcttttagctataaaatcaagaaaagtaagggaaattataagagagtcatgtaccagtcaggtaaagggctgtatacatgactttccggtgttattaacgcatgatctcgtttgtatacacttcgtgtgaaaccaggcaagtctacaaaacaacagactcataaatatttctgcttaaacacttgatgaagatgcaaatacaaaacccccaattccaaatttgattagaaaactaatctaattatacacagagagagcgaactctcagaaagagactgtatatacagaactgaagttgaatgcttccatggttatgtctaaatctaattgatcaaaagttaagagatttttgcaagacatgagccagaaaccctctcagattaaacactaattaaagtaatcttaacttttcaataacttaatctcaaaatcaatcatatacaacaagacctcgaacaattgataaaaacagcaatcaaacttaaccagcaaaagtatcaaacttttaataacacgaagctgtaagaaaacacttgccttggaggtgtgaaggagagagtgttggattcgtggctttccaataaatggggttcgtcttctcatccgattcaacaatcgaaggcgctgaacaaaacccatcatcgcttttcgaagctttaacaagacctttgataacaaataagaaagttctgattagtttcacagtatactcaaaagaacttgagaagaatctaaaagattcgtacttactaataacgatgaagacgattaagtaaagtgatcgcatttttgctgagagttagtggaacaattcaggtttcattcatgtttataaaaatctgagaagtgagaagtgagaacaaacagaacacgacagatgattctctgcagtggccagtagattatttatttggtagcctcatattaaattatacgttttcgaaaaatgagaaattcccggttttacttcggtttgatttggttactattatagtcgaaaccggaatattttcagagaaaaaaaactacaactattgggcctatttgttgagcccataaataatgttatgaagcccgatttgagacagatcgttatcgtttcggggtcacagggactttcactctttctctctctctgcaacaaagaagaaatg

SEQ ID NO: 6629 - DNA, 3000 bp, Unknown
  misc_feature (1)..( 3000): cDNA_ID_3090568_gDNA_ID_1621099_Annot_ID_171300 3000 nt of promoter + ATG
acaacctatcctttttcaaataaataatagtcccaaaagctataaaccccaccattgtctattgcattacatattttggatattttatacaaatatctacagtagtttcaaaatatataatcaatacaggatgtctacaaagggttagtagcgatatagcatcaaccaaaaataaagccatagcgctataatctttttttgtaggaatgtaaaattgtattcatccaaaacatgttttacaattgaatgccacatagagagctgataacagaaagaaagagtgtatactcctataagaaactagagtattaggaattgattttcagtgttaaatgcatcttttatcttttcacttgaaactagtttgaatttcggtatgtgttatacggaaatggagattatgcatctattggaactatgttacctcaatcttctgagctttacaatgttcacatacttaatcttctaaaatactactatattgataattcgatatctaatactctccttaactaatctagactacaaaaatcaaagaataaattgcgtataataagaatcgacttttgaatctactgggtttatgccaaccctaatgctatattggcagatgtatgatgtaaacatttaatttaataccaagttaaactatataaaaaaattgagttagctttaagctttttgccaagtggaaagtaaaaaatagtgacgatgctcgatcaattgtataattgtaataagcactctagctgcagctataaataccctactaagtctctcatctatcttcactatcttttgtgataagaaattctattatcaattcctatcatttgttaagaaaaagagttagaagtattaataatcttacaatatttatagataagataacaacaatatgaagcattctcacgttttgcttcttctatttgttcaagtcattgtccttttgcctctcctttgtctatccgacgattttgttaactctagagctacttattatggcagccccgattgcaaagcaaatcctcgtacgtattaaaattgttattgctatatacatcgtgtaccttaattctttttcattttcttagttgttgtatagacttgtacacgttatatattggtaaaagatacattggtgtaatatctcactataagccataactaattatttttgttttatatctacgtataggtttcttgttttgttttattttgaaggtttattcaaattctaaatacatatatgattgaaaacgagtccactaagtgtccattaactgcgtaattagtaatgataactttccattatgagaatatacataatatttgtcgaaagaataagaataattaattaattttttgatgatgcagggggacattgtgggtatggagaatttggaagagatatcaataacggtgaagtgagtggtgtttcatggcgactatggaacaatggaactggctgtggtgcttgttaccaggttattatatatagttatctacttatctcaatcaatatttcatcaaatattattatagtatatgctatgtcattaattactaaacttatattatgaaagaaaaaaaaacttattttatgaattataaaaaggtgaggtgcaagataccaccacactgcagtgaggaaggagtatacgtagtggctacggactccggagaaggagatggcacggacttcatcttaagccctaaggcgtacggacgtatggcgcgacccggcacagaaaatcagctctactccttcggtgtagtcaacgttgagtaccaaaggatcccttgccgatacgcagggtataatctggtgtataagatccatgagaaaagctacaatcctcattatcttgccatccttgtcttgtacgttggtggtgttaatgacatcctcgccgttgaagtctggcaggtaaatttaatcaaagatgttgagaaacttagatatatgtttttgaggatcaaaatatatagtttactcttagatgattttgtgaaacaaagttaaacgttattatatggtatgcatgtatatgtatgattttaggaggattgcaaagagtggagacgtatgagaagagtgtttggagcggttcatgatttgcagaatccacctagaggcactctcacattgaggttcttagtctacggaagcgcaggaatcaattggatccaatcgccaaacgctattcccgctgattggactgccggagccacctacgactccaacattctacttacttaattgattcacttttcatcagtgtgtttttatcatatagtatttattatggtttctgtatgcaatggctaatatatttaaataatgccctctaggacaatataattaatgatgataatataaataatcgtagtagattcatatataatttatgtattgtgtctcactaagaagattgtaatggtttgtatgagtttgattttgatggaataaatcagtactaatcaatttatcagatgatgatcaaacgtttcgtaagctttttttgtttacattttggtcagtcaagcatatatctctccctaatcaaccattttcatgaaaacaaattggcgcgatttttgttatatagataggcccattagtagtattcacaaggcccattaaaacttaatttatcttggccatcctcttcgatcgatttcgtcagttttctttgattctgggtagtaaataatcgggatcaattgtagaagagctcatcgagaaaagagagaacctaaactttaaattcaattctgtattgttctcaaactcgaacccgaaactttaaatccttccttatttgttttctggagttcttgtttagaactgttttggatttgttttttttgaggagatgctttagttaactaggtttgcttcgagctgatcgctgtgtggcataaaccctaatttcgtggaaactgtgctcttttagaaccggtccagtgagtaagggaatccaattggtgaagatg

SEQ ID NO: 6630 - DNA, 3000 bp, Unknown
  misc_feature (1)..( 3000): cDNA_ID_2107486_gDNA_ID_1621099_Annot_ID_171299 3000 nt of promoter + ATG
agataaaaagaaatgaattatcaatgatcttcggagtaaagaatgtatattaagagtccaaaagataattcaattacagaatttagcgttgtaattgccagaggcatttgctgacccaaataaagtgatgaagtcacctataccagttgtaaattaaatgctctagaatataatgaatgtcctgtaaggaccaatttcaaactgctattgagtcttaagatcgcatgaagcgtaatagaccttggttccaaatataaacatcctcgtaaaagtgaaggagcacaaaattaaaaatgaccaaattgaggaaataaatattttgatgatctcttgaagagagtgaatgatctctaaaagagacataaacatgacaaatgaaacattcaagtacttgacaatgaagagatctagctagttatgtcatgtcaaaatataatggaatcaaaagcaaatcgacgtcgtaatatatttgcatgctatgagcagttgatattatggacaaaaaggaggatcatgaaagaaagtctattgaaaagtgtacacaaagtaatgattagccaaaaatggaaaagaagaaatagacatataattataatctctagtagagatatttgtactagtagtctatgcacatgatgtgtaaaaccagtggaagataaatgagtctttatgtgaaagaatagtgaaattaatgagattttcacaagataagaaatgtattatgaagagatatattctcttgtggtggatgtaatatttttaagtatctaaagtctgacaataagagacagaacactggatatgacatttatatgaaattattgaaagatataatctctgaaggattaattatatgagaattatgttctctagaactctactcgatcgaataaaaagaaatatgtaacatgacatataatcatataaatgtatatttatgttgagtttgtcaaaatatattgatcaaactaatatttgttttgaaaatcattaaaactcgtacagagttatcataagtaatacgatgacaataatctatgataaaatatcactagataatgatatttataagtctatatgaaaaccatataattttgatcattaagattatggttattaattccaacgagatattgtatttgattgaaaatcatctccttaagaagatgtttccgagggggagattgaatgatatgcgtggatgtaccctttttccttatcatagtttttatcccacatgatttttctatgacaaagtttttaacgagacattaaagaacacgcaaataatacacttgatgaatattaagaaattctatcaatcatccaaatgaatattatacactaatgatatttagagaaataaataagatggtcaagatgaatcatctaaaagattcatgagcagaagaatgacgttgtactttatccagaaatttgttcaagagaagatttggcagacttattctcaaatactgtttattctctgccacatcttctaatcatgcagagattttactaattcatgaagctagccgcgagtgtgtatggctaagatccatagttcaccatatacaagaagactgtggtatgtatgcagggaaaaaaactccaacaattatgtacgaagacaatgcagcatgcatcgcacaactcaaagacggatacatcaaaggcgatagaataaagcacatcctaccaaaattcttttacacacacgatctacaaaagagcggcgatgtacgagttctacagatccgttcgaatgataatctggctgacttattcaccaaggcgctacctactgctactttcaagaagttagtctatcgtatcggattacgccgtctcaaagatctcgacgaatatactcataagggggagtaattgtatgttgcactctttttcccttaaccaaggttttcctattgggttttcctggtaaggtttttaatgagatagcatttcaaatactttacgagttatggtactataatggtcatcaagggggagtgttatgaataaagatggatgcccattataagacccatcatctaagcccatcatttagatgtttgtagagttttacctttttcttgtactcctatataaagaacccttttctcaatagaaaacacactcatttcttctatctctttctcaagagaaatttattttcaacggatacttgtgacttttggagactcgagaatctaaacaacggcgatctacaaagataaagagttattgagctcactatgccaagttctgaaaaggcccacttcaaattataaaggcccagtttaagcccactatggaaacgagacagaagcaaatgggtataatcttcaagtcaagcgaacgatcggtgacggtgttatcttaccgccggagccggagtttcccactctattgtaataacagatatttcgaccggagtttctaagtgaatccaaatttgttgttcttcgttgcggctccatctctcgctgtgtatttatagtcaggtcttttgagttatcccattttgcgcgatcccgtcttcaccgtttccatcttccagcgagcacatctctgttgatcgataattttgtacctagttcaggttagttgcgtaattatacttgtgtaatttctttttttggattctctctgaactgatttgctgggcgtggaccttcggttttgttcatttcgtagtcctctatgcgaatgtttccagcgtttgatctttagatctgtagttcgattgtatgcttctaatagttattcgttgtcttgtacatttgatctataatgagaactgatgcgcggttttagtcgaacgcgacatcgtagttcggattagagagtgtactaatctttgtttaacaaagatggcatttcatcttttgactgtgtgatatgtcaaacccgcagaatccataaaactagtttactttgatatgttttgttcttcttcattgaatgtttgtgtggtgtcttgtagttgtaggaaag

SEQ ID NO: 6631 - DNA, 1696 bp, Unknown
  misc_feature (1)..( 1696): cDNA_ID_3090553_gDNA_ID_1621099_Annot_ID_171312 3000 nt of promoter + ATG
aattccaagtaccagtgaactcatgagctagtagtagtcttctgaatcatgaaccatgtttctacagacattgcttagttttcttcagcaacaaagtcccgaacaaattacaagtgagacaacaaaaagcatcatgctttcgagagtcccatataatttctgagaaatgcgcagatcccaaagactaaagagagagaagaagaagaaatctcaatctcccagcttttgctgaaaagcaagtaaggccacccaaaactatacctactacaagcaaccagcagctgaaaacaaaagggataaataaaaaaagaaagcttttattaaagaaatgacagatgcccagatcttgaaaatgagtcaactaggaaaccgagtctgatgagaagaagaggaaaaaactattctcaaagccacgacttttgagaaagaaaatggaaaggtagaatcagattttcagatctcgaggtggtagatactcgagaaactaagaaacaaattatatatttcccttttgaaggttcgaactctggtctgtgtggtcattgcgctatcaagaaatctcgacctttttagttcattctgagtttgctgttcctttcttctccagctcactaggtggcctgatatagactgacctgtaaagcttaaaaatatctaaaaacataaacttttaacttttacgggtgaaatgtttaaattaaaataaatataatggttaacaacaaaaacatacaaatttaaagatcatccaatgatttttttttttttttacatacatccaatgaccatctaagtgcaaaatttatattattataattaaatattaattttttaaacataattaataagaaaaactttaataaaaaaaaaaaactaataagaaaaaccataaataaagtagtacaaaattattaaaaaacaaataaatatcatagtgatatgtttattattacttcatgcatttggttgatcaccaaaaactacatcaagtaatatgacaaactacaaaaaaaattgtgttttgaattcgtagatcttcaagatcgacaatatttttacaatacttatgttcatattttgtctttcttcagtttgaattgatactatgattttgatgatttttttttatatagatatatatatatgatctaagtatttgtcgcttatgtgattttcttttttcttgtgactagccgctatcgtctgcaaccgcaaatatttctagaaatgagattttgaaatttagcgatattgagtggtgcaaaataatttaaagtaaatttctaaatatgttttaaatgctaacaatcgcaatcgttcacaagtttgcgagttatagcggaaaaaccaatcaaaattcatgatatattatagcaacttcacataattcgtctattcaattaaattcgatcacctatttgtatataattttggttgattcagattttagttggttataatttaaaaaacttcatattttaagaaactttttgtatatgtttaactagaaatgatatattttagtaatttcggttagttcgattaatcaaaaattaggctgcgtaaatccgatttatctaattggtttatatggtataggaatttctccaccggttaaattatttttgaaacttaattaaattttggtttagttcagttactgattagttttttctttttaataataaagtttatg

SEQ ID NO: 6632 - DNA, 3000 bp, Unknown
  misc_feature (1)..( 3000): cDNA_ID_3048734_gDNA_ID_1621099_Annot_ID_171295 3000 nt of promoter + ATG
tttagctcaagctcccatgatggctccttctggctcaatgtccatgccgcctatgtctagcggcggtggaagctcggttcctcctccagtgatgtctccgatgccaatgatgactccaccacctatgcctatgactccaccacccatgcccatgactccaccacctatgcctatggctccaccaccaatgcccatggcttcaccaccaatgatgccaatgactccatctacaagcccaagcccattaacagttccggatatgccttcgccgccgatgccatccggaatggaatcttcaccttctccaggacccatgccaccggcaatggcggcttcgccggattcaggagctttcaatgttagaaacaacgtcgtaacactttcatgcgttgttggagttgttgcagcccattttctcctcgtttgaaatgattattgaattggtcagcctcgatcgttttcttgtaatttaccttcatttttttccctcaaattattagtggtcatcattttataatatttgagtttgtgtttgatgtacgattcagacatttgtttgcattatgtgcttaataagtttatcgttgactctacttgaagagagactttgtatgtgatgtaaatttcttctatctatggaacattgcattcgtagtcatatataggacataaatatggttacaacttggaaggataaataccacaaggcacaatatgatcaatacgacaatacctctcattgttagtcgataatatcgatgtatatagtcactagactcaccgatccgtaattccttttaacaaaaaatacgttattcagatatgttattttcatatatatgtgtaaaaatgttcttcctaataattaaaagagacaaaccaaagaaaaggctatatttgcaagctgtcattggaattttgcatacattttctctatatattctcattgaaattcatttattctttcattttatggaggtgtagaaatacataaaatccaaagaaaatgagaaattttcaaatatgttgaatttgagaatggaagaatatgacaaaggtgggtatagtgaataaatggtagggaatatagatatgcccgacccaagaggacagctaaaaagaaagtgacgttcacatgtctgtctttctctattgccccaaccattttccaatgtgtattagtaataacagaaatcatacatttaaaaagaactatatagaaattttattcatatatatatagcagtactagttagtatatctgcatttttttgtttttcaagtcatgttgatgatttattactttaaacagatgccgaagctttctaaagtaattacggtaaatatatgttagtcatttgtaaaaacgaccgatgacagaaagatatgttttatttcttagtatatctaacaatgttataaccgaatgatgacaacctataaaccacaatagagcactaatttaattacatgctctttgttgctggctccgtacaccggccaccacaatcaaaaccttaattgtccactttttagccacttcgaattctcagaaagataaatctaaggaagttctaggtctttcaaaggccacaaatctcgatatgttggtggtttgtgaatatgcaaatctttggtgatacgctaacttcttcaattcataatttcaataaacgaactgagaatttactgatgggtagttgttcaaagctggagtttcttccacctgctgacgtttacttggaatctctcaaggacccaaatctaaggaaatgcttacggttgaaaagtgtccgtccgatttcgaaaaccattccaggtatttttttttaagtcttacaacatattctttccggtgaggaggagaccatgttgtttttcttcccaagaaaatttaacctctattgctatgatcctaagtgtataaaaggcttgcaatcaatggaggttttaattatagtccatgggtgaataatgtcatcaatagtgataactggacaagatttttaaaaaatgccacaaacacaaaagaaaaaaaaaattgaaagtaaatgtcataaaatcataattatgcgtagtgtgcaaggtatactttggtaaaatctgtcacattagacatttacttatttacaattttgcaaattggttatttacttaaataaatgaaacttatacgcaaaataaaataaaatcctgactaagctcatatcttttaatttgttttctaacagaaatatatccctctgttagtacaccacattgacgatgtcattcattattaggaatggaaatttttcattctttcctataaaactagatgttaattaaaaaaaaaaaacaattatacggatttcttaagagatttgaatttctttacgtagattttctgtaagtagtataattcaaaagaagcaagttaaagctaatctccttgacatggattgaatttttttttgaaccaattacccgacaaggatttttttagtggtatttatagattttgccattttttatatctaaaaaatacaatttaacacattacgtttgggtttatttagttccatattttttttagggtatagtgtttgttattaagtatgtattttacaaaaaaaaatctcaagtgtttcattttttaaagttgcagaaaacgcaaaatctaaaatatttgaaggtggcaaatctaaaagatttaagtcacaaaatggcaaaatcaacaataatcctatattattttgggtggtgttgatgagccgttgacgtagaagaatagcatgtggccttatttgctataggatgtggccctaaccctaataggatgagaaatctttgctcaacttggcttagagtggaaccaaccgtgaagcatccgtctcaaaaatgtctactctatgacgtctttttcaccccaccccccccctctccacaaggcccctccatttctgtataaacttcagaatgctttcttgagaatgtttttatcttctttctatagtttcc

SEQ ID NO: 6633 - DNA, 3000 bp, Unknown
  misc_feature (1)..( 3000): cDNA_ID_3048738_gDNA_ID_1621099_Annot_ID_171289 3000 nt of promoter + ATG
gatgatgaggatgaggacgaggatgaggaggaggatgatgaggaggaggatgaggatgaagataattattggtatggaagaaactattttaacttccagaattgcttcaaattggatagagatgcacgagaactcatcctacgttcatgcttcaagaagactatggttttaccaggtggagaagtgcctgcatatttcaagcatcgagcatatggaaattccgtaaatatcactttacctcggagatctctctctcacaaatttttgcgattcaatgcttgtgtagtggttgaacctcaaaccgattcttatgggagtgtgtatgtatacttccaatacaaaggcgaacattatatccatacaatagctactgatatgacactgatgtgtaagacggatcatctggttttgtgttccttcaagttccggcagtttaaaaatactctatatccaaaggtaaaggtcttggataatgtggaattcaagtttaaagggaggaggatcaaaggatgcggcgtacaactcctgcatgtgtctccatatccggatgatagtgatggaagctctaaagcagagtacaaccaacagtctggagaaaaatgtgatgctgtagagactgagagtagtagcaagaagcggatgcgggtaagtcttttgccataatttgaactgaaaactattaaagctatctctcgattttctttttaatatttcaggaaggccactatctaaaagaatcgatagtttggtttattatacagatgacattaggaaactctgaagaagatttcaacttaccctgtggccaaacagtaacagacacaggattgaccgctccaaatctggagcttccattagggcggggagaatcgtcatcaatttcatatccatgtctggagggtgaagctttctctgttgattccatgataactaagcgacaagctaaagaaattcccatcgcgcatagggacgaagattctgaggcatcatggtaactgaaacatcttactattctgttttgttttgttgcagcataacaagacaagcaatctttattgatctatcaaataacctgaattataatgaagagaactgcagagtttcaggctctgaaacacaccaattcactgattggataatcaatctctcacagaattagagactctctctctatatatatatactttaaagactcaatatttagttataatgttgactctttgactctgttctttcttcttttataggtcatcaggctcatcaggctcatcaagctcttcgtcgctggtgcctttttaagtctccaactctagagcatggtactctgttcttacatctttgtatctacttctctaaggctttcgtataaatacatgttttgaaagccacaatttagctcattctggaaaagtatttttgacagattttgtatgtttccttacatctatggataagtttaaaagacattgaattagttaatgtttttaaattagtcctgacttttctaaaaacacagatacatctcaatgtgtatgttagtaattaattccatatataataaacttgtgcattgagagctgagactacaattgtaggagtgaactagtcattatcacatttaggatgtgaaagctaatttctctggtgcttattttagctgaattggtttgtgcaggtttgcttcagatattgtaccaattacctaataatagaaaaaaaaaataatacaccatcagtcgattccactcttttttctttcttgccgtcttacaacgaccttgtcattcccaggaacataaagggcattgcgcaactacgaggcagtgaagaattatgggaagtagccaagctgcacaaccgtgaatcctctttccctgaggttacatctcatcttacctccctgataaaactctccatttatttgattgctgcattggtttgaatataacatacatgctctgttcttctttgccaccagcatatggattcaaatatcacaaaagggttttcatcgttagcattatatatctttaaaatgtaaattagtgacaaaatgattagatagatgatcgtgtgagatgaattcacgtagagttttgtgttgttgtttcaggaattgtacgagtcaaggtacttcaaggggctggagttgagaaaatggtgtgaactcaacacaaacgcagagagtttctagacgcaattccacggccgctccttgacttcgtggatagatgtttgaccgttaacccaaggcaacgaaacagcgcagaggatgttctcagacacgagttcttccatccagtacatgaaacccttagaaaccaaatgctccttaaaactacagtggtggctgacgcactaagccaaactttaaactaataatacaattcttgaaaactaaaagagtaatttagcaaactagagagttagtgttaattagtattttcactgtattatttgaattaaaatcctcataatcgatatacttattctcctaaaccgtgtgcatgtatgtatagggaaacaagacttagatattaaacaatcataacattcttacgataaactgtcttgtacaaggacaactgataaccacaaaatttgtgttttcaaaatatctttgtagaggaaacgaatgtaagtttctgtctacttgcctagaaattgaaatattatttctgtcttgtacaaagactaagacttatcataattcagtgacaaccacaaaaattcaatcttcaaaaatatctttgtatgtagtgtaaaaaagctttcgaggaaaggaagggccgagtttctttattatttacgtctcaattgtcttgttaggagatttgattttagccacttaaaagaatatcttgtacagtaagtcttctatgcaagtcttggagggaaggaagacgaagtttctcctctctttctcacactatgtcttgctgatttacttctcttaaaaatcttcgtctcttctctgagttctctctatcatctcccatg

SEQ ID NO: 6634 - DNA, 3000 bp, Unknown
  misc_feature (1)..( 3000): cDNA_ID_3090590_gDNA_ID_1621099_Annot_ID_171284 3000 nt of promoter + ATG
gacagtagaccaatcaacaaaagtacattgtggtaatcctagtctgtgaagaaccagaaaccaaacctgttctgagaaggcacaatgaaggagtaagaagaagtcttcctttacattgcgtgtttacttaatgatcaaaaagttgattatatcaagaacttgcttgttgatcagtggcggacccactaagaaggaaggtgggtcagttgattttcatgtttgagtacactactccatatgaatcgaagagagtcatctataacgtaatagattattgtgaccgttgtaaaatactaatgtttttttttcaggaactgaaaatgtgctaggcatgtctttcaacacaacagaaatcgatgagtgtaatctcagaaatagattgtttgtaaatggacaatcttcaaaggaatgtgtaatctcacatttctaaaattttacaaggagttgtcgatcgctagagactggtgaaagcagattgtgtttacctcagggattcatttatttggcccgaaaactcagattgctatattgggatgaatatccgttgacgagtatgtgtttcaattttagggctgaaattttgattaaactcacaatggagaatagcaagcttgagaagttgtgggaaggagtctgtctggtgaggaaggatttgtcaggaagtgaaaacctgaaagaatttccagatctttcaacggccatcaatcttgaccacttggaacttaacgattgcaaaagtttagtgatgcttccttcttcaattcggaatctcaataaactgaggcggttggaaatgcaaggatgcaaaaatctaaaagttctcccaaccggcgttaacttggaatctctagagtacacctcgatctcaggggatgttcaagtttgagatgtttccctcgaatttcaaagaacatttcagagctccatctaaacgaaactgcaatcagagaagacatagattgtttctttattgggaatatctttggtctcactgaactcgtttggattgattgtccaataaaatatttaccgtctaaatgtcatgcagaatgtgtcgcagagcttacaatgccaggtagcaagcttgagaagttatgggaagtaatccaggtaacattctccttaaactcattcattaatgatgttcctaagatattttctcgacctttcttttgcttctaatatgatttgcttggcctgcaagcttgttagagtatatttgtcataaagccttttagcttcaaactagatggacttcccgctcaaattgggatttgaaatctagtaacgtaaattattttgcttgctatactaattttttcgcaaagaattgattataaactacttatttcttacaaagtatataatgattagaagaatagaacgctgcaaaaaacaccatcggaattcaaagtagcacaatctaattcaaaaatcttacctagtacattatggttgtgttccgctctgagttttgcccttcagaagaagtctttggttatccatatgaattggactacaacgatgtgaaattcaagtttgaatatcatagcaatgcttgttcttgtgtcaaatttgggcttgaccacgacacgcaaacttgtcgtttaagaggataaaaaaattcagcgtacggcatttagatgcctctccatctgaggatggtagtggtacgagcgctcaaactgagaacaaccaacattctagagaaagtgacatagtcaatgggagaagcaagaagctaaagcgggtgaagctttgaattattgaacggaaaattacatatctaactcttgattcattttcaggatcacctgcaaaatagaccaaaggaatttaatagatttgattttattatgcagattacggtaagaacatatgaagaaccttccaacttactctgtggtaaaacagtagcaaacacaagcttgacggctccaaatttggaactttccagatgtcttcttctataagtatgatactactgttatcagtttcttcaagcaaatttcatggcgatggaacatcgttgtataattccctttctccttctgaacatagattcggtggctgactgctaggaacccttcgcgtgcggcaaaagaaaaaaaccctagtcgcctctcctgtcgcaattttctcggctgacgtagcctaaaaagttatgagttctttcagggcgattttattttaaccactagaagtacagtaagtcttctatgccaggcgaagtttctttgtatttattattgtgtctgtcatcatacactacaaaaatataacttgtacagtaagtcttctatgcaagcctgcaaggaaaggaaggaagtttctgtgttaatttgttataacttgattgtgtctctcactatagtctcttgttaggggatttgattttaacctgtaaaataaatatcttgtatagcaactagcaagtcttctatgcgagtcttcaacgaaagaaaggcgaagtttctgtcttattaagttattattatgtcttaatacatcatactttgttaggaaaattgatatcaattaacctctaaaaaaatatatcttgaacaaagtcttctatgcaaatcttcaagaaaaggaaggcgaagtttctgtgttaaattgttattatatattaggtgtgtctcaccatactctcttgttaagggatttgattttaaccagtaaaataaacatcttgtataataagtcttctatgcaactcttcgacgaatgaaaggcgaagtttctgtgttatctagttatttattatcttaattgtgcctgtcgtcaccctactcttgttaggagatttgatattaaccactaaaaaattactaatcttgtacataacagcacgtttcccagcgaatataaggtactccgtttcgcacagcataagtcttctatgcacgatttctcctcttcctgcacactaatcattatgtattgctgatttacttcttttaaagatattctatctcaaactcatcatctttcatg

SEQ ID NO: 6635 - DNA, 3000 bp, Unknown
  misc_feature (1)..( 3000): cDNA_ID_3048744_gDNA_ID_1621099_Annot_ID_171282 3000 nt of promoter + ATG
gaagcgagaagcggatgggggtatcttttgacttttgattagagctgaaaattataaagctatcttttgacttttggtttgatttttcaggatcgaaacaccatagggacagactatttaatagaatcgatcgtttgatttataatgcagatgacatcggggacatctgaagaatatatcaacttaccctatggccaaattgtagcggactcaggattggccgctctaaatatggagctttcgttagggcagggagaagcatcatcatcaacatctctagagggggaagctttgtgtgttgattacatgataactgaagaacaagatgaagaaattcctatcttgtctactgattctggtaactgaagcatcttatcattctgttttactctgttttaggataacttgggatcgactatgactataatgataatgataattaactgcagatgatgaagatctttaggagaaccaaagtccgttacattatccagctctgcgtttgttttgaacatttcacttttcctgaaagaataaatgtttcagaaagccatactttagcatattctggaaaaacatctttggcattgttttgttttgtaaaaacatattctatttttaagaaagacattgaatttgggagcgtacctgcttgagtgcaggtactacccaaaatagtcttgcctttttaaaacatagatctcaatgtttatgttagtaaaggttgtttttctctttattagcaatgaataaatcagactttgggtacagaaaacaacaagaatcagcaacatttgcatatccgctgattcaatagccaaaaggcagaagcgtttttggcctaacttcggccaaagatgtaaccagcataaggaacaatccttcgggtgaaggaaagagcttttaaactttctacaggagacattgtctggtccacttccaaaccatgaagtatcatccagctatcctacgtcgatgagaaaatatgtcgctgctgttcccctatgccgctgcactctttaattatatcgagaagagtgaaagttgtaggcctgaactactcactagaacatctaggatgggaagctcattctctggggctgttcttgactgaattggtttgcttcagatctttgcatcaagggcctaaataaaacgtatggtctgatggggacgacacctttcactgctgaccctgaacagttaagatctgccttgactgaattcacaccatcacattgttaagattcctttcctggatccttagccgtctctacagcttatcacattgttaaggtaacctgaaacgtattacaactctgttttataatgaacatgggatcgaccatgactatactggtaatgacaagacgatttcttagtttttcacacaagccattttctcctgcagatgatggagcactgacaactagaaaacttttatggttccatgtccagaacagcagaaccactctgttcttacttctctctgttttgcttctttgaaaaattcgctttcctgaaaagatgtaaatataacagtcttgtcttttgaaacacacatatctctctacgtgtatgttaccaaaggttatttttctctctttaaatcaatgaataaattcggtaaagaaaaatgtatttcacaagagaattatcaacaacaaaaaagtgttggaactaaatttttaaatagcaacctcatcagcattaaatgcatcactgctaccatggcgtttcctacactcacagtaaaaaacagtgattacaacataactcagcaccaccactgccccatacatacaaaaccagcttccacccgtcctactcaccggccacaaccaccaaactcaatcacgaccctgaggtcaagtgagctagtcattgtcacatttaggatgtgaaagctaatttctctggtgcttattttagctgaattggtttgtgcaggtttgcttcagatatttgcaccaatgacctaataataataaataaaaatataatacaccatcagtcgattccactcttttttcgttcttgccgtcttacaacgaccttgtgattcctaggaacataaaggacattgagtaactacgaggcagtgaagacttatgggaagtagccaagctgcaatcgtgaaacctctttgcctgaggtaaaatctcatcttacatcccttataaactctccattcacttgattgctgaatttgtgtgacataatacaaatgctctgttcttctttgccaccagcatatggattcaaatatcacataaaatggttttcattgttagtccagaacatgatataactttaaaatgtaaattactgataaagtgatttgatagatgatcgtgagagctgaattcacatagatttttgtgttgttgtttcaggaattgtacgtgtcaaggtacttgaaggggatggagttgagaaaatgaggagaactcaacacaaaacgcagagagtttctagaaatcttcactccactgtccatccacaccacaccacacaactctagaaagctaaaagagttttttttttaacaaactagatagttaatgttttcactatattattatgtgaattaaaatcctcataattgatatacttacaaattctcctagtttctatgcatgtaagtatagggaaacaaagactgaattccccactcaacatgtttacgataagctgtcctttttacaataagcaaagaccttggacaccaaaataaatctaatattgatttaagaggcatcataacttgtagttgagcggttgaatacttgaaatcaggttttaaatgcttcattggccttggttcgaacctcattacaaacatttcgctacatttttatatttatggcctatgggcaaaaaataagaagtttccttgcgcatcccacccttaaggaccggcctcacagtaatcactctaatcaataatcactgtgtattcgatttactgtacttatcttctcctcatcatattccatg

SEQ ID NO: 6636 - DNA, 3000 bp, Unknown
  misc_feature (1)..( 3000): cDNA_ID_3090594_gDNA_ID_1621099_Annot_ID_171280 3000 nt of promoter + ATG
gtcgagtcacttagtgacttgggtcgagagatctcgtccggacttaggtagtccggatcggggcctttcattatctcttccagaactgctgcaaattggatggagatgcgcgagaactcatcttacggtcattgttcaagcctatgtccttaccaggtggagaagtgccaacgtattttcaacatcgagcttatggagattccctaactgtcactttaccttagagctctctttctcaagtattcttgctttaaggcttgcatcgtggttgaccttctaactgagggcaagagttggggtccatattgtgaggtaaatgctggcttcaatgggacactgtattgcaaatcattttttaaagatgcagacctgcggttgtgtaagacggatcatctggttttctgttccttcaacttccagcctgaagatcttccatctaaattgactttcaacgatgtggagtttaacttttcttgctccaagaggataaaagaatgtggtatacgactcttgaatgtgtctccatttccagatgatagtgatggaagctctgaaacagagtacagccaacagtctcgagaaaaatgtgatgttgtagagactgcgagaagcaataagcggatgcgggtaagccttttgacataattagaactgaaaattgcaaagctatctcttgatgttttattatattttccaggatcaataccttagtgacagactatttaacagaatcgatcctttggtttacgatgcagatgacatcgggaacatctgaagaatatatcaacttaccctgtgtccaaattgtagcggacacaagcttgaccgctctaaatatggagctttcgttagggcagggagaagcatcatcagtttcttcttatccatctctggagggggaatctttgtgtgttgattccatgataagtgaacaacaagatgaagaaattcctatcttgaattctggttctggtaactgaagcatcttattattcggttttcctctgttttaggataacttgggaccgagcatgactataatgataatggcaagacgatttcatatgttttgacacaagccatttttcctgcagatatatcacttcccttgatactagttaaatccatatgaaaatatcttgttccctgagctactcattaacacatctaggatgggatggaaaagctaattctctagggctgttctcggctgaatggtctttggaccaaggacctaaaaaaagacgtgtgttctgcgggagttactttgttatacctcataatgggaaggaaagctctcactggtgaccctgaacagttaagatctgacttgactgaatacaccatcactcggttccacttttttcttctttcttgccgtcttacaacgaccttgtcattcccaggaacataaaggacattgcgcaactacgaggcagtgaagaattatgggaagtagccaagctgcacaaccgtgaatcctctttacatgaggtaaaatctcatctttcatcccttgtaaactctccattcatttgattactgcattggtgtgaacataacatacatgttctgttcttctttgccgccagcatttggattcaaatatcacaaaagggttttcattgttagcattttgtgttccaaaacattatatatcttaaaaatgtaaattaccgacaaaattattagatagatgatcgtgagagatgagttcaggttgatttttgtgttgttgtttcaggaattgtacaagtcaaggtacttgaaagggatggagttgagaaaatggtacgaactcaacccaaaacgcatggagtttctagatgcaattccatggtcgctccttgacctcgttgatagatgtttgaccgttaacccgagacggcgaatcagtgcagaggatgctctcaagcacgacttcttccatccagtacatgaaacctacccttagaaaccaaatgctccttaaacggcagcaaatgcaatcgcagcctacagtggttgctgacacagtaagccaaaactctaaactaatattacaattgtaaatgtaaacaagaaaactttacatgaaaatattctctccactgtccacaccacacagctctagaaaactagatagtttgttgttagtgttttcactgtattattagttgaattataatcctcataatcgatatactaattattctcctaatttccatgcatgtatgtacagtatgaataggaaaaccagacttttgatattagtgaaccttaacattgttaaaataaattgaaatcttgtttctgtcttgaaccactgacagccacaaaattttgggtcttcaaaaatatctgtggagaggaaaagtagctctcgaggaagtttctgtctattttgcctagaaattatcttgaaatcttgtagaatggctacgtctcatcatcatagataaattcagtgacgactgatagccacaaaattgacttatcgttatagagtagaagctttccaaggaaaggaaggggaagtttctgtatcacataattatggccttatcttgttagggatttgatttttcaaccactaaaaaaatatcttgtacagtaagtcttctatgcaagtcttctaagaaaggaagaccaagtttacgtattatttgtcccaattgtcttgtaatgggatttgattttaaccactaaaacaatatcttgtatagtaagtcttctatacaagtcttcgaggaaaggaagaccaagtttctcctctctgttactgtgttgtattattgatatacttcaaagagttttcctttgagaaatttcgtctcttctctctcatcctctgccatggcgtcttcttgcttcagatagatatacaatgttctcagatggatatacaatgttttcgcgagcttcagtggagaaaatttcggcaaattgtttcgtggccatcttgtcaaggagctcgagctcgaccgtgaaatgatggatacatccaaagatgatgatatg

SEQ ID NO: 6637 - DNA, 3000 bp, Unknown
  misc_feature (1)..( 3000): cDNA_ID_3090604_gDNA_ID_1621099_Annot_ID_171277 3000 nt of promoter + ATG
atttcacaagagaattatcaacagcaaaaaagtgttggaactaaatttttaaatagcaacctcatcagcaacaattgcatcactgctaccgtggcgtttcctacactcacagtaaaaaaacagtgattaaaacataacgcaccaccaccacagccccatacatacaaaccagcttccacccgtcccactcaccgacctccaccacgaccctgagctcaagtgagctagtcattgtcacatttaggatgtgaaagctaatttctctggtgcttcttttagctgaattggtttgtgcaggtttgcttcagatattgcaccaatgacctaataataataataaaaacataatacaccatcagtcgattccactcttttttctttcttgccgtcttacaacgaccttgtgattcctaggaacgtgaaggacattgagtaactacgaagcagtgaagacttatgggaagtagccaagctgcacaatagtgaaacctctttgcctgaggtaaaatctcatcttacctcccttataaactctccattcacttgattgctgaatttgtgtgacataatacaaatgctctgttcttctttgccgccagcatatggattcaaataaaatggttttcattgttagtccagaacatgatataactttaaaatgtaaattactgataaagtgatttgatagatgatcgtgagagatgaattgaatgcacatagatttttgtgttgttgtttcaagaattgtacgttgaaggggctggagttgagaaaatggtgtgaactcaacacaaacgcagagagtttctagacgcaatcccacggccgctccttgacttcgtggatagatgtttgaccgttaacccgaggcaacgaaccagcgcagaggatgttctcagacacgagttcttccatccagtacatgaaacccttagaaaccaaatgctccttaaacaatacagcaaatgcaatcgcagcctacagtggttgctgacgcagtaagccaaactttaaactaataatacaattattgaaaactaaaagagtaatttagcaaactagagagttagtgttaattagtattttcactgtattatttgaattaaaatcctcataatcgatatacttattctcctaatccatgtgcatgtatgtattgggaaacaagactttgatattaaacaatcataagtacattcttacgataaactgtcttgtacaaggacaactgacaaccacaaaatttgtgtgtttcaaaatatctgtgtagaggaaacgaataacgtaagtttctgtctaattgcctagaacttgaaatattatttctgtcttgtacaaagacttatcataattcagtgacaaccacaaaaattcaatcttcaaaaatatctcttgaatgtgtctccatctcaggattatagtgatggaagctcaagtttgagatttttccctcagatttcaagtaacatcatatgcctatggtggcgttattgtccattgaagcgtttgccttctaattttaaggctgagtatctggttgaactcataatggaggatagtgaccttgagaagctgtggaatggaactcaggtactaattttttattgtttttgttgtcaatttgaaaacagaaatgtgttatgtttattgatttatttgttcaaaaaattaaatgaattttttgaaatgtttacgaacgtctgttattctctctttccttgttttcagttacttggaagcctaaagaagatgattctgcgtaattccaaatatttgaaagaaattccagatctttctttagccacaaacctcgagagactagatctttgtaaatgcgaagtgctagaaagttttccaactcctctcaactcggaatctcttgagtacctcaatctcctacgatgccccaagttgagaaatttccctgagattattatgcacagtttcagaggagaaattgacatcgaggtagcagattgtttatggaacaagaatctccctggactcggttatcttgattgccttaggagatgtaatccaagtaaatttcgcccagaacatctcaaagacctcacagtgagatgtaacaacaagcttgagaagctatgggaaggcgtccaggtaattcatacgtatattatatattgatcaagattcaataagagattcatccgtacaaataaggagaaaggcctagtattgggtatgtgctacaaggagttgggccgaacacatgagaagtctatggagagcttctagaaagagtgaaggcgcacaaatatctcttgtagccgttgaagaggactcacgagtgtctttagcgacatggtcaaccaaggaccagtcgctctcaccatcaagaccaaggaacctcttctctcatgtctctttcagtcttacgttaattgtaaacggtcatattccctttgtgtgtctttaaatacattgtaaacacacaaaggttactaactaattctatcaatatgatttggtcattctcactcatataccaactctcttgttcttcataattctcttactctttgctacaattccgcatattctttcattatatacaaggacaactgataaccacaaaatttgtgttttcaaaatatctttgtagaggaaacgaatgtaagtttctgtctacttgcctagaaattgaaatattatttctgtcttgtacaaagactaagacttatcataattcagtgacaaccacaaaaattcaatcttcaaaaatatctttgtatgtagtgtaaaaaagctttcgaggaaaggaagggccgagtttctttattatttacgtctcaattgtcttgttaggagatttgattttagccacttaaaagaatatcttgtacagtaagtcttctatgcaagtcttggagggaaggaagacgaagtttctcctctctttctcacactatgtcttgctgatttacttctcttaaaaatcttcgtctcttctctgagttccctctatcgtctcccatg

SEQ ID NO: 6638 - DNA, 3000 bp, Unknown
  misc_feature (1)..( 3000): cDNA_ID_3090615_gDNA_ID_1621099_Annot_ID_171274 3000 nt of promoter + ATG
gcaacactcacacatcgactttgattccgacgaagccgctctcagtttctcccgcgagaaaaaccaacaaagaacatctcagaaaccttgagaacgttcttagaacttcgtcaaactctatagatcatatcgaaaatgtaacttctcgtcaagagaagacgacgaagaatacatcgacgtcatcacttctcggaggtttgaatttggcgcgaatatggcctcagatgaaagcagccgtcgacgaaatgtcgccaaagaatctgaaacggctccaaaggcttctctcaaagtcatccgaggaacgttcgccgaagagtaaactcgggtctaaatggcgggagctacacgggttaaacaactgggccgggttgttggatccgttagacgagaatctccggcgagagcttgtccgctacggagagtttgtacaagcggcttatcacgcgtttcactcagacccggaaggttcgccgagacacgtggcgttacctgatgggtcatttaaagtgaccaagagtctttacgccacgtcatccgttcgtttacctaaatggatcgatgacgttgcaccggatctccggtggatgactaaacagacgagctgggttggttacgtggcggtgtgtgatgatccgagagagatccgacggatgggaaggagggagatcgtcatcgccctccgtggaaccgccacgttgctcgaatggtcagagaatttcaggcccaatctcgtttcaatgcctgagcccaaacccgatcaatccgacccgactcgacccaaagtggaatgcggatttaatagcctctacacgacgggtgaccaacacgcaccaagcctcgccgagtctttggtcggcgaaatcagccggctcgtcgagctctatgcaggagaggagctgagtatcagcgtaaccggccacagcctcggcgccgcaatcgcgcttctcgccgccgacgacatcgccgagcgtgttccacacgcgcctccggttgcggtgttttcctttggtgggcctcgagtcgggaaccgtgagttcgcggatcgtttggattcgaaaggagtgaaagtcctccgcgtggttaacagccaagatgtggtcacgaaagtccccggaatattcgccgataacgataaacaggggcaaagtcgtaataacgggagaagtccagggggtattatggaaatggtggagaggaacaatccatgggcttactcgcatgtgggagcagagctccgtgtagacatgaagatgtctccgtacttgaaaccaaacgctgacgtggcgtgttgccatgaccttgaggcgtacttgcacttagtcgacgggtttttggcatctaactgtccgtttcgggcaaacgcgaaacggagtttaaggaaactgttggatgagcaacggtcaaacgtcaaggttttgtacacaggaaagtctttaagacttaaccgtacttttcatgataacggagatgttttgcctagtccgtcgtcttcatgagctttgatttattaaagaaaaaagatttgttctcttttaatactttttaagtatttgtttattttttctaattaccaaaaaaagtatttgtttattttgctataattattatttactttttctaagattaagatattcattattggtggggggaattatttatttatttgtttgttatgatttctttgtcgccattggtgataataaaagattaaaaagttgtgcaatttagactttcgcgtttgttttagcaaatgtgatttttgcacaaaaaattgtaaatagaataaaatgaaataaatgtcattggttaaactattagataaaaaataagttttgctagagaaaaaaacagaaaataacataatctatgtgtttaaaccttaaatttcaattaaaatggtactgattaattattttcatatatacataggaacacttgaatatatgaactgcaaaactatgtttttttaaagtgggactaaatgaccaaattttattaaaacgacatatggaagactagtatgttgtaaccaacaatgaacaataaccaatactgaaataagttattgtttgtttgattttagaattgttacatccggtacgacgaagtctgaatcatcataagagtctggatcatcatctgagtctcatcacacaattgtttgcaatgcggttctaacatttatccacttcatattttttttatataaaaattgtttatacgtttccaacacgtaaacacttctcattgtacattttcttttttttttttgctataatgactgaaaccatgcatgaaaagtcttctaaatagaatcgaactaaaagaaaaattacacttaaaaaaacaaattgcaatattttttggttttatttggtttaaaactatgtatgatctagaaaaaaaatattatgagcctaaagtgaattattctgattctatataaatacaaacggtaagtattaagttagaaaactaaatagtcttatgtatacaaatctcttcataattcattaaatatattgtaaattgtaatgagtattttcatatacatagactgatagaagcactttatcgttaaaattgcaaaataaaagtagttataagtgggcataaatgaccaaaatttgctaaaatagattgtttttttttttttttttttggtaggggacactggacagggagataatccaataatgaaatataaacttttgtttagatatgccgtcggtttaagtattctgataatcaccaccgtttttttgcctattccaaatttccacacattttattttcatttcttaatatttatttccttatcatttctttctctcaccaaccaacaagttctcctttctacccatttcgtctccttcattttgacgttttctttagatctgttaataatcccatccatggcttggtctagtcactagtggtgttatctctctgtgtggaataaaaagcaaggttttttaatcacttggattgttttaagat

SEQ ID NO: 6639 - DNA, 3000 bp, Unknown
  misc_feature (1)..( 3000): cDNA_ID_2993912_gDNA_ID_1621099_Annot_ID_171269 3000 nt of promoter + ATG
tgcaagtcttggtgtcgtatgagatctataatgtaatcgttaacaaagaggggatatttgatcataataatggtccgtcgatgtcctcctaagttggtaaatcgtaactgccagttttcaccagactctctattctttagaaaacagaaaaaagtaaatgatttaggaggttactctcttttttactatgtacttattatcttgggttcttttggcgtcgtcgttatttacttttctatggagtactaccgagtacaaataattggagaggagtcatgcatgattattgattagagaatgaagaaattaaaacccaaaactggaagtccaaatcagacaaaagcacctgtggcccacaaaacaattgaggacgatattacgtgaaggacaaatggtcatttgacggacacacctttcttttgttagacgcagtcccgttcgtggtagggtcagatccacgtgaagttcacatgctttccatgcaccgtttgggtcatcctgttggtcccgctttattaactagtctatttcctctattaggaaaattcaattttcgaaacaaaaatcaatcaaaacatgtataaacaaactgataaaaaaccacacaaaaaatatggtgcttttctgagggtatatatattttttgttttcgtctgatcttatattttaaatttggattttatattcaaattttttgtatattttgtggtcataaattgtccaagataacaattcgtgaccaaaaaaaatatatgtgattattttacagaaaacaaataattaccaaaaaaaaaatcatatcttccaaataaaatgtaagagaaaataagaagattatatatgtgagaactttatgagctaaataaaatgaagaaaagtcatagtttagccgcgtaggaaatcattcagaattcagaaatatggctcctcgctaatatttttcttttaaaggtaattgtttttcaacctaatttgagagcaatgtatatcgataggtttcacattagcttatttcgctcacatacatgattgtgcaaaaaaacagaaacgatcgttaactaattatctaagaaagtgacatttcaaaaaggctcatttcaatatagagttgccttcttcatgacatgaccttgatatgataaattccctaatgtaatgaatcaataaaacgaacttatagaacggtagaaattacgtacgtgaggatttatatcatctattaattaattaattgacaacaaaaacagaaggggtagtgttcacgtgcatgtcacgcgggtaatggtgtggacacacgagcctcgtacggtgtaaagaaggagaacagagagagtcgcacgagccgcacgtgggatgttgacttgtcgattagcttaaggggtatgtccatatactaatgattaagtacagtcgaatgaaaacatgccacgagccctagatctacatgtttattgtggttttttttttactcagtcacatccacatgattaatattggtccctgatattcatcttatatatttcacaagtataacaatcacccaaacattagtttttcttaaattgttttacggtgaaatgtttcactgtttcctctatgaataattaactagtggagtggaatttattcatttatcatatccacataattcatctttattttcatttgtgcatataatatatatcctttaactttctcatgcttaccatttaggctttttgtcttcctcaaccttcttaaactttaatatcccccttaaaaacagatgaaaatagtctttcctcctatgaattttcccaatcactttacaaattattaaaggtcttccaattaacctggtttcctaataatgttgagtgtaatcctttcacaagcttttcttaagaaaatgaaaaacaatcatatatgtacaatactagagatatataatgagtcatgactcatattaatcgcggtttttgtaatatcataaagctttctactttaggcttgacagtgatttaatacagtaacatatcacataaatatgagaaatggaggctctttaattaggcctttacaatatacatatatattagaaatagaaagaaaagaaaaaaatcgaccgacaacaagattggtgaagaaacgcaataattgaaccattaagtacagtctaatacccgcagaaaatattacaccacctactcttagtggcaatgctgtactttaacatattgtcgagacaaggagaccaggttgcgtgaaatcatgtagatgatgatgcataaacaatcaccaaagttcaccctatgaatccaagcccttctagcttagtggctatgatcatagccgacatctcatacagtcacattccatttcggagtaaatcatgcgatgaacaaaatttagcttgttctcattacaagataacaaattggatactatatatcaaaaaattgtgagtgttaggatttggatcaaatctaactattagagaacgataatataaaaaacatacatgatttgaagtagtttactataattttgatagatttagaatttggaaatagagaacgattatagattttgctagtagaatttggaaaaagaaatgctattaaaaaacagaatatattctttttgtttaacattttattaatataacaaaccaaaatatagtttccgatattggccagaatatcgtcgggctacaaaaccggaaatagacattacggataaagcttaatccgtattttcactctatttcgcgtttaatactttgtttgtttactattaagatcaccatactatataacaaacaaacaaaaaaggtcacacaactacaataaaatgctaacaagccgaaagtgtacggcagcagtgtgtaatcgaataagtatcattaaagaaggccatgctcgattcattactctataccattccttaatatattagtattacatgggcaacaacgaaacaggataaaaaagagagagtgatcagtgatgatggatggtc

SEQ ID NO: 6640 - DNA, 3000 bp, Unknown
  misc_feature (1)..( 3000): cDNA_ID_1815117_gDNA_ID_1621099_Annot_ID_55799 3000 nt of promoter + ATG
tagtggattaaggcattaagctgtccaagttgcttgtattttcttttcattttattaattaaaaaaaaagttcaactatttattgactaataataatacgtgttaaatggttatcggtttaaaatatgggccataggcccagacttgaagaaaaacttgaaacccaaagttttatttttacttgttttctttctcagtgaatatctcccaatcaagcttcttcaattttgcttgctctctctcttacacggccaatcggtgttttcgcagctttcaggtttgtctcaatctcaaattaaatcggagtcaagtaataacaattgataaccctaattgtttcaattatattgtaagatttgaaattttgcagtagatccggaatcgtattctagttctggaatcgttgatctcgatggaattttttttaagatttcttcatacacatttggttcaaaagatcacataattttattttaatttgataagtatgatgattctgctaagtggcattggataaagttttcatttttgcaatacgtctaaacttgtctatgtcttgaatgaactctctgagttgcttaaaaagtcttgtgctttctttattacacaggcctcaatacaagacattctatataagcatattgcagaagaggcggttctaattgttgcatggagttgaacaatatgacgtagggaaattctaatttaggggaggcctcagagtttgcactaacttcataatcagctctggacgttgttgattgtatttgaacaagaatgtgtaggcagaattgtcgcgcgaaatcctcaccggaggaagtgatttcaactgatgagaatctcttgatatattgtaaacctgttcgactatataacatctttcaccttcgctctctaggcaacgtatgatttggccttcctctctcatcattttagcttagtaatctttcatctcctgtgtagatcacccactaatagtttgagtttgctaagctgattatggtctgactcatggcgagtgtgtgcttcttttgtctcctaatgttatttgaacttgttgtttgttgttgcagccatcgtttctgccaagatgcttgaactacaaaattggggcaaagcgcaaaagaaagtatgcgtttcttcttgaatgtagttgccacagtgatatgttatttatcttacttctaatatggaagctgatgaactatttatctttgttgagtagatatggacataatgaatggtttcttctttgttcatgctatacacttatattttacaaaattgtgttttgcttaggtcaagatctactgggatggtagttttcaactataaggattgtaataatacattacaaagaactgaaggttagtctttttctgttcttcgacaaaattcgatgtcaatgtctatgtttctctagatgatttgttatttactatttttttctgtattgtcacgcagttagggaggattgttcttgtccattttgctctatgctatgtggtagcttcaaggtgggcaactattacaactgaggtttcttccggggcctttcatatctaacactgtgaaatgctactgccgtttaatgctatatactttcactgtttggttacatatttttgtgtttgttgtttgtcttcttgctctttttaaactgctgagtgtgtgcttatctgagaaaacatgttccagttcgagcttacaatccattgtcttgtgtctatgcaggggctgcaatttcatttgaattcatctcatgatttatttgaatttgagttcaaggtatgtggttttatggaatttcttgttttgcctatgccgttagtaatgaggttatagttaaaaaagggtctttcctattgtagcttttggaagaataccagacagttaatgtttctgtaaaacttaattccttcatatttgaggtcagttactttaaacttggttaattgggaaatcctatagctggtgaaaatttggtttatattccatccttatttgtactaggaagaaggaagtgatgatgataaatttgagcccttctctctctggtaactctcagaaccccttgattaaataccttaatagcagtaactccttgcttttcttgtcagtacttctctataaatccaaccacaatgttttgcagctcgaaacctcgtaagcgtagacaaagaggtggcagaaataacaccaggagacttaaagtatgctttttaccgttggattcacccagtttagctaatggcacagaaaatggaattgccctgctgaatgatggtaaaatcacatcttcttctgtggtattcgttgtggcttagaacttcattttacagaagaagatacaatgtcctgattgtttagtttttgtacttctcctcgcattcttcttgtgagggtaatgttaccagaactgatgtacaaaattaatggcatgctacaggaaaccgtggtttaggatatcccgaggcaacagagcttgctggacaatttgagatgactagcaacattccaccagccatagcccactcttctctggacgctggtgctaaagttatattaacaaccgaagctgtggtccctgctactaagacaagaaagttatctgctgagcgatcagaggctagaaggtttgttcatcatgacaccccgtcatcataattaccatacctgttgttacaaatgttcttcctattatggataagtgtttactgtactgccatattaaccgagaaaatttcttccagccacctacttcttcagaaacgccaattctatcattctcacagagtccaggtgatccaagttccttcacctacttcttaggcattttctttaaattgctcatgatgatatcttatcaaagcatacttggtttgttctcatctaaatttgtattttgattctgtatgtatcaacgcaaaaaaattatgtccatgttgtctccgttttattgccactaaccaaaaactgcatgtttcttgtgacaagcca

SEQ ID NO: 6641 - DNA, 3000 bp, Unknown; identical to SEQ ID NO: 6637
  misc_feature (1)..( 3000): cDNA_ID_1815113_gDNA_ID_1621099_Annot_ID_55800 3000 nt of promoter + ATG

SEQ ID NO: 6642 - DNA, 3000 bp, Unknown; identical to SEQ ID NO: 6636
  misc_feature (1)..( 3000): cDNA_ID_1815101_gDNA_ID_1621099_Annot_ID_55803 3000 nt of promoter + ATG

SEQ ID NO: 6643 - DNA, 3000 bp, Unknown; identical to SEQ ID NO: 6635
  misc_feature (1)..( 3000): cDNA_ID_1815097_gDNA_ID_1621099_Annot_ID_55804 3000 nt of promoter + ATG

SEQ ID NO: 6644 - DNA, 3000 bp, Unknown; identical to SEQ ID NO: 6634
  misc_feature (1)..( 3000): cDNA_ID_1815089_gDNA_ID_1621099_Annot_ID_55806 3000 nt of promoter + ATG

SEQ ID NO: 6645 - DNA, 3000 bp, Unknown; identical to SEQ ID NO: 6633
  misc_feature (1)..( 3000): cDNA_ID_1815077_gDNA_ID_1621099_Annot_ID_55809 3000 nt of promoter + ATG

SEQ ID NO: 6646 - DNA, 3000 bp, Unknown
  misc_feature (1)..( 3000): cDNA_ID_1815069_gDNA_ID_1621099_Annot_ID_55811 3000 nt of promoter + ATG
aacatatcgagatttgtggcctttgaaagacctagaacttccttagatttatctttctgagaattcgaagtggctaaaaagtggacaattaaggttttgattgtggtggccggtgtacggagccagcaacaaagagcatgtaattaaattagtgctctattgtggtttataggttgtcatcattcggttataacattgttagatatactaagaaataaaacatatctttctgtcatcggtcgtttttacaaatgactaacatatatttaccgtaattactttagaaagcttcggcatctgtttaaagtaataaatcatcaacatgacttgaaaaacaaaaaaatgcagatatactaactagtactgctatatatatatgaataaaatttctatatagttctttttaaatgtatgatttctgttattactaatacacattggaaaatggttggggcaatagagaaagacagacatgtgaacgtcactttctttttagctgtcctcttgggtcgggcatatctatattccctaccatttattcactatacccacctttgtcatattcttccattctcaaattcaacatatttgaaaatttctcattttctttggattttatgtatttctacacctccataaaatgaaagaataaatgaatttcaatgagaatatatagagaaaatgtatgcaaaattccaatgacagcttgcaaatatagccttttctttggtttgtctcttttaattattaggaagaacatttttacacatatatatgaaaataacatatctgaataacgtattttttgttaaaaggaattacggatcggtgagtctagtgactatatacatcgatattatcgactaacaatgagaggtattgtcgtattgatcatattgtgccttgtggtatttatccttccaagttgtaaccatatttatgtcctatatatgactacgaatgcaatgttccatagatagaagaaatttacatcacatacaaagtctctcttcaagtagagtcaacgataaacttattaagcacataatgcaaacaaatgtctgaatcgtacatcaaacacaaactcaaatattataaaatgatgaccactaataatttgagggaaaaaaatgaaggtaaattacaagaaaacgatcgaggctgaccaattcaataatcatttcaaacgaggagaaaatgggctgcaacaactccaacaacgcatgaaagtgttacgacgttgtttctaacattgaaagctcctgaatccggcgaagccgccattgccggtggcatgggtcctggagaaggtgaagattccattccggatggcatcggcggcgaaggcatatccggaactgttaatgggcttgggcttgtagatggagtcattggcatcattggtggtgaagccatgggcattggtggtggagccataggcataggtggtggagtcatgggcatgggtggtggagtcataggcataggtggtggagtcatcattggcatcggagacatcactggaggaggaaccgagcttccaccgccgctagacataggcggcatggacattgagccagaaggagccatcatgggagcttgagctaaagagaaaggaattaaaaccatagacaatgtgagcaagaagaaggcttgtgaagagaaagaagaggccatggctatgtgtgtttgtgtgtggaatagtcgtttatgtaaagtgatatatagacagagatatgtgtgagagtagtaaaagaaagagtgggagagaaaagtgaaggttctttgtgctatttggatatatattagagattatttgttttataattttggatcgttggatacaatgtgtgacacgtatcagtcgatggataggtatgagatgctgatttattttcctccacaaattggaaagaaaaaaaagatgaaaactccaaagttgaaatctcattgtaggtacagatagaatagtcaatatatatggaaatggaggatattatgattacaatgccttttatatttattcttttaaagacatagtggaaacgatcaatcggattcacgggatggtttttaaggggccatatcaaatttattagaacaggtcattactgatgttagccattcatatgttagaacattaatgttcattttgttttctgtaaatttaacagaaaatttatgataaccatatcaagatattctataatattatcaggagaagacaaaatttacataggacaagataaaagagcataatgctatgttacaaaacaaaaaacgaaaaacaaaagggaccatttgtgttgtatttagtcacacagcctgatttagctccacggccaatattatgtccgcaccaactaaccgacattttggttaccccataccatttcctttgtctctcacgagcactctttggccatcatttactatttatccatctttacattataccatcacaaatgcacatgttccatatatgatataaccatccatacatagtcatgcatgcatgtatatatatattttatgggattactttcatttgaaattgacgactaatgttgttttctgtaaccatgaactccagtttttctctttgcatgttataaattgaacttctagagcatcaaaaacattaggtaaccaataatagtatttgagaaggttattcaaatatatagttcgaaatgcagcaagttttagcatcttgaataattgcattgttctaaaaattatctacaagactacaatcaatgaaacatttccaggctatatgggctcatttaaaatgggcctgtagacgcatgaggccgtaaataatccagctggcaaagaaatgagcgggaacatttttatgtacaaaatcctcgaaacaaaacatcacacgtaccgcacgtgccattctcccgctccttctccatttgccccccaaatctcaaattctcaaatccctagcttctctctctctccctcagattcacagcatttgcaatg

SEQ ID NO: 6647 - DNA, 3000 bp, Unknown; identical to SEQ ID NO: 6632
  misc_feature (1)..( 3000): cDNA_ID_1815062_gDNA_ID_1621099_Annot_ID_55813 3000 nt of promoter + ATG

SEQ ID NO: 6648 - DNA, 3000 bp, Unknown
  misc_feature (1)..( 3000): cDNA_ID_2107486_gDNA_ID_1621099_Annot_ID_55815 3000 nt of promoter + ATG
aagaagaaatagacatataattataatctctagtagagatatttgtactagtagtctatgcacatgatgtgtaaaaccagtggaagataaatgagtctttatgtgaaagaatagtgaaattaatgagattttcacaagataagaaatgtattatgaagagatatattctcttgtggtggatgtaatatttttaagtatctaaagtctgacaataagagacagaacactggatatgacatttatatgaaattattgaaagatataatctctgaaggattaattatatgagaattatgttctctagaactctactcgatcgaataaaaagaaatatgtaacatgacatataatcatataaatgtatatttatgttgagtttgtcaaaatatattgatcaaactaatatttgttttgaaaatcattaaaactcgtacagagttatcataagtaatacgatgacaataatctatgataaaatatcactagataatgatatttataagtctatatgaaaaccatataattttgatcattaagattatggttattaattccaacgagatattgtatttgattgaaaatcatctccttaagaagatgtttccgagggggagattgaatgatatgcgtggatgtaccctttttccttatcatagtttttatcccacatgatttttctatgacaaagtttttaacgagacattaaagaacacgcaaataatacacttgatgaatattaagaaattctatcaatcatccaaatgaatattatacactaatgatatttagagaaataaataagatggtcaagatgaatcatctaaaagattcatgagcagaagaatgacgttgtactttatccagaaatttgttcaagagaagatttggcagacttattctcaaatactgtttattctctgccacatcttctaatcatgcagagattttactaattcatgaagctagccgcgagtgtgtatggctaagatccatagttcaccatatacaagaagactgtggtatgtatgcagggaaaaaaactccaacaattatgtacgaagacaatgcagcatgcatcgcacaactcaaagacggatacatcaaaggcgatagaataaagcacatcctaccaaaattcttttacacacacgatctacaaaagagcggcgatgtacgagttctacagatccgttcgaatgataatctggctgacttattcaccaaggcgctacctactgctactttcaagaagttagtctatcgtatcggattacgccgtctcaaagatctcgacgaatatactcataagggggagtaattgtatgttgcactctttttcccttaaccaaggttttcctattgggttttcctggtaaggtttttaatgagatagcatttcaaatactttacgagttatggtactataatggtcatcaagggggagtgttatgaataaagatggatgcccattataagacccatcatctaagcccatcatttagatgtttgtagagttttacctttttcttgtactcctatataaagaacccttttctcaatagaaaacacactcatttcttctatctctttctcaagagaaatttattttcaacggatacttgtgacttttggagactcgagaatctaaacaacggcgatctacaaagataaagagttattgagctcactatgccaagttctgaaaaggcccacttcaaattataaaggcccagtttaagcccactatggaaacgagacagaagcaaatgggtataatcttcaagtcaagcgaacgatcggtgacggtgttatcttaccgccggagccggagtttcccactctattgtaataacagatatttcgaccggagtttctaagtgaatccaaatttgttgttcttcgttgcggctccatctctcgctgtgtatttatagtcaggtcttttgagttatcccattttgcgcgatcccgtcttcaccgtttccatcttccagcgagcacatctctgttgatcgataattttgtacctagttcaggttagttgcgtaattatacttgtgtaatttctttttttggattctctctgaactgatttgctgggcgtggaccttcggttttgttcatttcgtagtcctctatgcgaatgtttccagcgtttgatctttagatctgtagttcgattgtatgcttctaatagttattcgttgtcttgtacatttgatctataatgagaactgatgcgcggttttagtcgaacgcgacatcgtagttcggattagagagtgtactaatctttgtttaacaaagatggcatttcatcttttgactgtgtgatatgtcaaacccgcagaatccataaaactagtttactttgatatgttttgttcttcttcattgaatgtttgtgtggtgtcttgtagttgtaggaaagatgaacaagctgttggaatatgggagaaaagctatgttctatgtgagagttctctccggctatgaagaaaggagaatccggagttacaggttgcaactcgaaaagcgtatccagcaggtttctttctcaccatgcctctatctaatttcttagcataaatggtagaataagatgataaaaccctgctttggactatagttggtcgcataaatttgaagaaccctgtctataaacattattacccttgtttttattcattgttaatggaagtcaatatgtgtacttctagtttatgataattgaataatatctataaattagaaaagcttagtacttattgtacattgtgaagactgctgaaataagatcttccttacattatagtttcctaatcgtatagacttctgtacttgtgacttctagcttctagcttgggttggtcatggacctcatggttacctttttatctgatcaaacctctggtcctgcaggctaaccaaaggaaagtagagataaacagacttccagagcagattgtattatctgaagtccgccgtatggttgaggag

SEQ ID NO: 6649 - DNA, 3000 bp, Unknown; identical to SEQ ID NO: 6628
  misc_feature (1)..( 3000): cDNA_ID_1815046_gDNA_ID_1621099_Annot_ID_55818 3000 nt of promoter + ATG

SEQ ID NO: 6650 - DNA, 3000 bp, Unknown; identical to SEQ ID NO: 6626
  misc_feature (1)..( 3000): cDNA_ID_1815035_gDNA_ID_1621099_Annot_ID_55821 3000 nt of promoter + ATG

SEQ ID NO: 6651 - DNA, 3000 bp, Unknown; identical to SEQ ID NO: 6625
  misc_feature (1)..( 3000): cDNA_ID_1815032_gDNA_ID_1621099_Annot_ID_55822 3000 nt of promoter + ATG

SEQ ID NO: 6652 - DNA, 3000 bp, Unknown
  misc_feature (1)..( 3000): cDNA_ID_2990093_gDNA_ID_1621099_Annot_ID_55823 3000 nt of promoter + ATG
gattgtcagatctttctgtctacatgtgtagactagaaatatcttcatgtgatatttatgggaaaccatgtcttgtcctttctgaaaatgatacaacataagaagagatgtaagagaaaatatcttctaataatttttatttcaaagagatatttaatttgttttggttacagataaactcgttagcttatatatctacacttatgttcacttatcacatcacaaagcaggaaaatatcttagcgacaatgacaaaccaaagctcaactgttactacacttgaatttctttagttttacaattaagtctagacgatgatactctttgaccattgagataaccacaaaaccaaatcagtttgccatatacagtctaccttcttgcattcacaacacagaaatatttctacacacgcgttaaacaagactacaaaatattagcttggccttaacccaattgaaaaaaaaaaagcacaatcactaagccctaacaaatttacacatctcatccatgaatgaataccaccaagttttaccattgtttcatagctcacaagtcacacgagatcatacgatttctaacccaaatcctagatttctaactataatgacagaaaatattgttcagaagccttagttagatatgttaaccaaattggtacaagcaacatttaaagaacagagaaagaaaaaggaaccaagaaaataaaaaagatgtgccagagattgggttctagaatatcctagatttttacaatgatgaaatctaaagccaaaacaaagaagcactaatcaaatgtagtcgaccaaataagtgaggagggtaaaaaagagaagtggggagggtaagcaagtaggttacgtggaaggaagatatcaacgcacaaaaagagaaacactcaacgttaagggaccaaccacaaatcttggatttttgctgatgcagtgtgtgaaaacaggtccacacgctttgtacttttttcatcatcggtctacaataaagctcaagtctttccatggacagagataagcaagaaaaagtattaacattgttcacctcaaaataatttaggaaaatgacaatgagatttttacctcaaaagccaaaatcaacatctacccattctttcactcgtcacaatcatgagtttcttacaatgcttaccttagagtttagagacatattctcacaaaaaaagcttgtgtctatttcaaattcttgaccgtagatgtcacaacatgcatatatcattgaaaacagagcaacacaggaaaccaagcatatgtatctagatatacttagcaagacataactatagtctttgaatcaacatagggattaatgatagagaatgaggaagctcaagattttatactcagtttcttacaaaacaaatttctctctaactgcaaaaacaccaattaggatttgaagagcgtacctgtttgagtcaatgtccaatgtcgtccccccgccttctacatttcttagcctgctgaataaaagcacaagccaaaatgagaaggtgccaaaggcgataaggatcaatttctaccattcaaaaaactaatggtgagaattagaaacgagagaaaactacttgttgaggaaatagccaaaagcgcaatcttcgtcacctgaataaagaccaaaccgtcactttcaatgagtcagcaagaaaaagagagagagagagagagagattctctataacatttgagtcgacatggattctaatgcatcaaaagtcatctccaataaacaaacacttgaaactcacatggctaatagaacaagatcaaagccttaagtattaagcattacagacactactggctaacttttgacacatgttcttaagtaacatagtatcaatatccgtgaatcacatcgaacacacacaacaagggcttaatgcatcaaagtcctgttatttccatataacaacatatttcatttacaaacagaatgcagcattcaggcagtccaaatggaaaggttgacaaaaaaatataatcttgtaactctacatatatggcagaatgtaataaccaggcaagaaaaaaacagaataaacagatcaatgagtatgatataaaaaaaagtcacaaagaatgtgccacagtgaacaagagggccatgagaagaaattttcaaagaaaatattagcattgttagaattttttgggtcaatggatctgtcagctgcttagttggaaaacacaaatcttacaggaaggaaagtccaagaaaaagaaaataagcaaagttaatagccaccacaagaaatttcatacagaaataattaaatcgttgcacttatcttcttattcaaactaaaatcaagagaacttaataattttcagccacacgaaccatgtgttcaaagccaaaggtgagaagccaaaattatcagcttatctccattaacaagggaaaagcaagactagatttaagagttctctgtaactaaaaactgcaggagtgagtaagtaaataattcaccaacaggaaaacaaaactcaattatctatagctgaatacacatgtaaatgagaatttattaactaaaacatcttcctttgtaactgatgtgacatttacaatttttcattttgaggtgtaagaaccgtgtgacaagtgaaaaggttaaaataagcaacctttgtgatattttctctccactttttgaaattgggtctccaaaccacagccaatcaatattctttataaatacaaacacacaaacagcatctttctctcaaacacaaacatatcttctatcaaacaccaacagctctattctctacctcatttctcatcataacaaagagagagaaaaaaactatggaattgacactgaattcctcgagttctcttatcaaacgtaaagatgccaagagttctagaaaccaagaaagttcctccaacaacatgacctttgcgaagatgaagccgccaacatatcaattccaagcaaagaactcggttaaggaaatg

SEQ ID NO: 6653 - DNA, 3000 bp, Unknown; identical to SEQ ID NO: 6623
  misc_feature (1)..( 3000): cDNA_ID_1815028_gDNA_ID_1621099_Annot_ID_55824 3000 nt of promoter + ATG

SEQ ID NO: 6654 - DNA, 3000 bp, Unknown
  misc_feature (1)..( 3000): cDNA_ID_1815024_gDNA_ID_1621099_Annot_ID_55826 3000 nt of promoter + ATG
ttggatttcaatgaaggtttctgttgtcatcaatctggtggagttgtgtttgtatgctgggacagcaagagatacaccgttggctgctgtacaggtacgcttccatgtaccatgttcatttcatttgtcatatttatctaggagtatttagtattattttgtcctttggagctgccacagctgatacatttaagagggatataagtaataccaactagcgagaagttgggggcatatgcatttgttaagttctttcttgaagaaagccgagggtagaggatccctttgcatagatacttcatgcggaattgcctcactctggaactggttccccaaaaagatttcaaaattgttgatccgctatattgatatggatttattcaaatcagtcttttgtgaaattcctttctagttcctgggattagtcatgtgattgttcttatgggaccctacatcttctctatttctttggctccattttctgttctcgtgatctattttttcctagggattttaaatcaaagggacttcatagcagaaacaacctcatggcacatagttaacatctaaacaatttttttcgtatatgcttatagatctctggtggctggcttctctacaaatccaatacacacgatgagggtttccttactgcaacattgaagggattcagtgttattgacaaccgtgaaggaactgaaaaagagttcagactggctgtaggaagacctgcagatttagattttggagattcacattctgtgactgataaaaatcagggtttaactcagtcacatgtaaccacggggagtgatattggaccctttccttcgatgctcactcttgatgcgcaatttggtcagttgtcaacttttgtttccgtttctattcaaaggccacagttgcttgtagctttggattttctactggccgtagtagagttttttgtccctactataggcagtgtgctatcaagtgaagaagataaaaaccttaatatggtcgacgcaattgtcatggataagtctatctacaagcaacaaactgctgaagcgtttctttctcctcttggtcctttgatcgctgaagatgaaaaatttgataactttgtttatgatggtaatggtggaactttatacctgaaagatagaaatggaggcatcctctcttcacctagtatagagcctattatatatgtaggaagtgggaaaaggttgcaattcaggaatgtagtctttaaggtatagaaattctatattcaattttattactcggtgttagatcttaaatttatttctgttgtccttttattttgtctcacttttttcatattgacacagaatggccaagttttggattcatgtatctctttgggagcatgcagcagctattctgtttctagagaggatggggttgagttggaagtatatcataaagccccacaacaagactctgagaggaaggaagatccggtttctcaatctcccagcaccacaacagagaggtccacggaaatgatcattgagtttcaggttcttatagtggccaactttcttctttgtatgtgcataataagccaaggaaaaattcccctttaatgtttgaagctcgtttctactgttgcaggctatcggcccagaacttaccttctacaacacatcaaaagacgtagttaaaactccattactctccaacaaacttttgcatgctcagttggatgcttatggcaggtcagtggtttctctgcgattgggaactgaaatttaagcatgattagttgcataaaaattgatcagccttgcacagctgttgttcatatttctatgtcattcctttgtcttttttttactggtacagggttgtcataaagaatgatgaaattaaaatgagtgctcatacgttgggtctaaccatggaaagtaatggagtgaaaattctggaacctttcgacacctttgttaagtattcaagtgtttctgggaagactaacatacgtctttcagtttcaaacatatttatgaacttttcattcagcatcttgagattgttcatagccgttgaagaagacattttatcatttctaaggatgacatccagaaaaatgactgtcgtctgctcagagtttgataaaattgggaccataagaagtatgtagagttatttgttgaaattttatcagttcatattgtttttgttacctggtacttagtacttatattgcatgcagatccctgtacagatcaaatatatgcattctggagaccccatccaccccctggttttgcgagtctcggcgactatttgacaccattgttagtctactattctaggatatactatttacgcaagagcctttgcaagttaattaattggtatattacatggcagggacaagccaccaactaaaggggttcttgtggtcaacaccaatttgatgagagttaagaggcctttatcattcaaactgatatggtcacctttagcttccgggggattaggtggttcttcgatggatgacaaagatgaaagagatagttcatgttccatttggttccctgaagcaccaaagggttatgtggcattaagctgtgtggtatcaagtggaagtacaccgccttcattggcctctaccttctgcatcctagcttcttctgtttccccttgttctctcagagattgtgtagctatcagctccacagatatgtacgctgctatgaacctttcacttttacttttacgagtagctcactttctatacacatggacaagatgcatgcacaaactaaaatatatggggatgtatgttcccttgtgtagacatgtgcaaacatgcttactatctccttttcctgacatatatcataagttgttttttgcttgtgtctatgtgacttatatgcggaagtctcaaatgaaaactggattttataactccctcttttagggttctatttatttttcttttcttacccaatacataaatgattccattgtagtatg

SEQ ID NO: 6655 - DNA, 3000 bp, Unknown
  misc_feature (1)..( 3000): cDNA_ID_1815016_gDNA_ID_1621099_Annot_ID_55828 3000 nt of promoter + ATG
agaggaaaaaactattctcaaagccacgacttttgagaaagaaaatggaaaggtagaatcagattttcagatctcgaggtggtagatactcgagaaactaagaaacaaattatatatttcccttttgaaggttcgaactctggtctgtgtggtcattgcgctatcaagaaatctcgacctttttagttcattctgagtttgctgttcctttcttctccagctcactaggtggcctgatatagactgacctgtaaagcttaaaaatatctaaaaacataaacttttaacttttacgggtgaaatgtttaaattaaaataaatataatggttaacaacaaaaacatacaaatttaaagatcatccaatgatttttttttttttttacatacatccaatgaccatctaagtgcaaaatttatattattataattaaatattaattttttaaacataattaataagaaaaactttaataaaaaaaaaaaactaataagaaaaaccataaataaagtagtacaaaattattaaaaaacaaataaatatcatagtgatatgtttattattacttcatgcatttggttgatcaccaaaaactacatcaagtaatatgacaaactacaaaaaaaattgtgttttgaattcgtagatcttcaagatcgacaatatttttacaatacttatgttcatattttgtctttcttcagtttgaattgatactatgattttgatgatttttttttatatagatatatatatatgatctaagtatttgtcgcttatgtgattttcttttttcttgtgactagccgctatcgtctgcaaccgcaaatatttctagaaatgagattttgaaatttagcgatattgagtggtgcaaaataatttaaagtaaatttctaaatatgttttaaatgctaacaatcgcaatcgttcacaagtttgcgagttatagcggaaaaaccaatcaaaattcatgatatattatagcaacttcacataattcgtctattcaattaaattcgatcacctatttgtatataattttggttgattcagattttagttggttataatttaaaaaacttcatattttaagaaactttttgtatatgtttaactagaaatgatatattttagtaatttcggttagttcgattaatcaaaaattaggctgcgtaaatccgatttatctaattggtttatatggtataggaatttctccaccggttaaattatttttgaaacttaattaaattttggtttagttcagttactgattagttttttctttttaataataaagtttatgtcgacaattgataaacaacacagcaacacactgcactgcaccgtcatcaacagcagatatttttatattccttttacagagccgaaactctcccccaagtcattgagtcatgactatttcacatttccaaccgcctcttgcgtgctcttgaggaaacgatcctcatgcctctccttcgattccgtttctagtccgatcgaaatcgaactctttgagaatttcattctcttctcacgattattgattttacatttgttttttcccttttacggtgagaattttgatttgcagagttcaaagatgttggaagatcaggtagcttacttgttacaaaggtacttggggaactatgtgaggggattgaataaggaagctcttaagatcagtgtttggcaaggttagattgtttctattttctcgctgattttgtgtaatgtccggatttgagtttaaagttcaaatgtgctattgagtagcgattttgagttgtgaacgaatgtgagaactggttaggttttgtgtgctgtgattgactgcgatttatggaattgggttctcttcgagttatattcgggtagctagctattaaacggagaagtcaatagtcacacttctggatttttgagtttagtgtttcttttttcaggcatgtgttgggtgttttagttgatcggaactgttcaatttcccgtgtggcatattacatgattaaaatgatgtaggattgctgcttgctttcaggctttatagcttcttcgctcatggtttatcttggtttgtgctggttgttcacttataattgcttagttacttctcacagttgttactaagaacagatgattaaataaaaagaaggttttagcatacccatgtcaataaatttgcttttattttttccatttggttaatatagcttgtggtttaacttgatttcgcaggagatgtagagctgaaaaatatgcaactaaaaccagaagcacttaatgctttgaaattacctgtgagggttaaagctggatttcttggatcagtcaaactcaaggtgtgttttgtgtgtgtgtgttttcttatatatatcctatctaacctaaacaatatctacttgagtgcattagttatcttttcgtttttctattccatttgctcacgagtagtatttcacttgttttcatggtctctatcagtcatcttactcaatgtcatacaatatttattgtttttattctgggactaagtttcttcattgaattcatcttccaatagttttataaactcagttagacccattttttgatatgtttaaaaatcatcattttaggtaccatggaccagacttggacaggaacctgtagtggtttatctcgaccgaatttttgtattagccgaacctgcaactgatgttgaaggacttagtgaggattctatccaggaagcaaaaagaaatctaatacgggtgagataggtcgctcatattatgaccatattccatttatcttatttgagttattgaatcaattttctgtttgtggtaaccaggaaatggaaactaaattagttgaaagagctcgtcgactacagacagaaatggtgtggctagtgctacttgctcgtactagataacgtagcgaataatattgtactaaactaacaaccgtattttcttattctcttcaaagaacaaatcatggatg

SEQ ID NO: 6656 - DNA, 3000 bp, Unknown
  misc_feature (1)..( 3000): cDNA_ID_1815276_gDNA_ID_1621100_Annot_ID_55829 3000 nt of promoter + ATG
aaacatatcaaaaaatgggtctaactgagtttataaaactattggaagatgaattcaatgaagaaacttagtcccagaataaaaacaataaatattgtatgacattgagtaagatgactgatagagaccatgaaaacaagtgaaatactactcgtgagcaaatggaatagaaaaacgaaaagataactaatgcactcaagtagatattgtttaggttagataggatatatataagaaaacacacacacacaaaacacaccttgagtttgactgatccaagaaatccagctttaaccctcacaggtaatttcaaagcattaagtgcttctggttttagttgcatatttttcagctctacatctcctgcgaaatcaagttaaaccacaagctatattaaccaaatggaaaaaataaaagcaaatttattgacatgggtatgctaaaaccttctttttatttaatcatctgttcttagtaacaactgtgagaagtaactaagcaattataagtgaacaaccagcacaaaccaagataaaccatgagcgaagaagctataaagcctgaaagcaagcagcaatcctacatcattttaatcatgtaatatgccacacgggaaattgaacagttccgatcaactaaaacacccaacacatgcctgaaaaaagaaacactaaactcaaaaatccagaagtgtgactattgacttctccgtttaatagctagctacccgaatataactcgaagagaacccaattccataaatcgcagtcaatcacagcacacaaaacctaaccagttctcacattcgttcacaactcaaaatcgctactcaatagcacatttgaactttaaactcaaatccggacattacacaaaatcagcgagaaaatagaaacaatctaaccttgccaaacactgatcttaagagcttccttattcaatcccctcacatagttccccaagtacctttgtaacaagtaagctacctgatcttccaacatctttgaactctgcaaatcaaaattctcaccgtaaaagggaaaaaacaaatgtaaaatcaataatcgtgagaagagaatgaaattctcaaagagttcgatttcgatcggactagaaacggaatcgaaggagaggcatgaggatcgtttcctcaagagcacgcaagaggcggttggaaatgtgaaatagtcatgactcaatgacttgggggagagtttcggctctgtaaaaggaatataaaaatatctgctgttgatgacggtgcagtgcagtgtgttgctgtgttgtttatcaattgtcgacataaactttattattaaaaagaaaaaactaatcagtaactgaactaaaccaaaatttaattaagtttcaaaaataatttaaccggtggagaaattcctataccatataaaccaattagataaatcggatttacgcagcctaatttttgattaatcgaactaaccgaaattactaaaatatatcatttctagttaaacatatacaaaaagtttcttaaaatatgaagttttttaaattataaccaactaaaatctgaatcaaccaaaattatatacaaataggtgatcgaatttaattgaatagacgaattatgtgaagttgctataatatatcatgaattttgattggtttttccgctataactcgcaaacttgtgaacgattgcgattgttagcatttaaaacatatttagaaatttactttaaattattttgcaccactcaatatcgctaaatttcaaaatctcatttctagaaatatttgcggttgcagacgatagcggctagtcacaagaaaaaagaaaatcacataagcgacaaatacttagatcatatatatatatctatataaaaaaaaatcatcaaaatcatagtatcaattcaaactgaagaaagacaaaatatgaacataagtattgtaaaaatattgtcgatcttgaagatctacgaattcaaaacacaattttttttgtagtttgtcatattacttgatgtagtttttggtgatcaaccaaatgcatgaagtaataataaacatatcactatgatatttatttgttttttaataattttgtactactttatttatggtttttcttattagttttttttttttattaaagtttttcttattaattatgtttaaaaaattaatatttaattataataatataaattttgcacttagatggtcattggatgtatgtaaaaaaaaaaaaaaatcattggatgatctttaaatttgtatgtttttgttgttaaccattatatttattttaatttaaacatttcacccgtaaaagttaaaagtttatgtttttagatatttttaagctttacaggtcagtctatatcaggccacctagtgagctggagaagaaaggaacagcaaactcagaatgaactaaaaaggtcgagatttcttgatagcgcaatgaccacacagaccagagttcgaaccttcaaaagggaaatatataatttgtttcttagtttctcgagtatctaccacctcgagatctgaaaatctgattctacctttccattttctttctcaaaagtcgtggctttgagaatagttttttcctcttcttctcatcagactcggtttcctagttgactcattttcaagatctgggcatctgtcatttctttaataaaagctttctttttttatttatcccttttgttttcagctgctggttgcttgtagtaggtatagttttgggtggccttacttgcttttcagcaaaagctgggagattgagatttcttcttcttctctctctttagtctttgggatctgcgcatttctcagaaattatatgggactctcgaaagcatgatgctttttgttgtctcacttgtaatttgttcgggactttgttgctgaagaaaactaagcaatgtctgtagaaacatggttcatgattcagaagactactactagctcatgagttcactggtacttggaattaag

SEQ ID NO: 6657 - DNA, 3000 bp, Unknown
  misc_feature (1)..( 3000): cDNA_ID_4254729_gDNA_ID_1621100_Annot_ID_55831 3000 nt of promoter + ATG
aagatactatacgtgagattcagtttctttctcatgcgtatgaggatcattttctgcataagatttgtatctagttttgaagcaggatcagcatgtttactggactgaataaattttcaatgtttcaggagaactatggtaaagccgaaccatcaaacgttgctaaggtgaaagctctctacaaagagcttgatctcgaggtttgccactaagcattaactcaaaccctttcgttagttagaccaagtagaataagagaacgtaattattgcttatgaaagtagagaacatgagagatgtgatatatatgtaacaaaatctgcgtttgatcttgattattccatagggagcgttcatggaatatgagaaggaaagctatgagaagctgacaaagttgatcgaagctcaccagagtaaagcaattcaagcagtgctaaaatctttcttggctaagatctacaagaggcagaagtagagacatactcgggcctctctccgttttattcttctgacatttatgtattggtgcatgacttcttttgccttagatcttatgttcccttccgaaaatagaatttgagattcttgttcatgcttatagtatagagacttagaaaatgtctatgtttcttttaatttctgaataaaaaatgtgcaatcagtgataaattgatacttgttaatgtggcaaaaattttgtgtcacatgagggtgcaacagaaatttggaaggacctgaggctgtttgagcttacatcaccttgcaaaatcgaaacagggtttggggaatctggtcctatgtcaaattagggaccattgttggagaagaagaattttcaaggacatgtgtaacagatagctccaggaagcacttaagaagttacaatagataaagacgagaagattagtggaaatgaatctatagtgatgatcacaatctaattgatgataaccgatttgagtctcatcttagacagtacattgacaacaaaggtaccatagttttagtggttctgattttctaatatagaccccaagaagatattacagagataacactggttcagcttttcagcttaacaataaaatacatctgaccctatatttatgcaatttctccgtcctatatctactatatcgctaaataatgtaacactgaaaaatttccctaatctacattgtgagagtccagatcaatagtccaatgcaaatgtggtagatagaccaccttgccattggctcagtacttgacgataagcctatatcagtaacacccacaagaaatcgacagtcaccaactgaaggatctaggaaggtgaccatgccaagtccatcaaagtcacagctcttttcatgttgcatctgcatctgatagtaactgttgaaagcgtatgagatattatctttttcaccaagctggctgcacgagcccccgtcgttgagcgttgtgcaatctgcttcactgcaagcaagcctgaggtggtcaccaacttgggtcatgtctcttgatgggtgagccacacaccaccttgaaggaaggtactgcacattttttgcattcttgagtcctctgttgcctagtcctaagttgagacgatacttggcctgtccatcgaaagagaagattccccaatgcctctcaaagttaccaggcagtgtgcttttcgctccttcgtcaagcaaaccgaaaagatatacatccgcaggaggagatccaggcctgagcggtgttcctttgttgctcaacacatggctaatgagcccttgattaaaaacccgggctgctgtgagattagcaccaactgctccatctgtaggccaaccaatctcaccaataactataggcatttgaccatatccaagcttggtgagagcagcaacaagagtgtcaaagttcccatcaaatgcattatagtaagtgttaggcccatccggaaccggatgactactcccctcaaaaaaggcatagtcttgtggaaaatccgagttcccatagagactaaggaaaggatagatattaaccacaaaaggagagccattggagttgagaaacgaaaccaattgagtcataatctgtgtaagctcaggccggaacatcccctgagagggaacattagactgatacgcatctgcgttgcaaggaaccaccaacttcacatagctagctagatttgctctaaccaaagattgttgcaggttaaccatagttgggactacatagttctgaaactgaccaccgtaaccagtcagaaacggctcattccctactgcaacatacctattcaacagatatattggtaaaatcctctgcttaatcatagcttaaagacacatatactctgagagaaaagatacctaatatcagcaccgtttttgcctatgaagcgagagagattttgctggacaaacaaatcagaattgaaagttgagagcatctcgttaggaatgccgatcattacttggattccagtacccattaacgctcgaagcgcatctggattcgcatcgaaaagcttcaccttggtgatcttgtttgctttgaggagatccaccactgtggaaggtctcatcttgtgaaatgacaacgttccccagttcacgccgattgcagattccacctcatgggagacgagaagaagggagagggcaaagagagctacacctacaccgcttcccatctttttcactgagctctctctcgggtgcaaagatagcaactttttaaaggttacagctttatttttataaacagactgcatgtcgttttctatttaaataaacgtcaagcagtgcggttactaaataggaaacgacatagagattgaaatttggcgacaatacaggttgatgcatcgctggatttgctggaaaacaaaccgtcaatctccgtctttatagagaaaaaaagattctcttctcttctcgttctcatcatcgtcttaaagaaggaattcgatttttcgcctgaacctgcggatttttcgattcttcaaattcaatg

SEQ ID NO: 6658 - DNA, 3000 bp, Unknown
  misc_feature (1)..( 3000): cDNA_ID_1815270_gDNA_ID_1621100_Annot_ID_55832 3000 nt of promoter + ATG
taaggattgaaaagaaaaagaagcagaaggagttaccagtatcaccgatgatgatatacttaaatctataagcataagacattgaagtggacgaatctgaatccgtaggttcagacaaaaacgaatcccttcttctcctgatgggtaaggtcaagaatccgacaatgtcttcacttttaacgtttttgaatgtttctatagagtcttagaaacttctagattgtgtcacttagagatttggtgtctcaccattgggatgattgtacaatgattggagattgatgagtctgttgtgaaggttgatacgtgccatttcttttcttcttaaataaggcaatagcctcttatttggggtcccatgatttggatcaaaaaaaaaaaaaaaaaggtcctttgataaaatttaatatataattaataaatttcaacataacaaaaagtacaaaaatatagaaaattaaaaaaattatcctctattatttttctagttagctaaattaacaattttaaaaataaatgataatcaatttttagtgattttataattttaatcataaaatagataaagatctaacaaaaaaaagtttaataatgattggcaaaatttagttaaaaatcttaatataaattttgcctcaggcctccgaataacttgtcatagcccttgtaagttgtaagataaaacagtttcttttgtttgtgactttggctttttgttccttttctcaatttgcatgtctttctggtccaatattatgattgcttgagctcattttacccccttgttcaatttcgttgtcgtctgttctggttcacactcaaagacggttggttttccagcaaatccagagaaatatcaacctgtattgtcgaccattgcaaacttgctggcgtttcagtatttggtaggcttttatttgaaagacaagacagcacgcggaacaaaagccaatagactctagtaaagaagaagaagaaatcatgtgaaacaactgcaaaaacctagacacgaaatagcgggaaggagggctttgttaaacgagtaaaccatgaaagacatggaaggcatcgttcatcatgacaaaagctaaagggattactttatttgttgtataacacggtaaatggaaccacatgcagccaatacaattttctccacaaacactgaacttaccttcatgatatgatttatatccttactaccttttccagtacaatgcaaatgggctacattcctacctccattagatccttacgcaaacacatcttaatttttagatatatgaataggcatacacgtgtattgtcaaaccgttccaaaaccaaccacaacacagtcaccaaatcgaattccaaaacgatttacaactatagaaagaagcagagacatttttgctatatcatatgtgatcatttttacataatgacatagacatatttttcccatctcagccgcagcaccctcctccttgcgaggttgatccatctcttccacctgatggtcctggaattcctccatatccaactttgattccatatgactcatttgacacatcaaacacaccatcttgaatcttcttgtatattgttgcagctgtcttaatgaatgcctagcaaaaaatcacaacaccagtcgaaatcatgttaagtaattgggtaattggcaaatataccacattggaacgtatgggggtttacctcctcaacattctgagcagtcttggcagaggcctccatgaatataagaccgtgctcctttgcaaactgctctccttcctctgtactcactgcccttctgtgagcaagatcacacttattcccaatgagcattatcgtcatatttgcatttgcatgctgccttgcatcttctagccagctagctagatggttaaatgtctccctcctgcaaaaaaaacggaggtaaaaaatatcgtaagtgtcttgactgaaacagttataaattcaaaaacacaaatctaattctggttcagatctttaggagtcgaactccaatctagaaaagaagaataacgtctagttactacttacacaaaaaaaataatttgcttccctgatcaactctacttttgataaacatacagaaagaagcaaatgatttaccttgtgatatcatagacaagcaatgcccctgcagctcctctatagtatgaccttgtaatagacctaaaggattcttgaccagcctgtcattacagagagatattagccaagacaaaggatatgaaacttcagaatagccaagtcgcctagtcaaagaaaatcaaagcatatatgatgatgtgcacaaaccaatccaggtattcatgaaaacaagatagagatacatcatgaaagttgaagaagtaaggagaaagagaccgtatcccagatctgaagcttgataggtttgttatcgatggtgatcatcctagccccaaattcaacaccaatggtaaggtcatgcaccggctgaaacctcttgtcggtgaactgaagcagaagacatgatttccccactcctgaaaatcagaatcaatatacaaaaatcaacatcaccaaagcttctctcgacccctaaatccactaaaaaaagttggatatgacacagattcagatcaattcgcttttcaattttcgcaacgaaacatatataggttttgatcatctcaattccaaatggattgaagaaagataacgtagcagagaaggagttaccagtatcgccgatgatgatatacttgaagagataagcataagacattgaatttgaagaatcgaaaaatccgcaggttcaggcgaaaaatcgaattccttctttaagacgatgatgagaacgagaagagaagagaatctttttttctctataaagacggagattgacggtttgttttccagcaaatccagcgatgcatcaacctgtattgtcgccaaatttcaatctctatgtcgtttcctatttagtaaccgcactgcttgacgtttatttaaatagaaaacgac

SEQ ID NO: 6659 - DNA, 3000 bp, Unknown
  misc_feature (1)..( 3000): cDNA_ID_3593723_gDNA_ID_1621100_Annot_ID_55833 3000 nt of promoter + ATG
gatctcgactctgctcaacgaaaggctgctgatttaagggttaaactagaatccatcaaacattcaaggaaatgtgctatctctaccaaacacaccatgaatcaacggttagaacaacttcaatctgaaaaccaagaaacagagagcacaagagaggattacattttgattaccgcggagctgttcatggcgaaatacgagctcgcggaattaaaacaacagtttaacctctccgtggaagagagactagctgaacttcagagggcagaggaagcagagtgtgcgtctatggttaactccaacaagatcaaagacatgtcgcatgacatagcggaaatgcgtgatgctgctgagcgacttaattctgatgctgcaaggaaaaaagaggaagaggaacagataaaggaagagagtattgccttgagagaaacttacgtgtgtaagaagctagaagctaagcaaaggctggaggatctcaagcgagattgtgaccctgagctaaagaaagatattgaggagttaatggagatatctaccgaaaacgagaggttacaggaggagattaaactttctggcgagctcaaagaggcaaagagtgcgatgcaagaaatttatgatgaagaaagttcatacaaaagcttggtgggttcactcactgtggaattagatggagtgcagagagaaaacagagaattgaagggaaaggagaaggagagacaagaagctgaagaaggagaatgggtagaagcgagtcgtaaagttgatgaaatcatgcgtgaagcagagaaaacaagaaaagaagcggaagagatgaggatgaacgtggatgaactcaggagagaagcagcagcaaaacatatggtaatgggtgaagcagtgaaacagctcgagatagttggaagagcggtggagaaagcgaaaaccgcagagaaaagagctgtggaagacatgaaagtccttactgagaagaaagagagtctaacacatgatgagcctgacaagaagattagaatatcactgaaagagtacgaagaattgagaggaaagcatgaagagtcagagagaatggtacagtttaaagcgaaaacggttgcggctcagctggaagagatcaatgagagcagaatagaaggggaaagaaagttggaggagaagattaaagagatggaggagttaaaagctgcgattgatggcgcgttgcgaaaagcagagattgcagaggaagcacacagtattgttgatgctgaactaagaaaatggaaaccacaagacttgtagcagatataaatatgctttaggttgtttagggaactactagaatgtccataccaatatgtctttagtgagagattgatgactattcatatatctcatttcaacagtaaatacatgaactgcattaacatggaacattgctttttttcttcttgtttggatgtgaaattggacaaagtactaaactagaattataaaagccaaatacttattattatgataaatatcaaacacacaaaaacagtaagggactagatggaagaagcaaacacacaaaaatagtatacgtcaacgactcaaagggagtaattatctctttgtccggctggttgatttagagttgcactaagcttggagcataagaagaccacacaagtgggcaacaatacacgtaggggtcaggttttacgagatcgggagcttcccggagagtcgcggatttgaagtatccgtcttgtccaatgatgtaagctgtcgggtagcggcggtttcggttttctactcttgggttaaacaagtctgaattaaaaaatacagcgactttgttctcttcgtcaataaagaagctcccagcttcatcatcgaactgacaaccagtgggtggttccatatccactgacaaaaacatgctccaggacaccgcagtgggatcgatcttagtggttacccaaatctcccatgtttcaaaccgctgatataacaccgcaagctgatcatctctaacacaagatatagccacagtttccaaaacatcagagtgaaatggcagaggaagacgcggtccaaacctctctgtagtaaaatcaaaacagagtaaaaacttttcaatctcatctactacttcttcttcttctccttccacaattatcttctcttgagcaagaaaataagtgtttccattcaaagacacgctctgttgatgaaacggtatatggcagtcgggactgacatcaagaaccctccatgaatcagagctaaagtcgtagatttcgtaaccaaaaaggtgccctgtatcatagttcatcaagattttgtagttgtggttattgtcatatccgagagcgtaccattcgagtttgttaaacctttttcttggtttgataaaccttgtttgccctaaataaggattccacactagaagcctcgagttgtccttaccgacgcataacaacaaaccatcgcattgaaggactttagatacctcgatttgatcaagtttagcaatttgctttatacatggatcaacaaagtcatgttcgttgtttcggattccttggagatcaaacttcattgaacaaaccctagaatccatcatcgtgaatcccataaactgcttccttgctgctttaaagaaaataccttctttggataaagcgttccacattttgcaagtacaccgtactgaaatcaaagatgtcatcggaaccctagtgagaatctcccctaccaaatctggtgaaagatcagacattgtcgtcatcctttgaaactctgcaatacaaaattaggggtttagagttgtttaaaaatgttttccccatttcacgtacattttatatactgtacttctgagataagcaggccttagacggctcaattaaatgggccacaaaaagcccatttaaagaacgtcacgtgacgcgatataagcatgatccgaggaacacacttaaaacaatcaggttccacatttggctttgcacaccttccttgatcctatcaatg

SEQ ID NO: 6660 - DNA, 3000 bp, Unknown
  misc_feature (1)..( 3000): cDNA_ID_1815259_gDNA_ID_1621100_Annot_ID_55836 3000 nt of promoter + ATG
cgctgctgggaagtcgtggaactgggatgaacttttggctttgactccacagttggacttgaaagaggtgctggtggaggctgctcgggcagtcgctgatggggatttcgctacagcgtatggattccttgatgtcttggaacagatggtgtcagtctcaggcagtccgatccaacggctaggcacttacatggcagaagggcttagagcgaggcttgaggggtctgggagcaatatatacaaatccttgaaatgcaatgaaccaacgggaagggaactgatgtcttacatgagtgttctctatgaaatctgcccctactggaaattcgcgtacacaactgcgaatgttgagatcttggaagcaatagctggggaaaccagagtccacattatcgattttcagattgcacagggatcacaatacatgtttttgattcaggagcttgcgaaacaccctggtgggccgccgttgctgcgtgtgacgggtgtggatgattcacagtccacctatgctcgtgggggaggactcagcttggtaggtgagaggcttgcaactttggcgcagtcatgtggtgtcccgtttgagtttcacgatgccatcatgtctgggtgcaaggtgcagcgggaacatctcgggttggaacctggctttgctgttgttgtgaacttcccatatgtattacaccacatgccagacgagagcgtaagtgttgaaaatcacagagacaggctgctgcatctgatcaagagcctctccccaaaactggttactctagtagagcaagaatccaacacaaacacctcgccattcctgtcacggtttgtggaaacactggattactacacagcgatgtttgagtcgatagatgcagcacggccacgggatgataagcagagaatcagcgcagaacaacactgtgtagcaagagacatagtgaacatgatagcatgtgaggagtcagagagagtagagagacacgaggtactgggaaatggagggtcagaatgatgatggctgggttcacgggttggccggtcagcacatctgcagcgtttgcagcgagtgagatgctgaaagcttatgacaaaaactacaaactgggaggccatgaaggagcgctctacctcttctggaagagacgacccatggctacatgttccgtgtggaagccaaacccaaactagattgggtaagttatagtgatgatggttacttgagtggataaagaagagcacaacaaaaacacatctgtcgctgtaaattttttaggatgtgcaatgatgttttaagttgtaacacaacctaagttatatatgtatacaaaccaaacctggtggttgtttttctcttgtaaattgtcatgtggttgtgggtgggttgctagtaatgaaatataaccaaaacattgattaggtcattttatgatcttcttctatatataccggtataagtcaactggcggctgaacaaaggtcgtgaggtaacaaaatatgagacaaatctacaggtcagattgggttctgaattctgataaggtcttaaaaaggagctcaccaacccacaaaaccatggattgaacaagtacaggtcattgccttcattttattctttacttttctaaggctcaagcttcctttattgcctttaataacaatatactaatgagtattttgcactcagtaacaaaattcaggagagtaattttttgccctaacatgttacttttatgtgttaagagtttagaattttggatctatgattttagtttttgttagggaatcatattcatataaataaaatattgccattgacttaattgttgttattcacctaatttctctccaaatttggtcatttacctcagttgattctatattatacttgctaagtgttctttgtctaattctctatcattgtttgatttaataataaccaaaccttaagacttggaagcaaagaagagagaaaatcccaattaatttttaataattcaaagagagatattgagtgacttccactaatacaaagaaagcttggtttgtgcaatattttgcggttaagctattaattgctgaggcaacaccttttcacactttgctttccttcttccaagttttcaacttttctttcttactctttctattaatcaaactgcaacacaaaaatcatttggataatacatgtttagaagatgattaagctttagttttatttcaagattatcataattgttatctgttgttacctacattcatataatcttatcaaaaacgataaagacaaaaaggggatacaatataggtttttattataaagaaacaggaaagaaagaaaagggttttcaccaaacgaaattagttcaatcatttaaattatctttatccttatgattagtgtctttatatctgtcatatgctgcttctccttccaacttcctttggattatattctcttctctttattttaatttccatttgtggtagctgttttattttttgtattttcacgccgtgtccctttaaaataatattaactacaccactaatgttggaacatgaaaaacatgaatgaggtaattatgatgatgaaccaaatgttaaggacaagctcggtgtaactaagaagataattagtgaaacagaacaagtcaataacttgtaagcatttcagaattgaaaataaagataagggaggatgaatatgaatttagtaaatgggtaatgaaagtgaaagaagaagagggaagggttggttactgtctcaagggtttgaaatggagacggttgcttgagaatgaggaaaaagagttagtaagtttttaactctctctttctctctccctctctctttttcaacgtcaattcctttaaggaatggcctctctctctctctgaaagtgtgtgtgtatatattaaacgactccatttctcctctgcttagaccaaaactcatcttctatactgcaacaaagaaggaggagccgttgagactacaaaatg

SEQ ID NO: 6661 - DNA, 3000 bp, Unknown
  misc_feature (1)..( 3000): cDNA_ID_2107285_gDNA_ID_1621100_Annot_ID_55837 3000 nt of promoter + ATG
atatcaggaattcagctcaggtagccctgatggattggctctggaagatttgaatccatgcctaactccttataccaagaagaagcccaaggtagttgcttcttagccttgagagacaaagctcatgttattggttcattagctcacaagataagatgtgaaattaagctttgatatgtcctgcaggagtatgagagggttgactcagcagaagagagtttatcagggagaagcactataacaacaacaggcggtaaagtcaaatcgagttcaagaagtgtaaagatgtcaaggagctcagagggaaaggcagggcagagatcagaggagagcaaaggatggtatagaggtgggaggatgttttaaggtgaaaaaaagaaaatgcctcatataaggtaatcttgttccattttttccacttgatgtacaatgtctcttgctcttcaacctccagagagtagtatgatttttggtaggaaccatctggagccatgatccacgattgagttgaataagagaagagtgttgttatatgtaaaatagaagtctttcaaaataagttaatggtgtacttagtaggtgaggagagaatatgtgtttccgttgcatcccttcttctcacttgatgatctcattgattaaattatcattagtagtgttgtttattagagagtctagagatgatgttgatactccatccctttcttcaagatacatgctttggcattttcaatatttgcaatatcattaatattggtaaattgggagacaaacattaaatttacattactcattttcctttccctcctccttattactcccaatttttttttttcttctcatgctcaatgtctccctcatttctgtcttagtttcctccataagtatgattatttgtttactatcaattttgacatcctatttttgattctcaaataaacattaacctccaacacccaaaatttcatcacaaagatgtcacttttacatttatgtatggaggttcaagtgatgaactagacatttatttaccactataattaacacgatttagatctcgttaattaccaaagatacaataaaaacaattttcagagataccaatatattttaattattctattaacaaagttttcttttaaaaagaacaacattataacaaaaacttttcccattgatattccgaaaattaactctaatactataaggatattaatgaatcaactaatggtgtatgtatgtactaaagaagaaagcaaagagagtaaccgtgtgtggtgggggctcatgatcgttagttattacgtctcctactcttacgtaggcctttcctctgatctctttctgaataattgtagcttcaccgaagttgcttgctttattatgctctagctcctttttaggaccaaaaaagggtactgacaaagtgaacgaacacagtactcctgtccacccagaaatattataaaaattaatacaatgggctctccctttgcaatattcttcttagaaatttcaatattgtacatcagatttaagaacttctcatagatagagactagagaggagtgggcaactaatattcaagttttcctttgagggaacatatttacaaacatctgagatacaaatctgttttgtaaaaactgtttcatgtttgtaagaattttgtgtttgtacataaataaagaagatgccatctctacaaagggaaagacaattccatgcttttacatctcattctcttctttctttactcttttacttcttttgaaaacacaagaaagataaaaaaaaaaggaaaggttaataaagtatttgtttcactatttataattttatatagtctgtctcttctctggtaccaaaacacaaatcttttccatgcaagtcacagtttttgtatccattatctcatcaccttgtttcaatattctaactaaaaaaacaaataagttcaaagggacaaaagacatgtgtcagttagtcagaggatattgggaggtccacgaacgtccttaatctttggatttttccgacttacgagatattatgtgacgcaaacgcgtttctcctctttttttacgattatgccatcccaccaccgtacaaatcccctacgcgcctccacgcgtcgcttcctcactcccgtcttttccacacacgcgctagtcggaatatcttattggattaactctatgaattttcatatgaacaatatttataacatttttttatttggtattaacattatataaacatgatatttgggaaaagtctttcgtttgaaaaattcgtacgtgacaactaattttgtttttttttggatggtgaaagaattatcttggatttgaggcacacacttttgtttatggaatctaaaactagataggtgcacactatccatattgccatcattgttgtagatttgatctttgtgcaacttttacttgtgtatacatcttaatttccgcattcaaagattttcaaaaccactgcgatcagtttcatccaatcttatatcaacaaacatgcattggaaattttttacattaacaataagtcaaaccattttgaaacataaacctataaaacttgacaatatgggaaaaataaaggacaaaatattctaaaaattgaccaaattatagtcttaaacattaatttcaacgggactatttcgaaaccgtttttaaaagccgaagtcttattaaatacaaacgaaaaaattaactttgacattgggtatattataatgcttgtcgataaaataaagtgttttttacttaaatgttacatttattttagtatgctccataagtttgatatatcatgttatccttgttaattataaatgttaagcttgaatttgttgatgattccttcctaatttttttttttatgatgtaactgactaacaagtttttttttgtttcttaactaaccagggggttgatttaatttatgaagttaacataaaaaaaaaattacatgaccatg

SEQ ID NO: 6662 - DNA, 3000 bp, Unknown
  misc_feature (1)..( 3000): cDNA_ID_1815251_gDNA_ID_1621100_Annot_ID_55839 3000 nt of promoter + ATG
tgaggtttccaggattactatcaggctttatgggcttcgttgttttggttaagtaggagatttggatctgacaatggctttcgatgaaattggcttgttcgatttgaattctgcggaggatgatagatctgagtgaatcgaggaggttacggatgatctagaatcgtaggaattgtagcgagacgccattattgatggaaggttcaaaaaagattaggatctgtgaatttgaaattgaggaagaagatgaagcagagggaatttggtttttctgtttccaatgtcccactctcttcttttcaaatttcgtattctctctgttctaaaacggacttttcatctgtattgggcctaactatgggctttaaaagtttaacggcacttttgtgtttatttgaattttgttattctgtttattcaaataactaaatactaatgagataattaatcatttgctctagaaaattagaaccagcacatatctacacttttagctttcctttcatttttgtgcatttttttcctttctaatttggacttttgttacttccttcttttttcttaactgtaaaatgacatatacaaagtgaagagactttcatgttccttttttggggggtttatggacgagcattttgtatttttgtggacagtaaataatagcgaagaagttggcgttgattgaggcaggcataaaggaaaagatggaatgaataatgaagttggctttggtccatattgtagaacccaaagcctaataaccgtacactaagcccttacatacatgaaacgctgaattgtcattggtagaaaaggaaatggaagagtagtagtaaggaattatatcagttaataagagttgtaatgtgaatagaacacgtaactggactagtatgcatgtgtatgagaagttcaaatctttaactctcacaatatcgtcgaagacaattgtttaggataagatagaaactaaatgagcatttaaaatttaaagaaaaaagggaactgtagagttgccttggcaggaggggaaagcattatcatgaagaatctggtctacaagaatgggaaatggacagatgtatctgttcaccaccaatccatcttcataactcaagtggtccctttctctcgacccatccacgtctccttcatcacaagtaagaccaaattaagccaccatttggtgtctgtcatcttctctttaatgctctcttttgttctttctttataaacacaacaagacatgaaaggtttttgggaacttgtctgagttccaatgcggctgctgctatcatctgatccccaacccgaacttacgtctacatgtacctctcatagttgcggctggaagccttactctcattccaatgactttgctgccaacgcgttcctccttctcatcatcctcttctgttctttcatatgcgtcctctctctccacgctgctatccgttgttgcctccgtccagtcctccaacatgtccctaagcccgacccggaccttgaggccacccatccagacgctcccccgacacttgtctactccccgggcctaaacctagcaggcaatgaagcagagtgcatcatttgtttgtctgaattccaagacggtgacaccttacgcgtgttggagagatgcaaacatggattccacgtttattgcatccagaagtggctctcctcatcccattcttcttgtcccacttgccggacaaacatcttctcctccccacctcaacttcactcacaaagcttaccactaacgagtacaccttagtcagatggtagctagttcctggtcttgcccactttttttttatctttattttctttacaacttcacaccactatcatgttttacaagttagtttattttttacctttctccttttatattccatgaaatttgcacagtctaaaattgatatgaagtcacttttgtgaatcatcatttacaacgtataacaaacaaagaccaatgtgtaacgaagcaataacaatacctcataatatagagggaccaaaggctttatttaatgtcggagttcaagatatatgaggtcttgactggtgttaggtacgttcccacttgttggataagataaagaaaagagttgttactagataagataatggataaatatagaggatgagaaaaaaaaatagaagtggaatgacgacgactcacattacgagcattaactccattgcccattggcatggaatgattctagctagcagtaggagaaaattccaagtgcgtgcaaagttcttcaatgaattcctagaccccctaaccagagtcatggatgcaatactggaaaggcaagactatgctcgctgcatattttcaggttgctgacatgttcaagctcaaaacacaatcaagcgatgaagttagaggagaagatgattgaacaactttgatctggtctcaaaggtcaaagccatgcaatatctcctcgtatgtactacattgttctagatagcctaatgatgcacatcgtgagttatgttaaaaaactatttttagaaaaagttactgagagttctggacaaaaagttcagggtaatgatatttaaggtgacaaaaggtaggagatgttactattcacaaaaaaaaattaaagggttatcttgtaatgcgacttgttcatgttagttgttgacaaaaaaatagactgttgtagattatttgttatgagggtaggagtaggatcgtgtagtggagagacgaacacgtaagtagaaagaaagagccttgttattagattagagctgtgttaatgtgtgaacgcaaccaacagttcgtttttgaacgagtctaactagagacaagtcaaagcttatgactttgagtggacactggacagagctagtaacttctttgaagattctgaacaattttataacatcaagacacgactctgtcgctctctctctccatagaagaagacgaagaaatagaagaatcgagagagtgagacaaatctagtg

SEQ ID NO: 6663 - DNA, 3000 bp, Unknown
  misc_feature (1)..( 3000): cDNA_ID_2106051_gDNA_ID_1621100_Annot_ID_171353 3000 nt of promoter + ATG
ctctaatacctgaattgtagataatgattacataaaaaggcgtttgtggaacagcaaaaggaatcagaagtattggcaatttgacaagagaactaacacttgtcacagtagctcttgaggcagcatttgcttgccagtgcagcatctctcatcacttctttacacaatgggcattttaattcaggaggaaattccccgactgatcgtgttgttgatgtcaatccctccatttccttctcaaacgcatccctaaatttgtcaattgacataagtgatcaacattactaataatttatgtgaaggtactaacaaacaactcgccatgttaatttagtgacaacgtactcgtttggttttaaaactgctactgcgccacttggcaaggagtaagagccatttggggttgccatcagcatcgacttggggataccagtaggtggtttaactctcttaacatcaaagttaggattaccgtttgtggagcagtgttgaataaaatgtcctgagacagaaaatgatgttcagaacattcatttctcggtaataaccgtacacactcgagacattacttaaccaaattaaaaatatataaagattctctaagtcagtcataccagaaacattgcaccgatggcaaacatagcctggtggcggtgttgtcctctccattcctactcaaacaaatacaatcagtctctatatcttacatttcaatgaaagagcaaacaaaatatttggacaataataattaacagaacatccgagtctcaaagctaaatacttggggagactgaagcatataagtcaatcatatacaggaatataattaccaaaaccgcggccacccatccttccagccatacccctcccataacctctacccgggccaaaactatctgcaccttgtctgtaacatgaaagaaaaatacgaatgttatgcaaaatgtatgtcaagatctcatttagcatgctaatgtccatcagttcaagaagattacttactgatgccagtctagtgctggagtgtcaattaatgcctttagcttggtttcttcatcatcagctggtgcagaatcatgacataggttattagaatggactgctggggcatcaggaattgaatacaaatcattcccaaactcatcgaattcatcttcaacctataaggtagattaagttgtaaatcaatatttgtgtagaaggattccatgccaataaaaactgagaaagccaactcacgggagatgcatcagcagtaataacattgttcatatcagcttgaacgttttccactttatcctcgactctcggcctgcaaaatgtagtcatttacatcatgacacatgggaatctggtataatttcacacaactaataatgaaatgcgcagcttagagcgaaagaacacaaagattgaacaactcagttgagaaattaggtattaaagttatagagaaattactcttctctggtaataattctgatgcgagggcgtccagggacccggcgaattagcacagaagtattttttggtattaacattgcttcatccagatattctgaaattgcaaaaaaaaaaataagtatgaaggccaccacatattgcaactataccaacagagaatcgtagttaagggtttctttctaatgattcacaaccacaaccaatcaagaacagtagtctcagaagtaatcacatttaacatataagctaatacagtacgcaagaacttcacttttattttttttattcaactaacaaggaagtaccaggtacataacatccattttactgaagcagttagatactgaacaatccatggccagattaacagtgctaaatgtgattacttcggaagaaagccataaaccatggaaattttgacaaagcaagtaataaccatatattttgataagtgaatactgatcacaatcagaccagaatccaacctagataacaacaaaacacattgcacaatatcttctaggtgaataggataagaaggaggaagacaaaccttcattagtttgggcattagagatgacaatgtcaaggtctttaccacttcccaaatgcttagtttcgtaaattttttctttgagtaaaccaactgttataaaaggaccatccatggagatggtatcataatccctcgcactcttaaacttgtaatatattgccattggaattaatctgataatgaataaaaatacaatctgtattactaatttattaaaacacaccagaatctactctctttgaaaaaaaccttaacccaggccaaaaaaatggaggccagaaagttgatttccaaaacaaaaacaaaaagtaattacaaaatatgattctttacttctctggttggacttcaacaaaattcgacagaagaaacctctcacgcgctcttcaagacgaaatcaaatcaacgagaatttcccacaaagctcagaaacgaaacgagaacgcccgtgttggattgaatcgaatacatcgcagggacaatgctcagatatctccaaacaattgaatcactggcttcaattcagaagctgaaactctccaagcttcgaatcgaggaaatagaatcgaaaccaccgcggtatccctgatgattcacggtgaaattgcagacgatctcgagagagaattagagaatctttggcgtttgatggatatatgaaggagaaaccgatggatatcgcagaaacacgaactctagggtttgaagaggaatagagaactatcgtaaccgaatccaaaagactcttcacctaattctcttgcgttttggctccttttacataaatttataatgggccatacagttcaattagagatgttttatgttgtagcgaaggcccaatacataaagctaacggaaaaaggcccaataagggctttctttgtctgatggaaaccctaattcccatggagccatctatttaaagcacaaacctaattcgaagaaagaagtgactgcgacgccggaaaatcgcaatg

SEQ ID NO: 6664 - DNA, 3000 bp, Unknown
  misc_feature (1)..( 3000): cDNA_ID_3048780_gDNA_ID_1621100_Annot_ID_171352 3000 nt of promoter + ATG
atcttcatactctttttccactcctttcaacaaaaatagttaaagatgtatttcattatattatcaaatgggaattgcttaagtaatgttcatttcctaaattatacaccattttatggtcatttacccaaattgcaaaaaaatatctttgagcagccagccatatcctccgaaagcttccaagtttaatttgtacaccacaaaaagataaaagaaccaaaaaagtaacatcttcttttccagatatggtctgtagtctgtgctattttgtaaatatgactccatactagatttgtgtccctcaccaaatcggtctcatcctagaaacataccatttgcacacaaattattcatacagatataaccgtacaatatttgagataggccccatcgacgtcgtttagctcaaagcaagaagggagagagagagtcagcgagcttcgttaatggcggatgttaaggactcagtgattaccaagtacggaatcgtagggattggtatgatgggaagagaacatctcatcaatcttcaccatctccgtgaccaaggcctcgccgtcgtttgcatcgccgatcctcaccctccttcacagctcctggccattgaactcgctcaatcttttggatgggagcttaaggtattttgaatttaccagaacaatcaaccttaggagttaggacttacttagagcggacccttttgctgtgttttctatataatgttctggtgcataattgtttgattcctagtctttgtacttgataaaaaaatttcataccttgattgtggaagagcttaggatttgagatttttttttactttgttgtggttaaggttttctcaggacacgaggagttgctcaagagtgagctgtgtgacgttattgttgtctcttctccaaatatgactcatcatcagattcttatggacattatcaattattcaaaaccgcatcatgttcttgttgagaagcctttatgcaccacagttgcagattgcaaacaggtcttttttctcttcttttctgtttggtaccaaattgatcaattcatccaactttgtctggaatcaggttttggaggctgcaaagaaaaggtcagatatggtggtgcaagttgggttggagtacagatacatgccgccagttgctaagctaatagaacaagtaaaaggcagagactttggtaatgtcaagatggtagcaatccgagaacatagattccctttcttggttaaggtaggcttaaacaagatgggactatgtgtagtgtttacgcttcacatttttatatgattgctgagagaacacatcactaggtgaacaactggaatagattcaatgtgaacactggagggaccttagtggagaaatgctgccacttctttgatctaatgaggctctttgccggtgcaaatcctgtctgtgtgatggcttctggaggcatggatgtgaaccacaaggatgaagtttatggtggaaaggtacatttttatcccaagttacactcaatcaacgtattgcgagtttcatactagatgtttctctgttatataggtgcctgatataattgataacgcatatgttattattgagtttgacaatggatgtcgtgggatgctcgatctttgcatgtttgctgaaggaagcaaaaacgagcaagaaatttctgttactggtgacattggaaaggtgagttcctttgaaatattatgggccatttttgtgtgtgtgtgtgcttatttatgcgcttagtgtgataggattttaggtttgatatgaaaaaaacagagctgggtgttctttcttttttattgacttctctgaaccattcgacgttattcccaagagtacataatttccatttattcccaaatcacatggcatatctacatgctcttgcatatagatggaagatgagcataaagtgttctcaagactatttctttggagttgttcatatgatccatgagttttgagttttgtcaatatgtccttttgctttcttttcaactgacgtggcaagcatgttgcagggggaggcacttgttccagagggtatagttcgatctggcagtcgtattggaggaagagaacacgttcaaacaataaaagcagaagatgaaagaataaagtaagctatatttatctacatatcgtcttacactcttaacaatgtattatagtctcacatcgcatcacacgatgttggtttattcagatatgaagggttgcatcacgggtcaagttacttggaacacctcaccttcttatcagcaatcagaggtgaaggaatagcagctgttgatttggaagacggattgatggctgttgccatgggagttgctgcacagctctccattcaggagcgccgctatgtaaccattgacgaggtcttgtgatttgtgactgtcagataggtaaataaactaaaatagaacctttgtattattaccgttcaaatgtttgccatacaacactgtttattgtaagaagagagtgatcatcaactgttgttataagataagccaataaattgaaatagcaacttatttgtactgcttggcaatggaactggatcaaacagcccctcaatttctctacaatccggataatagaaacagattcaaactctgttgaaccaaaataaccgaaccaaaccaaattttaatttggtaattctctaatttttttgtttttaatgttctttggacaaatataaaatataaaaatgtcgattgaaaattgaattaattaaatcggaaacaaagaattaatccaacaaatgtatatgtttgattttggctggatttcacaaaccaagtaaattgaaccggaaaccctcagcacagtttggtcattgaagccggtttaccaaattaaaatcggcgtggtggagtccaaaccgattgatagaattcacagtggcgcgcttttgccttcattttcggaactcgtgtacctttcactcaattttcaaattctgatctgtggagcgaaa

SEQ ID NO: 6665 - DNA, 3000 bp, Unknown
  misc_feature (1)..( 3000): cDNA_ID_3048784_gDNA_ID_1621100_Annot_ID_171351 3000 nt of promoter + ATG
gaagtctacttcggtctgaaaaccggacaaggtcttttggagttcaagtgcaagagcaagattcacaagcagagatgggttgatggggttcagtctcttctccgccaagtaaattgctttgaggctgccaaatgctcgctgggatctctgaatctcactggtcacacgtgatgcaggatcctgtatatatttgattatattcatatatataatatccaaatttttgctgttgtgaggtatttgcaaaacctggcaatgtaacctcagaagacttttggataaaacaaagcaggttgttcaaatgatcacaacaagtgttaggaacattgctatgtacagaaagacatcagaagaatgatgaatctcaattgaactttttatttccaatgattcagtttctatgaagagtcaaaaaattgtagagaagtggtatgtatatttttgtttgagtgagaagttcatatgaagaatcacgtgagagacatgtcagagatattcatatagaccgtattagaatacgacagtcctttgtgtcccataaggcaatactcgcagttcgcagtaagattttatagctttcatgagacactttttctcaaggtcctctgatttctggacaaagctcctcaaattgtctcggtgggaaactctctcaacctgtaaaaactcaaattgagacgcttctgaagaacaatgcaacactcaaaacaaataaactagttgggagatgaatcaccatttgctcaatgataggacctgaatcaagctcctctgtaacaaagtgagttgttgcaccaattagtttcacacctgcatcaaatgcctaccaatacaatctagtaaagtaagagacagggacgaaaacttgagacataaggacgagctaaatataaacctgtttcacgggatttcttcctttgaatgatggcaagaggccatgatggatgttgattacatcttttccataacctttcaagaagttaccggatagtagctgtcaaaggaaacttttccagtaaacatcatccgtcaatataataactaatgctaagaaatatcttttgttaataaagctgttcctgcaaagaagcataaacacaaagcaagaacagtctgaagagaagatttgattcattttggcgcaaacaaagtgtaatgagactattcaagacaaagaaaacgagcctaggatggaacttaaaagctgatatacctgcatgtatctagcgagaactagaaaatcggtacccttaaccaattccaaaatctcctcttctattttattctgatcggttgttggtaaataatgataagagatgccatgcctctggagaaacctcataacatgggtgtttggagctctttcatgattactgaagacaccaaatattccggaatcactagtcataactaatatatccatttagttcgttggaagagatatatgcaaaccttatcacacatgttatatcaacgggaagttttccatcctgccatttatgtaacatttcaaccagacaatgatcctacaatacaaaagaatcacacaactccaggaaaaagaaggcacagaataaaaaggatcttctttatgacataaaatttacctgtttcgacagtagaagagctatcttgtatttggggtctaaagagggcactcgtactactgagctcaaagcactaaacttttgtgcaatagtttgaaaatcttcatccatctgcctcctcggccattttactggatcaaatataaactcactgcccaaagaaattaccttttcatcacaactaaacccaaaaatagaaacttttaactgctccaagcttttagtattcactttaaagacattgattcagaaagaatctattgaagtaacatcaaaggtaagatttttcaaatgggaaaattggaaactttaccttctagagtagaagacgttcttgttctcaggaaccaaaacatcataaccaagaatgttacctcctttagcagcaatacaatctgaaagtttcgctacaatcccaacgacatcctaaacttcaaaaagaaaaactggattcagttagattaggaccaaaagaaattatggggagacatcaatgattattggattcatatacgtaccggacaatggaagacgtggaagccgggaatgagaagaggtgagacagaggaatcgagggactcgccgtgaaattgagaagatttaaaggaccatttggtaaatgatctaaaagctgtggcggagagacatgaggtggtggagactcttcgtatcattgccgctatttcttgtcgcactcttttgaatccgactcatccgtcgttataaacattctcacctttttatcgttagattatgtgtttgttattcacatatcattctgaaattttagagcataaactcaaaactctacaaaatagagtgacttcactgtttacttcgtcgtattaaaaaaagtttattatattttccaaattgagcaggaattgtttttgataaaattctcatttttatacatataataacaacttttctaatgaaattattttatcttcatactctttttccactcctttcaacaaaaatagttaaagatgtatttcattatattatcaaatgggaattgcttaagtaatgttcatttcctaaattatacaccattttatggtcatttacccaaattgcaaaaaaatatctttgagcagccagccatatcctccgaaagcttccaagtttaatttgtacaccacaaaaagataaaagaaccaaaaaagtaacatcttcttttccagatatggtctgtagtctgtgctattttgtaaatatgactccatactagatttgtgtccctcaccaaatcggtctcatcctagaaacataccatttgcacacaaattattcatacagatataaccgtacaatatttgagataggccccatcgacgtcgtttagctcaaagcaagaagggagagagagagtcagcgagcttcgtta

SEQ ID NO: 6666 - DNA, 3000 bp, Unknown
  misc_feature (1)..( 3000): cDNA_ID_3048788_gDNA_ID_1621100_Annot_ID_171347 3000 nt of promoter + ATG
accgactagtggacccacccagtagatccatatctgagagaagtcaccactgacaacagctggtccaaatgacctggccgggttcatggaaccaccgctaaagggacccgctgcgaggatgttggcaccaacgatgaaaccgatagcaattggagcaatggtcccgagtgaacctttctttggatcagccgctgtggcgtagactgtgtagaccagagcaaaggtcaccacaatctccatcactactccttcaatagctcctaaaccggccgctactccatgagtcggtacgctctgcataaccgggaaataaacacattctcggttaatccatataccttttaaaatcaaactggatcttaagaccggcataacattttttagtcacggtcgtttggacaaaacagtcataatcagaaataacacatgacttaaataaatagtattgaataaattacgaatgtttttgtgtacctcgccattggtaacgaagacgaggaggagacacgcgacgatggagccaaggcattgagcaatccagtaaaagaaaccggttattactgtgatgttgccaccgacggcgagaccgagtgtcacggcggggttaaggtgtccgccggagatgttggcggctatggaaacaccaacgaaaagggcaaaggcgtgagccacagcgacagcgacaagaccagcggggtccaaggctgcatcggatgtgagcttggcaaaagcaagagcagagccaacgccagcaaacacaaagagaagagttgcgataaattcagacaagtaagccttaagagatgctacactaaaggagtcacccacacttcctatctcaatcttcaccattttgatccgacaaaataactctgtttttcgactttggttgattacaagttatttctatttgtgtggttttgggcatactaatgcttgactttatatatagcaaagagccaaacgaggtaatgaagttgttggtcccactctacgtggcctgtcacaattggatgccgcccaaaccgccaattatttagactattcattttcttttgaattttgagggttagtgacatcgaagatgattaaagacaaccaattggtataatgctatgaaaatgatggataaggtatttcataatatgtgaagataagagtgttctgttgtcatgttaatatcctgcatttaaactaatgttgtctcacaccaattatgatagatggtcgtattcttttatatctatatatattttttttggttacaatttgtattttttagtttgggaggtgctaaacgcctaaaatattaatagggattaggagttaattcatgtaccaccgctgctttgtttggagttggtgtgtaagagatattggcatatacatgtaataaaattgcaacaaacagaaaacttaagatcttagaaaagtgatccaaagtagtggtgacattaaataaaaatttgcagagaggatggttgtttataatactttctccgccccatgaattttaaaagtaatatttttagtatatggtttatggatagttttttattatcatgaatttaatttgcagtatagaacaacgaagtggaatgctcaatcctagattaaaccgatccctgacaaatgtttttccacccactaccgcttaaaagttgaaaattattccatcccagtaaactgatattatgaaccaaacgtccaaactcaaataatcgatctgaaaatgaactatattttttttaaaattatgaattcatttttcctattcaaaatattgaattcgaatccaaactaaacaaacagaaagaaaaacctgattttaaatccaattttgttttcaagttaaataaacatttgattaaaacttgaagtcgaaccaataccaatacgaaaccgtaccaaaccatctatggtacaaatactatcattcataaaccaaaataccaaaaaaacctaacagaaaaaaattataaagtgggcctaagcccatataaatatcccaatggattccttttgatctgatggtccaaaagtccaatccgtcaattgcctaacacacaaaagcctctatctattagttagtgagtgacatgtctcttctctaattttatccttaagacactttccattttgtttagccaaccaatcatcttcattacactaatcagtagtcaatagtcatttcaacaataaatcttctaacttttaccacagtcacgtcaaacaaaagttgttttcttttacctcttggtcatttaattttcttttaacggaactctagccagtaaattacactaaattttaacgtacgttaatttaaaagtaaaaaacctttcgcgtctttttgtttaagttcaatattagccacacgatccagaaaattcgacacgtgtcactatggattaagcggcatcagtatccatctttattttctctccaaatatttatttaattttgggctttacttaaaccagactcatttcatttgccgaggaaagcgaatataatttatcgggcatttctctcccaatctgcttcactcgccaaacctcgtttcttcgccggaaccctaggtcacctccgtcagtttgaattttccggtgagtttaacttcttcgctagcgtttcaatttatcattttaagaaagttcactcttttaggttttcgtgtgcccttgaattttgagaaggaagagattttataattgacgcgtatggttttgttgttggtggagcagtagtagatgaacgtgcgattaggtaacagttgaggtctgacggccaggttttcttgtcaccgaatggagggaggtagcgtctccatacactcttgtgtcggtacttttcgctttcctactgttttactccactcgacaagaaaatgaccagagtcgcttctttaaatatgtttcacggttgttgtgttatgcttttgtttcttttggttgtttgatgtttatatatgtctctgatttcaggaataaactcatg

SEQ ID NO: 6667 - DNA, 3000 bp, Unknown; identical to SEQ ID NO: 6659
  misc_feature (1)..( 3000): cDNA_ID_3593723_gDNA_ID_1621100_Annot_ID_171331 3000 nt of promoter + ATG

SEQ ID NO: 6668 - DNA, 3000 bp, Unknown; identical to SEQ ID NO: 6658
  misc_feature (1)..( 3000): cDNA_ID_1815270_gDNA_ID_1621100_Annot_ID_171330 3000 nt of promoter + ATG

SEQ ID NO: 6669 - DNA, 3000 bp, Unknown; identical to SEQ ID NO: 6657
  misc_feature (1)..( 3000): cDNA_ID_3048799_gDNA_ID_1621100_Annot_ID_171329 3000 nt of promoter + ATG

SEQ ID NO: 6670 - DNA, 3000 bp, Unknown; identical to SEQ ID NO: 6656
  misc_feature (1)..( 3000): cDNA_ID_2123126_gDNA_ID_1621100_Annot_ID_171328 3000 nt of promoter + ATG

SEQ ID NO: 6671 - DNA, 3000 bp, Unknown
  misc_feature (1)..( 3000): cDNA_ID_3048752_gDNA_ID_1621100_Annot_ID_171388 3000 nt of promoter + ATG
ggaaacgaaggacggcactagattgatctggtaagtagtcaagtactgctcttttacggtgtacgtgtcagggtatgccaagtactgggacacacgtgtcattcgtgtgaatctatagagaatacattttttattattatagagaatacattttttattattatgacatttatattattataattatacattctaagttagatcaataacttagagcatctcaattcgtttctcaaaaagtattacttatttaacattatggagaaatgttggggtgattttttcattaaagattttaggttatctgaagttatttactcttataaaagactcaacggaagagtgacaaaaagaaataaactcaacaaggcaccccattgaaaacaaaaccgggcatgaatgatcattagcacccaaaaaaaaggttttgttaagatacataagcaacaaattagtcattcatacattttaaacaaacttattgtttatgtttgttttcttaatacttggtcgttcaaccactacagcattttatacaaatatatagtgaaccaacgaatgtaatacattgtctgattcccttaaataataattaaaaatcaaccttataaattcaacatttgttttttcttgctatggcaacacattcacatactagaccgtatttcgtcgaggaaaaaaaaaactcaaaataattggtactgtaaacaaacatcacagcattttgttcacacattcctggtataagtttcactaattatacaaattatacaaattatcgacgattaataatcatacacatatagtcatagatgataggtttcttaagaataataagaacgtaaacaacggtccaatagaggcaatggcaatgacacgtaaataagcagcttaagaaaagggaattgggacctcccaatcctatgggctaggaaatatggggccacaggatttatgcagttgagaaataatttacatttaaaaatgcagagaaatgacaggagagaaagagagcgacgaagcagaatctggaaatgactcaattgagggaaaataaaatatttataacaatttaaaatggctgagagtgacgtggttccatagatatttagacatattattgaaaatgaaaaacgtcgtgaccagaaaaaataataagcagcatcagaattgtataataataattcactggagacattacacacaactaatataattgttgaaggcgcttcatattatgtatcattgaaggctaatttatcaaataccgaactataaaactttgaaattcttcatattaaagtatggagtgaaatttattcgaaactcatattaaaaaaaaaaaatacaagaagaagactttaaagggacaggtggggtaagactttgggaacttccgagccttgcgcaagtgtacgacgtttactagttttaataatcgcttacacgcatcctttaggcgcgtgtttcacacttcaaggaggctcctttgttattattgtttccaaggaagtccaacaacaattaatgtatgtttagttgttgttactggtattgtttaaccatggagtattatcaaaaccaaaccctgttctcacataacataaaatcactccatcaatttccatgatgtcagatgttttacatttcttacacatataaaatttttttgatgacatagttgtatacttgtatcttttcgttttttccatttgaaatagcactcactaatagaagtaaataacgaaatgtcatgagacttttggcatggaaattgcaaaacattgttttttaaacctgatattcttcctatttacaagttaaaagtgtgaggaaaaaatggcgaatttacatgttaaaatcaaattaagcttttgattgacaagctaaaaagcctaaaagtaattttgatttttgaaaatgttgagtgcggagtcgtcacagagcttttttccaaagtctttgcaaaaacgtcattcatcacaagaaataaagaacctaaaaaagggagaaaacgacgtcgtatatgttctattaataatttaaagtgttgtccttgccaataaagaaaagacacaagtggtggtggtctgtgtagatattacgtaacgcgcaatctcacgcgctcgtggaccccacgatccaatgactttctttaacgtccaagtgcggatgggacccatgttttatggaaccgtttcgaagattttctttgcagtggtttttgctattacgtttatgccctttgttcttagcttcaacaacaatattgccattttccaaagaattttattccagttttatactaattgatagttataataataccgtctaggttaatgatgttattaattctagtagtattgattagacaacaaatcttagtgttatttattttagtgttttttaagatcataaaaaaaggtgtagcttataatagcatatattatacatagttgatgtgggtcaatgacaatgtaatttaactgaaactttcttatgaaaatcaagtttgtttctagtcattgtctttttttttggccggttttaaattttaggtatttttcgtatatctatttttcttagattaaaatttgattcaatcgttttggttcagttttgcattgctgtttaagtcactagatattttttttctacatagtgtttctatagaaaagagccttacactattatacacaagtgaaataagtaatttgattcataagaaaatgcttaattatatactagtggctcaattattcctcttcataatgtaatggttaggtagttaaaattattaaagaaattcgattaaggaaaaaagcggtattgcaaaaacaagaagccaatagattctctctcttaaccagaatcaaacctgtccttctctattcctataaaaaccaaactccatcttctcacaaatctcctccacaccaaacctctctctctatctctgtccaaataagaacaaaaaaagacaagattcagaaaaaaatg

SEQ ID NO: 6672 - DNA, 3000 bp, Unknown
  misc_feature (1)..( 3000): cDNA_ID_1027047_gDNA_ID_1621100_Annot_ID_171385 3000 nt of promoter + ATG
gaattggcttttgggtttctctggctgctaagtattttctgttatgaaataatgacagttttgcctgcgggatggagcaatgataaccatggtgggagagggggaatgggacgtggtcgttggtcaaatgggagaggaggacctgggcttcttcctcggcctggaccttaccctggacgtggtggtaatcgtggtggttttggcgggagataccagaattatcagcgtgatgaacgttttgtttctgagcttaagctttcgaaaagcaaagaaacgttggctagaaaacaaaccaactttcaggaggtaatatatatcaaggaatgctgttttaactactacatttttatggttatggtaacgcgtttcgaattgcttgatattaacagccatgtgagcttacttgctacagtcgagtagaaggtggagaagtaatctacgatgaccaaggattggtgaggcgtttggtgttatagttcctttagattctctcttttcttcttttgtcatcccattgaactatttaattgatggggtatatgcagacctttaaacataccaactatcacagcttatatgtatccactttgttcttgtttcccagaggcttttcaaacgtcatattggtgaagagattggagcggatttaaatcaaggttatgatacttttattgagaaaaaaggtaatgcattagtggcactagtgaactattagcatgtgtaaaatgaagaattgtgatatattcagctgattagtcgttcttttgaggcagatctgggctctgagggctttggtgaccttcttggcagtattagagcaaaaaacatttcgctggacaacattcattttgtggtatgaagtgcggatgtatatatgtccatttcactgtcaatttattactttgaaagaggttatcttaatggtgtcttttatttttgcttttttggacagacttttcgtaataatctaaacaaggtaagtgagatccccaacagttatttgatctctatgatatcaaatgaatcactctgtgcacattgtttcattctttcagatattgggcgctgcttacaatcggcatgaaccgtgggaaatgggcgtccataagagaaatggaaccatatatctagatgtgcataaactgcctgaaaggccgcagagtgacttagatcgccgcaggtaatcttcgctttaattgtatttgcggattggagtgattctactagttttattataaatggtgctaaagaatgtctgtgtagaagacaatgctaatgttttgaaaaaaatgggtcataaagagtttataacactgctctgcatattttgctactaataaacttgatgttatgtttccatcagatgttactggggttattgttttgaaagccttgctacggaagatccaggaagagcttatggagaagaaatacatcatgtggatgcaaatgttgaattttgttctgttgtcaggactaaactaggagctcaccgagttatgatgggtgctgaaatggactgctgtgatgtatctgataagggaaaaaggttttacgtagagttgaaaacaactcgtgaggtatgactcttgctatagttttcctaataagctcgtttgttatttcagcttctctctttcatttcacacacatacatattggccagtaatgtccctactgtttactctccagttggatgatcgtaccgttgacagatttgaaagagagaaattgcttaaattctgggtaagtatgatctaacacgggttacatatatcttctttgtttctccattcttgtttagacttaaatggttttaacatgctgcagatacaatcattcgtagcaggagttccatacattgtcgttggatttaggtatgaatttgccaaccattctaaggataaactcaaaaagtctaaacctttcgccatttaagcaaatcagttcaagataacattaccatatcccttttcatcttgatgtagagatgatggaggaagactagtacgcacagagagactaacaacgagagatattgcgcatagagccagattgaaaaactattggcaggtaagtgttatcagttctcattacagacatgaatgataagaaacactaatgaatttgggaactagggaggagtgtgcttggcatttgccgatgaagttctttgctggctatacggcactgttaaagaaagtaagttcattttttgttacgtctacatagaacaatggaagaagatcttttaaatttacatttcccaacaatgtgttttgcagacgaagattacatacttcagttcgtgcaccctttcatgagactagagcttcttcaagctcaatcttgtcctgatgccatcactaatcatgttcaccttctacaaaatcctgcatcaccaccaccaccacctcagtaactttatgcttctttagtggagtcataaactgtaatacttagggttcaaaatcaaatttgaaatgaaggtttagattttggatttcttttgtaacattttattaaccaaaaacccaaacattgaaaaaggaaaaaaaattgtgattcaaagattttaaactgggtccaagcagaaagcgagtctaacatgggccgggtctgttttaaactgggtccaagccttctaatcttatcacgtgagcgtcacgtgctctctttttctctctctctctctctccctctggctgacgaatcaccggagaacccaatttgtttcattcctttcccgttttgcccttccctgttcttttattcttttcttatctacaaaaaaaacttcgagcaagaacaaaaaaaaaaaactgtccatgtaccacaccatgagattagttgtcagatagatattcgcgagacgagaagctccaattaaaaaccctagagctcatctctctctccaggtacggccttttcgtttttggctttcaccggcgtggatctccggtgacggggagattcggaatttcggagagattttagatc

SEQ ID NO: 6673 - DNA, 3000 bp, Unknown
  misc_feature (1)..( 3000): cDNA_ID_3090678_gDNA_ID_1621100_Annot_ID_171384 3000 nt of promoter + ATG
tatgggatagacttcaggagaagaaaaaaaaaaaaaaaccggaaattgttcgggggattgaacccgacgtgaatcgaacacgcaaccttctgatctggagtcagacgcgctaccattgcgccacggatccggatgttattatgttgcatttataaaattataataccgtagtatacgcaaattaaacaaaacattttgaggacgcgttcccaacacggccggtgaccaaagagtcaatttaagcccgctttaaagatatcaaaatgatataaaactctaattgatcgagttaacggcaggagaatcaaagctactaatcataatcaagaaatttaatatatatacgctattattattgttttgaacgataaacacgtggtctggtcgtgattaaggtcctaattatgtcaacgtttgcctgccacattgcagaccgaagtactaattccacaccgactggtctacgacatatttaattcataaacacaatactttataattaaattgattcttgtagagatttggcttcatgatctgatttatttagttaataaccatttcaacagataattacagtttagagcctttttccagttgtcaagagtgttatggttttaaaatggcaccctgtaaatatcacatatgttagtggatttattttaccaaagaaacaaaaaatgttaatggattaaaaaacttgtgtttttttagatagcaaaaccaaaagaagatatggtgaccactaacacgatcagtcgaagacaaatgtttcccagactttattattggcgtttccattttgcatattagtcaaattatggagcatcgcaaatatctaataaactaactatataaaaagttattataatacagggttaccaattccgtatattcagaatattcctaagaggtgccattttgactaataaaatggacggatctttgatttattccggaagtgaatggatattagaagaaacaaaagaaattttgaatttcttgtccaaaaaatatttttcccattcttagtatacagaaacatagaaaatatcgtgtatgcttacgtaacaatcaagttgtaaaaagaaaaaaagacagaagataaatagtacagaatgaacataacagaaatcaatctatggaattaggtacaattaggttcggtctaactgaaattacatgacgacagaaaaaactgaactaaacgccgattctattaacttccaaaactgactcgtctcacacgcgcttactatgattcacacgtgcgaatatgccatcatataagcgctactaaaattcattccaaaggaaaaagaaaaataaataatcgatctcaaccgtccgatcatccatcttgccatcaccgttcaccaatcttcttcgtctcctctctctttctctctttttgctgtttctagctcctctctctctggatctcgccggcgaaccgtttctcttgggtggtgagtgttgcttcttatttttaagaatctttttcttttatttccatcgaatttcgtttttttgagtttgatttttggcctgtggaattctcgatgtttctacattgatcgtctggtttcgaatcgtgttttactggtacaattttgattccatctccgtatcttatggattcgaagaactttgtgttttttttttctttcttcattgatgctactttgctagggtttacacttttttcttccatggtaaaaaaatttgagcaaagttgttgagattcttctagactgttttcaattttacgtttcacaaagatttttttagatgatttgtttctaatgaaatggcattgtttgtgttctgtttccatatgtgtagattttgaaaatatgtttgtgatgattgtgcagtaaacagtagcaatcaagctatagaatctcagatatcgctgaattagctgttggattttatccgccttttcttcgttatccggggctcgggtataaggtttcatcgtcttatttcatctgtaaatgggctgcttccactcaaaggcagcaaaagaatttcgaggacacgaagaccctgttaagcttgcctctgagacagcttgtaagtttactcgcgctataagtttaaacctcctctagattcatttctctcaaagctgcatgttcatttgttttctgatatgagatgagaatcatcagttagattcaaatcattctttctctgttcactgatttagtttatctccggtttggatttttttagttttgtgttttggagtctttgtctgcctaacaatttctagtaatgatccttcaaagttggttaacactctatctcatgtttcttgttaccaataccatcaccttaatcttgttccttaacttgtcaagacgagttctctctccatgcaaattctaaatgtgaattattagtctctttgtttgtttgtttgtttgttcctggtaattctttgttttgatctcgtagtgttgcttgtttttttctcttttccagttagtgtgagtgaggttgaagcattatttgagctattcaagagcataagcagttcggttgttgatgatggtctgattaacaaggtacaaagtttgtttcttttgacccaatttggatcttttcatgaccccatcgttgtatctttttgttctttacgctattcatctacagtatttttcaacttagttgactttatttgagcaataattattcttccatgacgatatgtctgttccatattgcatcgattcaatgtatcgtagcccttaatgtttgacttgaacttaacttattttattgattgctttgattttgaattttgaagccttcatggcccaccttgtttatgttgttttttaatcctggcttcacatgtatgcaggaggagtttcaacttgctttgttcaaaagccggaagagggagaatatatttgctaatagggtaaaatcttaattcttcaggcttttacaagattcatcttctggaagagtgatctaaaccaagataat

SEQ ID NO: 6674 - DNA, 3000 bp, Unknown
  misc_feature (1)..( 3000): cDNA_ID_3090684_gDNA_ID_1621100_Annot_ID_171382 3000 nt of promoter + ATG
acattaagggctacgatacattgaatcgatgcaatatggaacagacatatcgtcatggaagaataattattgctcaaataaagtcaactaagttgaaaaatactgtagatgaatagcgtaaagaacaaaaagatacaacgatggggtcatgaaaagatccaaattgggtcaaaagaaacaaactttgtaccttgttaatcagaccatcatcaacaaccgaactgcttatgctcttgaatagctcaaataatgcttcaacctcactcacactaactggaaaagagaaaaaaacaagcaacactacgagatcaaaacaaagaattaccaggaacaaacaaacaaacaaacaaagagactaataattcacatttagaatttgcatggagagagaactcgtcttgacaagttaaggaacaagattaaggtgatggtattggtaacaagaaacatgagatagagtgttaaccaactttgaaggatcattactagaaattgttaggcagacaaagactccaaaacacaaaactaaaaaaatccaaaccggagataaactaaatcagtgaacagagaaagaatgatttgaatctaactgatgattctcatctcatatcagaaaacaaatgaacatgcagctttgagagaaatgaatctagaggaggtttaaacttatagcgcgagtaaacttacaagctgtctcagaggcaagcttaacagggtcttcgtgtcctcgaaattcttttgctgcctttgagtggaagcagcccatttacagatgaaataagacgatgaaaccttatacccgagccccggataacgaagaaaaggcggataaaatccaacagctaattcagcgatatctgagattctatagcttgattgctactgtttactgcacaatcatcacaaacatattttcaaaatctacacatatggaaacagaacacaaacaatgccatttcattagaaacaaatcatctaaaaaaatctttgtgaaacgtaaaattgaaaacagtctagaagaatctcaacaactttgctcaaatttttttaccatggaagaaaaaagtgtaaaccctagcaaagtagcatcaatgaagaaagaaaaaaaaaacacaaagttcttcgaatccataagatacggagatggaatcaaaattgtaccagtaaaacacgattcgaaaccagacgatcaatgtagaaacatcgagaattccacaggccaaaaatcaaactcaaaaaaacgaaattcgatggaaataaaagaaaaagattcttaaaaataagaagcaacactcaccacccaagagaaacggttcgccggcgagatccagagagagaggagctagaaacagcaaaaagagagaaagagagaggagacgaagaagattggtgaacggtgatggcaagatggatgatcggacggttgagatcgattatttatttttctttttcctttggaatgaattttagtagcgcttatatgatggcatattcgcacgtgtgaatcatagtaagcgcgtgtgagacgagtcagttttggaagttaatagaatcggcgtttagttcagttttttctgtcgtcatgtaatttcagttagaccgaacctaattgtacctaattccatagattgatttctgttatgttcattctgtactatttatcttctgtctttttttctttttacaacttgattgttacgtaagcatacacgatattttctatgtttctgtatactaagaatgggaaaaatattttttggacaagaaattcaaaatttcttttgtttcttctaatatccattcacttccggaataaatcaaagatccgtccattttattagtcaaaatggcacctcttaggaatattctgaatatacggaattggtaaccctgtattataataactttttatatagttagtttattagatatttgcgatgctccataatttgactaatatgcaaaatggaaacgccaataataaagtctgggaaacatttgtcttcgactgatcgtgttagtggtcaccatatcttcttttggttttgctatctaaaaaaacacaagttttttaatccattaacattttttgtttctttggtaaaataaatccactaacatatgtgatatttacagggtgccattttaaaaccataacactcttgacaactggaaaaaggctctaaactgtaattatctgttgaaatggttattaactaaataaatcagatcatgaagccaaatctctacaagaatcaatttaattataaagtattgtgtttatgaattaaatatgtcgtagaccagtcggtgtggaattagtacttcggtctgcaatgtggcaggcaaacgttgacataattaggaccttaatcacgaccagaccacgtgtttatcgttcaaaacaataataatagcgtatatatattaaatttcttgattatgattagtagctttgattctcctgccgttaactcgatcaattagagttttatatcattttgatatctttaaagcgggcttaaattgactctttggtcaccggccgtgttgggaacgcgtcctcaaaatgttttgtttaatttgcgtatactacggtattataattttataaatgcaacataataacatccggatccgtggcgcaatggtagcgcgtctgactccagatcagaaggttgcgtgttcgattcacgtcgggttcaatcccccgaacaatttccggtttttttttttttttcttctcctgaagtctatcccatacggcccaatcatactaagttaagcccaagaaagcccttatcaataattctaatttcccccctaattatacgactagggtttatctgtcctaagccatgaaaattatttgaaagggtttaacagagagattcctcgtaacacttccctctgtactaatttcaaattcgtttacgtttcttcatctattctggctgcttgcagccaatttttttgaagttcgaagcttcaattgaaatg

SEQ ID NO: 6675 - DNA, 3000 bp, Unknown
  misc_feature (1)..( 3000): cDNA_ID_3090698_gDNA_ID_1621100_Annot_ID_171375 3000 nt of promoter + ATG
tacctttttcactgactttgcttctctatttgttcaaattctcgttctcaacatggtaagttcttcccttaaacccttggtgagttcattgttacctctaatgtctctctatctaatacaatttcgtcttattttgtgcagtttaggaagatgaagaaaggaagaaaagaccgaagaaactgaaaccaccaaatcaaagtctacatagctcagagttttagtcaaatcactctttttacttctctttgactagtctctttgctatcataaaaacttcagattgtaaacgactttgtactctactctggctctggcctttactgtctaatatcaaatttataacaaaaatgcaagttaggagaaagtcataagtgtacatgtttcaagaactattccaatgtttggtcaaatcttatgttctatttggatggtttaaaatgagtaaacaatttgatctacagtttctagtatgagtgaaaattaagatattagggaaaatactagagactgtaaccacactttttgtctatgagtctatcttacattagaaagaagctagttgatatttgatactaaaataattttctgctaatggacattgttgccatagtagttgtgttgctgttattattagcgtatgaaaatgaaaatgggttttgtaaattgtgatttgtaagcacgattggggcatgactttttgtgtttgacctctaatagcactccaattctcatcgtcttttctcagccgttcgatcatacctccatcattttgcctacacctctcacaccatttcattattacattaccatcgtttcttttaaaaaaagaatatatagatcagagatgtgattggcatctgaatttctggttacactattttaaaatttggtaagactactcttcaattcggtctctgacacattattcttcagttttcgtaactaatgctccataacattttaccaatcacattagattatatcgtttacttaagaaaaaaaaatagaactatttttgttttcttgtgtttaagataaattttttggagtaatgctatcactcgataagttaacttggttcggtttatttacgttgaattgagaattctttattggtgcattacactatgtacgaaaccaaagaaaagaaacacaaagaactaaagatctcaatacatatactactagttaaatgcaaaagaaaaccgaatattataataaattacacgtataatataatgtatggtgttgatatcgcattagttccctaatcacattcacaaattaccaaagaaacataagtaggacccatgttttgaatatctttaactaaatcaaacggtggagggaggagttgtgtccatgatcgtcatggtggacggtgactttacataccatttctttctttttaactttgttttttttatgacacatatttatcaataattttagtcttttctttgttataagaaaaatatatataccccacttaacaaaacttattctaccagcatagtattgtcacacatgtaaaaaaataagcaaaaataacctaatctcttaatctagtcgttgacaaaactttagtatttgctaagttataaataaataaacaagaacccaattataaaccttattcagcaaatccaaaggcatgaataaatctaccaatcgttacggtatttaaaataccgtattgtactatagatttatactttcacattctgtcgacacattattttttcttgcacaacattttttttttattatatttttttcttgcaaaacatgaacaatattattgacaaagagtgtatgtatcttatatagtttttttttgatgtagttaataattttagagaaaaaaagcttaccagtgcttttttcttcctcatttttttttcatagtcattaatatttataattgtcgttattatatttattatacatgttggaaatatcaatagtaaaacaaacaaagaaagaaaagtctatagtcaacaagaaggatggaagcattaggcataagcaataatattcctcctacccaaaataatactcctataacttttatattaaatctgatagtcatagatctcatttcttgttaaactaattttctaaaatgaaatctcaaaattttatgaaaggatgctgaaacatttactttcaaaaataacaaaagaaaacaaaatgaaatgaaagtggccattttatgtcgactaaaaaagccattttatatgatgtcaacaaataaagccattatatgctgaagtaattttttatttttttttatctaaaatgaaattgaaaggaggaaaaaaaacatatttcttttttatgtaaggaagctgaaacaattaatttcatcgttacataataataatgcaaatgaacaaaaataaaaataaaataaaaagagagaccattttattattattattatacacaaacagtttctcgctctaaaccctcaaagttgttctctctctctctctcttctcctttttcacagccatttattagattcctctctcacaattagtctcttctcttttctattggattgttgtattagactgatagctcaaggaacccaaaaaacaaaaaccaaaaaagataacataaattatcttcttgaaattgttctctttcttgctttgattttttcaattttcttatactgagtttttgtatttctgtaaaatttgcttataggagactttctgggtatcttggcttcaatttgcagaaaaccaaaaaaaaaaaaaaactttttttctgggtttttttccttagcagagaaaaggttcttaatagttttaagactctggttttgtatattccaattatagctgaatattaaacacaatttataaaacttaaatttctttccaaaaaatctcttctttttaagtctataaaaattgcaactttcttctgaaattattcatttttgaaaaacacaaaagaaacaaagagagagatagagatattatg

SEQ ID NO: 6676 - DNA, 3000 bp, Unknown
  misc_feature (1)..( 3000): cDNA_ID_1815172_gDNA_ID_1621100_Annot_ID_171373 3000 nt of promoter + ATG
ctcattatgtgacccaaaaaaagaaaaagaaaaacaaatcataagggaattcatcgaccacatcctaatacagtaatatctatgctgaatgattcatagagattagggtaatttaataataaaaagttgggttccaccttcacaagatcaaaattcaagattcgaatagttgagacgaagtcccaaaagaaataagacgagaacatgtcttctgtttttgttcctgaagaccctcaagagtcaagacacaccaaacaacatatgcacagaacacagactcattcatacatagtttctattaaagtatggactttaggtcatcctaagccatatatcattcattatcaaacaaggaacaggtctacatccatcaaccggaagttcaactaatcttaatttactttctcagaaaatgtgcagggaatgacttacaggcttaaaaaaaagaaagaaagaaacaattcttacaaaaaaagagcacaatgcggaagattactacctctggaggtcaaacacagcacggtggatggtgttcacttgaaagtggacagacgaggaagcttgtccctcagatagtaaagccttgctcttcttactttcctgtgactcaccacttttatctctttgatgttgggagagtatctgtcaaatcaaacgattaggagaatcaacacataccaaacacttttcttaattcccacatggtaagaaaataaccgatatatcacaggaagtttctcgagactcgtatgttatacagcagaatgaaagatagtaaacatgagcagacatgatagttgccatagtgattcaggctgccataactgggaaggtataacagcaactaaagacttattacagtaaaacctctgcacagagtctaactattatacagggactttatgtaaggtaacacaaagtataactcagtatctatgtataaacttggttttattgaaaagctcagaacatgtgaaaagactcataatcaaagtaggtcataccaaatggtcactggagaggggaaaaaactcacatgggaaacacaatttcaacaccgatacccgcaataattctccgaatacgaatggtagtgtgtatgcctgcattttgtctcgacatcactatgcctttgtagatagatagcctacgtttgttctcaggaacttcctgccaagccaaacaccatatcccaccaataatcaaaaacatcgattcaatccataacttaagaggcttcaaaaatatcaacaacttaccaatttgatttctacaatatctcctgtcctgatttctggaacaggtctcactttctctgctacctcaattgctttctggttcagtatctacaacaatcaacagataataacattcaatctccctcaacattgcctataagataactatagaaaaagcaagtccctcaacacaaatgtgtacacagagacttactgattcctaattgctaaacactcataatttggattactgataaacaaagaagttcactaacccccatgacatctccgagcttgatcctaggttttcttgtaggtttagcttcgaccacttcctctacatttccttccgtatcagcgatttcagcaacaaattcttcagattcagcttctgtgttaccttcttctgctctaacgataaactcatttctcaccctagtatcgagtgagaacccaaatttcgagccgggatgattcagagaaagcctagaaactgatatacgagaatccatcgatggtgcacacgatagaaacgaagaaaaccctaaattcttcgatgattgcgtagggtttctgggtatcatatgcaatgcctaaaaatcccatagaaacaaataatcaacaataatgaattaagtgaaaatagagatttcataagctttcgtatatttaaacctgaggaagacgatgaaagctcatcgccatagctgcagcaaactctcagttactcggagaaaatggagggaagacagtggaaaagagccttatctgcttttcgcttcctattttggcacacgtatgccatcgcacgtgtgaattttctttatgggccgtttgttattgtgggcctttagtatatcaatattaatataaatagatagtactatgatttataaaaatatcaataaaagagtcggctaatgacacagtcttattatgattacataaacctataatttgggcccaccaccacgtcggtcgtgtgggccgtcgcttcatgcgtaccaaagtggtcaccgtggcatgacaactgttgttctgccttttggctctaccgtaacaaataggacacgtgtcgcgtcttcacagtttatgtcgtgttctatctctctctgtctctctctctctcccgccaatatctctctccctttggtctcttctctctaatcgctctctctcaatcaaattaattcgtgattctgatttatcaaacactaaaacaaatggatttgggtatttcattttgatccgtaaaggttgattcttttttttttttgttatcattgaaaattttgttttgttgtgagagatggcgatgaattcgaagaggaaaacaccacctgggattgcgcttctgaggagagtcagaggaagaaattggagtccaaagacgtttcggtacgcgattttgtttattactttcatcgcatatgcttgttaccatgcttctcgtaaaccaagcagcatagtgaagagcgttttacacccagactcaagcactaagccacctcaagaacataacagcgacaaaatttatccttggcctatgggtaacgtgtttgtgaagagagaaattggtgatatagatgaggttttgttgcatcgtaagtctaaaggatgggaaccgtttaatgggaaagatgggacgtctaggttgggagagattgatgtggcgtttcttgcttgttactctataggaatgtatgttgctggtcatttgggtgatagtttggatctgagattgtttctgacttggggaatg

SEQ ID NO: 6677 - DNA, 3000 bp, Unknown
  misc_feature (1)..( 3000): cDNA_ID_2123239_gDNA_ID_1621100_Annot_ID_171372 3000 nt of promoter + ATG
gtaactagttgacttatggtttctcgtttaattagttaaaaagagaaagtctaagcatttcattcgaattctttctcattgcttgtacacttctgttgtagtcattgagcatcaatgagtttctgaaacctgcggatggaaagagttactacagaccaagaggtggttaccaaggtggaagggaaggacgtggaccaagagaaggaaaccagagggacggtggaagaaacctgagggaaggagggagaaaccagagggacggaggagctgcagcacaggcaccaacaccggccattggggacagtgcacagttccctactttgggtaagtaaggcaatctctccggtttggtccttcagcttctgtctggactcgtttctctgtaatatctcactcggtttggattttgttcttctgattctatttttattgttatactcttccctttagagagctgaaggttttttgttttgcgaacccaattttgggagttttaagttaaatgaggccaaaaaatcaaccattctccttttgttgtttaggtttcaattatatttaggtgggactttttactaaagaagtttattaataatccaagtaccattacaaagaatttaaaagcttttggacacaagtgaaaaattgaaaaaccaaatacaaaagatttaagaagcaacgttgtttagatttcttacatgcaaacgaatgacataatatggttaagtgttaccaaagcgaattaagaggagcagcagcctgattgctggttaacaggttgtcctcggatctggaccgttggtggcttagatcctcctgcaggttggctcgccattctgcaagacagaatccggttaaggctgctggtctacaaatggtctgcaaatgtaataaatatatgagctctgaatacaataatgattggtgagttacctggtcttgattgcagcagtcatggccatgaaagcttcttcgacattggtagcattcttagcacttgtttccaagaatgggatcccaagttcatcagcgaaagcctgtgtagacagaacaaccattacagtaaatccttgagacaagacacaagagtgtcaaagaacctttaactgtgacgaacttctgaagcatattaccttagctgtctcagtggatacaactttctgtgatgtgagatcacacttgttcccaaccagtagcttgttaacattctcacttgcatagcggtcgatttcatttagccattgcttgacgttgttgaagctttctagatctgttacatcataagtcacctgacaaaaatgaaagtttagtttcattaatggatgtcagaaaaagggagataatgtaagtgtgacaacgaacttacaataattccatgagctcctctgtagtaactgctagtaatcgttctgaaacgttcctggcctgccgtatcccactgcataattggtgatagtaataaggagagtgatcatatatatatatatatatatgcacatacaacaatttcaagtgattggcactagtcgagacaacttacaatctggagtttgatggtctttccatcttgttcgactgttcggattttctgcaaaaaacatcatcacaaaattcaaaattaaaacttttctgtttcatgcatgaccaatagataaagtgtaagaagcttacaaagtcgacaccaatggtgctgatgtagctatccaggtaggaatcatcctgcacatacaaacaaattgagacactacttgagaagatcaacaacgacacttaatagagttacttatttgtatgtagcctatttatgtatacaaatatcataagctaggtgattaagagagaaatgaagttacttacagcaaaccttagaagcaagcacgactttccaacaccagaatcaccaatgagcaaaagcttgaacaaatagtcactgcagatcaaaaaaattagaaagaagcataagacacatgtaagtaagagagtataaatcatttttgacatttctccagctatattaagagcttatgacatatttcaaagttgctaaacattgtgaagaagctcatagatttctaaacgccatattcaaaacacaatctcaagcaccataatcaaaatcgactatggattcacgtcacacccgtagaattttcaaactaagagaatcatctgtgtattgaagagaaacaacagatctcaaccaattttattctagatctaatcaaaattccgatcaacgaaacgagactccaatcacgaaattgatcagacagattaacaaagccagcatcaacataaggttaatttcatgaatctccttgtaaaaaaatgatacgaagaaaatctatagagaaactaaattacataacatgttataaatttcaaaatcgatctgaacgattagagaagaagaagaagaagaaggttcttactattcaggattcatgattgatctcggagctggatcgatctaccggaagaaaaataaaataagaagagagattccgccgattaaacagagaaaagagccgtgatcttcgtcggtgatgagagactgagagagagagagacgtaacacgatcggtttgttgtgtcgacgacgtggttaagaaatgagaaagggccacactacaactattgtttttaaatgcttcttttttttggttgcattgctgacgtgtcttcgccaacccagaagatgcgtggacgagaaagtttcaatacgatacaacaaaaagaaaaagaaaaaagaattgtatttacataatgggcctaatgaaaaaacttatcactaaggcccattaaacattttctcatcgaccagggaacagagaacgctgaatcatcttcttcttctctttcattttccgagtctctatctcttgctttatcaacagttcggtaactacgacaaagaaaaacaggcgggaaaccaaatcaatggaggattcttagctttttctctgtaactcccattatcgtatcttcagcttagtgagatag

SEQ ID NO: 6678 - DNA, 3000 bp, Unknown
  misc_feature (1)..( 3000): cDNA_ID_1815179_gDNA_ID_1621100_Annot_ID_171371 3000 nt of promoter + ATG
gttcctgcttctgaaccactgttaaccgatagaagatgatggagaagggagcagcgagagaggcagtgtgaacagaaaccattgtttgcgcaagagttttgttctgttatataattatgagtttgcagaggaacttacagttctttgtattctgtgttttgtctgatattgtgaaaaatttctttatctcataacaaatgaaggaattggcttacagctttcttcctctatttcttctctgttttctacgacactcaaagcaatctttgcatggtggtgtttcgtaattgtaagaggaaactaatttcagtttttcgggtgaaactttgagatcttctatgattatccttcgaagcttttcgttctcttccattacttcatcaatgagtttctgatgtttcagcacctacacaatcaatttcgtgtatacataaccatggactactaaatctgataaactgtaacagaaaaaagaaagaaactggaagtcaagaaggagacgataccatttgaagcattaagctctccgattctagttgtgtgacctatcaatgtcatgaaacaaaaggaagttcaaggatggctttctgagatcaaagcagagagggggaaacattctgtgatagaattattacctgtcgttcttccgcagttgtgtcctggtgtttcagaatagggttgtcgagaaaactgttgatcactttctcagttcgagtaccaaacgttcttgaattagtagaggaaccactgttcttcaaagatgcttttgtgtccacatgtttcttgtgaccggttacagattgagacacctggtcttcagtctcagtttgacttgaggtggtctcactcgttcttccaagtttagtcatcaagttggatgcagttccctagaaaagattcatactcatggttttatgtgaatgaaattaataaggacactctttgaaagactggtgcttaccataatagaagcttgaagtttgtgtatggcacttggtttcactgcaatgcctgtcaatgatggatatgagttaatgacaataagagagcgatagttcaaataagtaactcaagggatgcttatacaaccaacaaatccaagtaactcaactgttcagaaacaagccatgtatcaaaattgaagagcgtttagaacaaaatcgaaacaagaagttttacttagaacggaaacataccaactccgaaaccatgaccaaagccaactccacagccaacacctgcttgaatgttcctcgctccaagcttccgcaactatagatggcgcaagtacacaaccagattcagaataacataatgcaggaagatctaaaaaagagcaggaacaagtttgtctatactgtacagcgccattcacgtggtgtgtggcacccgaaaatacattggttgctcctctagctgaattcataatttcccccaccattggaatactacctgatatgtcaataacaacaacatcaataccagattagtgatctcacaatcatgatgctgtgaaagcaaaccaattagcaaagtaaatgacacacgattttcaactatgagtgatagcttaacactagtttcatttccaagaactctgattgaaacatagtcttcaacaaacaataaaacttcttaatttgaacagaccataaaatcatcagtggcagcaatacactgagaatcaaaaatcaaactttcaaaatcaggttaatttgagctgattgattacaatcaatctcaccagatttcttaattacacactccttcacacctcaaaaacggagcaaaaggaaaaagagagtatataccgagattcaaaggtgcaccactaccaataccaactccacaaccaacgccaaatccagtgaagacttgaagagccttaaaagcaaaaggattctctattttaattccccttttagaaaaccctaatccttccttcttcatcaccacaccattgctgctgatgcttccgccgccaatttcctccatctatctcactaagctgaagatacgataatgggagttacagagaaaaagctaagaatcctccattgatttggtttcccgcctgtttttctttgtcgtagttaccgaactgttgataaagcaagagatagagactcggaaaatgaaagagaagaagaagatgattcagcgttctctgttccctggtcgatgagaaaatgtttaatgggccttagtgataagttttttcattaggcccattatgtaaatacaattcttttttctttttctttttgttgtatcgtattgaaactttctcgtccacgcatcttctgggttggcgaagacacgtcagcaatgcaaccaaaaaaaagaagcatttaaaaacaatagttgtagtgtggccctttctcatttcttaaccacgtcgtcgacacaacaaaccgatcgtgttacgtctctctctctctcagtctctcatcaccgacgaagatcacggctcttttctctgtttaatcggcggaatctctcttcttattttatttttcttccggtagatcgatccagctccgagatcaatcatgaatcctgaatagtaagaaccttcttcttcttcttcttctctaatcgttcagatcgattttgaaatttataacatgttatgtaatttagtttctctatagattttcttcgtatcatttttttacaaggagattcatgaaattaaccttatgttgatgctggctttgttaatctgtctgatcaatttcgtgattggagtctcgtttcgttgatcggaattttgattagatctagaataaaattggttgagatctgttgtttctcttcaatacacagatgattctcttagtttgaaaattctacgggtgtgacgtgaatccatagtcgattttgattatggtgcttgagattgtgttttgaatatggcgtttagaaatctatgagcttcttcacaatgtttagcaactttgaaatatgtcataagctcttaatatagctggagaaatg

SEQ ID NO: 6679 - DNA, 3000 bp, Unknown
  misc_feature (1)..( 3000): cDNA_ID_2999833_gDNA_ID_1621100_Annot_ID_171370 3000 nt of promoter + ATG
ttcgaaattccggtgatcggaggagtaatttgcggaaatagaagggaaaattggaaaaataggagagtggagcaatacctgattcataacatctgggttagattcaagtggaagccatctcttagatgaagaactctcgcttgcggtcgccatcttaggatctttctcgtcactatcgatcgaattttgcagaagaaatcaaaatccttctataagaaaacaacacttcggctccaagatacgaatccctcaacatccgataattatgcaatggttcctatctattaacgggcctggctcactttaatccttctattaacgggcctgaccctctttaatccttctattaacgggcctgacccactttaatctgtctatccccttcgtatgcaattgttattttcagttgccaacgaatccaagttgtccgattttggtagaaagtaagtcaactagtcaagcattttaaactcatttgatctcaattggttagcacttgtacaatagtcaggtggtgaaattatgccttattgcgtgttatccatgattatcactatcgacaatatgattcgattgtatggtccattgatctataaatgtggattctctaaaccatgattaccaaccgcatattataattcggaaacaagaaaagaagattcagaatgtacaaaaagagaatccgagtaagtcattgactcagaaacaagacttaggagcattgcttctcttaataacagcctcaggcactcttagagatggctgtcacattgaagttgagagaactcggattcttctcgattatcttctttatcactttcgctgcgtcctacgaggataatatcaaagctattcaagtatataccggtttgcatttcctggattctttcaccgttttgataactttaagcttaaagagtgaagggtttatactactttgataattcttaagcttatagagtgaagtgtttatagtacatgcaataaggtagctggagaggaagtaccatgtgaaactggtcctgccctatctccatcaagttcatagagctcacttgcattatatggtaatagagtgtcacagtttagtgccaacttggaagtgagtttcattttggtgttgatatgaattttttttaccatctacacaagctaaacaaatgaaatgcgtgtccacctagtctgaagcctgaagatgggtaaacataaaaaaaccaatgtaacatctaagtgaacaagtcacaaatacattagcatcaacgggaggtgagaagttaccgttgtatcaccagctataatagctaaagaatgagcatatatcttctatttgactgtcgctctcaagaaaccttgctcgctatcaaaatttccatagacacacacattagacacgaagcaaacactctaagaaagatcaaatatataggagaaacaaaagatagagaaacacctctataggagtcatattggcagtggatttgaagaatctattcaggaacgacccctcagctgaaataagaaatcaaaagtgataatcgataaggattaatatctttagattaatgaaaggaacaaatagaaagcctgaatataactcacagagtttgatctcaaaggttatattctcaatagcatgaagaaggccaatggttccacaagcattatccacattttgtttcatgaagtaaactttatcactatgcacctaccaaattcatcaacacagagtatgaacgatacttaactacaaagacaagggttcttttttcatagaacaacccagatgtttatcagagagaagctcatcctttccttgatttcttggttatatacattatatatataaaaaatatgattaattttgcttagaaataatcttcctttaagaaaaaatgaaatatttacatgaaaatcaaccaaaatgaaagaatttttatacattatataaaaaataatatttttgtttcaatgtaggtggacaacttttatcctatgtagtttaaattaactgtgtatgggggtcaaaactataaaatactaggtcattataattattcctaagaaaaaaatatagttgtttttattttattttatagaggtcaattgacccccataatactgcactgcgtatatatgtttttgcattccgaattttgttttacctccgtatcatagagactgaaatatatatcgggtcttgtttacacaaaaaatcttaaaaataaatgaggttaattattatacaatatttaaaatgaagagacgtatccagtagcatatctagaaattgttgttgtaggggtcaaaagttttctttaatatataaaataatatacattatagatattaaaaatattcttaattttgcttagaaataatcttcccataaaaaaatgaaatatttacatgaaagtcaaccaaaatgaaataatttttatacattatataagattaatatttttgtttcaatgtatgtggataatttttatcctatgtagtttaaattaactatgtatggagtcaaaacaatataaaatacttagtcatcatgattattcttaagaaaatatagttgatttttttaattttatagagatcaattgatccccataatactatactgtatatcttttttcgtaggatttagaatggaaaaccttttggaataattcaccaatttacaattcattttatgattttgccatcacaaacgacatcagagtaaatatgactaacgggcccggcccaataattcaagattagttttttttaaggatttctagggtttttactttttagtatattatcttcttctctctctaaccctcagttctgttaagtacttggcttctaacaaacgctgtctgaatcatatttcgattctgatttttcttcatggattcgtatagccaataagttttttcaatattcaaaacaaaaaccccatcaaaataatctccggaccagtttctctttcgattcagtcggaccggaaaaaca

SEQ ID NO: 6680 - DNA, 3000 bp, Unknown
  misc_feature (1)..( 3000): cDNA_ID_3090710_gDNA_ID_1621100_Annot_ID_171363 3000 nt of promoter + ATG
tttaaagttgaaactgtacaccatatatataaaagtgagataaatgtaagaaatgcacgtgttcaatcatatggttgaaatagactggatacatgcattttgattacttttacacacaagtatttatagaatagtattatagtaccttcgtagaaattacatattccaacttaattgtagtatactgttcagaaagagtaactatttatgtccaattgccaaaaaataaatattctattaaggaagttattgaatagttttgttgaatggaattcgagaagaacaatttaagtatgaactagtatattatacgatcaaacttttcgttcttattttattaactgaactatgaccgcgatcacacatgttaacaaaaaattaacaaaggtaaattaaaatgatgattaattatagaataataacgttaaacatatgaaaacttttggttcttataaaatttatagaataataactaaattagaacaaaaaattaacaaaggtaaattaaaatgatgattaattatagaataataacgttaaacatatgaaaacttttggttcttataaaatttatagaataataactaaattagaacaaaaaattaacaaaggtaaattaaaatgatgattaattatagaataataacgttaaacatatgaaaacttttggttcttagaaaatttatagaataataactaaattagaacaggaaatctcacatattaacaaaaatttaataaagaaaatatagtatgaaagtaggacatgttgtatagtggttaatactaatctcgtctaatttcgttaactacgttttagaggcttaagggtagtttacaatttatgtctcttgttgtaaaaaaaaaacatttacgatatttacataatcgaacttcttcactgacttttttttaaataaaaagaatctaactgacatcctctctagactcagttaaacaaagagtctagaaattagtttaaactcaaatacgtaacataagcctagttttggaaacatgtggacctctaggctctaagttttcatttgttgtggattctggcatttggctgttttctaacacacaactctggtgtaacggtaccattatcccagtttaaatatgtataatgcatgtttatatatatatatataaaaattaaagactaatgataagaagaaatcaatcaataattgattttttaagtactagatttttttctttcagtttttgacatcctagatttccagaaaaacttgaaaaactatagctaacatgaacgaatatagcaaacatttttttttgtaggaacgaattagtaaacatgaatactctgtaattattgagaagttaattatggattcgtctgggcaatacccattgatatttcccttgaaacaaagatatttgtaataagaacataagtactggacagacacacagagctgaactagacatgtaaattatttacaaatgttttaaataagtgaaaacgttgatttgaaaaatatattagaagattcatttaaacctacatctaggataagccttgagcaatatgtttcatatatatagtataaattgtcatactgatagaaaattgcatatgtgtgtgttaggctttgtaaattagtttcaagtatgaatcaatatctatgatgaagtaagcacattcgtacgaagacgtaaaatggatatatcacgttcgaaagcagcaaccaaagccaaaagtggtcacatggtttgttgttgtaaaatatatatttttggttataattattgtagaataattgagactagaacttaattagtattacgattccgctaattacgcagcccttatctttcgagactataactttaatattacgattcctctgatagtctaattatgcatgcatttttgtgtgtttgcgttttagtttatgttttatacgtaaggtaatatctattcacttacaaatgaagcgataagcttataattttgtagcttgtacccgtagacacaataaaaatgtatatttatcggtgtaatgttttactatgttcggcaacattttaacaacactttagttttcagtgattatataacagctagaaatgaacatatatatagtgttgatcattgaaataaaaacagctttctggtctgagatgtataaaacaaaaataatggatattttatcccgaaagattatgtagagattggatgaacaaattactggttgaacttgaaattattggactttttttttttaaatgtttttgggcagctatacgagaattccatgggtctttgtccacaaaatgttggcgaccatacgaaaacatcgtcgacattcgacaaagagaatctagtcttcataactaaaatatttttaatccaaaaacaaaaataacatccgacgtacgtgaagtaaaaccagtgtttttcttccatcaaattttgcaactatcataagtttttatataaaaacgtgtgtttatccaaacattgagttgatacggccgctaaattttgatattgcaaatgcatgcatgcgaagaattctcacaacgagtagtaaattaatcaaatattaacacgaaaggtactttataataactattactaaaccgtactaatattttgataaacatgaatcgataaattcttgtctaatcatctgccaaagaaacccaatattagagcgcagcctaattaaaatatttgtgttttgtttttttaccccagctgccattgatgaaccacacgatcaaaccgttgacgaggggtttataatctaatcaaacggtgtaaaaccggtgaaacacgcgtgtacatacaccatcccgcatttgataattttagattttaagtttaaaaaatcctgaggatgttgccttgaaagagtctctcattgacttgactctttcctataaatacacctttccactctctcttctccactgtcaaatcaaatccctcttcctcttcaattctctgtttcctccaaaatg

SEQ ID NO: 6681 - DNA, 3000 bp, Unknown
  misc_feature (1)..( 3000): cDNA_ID_3048768_gDNA_ID_1621100_Annot_ID_171361 3000 nt of promoter + ATG
gtttgaaagtgtgttaggggaccacctcagtatatcggatgaggaggttgtggaatttgttgtgccttacttaatgcaaaactgtatgtgaattttcatgagactataagattgacaaagtttatggactataaatccaaattcatttattgtttctgataaagatttttttaaatttctggtaatttttttaactttgtgtcattatacttagtaatttaaaatgtagaaagtaaaaatagctggtttaacagttaatctttctttggcctatttttacaaggacatacatgtatagaattttctgaaagttttcaaataatttgtttaacctttctttaaagtttcaagtcaatgccgacaaagaaaaaaaaacaaagaaaattatgccacagaagaaatttagatgagtaagatcagtagatacaaaacaccaaccaccaagtaataaattctcttccattttatgactaaagcacaaaaaattagataaatctgtatcaaacgtaaacttattgctttcttccttctggtagttccccaaaactcaaagtactctttttctgtgtaaacaaaaaaaaaatcaacggtactctttctcttctaagttgttgttccatggagaagagtttccagaaatcagctctccttgtgaccttgactctcttcttcttcattccagtttcaatctcggttccattcattctgtttcatggtgattaacaatctttcttcttcctcctctttccttttttttatcgactagcttatgtatattgcttgacatagggattagagatcaatgctccaatggtggagtgagcagcttcgtacagctccttagcaacctctctagctcccatggatcttgcttgtaccgaaccaactccttctttttcttgtttcactctgatcttgtaaaagggtttaattgttgtctcctcctttgttatgtctcatctttgtagagaaataggaaatggagagcaagattcggtgactatgccgcttacgcaacaagcgagtgtagcgtgtgagaaagttaaacagatgaaggatttgagtcaaggctacaacattgttgcacagtctcaaggaaacttggtagctagaggtctaatcgagttttgtgacaatgctcctccggtcttcaactatatatctttaggaggtcctcatgctggcatatccgacattcccaagtgtaatgtgagctctctttccattactattggactatgtgtcttaatcacaatcatgatcatgataacaacaacattggtgttctctgtttcaagtctacactttgcgagttgctgaaaacagcggtctacaccgacttcgtacaagtaaaccttttctcttcttcttctctaatcaagattcaaaacctttgagcattcattactactacccatcattagcaacatcactaatgactctacaggatcatattgctccaagtggttatatcaagattcctacagtacgtaaactcaaacccttttctttgtaatccttaaatcatttcctattagatttagatgaatacttcaactgagaaagcatgaaactggttttcaggatataaaagattacctggaacactccaagtatctgccaaagatcaacaacgagagacctaacgaaaggaacaccacttttaaagaccggttcactagcttgcacaacttggtccttgtcatggtgcctctctttcttaaaccacctaaatcttgagcaacattgttaagtagcttcattaatattgttttcttcatttcctaaacagtttgagggtgatgcagtagtgattcctaaagaaagttcttggttcggatattacccggatggagcttccacacctcttttgtctcctcaacaggtgaaaccttcttgatcatctccatgtcatttctttgcctgatcatcaaccacttgtttctaacttgatattggttatccagacaaagctctatactgaggattggattggtctgaaaacattggatgctgccagaaaagttaagtttgtcagtgtccctggcgagcacctaagaatagcgcaagacgacgttgtaaaacacgtcgtgccttacctcaagaaccagcctgcgtctatgagtgaagatttggagatactgcatctatgattgagacttcattgttatgctctcttagaatcaaatttaaaagtgaagaactttagaggctcctttttcttaatcataaatccaaataatttcatcatgtacattattcaccagacaaagctatacagataagagtggataggtctgaaagctggatgctgccggagaagtcaagtttacgagtatctcgggtgagttgtgaaacacgttgtctctacataatgcaagttggtccatgacctctttaatattggacccgatcactgtcatttttgtgacaggtattagggtcaaatcaattattatttccaaagaatgggagaacatatcaaacatatggaaaaacgttttgtaaaacattaatttctgtagagcctaccgtatttatattggcacaacaattcaccttttgtgtgtatataaaggatcgaaactaatccatacacctcacaactttccaagagaacttaataatacaaactcctctacctctagcatcgatctattactcttctcctttgaatttaacttctacaaaggtattatatctcctctgttagtaatttctatatcaaccatacaccatatacatacttctattagttaaaacgccattaaaagtttttttacacaagtaaaccgttcaataacttttgaaagtctttgccgagtgaagaattttagatcagtaaatatatttcatacatagttttcttccatctttgtattgattaaagaacaaaacattagataaatctgtaacatacgtaaacttcttgcgcacgtaattactctgttttgtgtttaagaaagaattaacggttctctcccactgagtagctccatg

SEQ ID NO: 6682 - DNA, 3000 bp, Unknown
  misc_feature (1)..( 3000): cDNA_ID_3048776_gDNA_ID_1621100_Annot_ID_171354 3000 nt of promoter + ATG
ggagggctacttcttcctcagacgggttagcaatggcatggagctgctgcgagtatctcttatcactcaaagcgtaagcatttcacactgagtttttcccactgttgaaaggtactttataagtaactgcatatgtactttttgtggctttcaactttcaggtacacagtatttgcaacccatatggacagtctcgcagagttagcaaccatctacccaaatgtcaaggttcttcatttttatgtagacatcagagataaccgcttagacttcaaggttctgtctgtcttcctttcgtatgagttcgagactttaggtactgctgctgaatgttacattgttctgatcagtttcaactgcgagatggaaccctacatgttccacattatggccttctattagctgaagtggcgggtctgcctagtacagtgatcgatacagctaggatcataaccaaaaggatcacagacaaagtattacccaaaacttaataaatatgctagcatattaagctctattgttctcatttcatgatgttgaacaggaaaataaaagaatagagctaaattgtgggaagcaccacgaaatacatcggatctaccgagttgctcaaaggttgatatgcttgaaatactctagacagacagaagactcaattcgtcaagcactccaaaatctgaatgaaagcttcactgaagaaagactctaaatagtttataacagaggacactaggatacattcacgttttaattgcaatgtctataagggttctacattactagtcccaagtgagctttcgatttgttggctttcagaggctaaaggtaggagcaaatctacactcttgatattaagtagggaaaaattaatcatcaaaaataagtaataactaagaaacattgctttatggtcagaatcaaagaactcaaaacttgaaacaaactcttgaatgtgaaagtcttccatcccaatgtaattccagaattccgaaacacaatccacactgaagatataccagttcgagaaaaaacaaaacataaaactgatcaccggtaacgacggagagagatactgttgttcttcttccaggttgccctgcgggaaggtctgttcttgtggttgttgtgaccctttccacgaagaccacgattcttctttccttcggaggtgagacctctgagttctctgtgcttgtgcacagggttgcagatccagttgatccttggatcatttcggacggcattgtgtgcagggtctacaaggataatctcgtagtacttgtaggtagagtcctgagaaaaccagagaaccaaaccattactcacttgattccatactattaacacatttacaggatggcatagcaactagtaactaaaaacagtgtgatgcatacctcattgagccagtaggagttaacaaccctaaggcctcccagtttgcgaccagcacgttcctcagcaacagatctcttactacgctggaatttgagctgtgtcactccctggttggtgggtttaccgtacacgatacccttaggcactggcctcttgcgtccaccacgtctgactcgaacacggtagacaacaaacccctaatacagagaataaagagaagtcagcaacacagagagtgaataactcatcaaacaaaagtacaatttttttgatccagggcttaaaaaaaatgtatcaatcttagacaggaacagagtccacaaaagataaagagctgttcagtcagaagaatgaatctatgtagctgggttcaggaagtattctatcataaagcgcagacataaatgactacgcatcaagacaccgcttaaccagcaatcaatcgataaggcttgattcaacaacattacctaaacctattaaattgataaccaaaatgaagagaagaagaaaaagacctgcttggccttgtagccgagacgacgagccttgtcgggacgagtgggacgaacaagacgaacaatggaaggctgctggcgatactcccaacacctaaccctctgaagaaacctcatcacatccgactgcttcttcctccatagctccgacacgtatttgtacgcacctgtaatcaaaaatcacatttcatccttaattaacttctagaatctaatgaacaatacagaaacgacatctgagagagagataatagtgagaaacatacccattgcgattttccggcgtcgcagtcacttctttcttcgaattaggtttgtgctttaaatagatggctccatgggaattagggtttccatcagacaaagaaagcccttattgggcctttttccgttagctttatgtattgggccttcgctacaacataaaacatctctaattgaactgtatggcccattataaatttatgtaaaaggagccaaaacgcaagagaattaggtgaagagtcttttggattcggttacgatagttctctattcctcttcaaaccctagagttcgtgtttctgcgatatccatcggtttctccttcatatatccatcaaacgccaaagattctctaattctctctcgagatcgtctgcaatttcaccgtgaatcatcagggataccgcggtggtttcgattctatttcctcgattcgaagcttggagagtttcagcttctgaattgaagccagtgattcaattgtttggagatatctgagcattgtccctgcgatgtattcgattcaatccaacacgggcgttctcgtttcgtttctgagctttgtgggaaattctcgttgatttgatttcgtcttgaagagcgcgtgagaggtttcttctgtcgaattttgttgaagtccaaccagagaagtaaagaatcatattttgtaattactttttgtttttgttttggaaatcaactttctggcctccatttttttggcctgggttaaggtttttttcaaagagagtagattctggtgtgttttaataaattagtaatacagattgtatttttattcattatcagattaattcca

SEQ ID NO: 6683 - DNA, 3000 bp, Unknown
  misc_feature (1)..( 3000): cDNA_ID_2123123_gDNA_ID_1621100_Annot_ID_171327 3000 nt of promoter + ATG
attgtaatggataaggagactaatatggacccttttagccatgtggaaatatgagcctcattcctagtatttccatttttattagcaggttcaatcaaattaatttcattcttcgtgttatataaactcagtgtccagtttcaggtgtatattgctatgacgaataccagttgaggttaaagagagcaggagaacatactgtgaatttcggaagtcggattttgtagacatccactagttccatcatcagatcaaataagtttgaaaatgcactgtctaggaccattccagcaattgaaggatcttctgctccatagagaaggctgcacattatattcccgcttcatcaaatgatggagagaacaagatgaaatgtggagagttgacacacttttcagatcatagacctttagaaagctggtgaatctatagtcaacacaactactaatactacttttaagtgtgactgaaaagtagctcaagaagtaacctggtaactgcacccatagatcgtccccaaagtccaatacgggatacttgattgctgtttctcaggtaagataccacagtcttgagatcatccttctagcttaagtttaagaagaaaaaatttagataaggaaaagacgaagaaccttgagaaagtaagacccgaaaacacacctcatgccagccaaggcttacataatcaccctcagataagcctgaccccgagaagtcaagggtgaaaacagttatgttagatgggaggagaaccataactgcctcatttgcatctgccctacatccactggtaagattccgaaacaaacggattaagttcttatttattcaactagtcataaacaagttcttagttcctaaaagagatgtgcaagtatctatgtacctattgccatgacagtatataacacaggggagaggagtatcctcccgagaagatgagggaacataatgactgcaacgcaaagtgtgacccctcgaatttgtaagctacgagagtacaaaaacatgagacctataaggttaacctcaagaggaaccagaatttgaagaggacaataagaaaacactaaatcattaggtgcccatacttgcctccaagtcttgtcttttacactttgtgccaccgaggctaaactccttctcccacaaatactgatcaggatcatactcagccctgtcaaaacacccccaacagctatcaattgaatgcaaaaaagttgagacttgaaagagctaaagagggtggagaagtacctaggaggtcgaattacaaagttgatgaactgatcaatcatcttaattccaagtaccagtgaactcatgagctagtagtagtcttctgaatcatgaaccatgtttctacagacattgcttagttttcttcagcaacaaagtcccgaacaaattacaagtgagacaacaaaaagcatcatgctttcgagagtcccatataatttctgagaaatgcgcagatcccaaagactaaagagagagaagaagaagaaatctcaatctcccagcttttgctgaaaagcaagtaaggccacccaaaactatacctactacaagcaaccagcagctgaaaacaaaagggataaataaaaaaagaaagcttttattaaagaaatgacagatgcccagatcttgaaaatgagtcaactaggaaaccgagtctgatgagaagaagaggaaaaaactattctcaaagccacgacttttgagaaagaaaatggaaaggtagaatcagattttcagatctcgaggtggtagatactcgagaaactaagaaacaaattatatatttcccttttgaaggttcgaactctggtctgtgtggtcattgcgctatcaagaaatctcgacctttttagttcattctgagtttgctgttcctttcttctccagctcactaggtggcctgatatagactgacctgtaaagcttaaaaatatctaaaaacataaacttttaacttttacgggtgaaatgtttaaattaaaataaatataatggttaacaacaaaaacatacaaatttaaagatcatccaatgatttttttttttttttacatacatccaatgaccatctaagtgcaaaatttatattattataattaaatattaattttttaaacataattaataagaaaaactttaataaaaaaaaaaaactaataagaaaaaccataaataaagtagtacaaaattattaaaaaacaaataaatatcatagtgatatgtttattattacttcatgcatttggttgatcaccaaaaactacatcaagtaatatgacaaactacaaaaaaaattgtgttttgaattcgtagatcttcaagatcgacaatatttttacaatacttatgttcatattttgtctttcttcagtttgaattgatactatgattttgatgatttttttttatatagatatatatatatgatctaagtatttgtcgcttatgtgattttcttttttcttgtgactagccgctatcgtctgcaaccgcaaatatttctagaaatgagattttgaaatttagcgatattgagtggtgcaaaataatttaaagtaaatttctaaatatgttttaaatgctaacaatcgcaatcgttcacaagtttgcgagttatagcggaaaaaccaatcaaaattcatgatatattatagcaacttcacataattcgtctattcaattaaattcgatcacctatttgtatataattttggttgattcagattttagttggttataatttaaaaaacttcatattttaagaaactttttgtatatgtttaactagaaatgatatattttagtaatttcggttagttcgattaatcaaaaattaggctgcgtaaatccgatttatctaattggtttatatggtataggaatttctccaccggttaaattatttttgaaacttaattaaattttggtttagttcagttactgattagttttttctttttaataataaagtttatg

SEQ ID NO: 6684 - DNA, 3000 bp, Unknown
  misc_feature (1)..( 3000): cDNA_ID_1815247_gDNA_ID_1621100_Annot_ID_55841 3000 nt of promoter + ATG
cttgctcgctcaagaagttagtgaaagctgtaaacgaggcattggtctatgtcaacaagttcgaagaggtcttagacatcgaaggagagttagctaacagcaggaaagctgcagaagttgtttggttaggagttgatctctaccataaatggctcaacgtggatcttcgaaaactatccaagcaacatagcaaaacaccacaggaagttcttaaagagctggtagatatagcacaaaaagagtttacagagtcatgggagaaaaatcggatactatgcatgaagcataagccctcgcactggcccatcaagactcaagcagcaaactcaatgtaccgaatcagccaaacccttttgatgaagtacgaattcaagaaacatttgaaacagaggagactctgttgaaagatgtggaaaagatggtatcggacatagtatcaggatgcttttgcaacacggcacaagttattggaatgaagtgtttggttacagcagtggaagtgagggaagcgtcggtgagagaagcggcaatgcatttggggagaacagagaagatacttgagatcgtagacaggagatgcatgcctgctttgtctcatcacaaagtggcaaagattgatgaatggagagagttttataggaccaataaatccatcactttcactcatccttcgtcccagtgtacgacccgtgaactcattatcacctagaataacacattttcttgtcacatttaaagaattaattacgttttgtacatgataaaccctaattagcaaataaaatcctttctttgtcggttgatctaactattaacacttgatgccaagtctaaagagtttattagtttttaaaacccagtttaccaataataagtttcctttgtcggttgatgcactagtcaaactatcaaagtcgtcaagtttgctttgttgacaaggcaaagctactcttccaaaacattgatccattcttctggaaatttgcaataacgtctcaagaccaatgcaagtaataatttaaccatgccatgttatcaacaaaagctgcttctctgatttctagagtattattttttaaccattattgaagtttgaagatttcttattattgctaaatggtaaaaccatcttgaggggaacaatttgataaaactgtgtgctgcttcctgtctccgaccaaaacatgtttaaaattagattcggaccaaacaagttgtcaatttttagtacaaatcaaaggttcaaatgtcaataaataatcattacattttaaaatttcgaaataaaaggacaaacatgtaaaaaccaaaaaagtgaagcactgatatttgtcatttctgcctataaaatgtacacttcccactcacacggtcacagaaaccaaattcgaagaagaaacagagaatcatcaaatcaaatccctaaaaattgatttttgaaatggagaagaacgcatcgacttcgtcgttgaaggacttgggtccgagtggtctagatctaaccagcgcctttttcaaaccgatccacaactccgatccttctctcccttcaaaccgacgtaccaaagtctccgtcgtcggagtcggaaacgtcggaatggccatagctcaaaccatcctcactcaagatctcgcagacgagatcgctctcgttgacgccaaacccgataagcttcgtggcgaaatgcttgatctccaacacgccgctgctttcctccctcgaactaagatcaccgcttctgttgattacgaagtcaccgctggatctgatctttgtatcgtcactgctggtgctagacagaatccaggcgagtctagactcaatttgcttcagaggaacgtcgctctcttccgtcatatcattcctccactcgctaaagcttctcctgattctatattgatcattgtttctaatcccgttgatgttttgacttacgttgcttggaaactctctggctttccggtgaatcgggtgcttggatctggtactaatctcgattcttctcggttccgattcttaatcgcagatcatctcgacgttaatgctcaggatgtacaggtcagttccaaccaaaattagggatttttgttataaagctgtgatttgttttggttaaacattgcgattaaggagtcattagctggatttaatggtttagtatgataaaaatctatgctttagtggttttatactgtattgttgagaagatcaattgaagagcaaaagtgtgtttggattggttgttgtaggcatttattgtgggagagcatggagacagctcagtggcattgtggtcaagcattagtgttggaggcattcctgtcttaagctttttggagaagaaccagatagcttacgagaaacaaactcttgaggatatccaccaagctgttgttggtagcgcctatgaagtgattggactcaagggttacacttcttgggccattggctactcagttgctaatctggctcgtactatcctccgtgaccagcgcaagatccacccggttactgttcttgctcgtggattttatggtgttgatggtggtgatgttttcctcagtcttccggctttgcttggaaggaatggtgtggttgctgtgaccaatgtgcatatgactgatgaagaggctgagaagctgcagaaatcggcaaagactatattggagatgcagagccaattgggactttgaatatccacatctatatatgcatcaatttcaattttataactagtatcccacgggtgatagtgtcgatgttgatcactatatgttatgtaaatgcttgttcatgcagagtaatcccaactttgagttctattttgaaatagggtatttgcttacaacacacttgagttaccacttaccagtaatgtgaaaatgcgtggttttggcatgaaattattgtgcatattgcaaggcaatcgacacaaacattagtatatcaaaaaatatgatgtgtagaaaaaaagaaaagaaataaatttcttttaaaaa

SEQ ID NO: 6685 - DNA, 3000 bp, Unknown; identical to SEQ ID NO: 6666
  misc_feature (1)..( 3000): cDNA_ID_1815228_gDNA_ID_1621100_Annot_ID_55847 3000 nt of promoter + ATG

SEQ ID NO: 6686 - DNA, 3000 bp, Unknown; identical to SEQ ID NO: 6665
  misc_feature (1)..( 3000): cDNA_ID_1815216_gDNA_ID_1621100_Annot_ID_55851 3000 nt of promoter + ATG

SEQ ID NO: 6687 - DNA, 3000 bp, Unknown
  misc_feature (1)..( 3000): cDNA_ID_1815209_gDNA_ID_1621100_Annot_ID_55853 3000 nt of promoter + ATG
gaggtttcttcttcttcctttttcctgctgaagagcaaaagtatgcattattactttactgatgatactaatcgccaaacatcaatgtatattatataatgtgtaaaaggtgatgctttctcttctttaaatgcataagtttctcgtgctaatgggacaatagccagtgattaccttgctccccagaagcaacctgctgcggcatttcttccttggggggctgcgtattcagttgtgaaactgctgcttccttgccatttgaggatccttgaatgtttgcagatgcatcaactggcttttccactttaactatttctgcagacgcccaagcacttgtgatctctgctatttctattgacggctttagagttgaagtctcattgttgttactaggagctggtttcttttcgcctccagatgcagcagatgtagtaggagatagagccttgggaggtggacaccgtacagactccatatctagatttaatactcattagtttaccaatgatggtacacacaaatataaaagactgcgaatgagagtatgaaataccttggacttgacacatgctgccagcgttctcagcactactgttaccagactccaatatccggtttatagtatcccttagggttttgttaggtagaagatcatcagctaggacatgagttgctccacaaacacacattgactttgcaatgatgtgatctctaatacctgaattgtagataatgattacataaaaaggcgtttgtggaacagcaaaaggaatcagaagtattggcaatttgacaagagaactaacacttgtcacagtagctcttgaggcagcatttgcttgccagtgcagcatctctcatcacttctttacacaatgggcattttaattcaggaggaaattccccgactgatcgtgttgttgatgtcaatccctccatttccttctcaaacgcatccctaaatttgtcaattgacataagtgatcaacattactaataatttatgtgaaggtactaacaaacaactcgccatgttaatttagtgacaacgtactcgtttggttttaaaactgctactgcgccacttggcaaggagtaagagccatttggggttgccatcagcatcgacttggggataccagtaggtggtttaactctcttaacatcaaagttaggattaccgtttgtggagcagtgttgaataaaatgtcctgagacagaaaatgatgttcagaacattcatttctcggtaataaccgtacacactcgagacattacttaaccaaattaaaaatatataaagattctctaagtcagtcataccagaaacattgcaccgatggcaaacatagcctggtggcggtgttgtcctctccattcctactcaaacaaatacaatcagtctctatatcttacatttcaatgaaagagcaaacaaaatatttggacaataataattaacagaacatccgagtctcaaagctaaatacttggggagactgaagcatataagtcaatcatatacaggaatataattaccaaaaccgcggccacccatccttccagccatacccctcccataacctctacccgggccaaaactatctgcaccttgtctgtaacatgaaagaaaaatacgaatgttatgcaaaatgtatgtcaagatctcatttagcatgctaatgtccatcagttcaagaagattacttactgatgccagtctagtgctggagtgtcaattaatgcctttagcttggtttcttcatcatcagctggtgcagaatcatgacataggttattagaatggactgctggggcatcaggaattgaatacaaatcattcccaaactcatcgaattcatcttcaacctataaggtagattaagttgtaaatcaatatttgtgtagaaggattccatgccaataaaaactgagaaagccaactcacgggagatgcatcagcagtaataacattgttcatatcagcttgaacgttttccactttatcctcgactctcggcctgcaaaatgtagtcatttacatcatgacacatgggaatctggtataatttcacacaactaataatgaaatgcgcagcttagagcgaaagaacacaaagattgaacaactcagttgagaaattaggtattaaagttatagagaaattactcttctctggtaataattctgatgcgagggcgtccagggacccggcgaattagcacagaagtattttttggtattaacattgcttcatccagatattctgaaattgcaaaaaaaaaaataagtatgaaggccaccacatattgcaactataccaacagagaatcgtagttaagggtttctttctaatgattcacaaccacaaccaatcaagaacagtagtctcagaagtaatcacatttaacatataagctaatacagtacgcaagaacttcacttttattttttttattcaactaacaaggaagtaccaggtacataacatccattttactgaagcagttagatactgaacaatccatggccagattaacagtgctaaatgtgattacttcggaagaaagccataaaccatggaaattttgacaaagcaagtaataaccatatattttgataagtgaatactgatcacaatcagaccagaatccaacctagataacaacaaaacacattgcacaatatcttctaggtgaataggataagaaggaggaagacaaaccttcattagtttgggcattagagatgacaatgtcaaggtctttaccacttcccaaatgcttagtttcgtaaattttttctttgagtaaaccaactgttataaaaggaccatccatggagatggtatcataatccctcgcactcttaaacttgtaatatattgccattggaattaatctgataatgaataaaaatacaatctgtattactaatttattaaaacacaccagaatctactctctttgaaaaaaaccttaacccaggccaaaaaaatg

SEQ ID NO: 6688 - DNA, 3000 bp, Unknown
  misc_feature (1)..( 3000): cDNA_ID_2123194_gDNA_ID_1621100_Annot_ID_55855 3000 nt of promoter + ATG
gagtcttttggattcggttacgatagttctctattcctcttcaaaccctagagttcgtgtttctgcgatatccatcggtttctccttcatatatccatcaaacgccaaagattctctaattctctctcgagatcgtctgcaatttcaccgtgaatcatcagggataccgcggtggtttcgattctatttcctcgattcgaagcttggagagtttcagcttctgaattgaagccagtgattcaattgtttggagatatctgagcattgtccctgcgatgtattcgattcaatccaacacgggcgttctcgtttcgtttctgagctttgtgggaaattctcgttgatttgatttcgtcttgaagagcgcgtgagaggtttcttctgtcgaattttgttgaagtccaaccagagaagtaaagaatcatattttgtaattactttttgtttttgttttggaaatcaactttctggcctccatttttttggcctgggttaaggtttttttcaaagagagtagattctggtgtgttttaataaattagtaatacagattgtatttttattcattatcagattaattccaatggcaatatattacaagtttaagagtgcgagggattatgataccatctccatggatggtccttttataacagttggtttactcaaagaaaaaatttacgaaactaagcatttgggaagtggtaaagaccttgacattgtcatctctaatgcccaaactaatgaaggtttgtcttcctccttcttatcctattcacctagaagatattgtgcaatgtgttttgttgttatctaggttggattctggtctgattgtgatcagtattcacttatcaaaatatatggttattacttgctttgtcaaaatttccatggtttatggctttcttccgaagtaatcacatttagcactgttaatctggccatggattgttcagtatctaactgcttcagtaaaatggatgttatgtacctggtacttccttgttagttgaataaaaaaaataaaagtgaagttcttgcgtactgtattagcttatatgttaaatgtgattacttctgagactactgttcttgattggttgtggttgtgaatcattagaaagaaacccttaactacgattctctgttggtatagttgcaatatgtggtggccttcatacttatttttttttttgcaatttcagaatatctggatgaagcaatgttaataccaaaaaatacttctgtgctaattcgccgggtccctggacgccctcgcatcagaattattaccagagaagagtaatttctctataactttaatacctaatttctcaactgagttgttcaatctttgtgttctttcgctctaagctgcgcatttcattattagttgtgtgaaattataccagattcccatgtgtcatgatgtaaatgactacattttgcaggccgagagtcgaggataaagtggaaaacgttcaagctgatatgaacaatgttattactgctgatgcatctcccgtgagttggctttctcagtttttattggcatggaatccttctacacaaatattgatttacaacttaatctaccttataggttgaagatgaattcgatgagtttgggaatgatttgtattcaattcctgatgccccagcagtccattctaataacctatgtcatgattctgcaccagctgatgatgaagaaaccaagctaaaggcattaattgacactccagcactagactggcatcagtaagtaatcttcttgaactgatggacattagcatgctaaatgagatcttgacatacattttgcataacattcgtatttttctttcatgttacagacaaggtgcagatagttttggcccgggtagaggttatgggaggggtatggctggaaggatgggtggccgcggttttggtaattatattcctgtatatgattgacttatatgcttcagtctccccaagtatttagctttgagactcggatgttctgttaattattattgtccaaatattttgtttgctctttcattgaaatgtaagatatagagactgattgtatttgtttgagtaggaatggagaggacaacaccgccaccaggctatgtttgccatcggtgcaatgtttctggtatgactgacttagagaatctttatatatttttaatttggttaagtaatgtctcgagtgtgtacggttattaccgagaaatgaatgttctgaacatcattttctgtctcaggacattttattcaacactgctccacaaacggtaatcctaactttgatgttaagagagttaaaccacctactggtatccccaagtcgatgctgatggcaaccccaaatggctcttactccttgccaagtggcgcagtagcagttttaaaaccaaacgagtacgttgtcactaaattaacatggcgagttgtttgttagtaccttcacataaattattagtaatgttgatcacttatgtcaattgacaaatttagggatgcgtttgagaaggaaatggagggattgacatcaacaacacgatcagtcggggaatttcctcctgaattaaaatgcccattgtgtaaagaagtgatgagagatgctgcactggcaagcaaatgctgcctcaagagctactgtgacaagtgttagttctcttgtcaaattgccaatacttctgattccttttgctgttccacaaacgcctttttatgtaatcattatctacaattcaggtattagagatcacatcattgcaaagtcaatgtgtgtttgtggagcaactcatgtcctagctgatgatcttctacctaacaaaaccctaagggatactataaaccggatattggagtctggtaacagtagtgctgagaacgctggcagcatgtgtcaagtccaaggtatttcatactctcattcgcagtcttttatatttgtgtgtaccatcattggtaaactaatgagtattaaatctagat

SEQ ID NO: 6689 - DNA, 3000 bp, Unknown
  misc_feature (1)..( 3000): cDNA_ID_1815197_gDNA_ID_1621100_Annot_ID_55856 3000 nt of promoter + ATG
aaaaaaagaacccgtaaaaagcttaaaagactacaactgcttaagtctatcaatgatgatcaatatattcatgtaagtgctaaataggttaatttctctagtgaattcgattttggactaaaaatcaacaaatattagatcatctagtgaattcgatttctctaggccatcaaagaatattattagttaggtccaaagacctaaatttatttttgtgtataaatttaataaaatagaaatttacattttgatatttttaatattattttggtgacaaaatatttagaaattttttatatttttaaatattcttttattttcatatattttttattttattttacaaaaatttaaaaagaataaaaataaaaataagttcataaatattaattagcaagatatctaatctccattgcttgtttaaaatgttatgtggacgcgcaaatagcttcgtatagattatgttacaaaaagatttctaaaattaactatgtttaagttcgtattattttagttaaggcccatcagagaatattagttaggcccaaaacagtgacactcaccgttttggcatcttctacacatgagcaaaactagacgcaacgcaatgatggcgactaaaacctcagagcaaaaaacatgaacaacttcttcaatcccagtagaccaagcccacgtccatggccaaacaggaagaagcaaaccgacaaatctgcgatatttctttgctccgtttctatacttgttgtgttcttcatcgtcgtcttcttcatcacttactccgagatgcccaagtccttgttctcaatctctgcattttctggatccgttcaattccctcagtgcagatccgagatactaacccgaactcttctaggtcagaagtttctctggtacgctcctcacagtggattcagtaatcagctatcggaatttaagaatgcgcttcttatggcgggaattcttaatcggaccctaattattcctccgattctggatcatcacgccgttgctctcggtagttgtcctaaatttagggttttgagtcccagcgagatacgaatctcagtttggaatcattcaattgagcttcttaagactgacaggtacaaaatctcttttttttttcgtaatgagttttagtaatttgatcaatgtgggtgacaaatgttggtgtttataggtacgtttcgatggctgatattgtagacatttcgtcgctggtatcttcttcggctgttcgagtcattgattttaggtactttgcatcactacagtgtggtgttgacttggagactctatgcactgatgatttagctgaacagtctcaggcttatgagtcactgaaacagtgtggctatttgttatctggagttcgtggtaatgtagataaatgtttgtatgctgtggatgaagattgtagaaccactgtttggacttataaaaatggagaagctgatgggagattagattcgttccagcctgatgagaagctcaagaagaaaaagaaattgtccaacgtgagaaggcgaagagatgtgtataagactcttggacatggtacagaagctgagtctgcagctattctagcatttgggagcctcttcacagctccatacaaaggctcagagctgtatatcgatatccataaatctccaaagataaaatctttggttgagaaggtcgatttccttccttttgttcgagagataatgatcgcgggaaagaaatttgcttcagaaaccataaaggcgccgtttctttgtgcacaacttagattactagatggccagttcaagaatcatcgggagagcacttttacgggtttatatcagaagttggaagctttgagcgttaagaatcctggtctaattaatgtgtttgtaatgacagaccttcctgaatttaactggaccggaacttacttgggtgatttgtctaagaactctacaaatttcaagctccactttataggggaacaagatgaattcttagcgcgaacagagcatgaacttgattcagcgagtcacggccagaaatttgggtctattccgatgagtcttgatagtataaaaaagatgcagacccattgttaccctcatggaggatccaatgtgcagctttacatagaggaagctgtttgtagctgtgcttcactgggttttgttggtactccagggtctacaatagctgatagtgtagagatgatgaggaaatacaatgcgtgtagtagtagttgaactcagactgcatttctattggattcatctggtggatgagccaatgtgtagtgattttattaagttttgccggtctttgtatagagatggatagagatagatgatagatctgtcatctgtctccacttgaagttattggtgatgaaaacaggctcttaaattgttttgtgttgttaagttatttgggaaactatctaagtttcttattaatagatgaagctacttggttcctttctgattattcacacacaacaatggaagagtaaaggttgcgtgggatggttgcttagtaaaggttttgtgagttctgtagatgtctctagtggtcgacaagatttgtaattgttgtaccaatgtctttaaaccggctattgaataagaaattttgtaccaaataaatctagtgaaagagggttggttgagaagaaatgtaattatattaaaccggaaatgaaattttacgtcgatgtgtattttgtgaccaatgagatctctccacgtaaacagattccacgtgcagcttcaggccgatttaagcgaatttaatctgtcgttttgttgggttcccgtcggtgacatccaccgcgaacatttcgaccggagttttgagagagctcagagtgtttcgagtgtgttatttggatctgcgatctgatcgtctcgcatcgacgtgaaaggttttctaatccaattggttctgtggaaatttggattcggaggtttttgtttggaagatctttctgcggttttcaccgccatg

SEQ ID NO: 6690 - DNA, 3000 bp, Unknown
  misc_feature (1)..( 3000): cDNA_ID_1815193_gDNA_ID_1621100_Annot_ID_55857 3000 nt of promoter + ATG
aaaagaaagagaagtcgtaactggtggtattctagggccttttggatttgaaatcatgaatattagcccatttagcttattgtggtttaggtactccattctcacattaggacttcaagccttaagatgcaatcacatgaatatgaactgtgagccattttctttatgcaggttgttgttaagtgggtatgcagattttttaaaaaatacagtcatacagaggaaacaactgtgtgattaataaaccagcgtaaaagcaaaaactacactcttagtttcacatttttggaataattagaaacattaatgcagaactgtaactatttttagccgtcttctcaaagttatctgcaggtttttaatttgcttttattctcttagaaaccttattgtacttaaaaaaacttatatggatcttaatacactttctaactatgtgtgttaataagagttatatatggtttaataaatcattgtctgtgctaataagagttataaatggtttcaaaaaaccctttttaaacatagattatgttgttttcctctgccattaaacttagacgcatcttaattactaactcaaaaacaaacccctctcgctctctctctttatatatatctataattatatgaccttaccgatatttacttatagtttagttactactaagtttgatatgagacaagaacatgtctcttgagatatcttcttcctagcttctactgtgatgtatctggattctcgatcaccagcatacctatctaccctgcaacaaagcagaaacaaaatccaactacttaagcacaaacctcaacaagatcaagcaatgtaatatcataacaacgttaccatatatccatgaaaatgataagtttcaattagggagatgacttcacctttttccttcaccaaaagactcctttgcatcgatcatcactgcaaatggaatacaatcgctgttacgggttttgtatcattaaagcagcagtaccattaggttacgtaaagctaacatagaatgaaacttcataaaatctgtaatagcacctaaaggtctagactttcatccatttcatactatctacagatcaatgtagctaaagggcaggttgatccaagctttcatcgagcaagtaagtggactgatcaaagctaaccttagccggagaagtggctactctgaagcaatcagcattcatcccaacgagacccaatccagggaaaatgacctacaatggcagacattgaattgcctaagaaaatggagacactaaaaaaacgtagtcattgttttgaattctctgtgaggcaattcgtcgaacacctggtgacttacatcgagatgtttctgcatagcttttgccctcttccttggccggcgagatgacctgttcccactcatgctgaacaaatcttcttcgatctcgtctcgagctagagcaacccaaagcctatgattctcgtttgcaacctcaccaccgcctaatccgggtgattccgccgggattcctctctgcctgttcgatttcggctcaattcctgcgcctgatttctgattcttcacctccgaacctcctcctccgccgccaccgcaaacctccgccgtgaacacgccgtttcctttcttcgaaccaccataagccttcctcggacgaagattccacgtcctcttcgcttcctcctcctccgtttcttctctctccttcaccgacaccggcacttcctctctcgcgggagaaatctcatcggatttcagcttcttcaggttatcgtgctctgatgagggagcaaaggaggagaaagagagacgcggctgacgacttgaccgtgacgccacgacacggttagaaacagccaccgtctccgccgattgagaagcagacctctccgacttggaattcgcagacattggtatgagattataccaaaacgtattcacctgagagatgatcaaaaaccctagaaggtaaaaagcagagaggagagagagagatgtaggagatttacggaagctgatgcatgcgtaagtttctaattatgtttttattcatggggtgttattggtttatgatttcaaaagacttttagtgttttaaagtgttatttagaatttattgttattcgatcacgatttgttaaaagtatgttatattttgttggctaaaataaatcattagttaattattttatatcctgatatatcaacatcaattatcatccttctgatatggggattaatatatgttaacaataaatccagaaaattacgtttagatttagacatataaataaagagatcttaaagaaaagaagagaaaaaaaagaacccgtaaaaagcttaaaagactacaactgcttaagtctatcaatgatgatcaatatattcatgtaagtgctaaataggttaatttctctagtgaattcgattttggactaaaaatcaacaaatattagatcatctagtgaattcgatttctctaggccatcaaagaatattattagttaggtccaaagacctaaatttatttttgtgtataaatttaataaaatagaaatttacattttgatatttttaatattattttggtgacaaaatatttagaaattttttatatttttaaatattcttttattttcatatattttttattttattttacaaaaatttaaaaagaataaaaataaaaataagttcataaatattaattagcaagatatctaatctccattgcttgtttaaaatgttatgtggacgcgcaaatagcttcgtatagattatgttacaaaaagatttctaaaattaactatgtttaagttcgtattattttagttaaggcccatcagagaatattagttaggcccaaaacagtgacactcaccgttttggcatcttctacacatgagcaaaactagacgcaacgcaatgatggcgactaaaacctcagagcaaaaaacatgaacaacttcttcaatcccagtagaccaagcccacgtccatg

SEQ ID NO: 6691 - DNA, 3000 bp, Unknown
  misc_feature (1)..( 3000): cDNA_ID_1815189_gDNA_ID_1621100_Annot_ID_55859 3000 nt of promoter + ATG
gaggttccacgtgaggaagatctatctagagtgatgtcaaggtcatctccgcaaccaccaccggaggtaccttctctttcagtactcctcctctttccactcactgtgctcgagatcgtactgtttggagacgaaactcctgtctcctcttccaaatccaccgttgttggcaagctgttcacgtcgattttcctaagaaactgttgcttttgttgatctgaaaaatgaaaaagggttatttcaggatctgtgttgtttccttgtggaaaaaggttatcaagactttgttgaagaagaagcttacctgaggaagaaacaagggtttggttccatggaaacatctggagattggacattggtgaagaagtgggtttaagatttagctggagaggatggttttgtgcaaatcccaagctaagacttaaacccaaatcctctttacccatcatcatgatattgtctcttggtagaaaatgagaatagcaaaagctttgatctttatgagtagagatgactagaaaaaccttgatctaaagctgattttacctcaaaagatttatcagttgtgctaagtgtatggaggacaagagaaaccttcttctagggttcttatagagagagagagatgtgaaatgggaaatgaaaagagaaagagaggattaatataggaagtgaatgatatgagatgttgtcaggttggccaattataatctattaatgcccttttgaaactcaattattatatccccaacttgttccctctttgtcttctcctttctcttttttttttttctttatcttttccttcttcttcttttactattttagtaaattgtatagtaagtcctatcttttgctatctttttccataacctcaaagtacttctatatatgtatggaatccaaagtaaatttaaaatgcaaattcatattttccatctctactttatttcttgcaaatttggactaggaaaagagaaactctataatatgcggtgcaaatccattatgacatttatttagcgacaataagtacatcaaattatatgcctaatcaactaaataatgattctaagttttaattatataccttcacatatatatgaagtgactcatgttatgtcttgcatatattagatataagcagccttagcttctgatttaatagtatccgaggaattttattattgcgccaatttgatatcatttcgagatatatagacattagttctttattaaaaaaaaaattaatagaattattattaagagttgtaacttgctaatctttttgaccatgtcaaaaaaaaaaaataaagatgttattggatgagcttactagagtgaattttatttagtatttacggtaagttgaataattgccaatctaatagttatgctacaaaatatttactctactgtaaagaaataaacgtgaacatctttagttttttactccacctaaaagtggtagtaaatatttcagttcattttctcttttcatttttatttaaccctcaaatttttccaatcattggtgcaagaacttgtgacctttgtaaagaaaaaaaaaacaactcaatcagtcaagatcacacacggatgagaacagatatcgaagaaatagttggcaattaattgttgaaataatgaagaaaaaaaaaggactaaatcaagtggttggtacaaaacacaatccacatgaatctgagctcattcaaagttgtgggccagtcacctgttgtgatccaatcatatccatgtgggatgtgggatctatcattacactaacacccatatgtattacatatgaatccaatattcactgactgtttctctattttcatttcatgttcttaaactttcaactattatagatcatcatacttcccttatcatcaattttgtagaatttttaagtattcagatcgtgttctataatcagatatattctgagtgctgctaatcagaatcattttgctttattgttgacaaaaaaaaaaaagaagaagtaaattaaaactgccgaaagatgattaaaaaatgtctcaaatagttttgggctcaagagagaacatgggcaggtgggtcatgtcacgtgacaacaagggacccgaaaacactcgacccggccgtgcgttttattttgtttcctcacgcgccgacatcttatcattgcctaccacgcgccttcatcattttcgcttcgttgtaatcattatacgcatgatttcaaatgaaataactccttctcattaatgatctaactgtactcgaaattaaaaatagttaaacatagtacattcgaattatatgccgtatataatgaactaataattcatctttctagtaagtattttttttttcaaactagtagtgtattatgcgttctaaacgaaaacatgaaatatctatttagaagctctatttgaaaatgttaatggatttgaatactcacgacaaaacgaaccaaaaaattgttattgaatatatatatttctacttcgttttttgattagaagaaattcgagacccaaaagctcgtagatcccccttaggttgagacgagaaattcaagacccctattagcttatatatatttagtctatacttgtatataatagcagtgattaagggttcggtatagtcccggtttattcatctaattaaggtgaatctctggtttattattggtttagttggtttgttgtctatacaacattgtaacaaactttcaagattattaatgagaaattgagctttcaccatgttttctctctcgagcatggttcctattatggtatcagagcaatttctgctcttacttctctgatttctcatcgatttctcattgctttcttcgtttttcttcgttttccaccgttaaagtgttgaatcgatcccggatttgtgttgttttgagctcaagctgaccagaatcaccttctgaagcttcgattcaagttccgataacacatttgagcttcgatctctctatccatg

SEQ ID NO: 6692 - DNA, 3000 bp, Unknown
  misc_feature (1)..( 3000): cDNA_ID_1815182_gDNA_ID_1621100_Annot_ID_55862 3000 nt of promoter + ATG
tcatttctcatttgtgacttcatttttgaaatatctataaatttgtaatcaataattacaattaataaattagtttggcggaaaaagctctaatcttataatatgggaatcacgtatatatattacaatttccatatttttgcatggtaatatctatgactcttttccttcttttttttttctttctttaaaacaaaaatgctatggttctttttgcatggtaaaagctttccattttgatttttataccatcgcctatacgtcgatccttaagagtttctctcatccaatcttagacttttataccacaaatcaacttttccctatataccactgcttacgttaagtcattaatacagctaatagattatttagataactttaataatctcttgtgtgtaaaactgaattttggttctttgtttatctttttagaaatccgaatcatatctatatttacggatgtgaacaccataattctcaaatggtatcgcttctttcagtgaaaccaaatacgaggcttcaaataaattttattattcagtatatataaaaaaattaaaatgaacaaatcaactaacaaaaaatttgagagaaagtatattgaatatatttttttaaagtaaaggggggtaaattgaatattgaagtgtaataatcaatgaaaattatattagtacatacgtgttaaatatgtaaatacatatatgattttttttttgccaactaatatttagctttgacttttatttgttttgttcattacttatatgcttaagttttaaccaaaaaaaaaaagcaaatcttcaaagaaaaaaactccgtgtataaacttttctcgatcatttttgcagtctctctcccaaccaatcccattctgctcgactctcatgtaagctccgtttccttcgtcttcctcgtctctctcgatctctcttgctcgattgttgtacatgaaaacgcacgcgcccaatttcaattatgtttcgtggctttcctgatttgaaattcgagcgattggatagatttttcttttagaggattagatttttgattgtatgtgtaattgctactgtgtgaatcgaatccttggatctgttctcgttagtcgccaaagaagaagttgtatacatgtttgattgtttatgttcgaattgcttgaattccaattattttgatctaagttatggaacatttgattgttacttttggtgtttatatgatgaatatgaccatcagttttttttttttttagtgttgcagaggtttaggaagaaaggaatggttcgatcgtgactttgaattgggatattgtgtgtaaaatgtgggtgcctacattgagctcaagctcatgttcaagtgatgagagggatgagagcagtggagaagccgcgcttacgccggtttatctcaatgtctatgatctaacgcctgtcaacaattacctttattggtttgggattggcattttccattctggtattgagggtatgtttcttctctttctctttaagattcttgattgagatcacgaaaggagaaacctttctatgagtctgtatatctgtaaactcaagagaacattgtctacttagtatgcttttgagaaggggattgtttctggatatagaaaaatagctgtcttaatgatttggtggcaatactaggctcttttgagaaggggattgtttgtggatatagatgtaggaccaagaaaagtgttaaacgctgaggattatttagtggaaactttctatgatcctttaataacttagattttacctgttattttagttattattcattgctctctttgacacagttgttcaacttcaatgtagctcataatttggaatattgctatggagctcacgagtatccaacaagtggggtatatgaggtggaacctaggaactgtccagggttcatctttagacggtcggttttactgggaactaccagcatgtcccgttcagatttccgctcatacatggagaagctttcaagaaagtaccatggtgacacttaccatttgattgccaagaactgtaaccatttcactgaagaagtatgcttgcagctaacaggaaagcctattccaggatggattaatcggctggcccgagtaggtaaaagatataataaacctttctctgtgttaagttacaaacaaattgtgtcctaaatatttactcatggtctgtttgagtttcaggttccttctgtaattgtcttctgccagaaagcattcagcttacagctgttagtgctcttcccgaacgccttgaattctccggtaagctcctaactaagagaatgttataaccaaaaaaaccccaactcctttgtgatcaaaacaaatcatgaatggcttcgtattttccttatgtagatgaggatgaatcaaactcagaggcatcttctgtgtcagatgaagaaggatcagagcagcatctcataaatgtagcagacagagagattgtgtatctacaaaacaaaccagtgcgacttaccagagaggagatcccctgagaaaccaaccagcgacgacaatgtacttcctcctgaatcaacccaaccaatcatcaaaacttgcagagtgtggtgtgcccatggaagctgaaagggagtaagttatatatctcgttttgtcaccttagtgctgcgttggttctgtcggaaattcgatttggtattcttctcatcattttaggaatgtaaaaacggattcccggattcattttaatcagacaaccctttggcagtaaaaatctaaagatttctccatattttccatatctagttaccccggttctacccataaggccataaccatatcgaaagagctatcaagctgtttatcgtttgtaataaattttaaaaacaaatcgtaattaaagttattaaaagaaagaaaccacaaatcagttactagggcaaaaaaaccccaatttgtttctcaaattttccccaaaccatatagggtttgcactgagaatg

SEQ ID NO: 6693 - DNA, 3000 bp, Unknown; identical to SEQ ID NO: 6680
  misc_feature (1)..( 3000): cDNA_ID_1808465_gDNA_ID_1621100_Annot_ID_55863 3000 nt of promoter + ATG

SEQ ID NO: 6694 - DNA, 3000 bp, Unknown
  misc_feature (1)..( 3000): cDNA_ID_1976982_gDNA_ID_1621100_Annot_ID_55865 3000 nt of promoter + ATG
agcttgagaaggaggaggcggcttagtcggcatcttaccagacttagcagtctgaaccggagccacaaccttcaatggcttagacgcaacaatctggctgggatcctctgcgtcatcgtccaagagatcgaaagggttcacagacgccattgtttttccggtccgactgaatcgaaagagaaactggtccggagattattttgatggggtttttgttttgaatattgaaaaaacttattggctatacgaatccatgaagaaaaatcagaatcgaaatatgattcagacagcgtttgttagaagccaagtacttaacagaactgagggttagagagagaagaagataatatactaaaaagtaaaaaccctagaaatccttaaaaaaaactaatcttgaattattgggccgggcccgttagtcatatttactctgatgtcgtttgtgatggcaaaatcataaaatgaattgtaaattggtgaattattccaaaaggttttccattctaaatcctacgaaaaaagatatacagtatagtattatggggatcaattgatctctataaaattaaaaaaatcaactatattttcttaagaataatcatgatgactaagtattttatattgttttgactccatacatagttaatttaaactacataggataaaaattatccacatacattgaaacaaaaatattaatcttatataatgtataaaaattatttcattttggttgactttcatgtaaatatttcatttttttatgggaagattatttctaagcaaaattaagaatatttttaatatctataatgtatattattttatatattaaagaaaacttttgacccctacaacaacaatttctagatatgctactggatacgtctcttcattttaaatattgtataataattaacctcatttatttttaagattttttgtgtaaacaagacccgatatatatttcagtctctatgatacggaggtaaaacaaaattcggaatgcaaaaacatatatacgcagtgcagtattatgggggtcaattgacctctataaaataaaataaaaacaactatatttttttcttaggaataattataatgacctagtattttatagttttgacccccatacacagttaatttaaactacataggataaaagttgtccacctacattgaaacaaaaatattattttttatataatgtataaaaattctttcattttggttgattttcatgtaaatatttcattttttcttaaaggaagattatttctaagcaaaattaatcatattttttatatatataatgtatataaccaagaaatcaaggaaaggatgagcttctctctgataaacatctgggttgttctatgaaaaaagaacccttgtctttgtagttaagtatcgttcatactctgtgttgatgaatttggtaggtgcatagtgataaagtttacttcatgaaacaaaatgtggataatgcttgtggaaccattggccttcttcatgctattgagaatataacctttgagatcaaactctgtgagttatattcaggctttctatttgttcctttcattaatctaaagatattaatccttatcgattatcacttttgatttcttatttcagctgaggggtcgttcctgaatagattcttcaaatccactgccaatatgactcctatagaggtgtttctctatcttttgtttctcctatatatttgatctttcttagagtgtttgcttcgtgtctaatgtgtgtgtctatggaaattttgatagcgagcaaggtttcttgagagcgacagtcaaatagaagatatatgctcattctttagctattatagctggtgatacaacggtaacttctcacctcccgttgatgctaatgtatttgtgacttgttcacttagatgttacattggtttttttatgtttacccatcttcaggcttcagactaggtggacacgcatttcatttgtttagcttgtgtagatggtaaaaaaaattcatatcaacaccaaaatgaaactcacttccaagttggcactaaactgtgacactctattaccatataatgcaagtgagctctatgaacttgatggagatagggcaggaccagtttcacatggtacttcctctccagctaccttattgcatgtactataaacacttcactctataagcttaagaattatcaaagtagtataaacccttcactctttaagcttaaagttatcaaaacggtgaaagaatccaggaaatgcaaaccggtatatacttgaatagctttgatattatcctcgtaggacgcagcgaaagtgataaagaagataatcgagaagaatccgagttctctcaacttcaatgtgacagccatctctaagagtgcctgaggctgttattaagagaagcaatgctcctaagtcttgtttctgagtcaatgacttactcggattctctttttgtacattctgaatcttcttttcttgtttccgaattataatatgcggttggtaatcatggtttagagaatccacatttatagatcaatggaccatacaatcgaatcatattgtcgatagtgataatcatggataacacgcaataaggcataatttcaccacctgactattgtacaagtgctaaccaattgagatcaaatgagtttaaaatgcttgactagttgacttactttctaccaaaatcggacaacttggattcgttggcaactgaaaataacaattgcatacgaaggggatagacagattaaagtgggtcaggcccgttaatagaaggattaaagagggtcaggcccgttaatagaaggattaaagtgagccaggcccgttaatagataggaaccattgcataattatcggatgttgagggattcgtatcttggagccgaagtgttgttttcttatagaaggattttgatttcttctgcaaaattcgatcgatagtgacgagaaagatcctaagatg

SEQ ID NO: 6695 - DNA, 3000 bp, Unknown; identical to SEQ ID NO: 6679
  misc_feature (1)..( 3000): cDNA_ID_2999833_gDNA_ID_1621100_Annot_ID_55866 3000 nt of promoter + ATG

SEQ ID NO: 6696 - DNA, 3000 bp, Unknown; identical to SEQ ID NO: 6678
  misc_feature (1)..( 3000): cDNA_ID_1815179_gDNA_ID_1621100_Annot_ID_55867 3000 nt of promoter + ATG

SEQ ID NO: 6697 - DNA, 3000 bp, Unknown; identical to SEQ ID NO: 6677
  misc_feature (1)..( 3000): cDNA_ID_1815176_gDNA_ID_1621100_Annot_ID_55868 3000 nt of promoter + ATG

SEQ ID NO: 6698 - DNA, 3000 bp, Unknown
  misc_feature (1)..( 3000): cDNA_ID_1815172_gDNA_ID_1621100_Annot_ID_55869 3000 nt of promoter + ATG
gatgcggctataatcttggacatgggtatcactgttgtcgctaaagatattccagggatcaagaaaaactccatttatttcagtggcctcaaccaccccttaacggatcccgaatgtagatttgtctatgatctcacaaccggcaccatggaacctttgccacaatgcgttctctcctccatgctcttctctgattctcgatggttcttacctggtttcaccagttaattggacatgtttctgcttcttgttccatttttttttgtttttaaattattaatacctttgcttttacttagtcttttgatggttagtttctttgtattatgcatatgttttagacttcatgacttcaaggtgttacgtgtttcaattatcttatttgttaccagtagtaatagtttggttagaacttcgatgatagaggttttggcacactatgattcgaatctcattatgtgacccaaaaaaagaaaaagaaaaacaaatcataagggaattcatcgaccacatcctaatacagtaatatctatgctgaatgattcatagagattagggtaatttaataataaaaagttgggttccaccttcacaagatcaaaattcaagattcgaatagttgagacgaagtcccaaaagaaataagacgagaacatgtcttctgtttttgttcctgaagaccctcaagagtcaagacacaccaaacaacatatgcacagaacacagactcattcatacatagtttctattaaagtatggactttaggtcatcctaagccatatatcattcattatcaaacaaggaacaggtctacatccatcaaccggaagttcaactaatcttaatttactttctcagaaaatgtgcagggaatgacttacaggcttaaaaaaaagaaagaaagaaacaattcttacaaaaaaagagcacaatgcggaagattactacctctggaggtcaaacacagcacggtggatggtgttcacttgaaagtggacagacgaggaagcttgtccctcagatagtaaagccttgctcttcttactttcctgtgactcaccacttttatctctttgatgttgggagagtatctgtcaaatcaaacgattaggagaatcaacacataccaaacacttttcttaattcccacatggtaagaaaataaccgatatatcacaggaagtttctcgagactcgtatgttatacagcagaatgaaagatagtaaacatgagcagacatgatagttgccatagtgattcaggctgccataactgggaaggtataacagcaactaaagacttattacagtaaaacctctgcacagagtctaactattatacagggactttatgtaaggtaacacaaagtataactcagtatctatgtataaacttggttttattgaaaagctcagaacatgtgaaaagactcataatcaaagtaggtcataccaaatggtcactggagaggggaaaaaactcacatgggaaacacaatttcaacaccgatacccgcaataattctccgaatacgaatggtagtgtgtatgcctgcattttgtctcgacatcactatgcctttgtagatagatagcctacgtttgttctcaggaacttcctgccaagccaaacaccatatcccaccaataatcaaaaacatcgattcaatccataacttaagaggcttcaaaaatatcaacaacttaccaatttgatttctacaatatctcctgtcctgatttctggaacaggtctcactttctctgctacctcaattgctttctggttcagtatctacaacaatcaacagataataacattcaatctccctcaacattgcctataagataactatagaaaaagcaagtccctcaacacaaatgtgtacacagagacttactgattcctaattgctaaacactcataatttggattactgataaacaaagaagttcactaacccccatgacatctccgagcttgatcctaggttttcttgtaggtttagcttcgaccacttcctctacatttccttccgtatcagcgatttcagcaacaaattcttcagattcagcttctgtgttaccttcttctgctctaacgataaactcatttctcaccctagtatcgagtgagaacccaaatttcgagccgggatgattcagagaaagcctagaaactgatatacgagaatccatcgatggtgcacacgatagaaacgaagaaaaccctaaattcttcgatgattgcgtagggtttctgggtatcatatgcaatgcctaaaaatcccatagaaacaaataatcaacaataatgaattaagtgaaaatagagatttcataagctttcgtatatttaaacctgaggaagacgatgaaagctcatcgccatagctgcagcaaactctcagttactcggagaaaatggagggaagacagtggaaaagagccttatctgcttttcgcttcctattttggcacacgtatgccatcgcacgtgtgaattttctttatgggccgtttgttattgtgggcctttagtatatcaatattaatataaatagatagtactatgatttataaaaatatcaataaaagagtcggctaatgacacagtcttattatgattacataaacctataatttgggcccaccaccacgtcggtcgtgtgggccgtcgcttcatgcgtaccaaagtggtcaccgtggcatgacaactgttgttctgccttttggctctaccgtaacaaataggacacgtgtcgcgtcttcacagtttatgtcgtgttctatctctctctgtctctctctctctcccgccaatatctctctccctttggtctcttctctctaatcgctctctctcaatcaaattaattcgtgattctgatttatcaaacactaaaacaaatggatttgggtatttcattttgatccgtaaaggttgattcttttttttttttgttatcattgaaaattttgttttgttgtgagagatg

SEQ ID NO: 6699 - DNA, 3000 bp, Unknown
  misc_feature (1)..( 3000): cDNA_ID_1815161_gDNA_ID_1621100_Annot_ID_55872 3000 nt of promoter + ATG
cattcagtattggaggtcgggttttaaaccctttcagaaaccgccttcttccgagaaatgttcaagccttgttatgtactaggaactcgttgcgtggttttgcagagttggaagataaaaaaagaatagtctaattttttggacttaattttttttcatttgttgatttatatcttctaattgtaggtgacattgaagaatactttgatgatggaattgaaggtactacatcggtagcaagtagctctggagtatgagaagatgttgtatttttgttttaaattgattttcagatatttgattactttttaagtttttcttgtttaatttgacatacaaattattattattttgctatgaaaaaaatttacatgatatatttacataccagtttagtttataagcaaaatatagatataaaatatatataatagtatattagtaattaaacataaacactagaaaaaaagacaaaaatcaagttgggtacccacgggtagtatcagaacaatcaggtttttttcgggctttacccactaatcaaaaacccatttgggttttctaaagttgagtttttggtgggcgggtttattttgggttcaggtcgggctgggcttttttacccaccacaacatctctatttctctttaatgttttgcttcactcactcattttaacacaagcacaaaaagaaccttcactctcattctctctagtctttggttagtttcttgttttgacacgaagacataaaacgattagtaagagagagaaaagagaaaatattagttgtcaacattttgtattgaatccaaagatagattcttataacaagacatacacacatttgtggatggttataattgttaaatccaacttttaattttactgaaattaatgaagatctctacaaggtctcaaaggctcacgttgtatccatgaagctaaaattcatgaaccaaaattagcaaaggatgtccacaacactgactgtcattatatgatgtgtgtccacatatccaacgttttatggtagagtttatatagtatagcatgtgaatgtattaaccttatggatgtaattgtatggttaattttgttcatttaataagattaaccagattaattggtcatggtttccaaaatcatctcaaatcctttgtaaaaaaaaaactaatctgcgaaatataagtgaagagaatcagagctagatccacgtttgagaggataacgtcctcttgacggagatatgattgttggagcggcgaagaaatagggtttagaacttcgagagaaagagagaaacgtatcttgcccaagtggttacatttttgatgcggttgttgaaatttgggagaggcttcacgatcatggaatcaaaatcgaaagagagaatgtcgatagcgttgttgtaattttcgagaaaacttctgacggaaattctgtgaccagagactttcacatgttttggaatcagatccaacggagaaaggtggatttgagaatatatttgaaaaagatctcgagagaggaagaagaagagaatcaatagattgttgagagatagggaagatgatgataaaccttaagagattcaattttgattttgaatattcagaatgtcctaaaagattgaatttttattctggaaagagagatgaagaagaagataggccaaaaatgtttttgtattgtgaaagaagagagataacgaagagatattactaaggaaaagaagagatagttagagagtagtgatgttaattcacatcaaaaaagtgtctaatgattgtaaagtgcttaattacggctaaattttcagaaaagtgcctcaacacgtaatattctctagaaaagatccattacatctacacacaacagtatagtttaatttcttggattttttttctgacaattttattaaaatttgaataccaatgtcgatgtagaactacagttgtccacatatgaagttgaatccataatctaaaatctaaatttatataattaaaaaaaaaaggttaactaacaagccacagaagaaaaacacgatcttttgatgaaggtaaatttagaaactaatctccaacaaaatccatttcaatgagctatatatcaactcacaagtcgtaacccgtgccatcattaatattgttcacgtacattttcgttttggcataagagtatggtttgagttatatttcgtgaaagtacatattttaaaaaaactacttctttgtttgtgtaagtgattggaaacgacatgtttgatctctttttgttgttattgaaaatgattttaattgaaaatcgaaattcgtgttaggactttacatattttgttccctttttagcctaacacaataacctattcttggtccgtccataactaaattctcagttctcgatcgcctacatatacttttttttttttttttttgttagattgatgtacgtaacttaaagtatatgtacctactcattccttaatctaggaggacaacatatatgactaagatctagttcttggaactacatgtttaacaacattagtactaattgggtgacacatgcatataaatatacaaatggttatatctaaggataataattggatctctaattttcaaactaatagcattatggaacgtatgttagtgaaaaaagtactctttaatttattattaacatcaatattagtcgccattttgtaaagtcatacgacacataattttttaaattaccatcgaacctaaaagacattctcgtagttcaacgaacgcaaacacacgtattcacttgttttcttctggccagctatatagtctacgcatcgcatacgcaaaccatatatagatccatcactctatatttacatatatcaatgtatacacagagagctatatatagagaatacacaatacattctattcttgtatactcttattacaaaaaaaaaaggagagagagagagataaccaatttctctccctgaaaatg

SEQ ID NO: 6700 - DNA, 3000 bp, Unknown
  misc_feature (1)..( 3000): cDNA_ID_1815157_gDNA_ID_1621100_Annot_ID_55873 3000 nt of promoter + ATG
aaacatcttcaaatctcgttagccttttgtttgaataattacaccaaaaataaaggaagaaactttgttttgaacccaatgatgattagttcacaacttcacataatctttcatcgcaagattgatacatactttgtaatcgacatacatgctaaagttttcaaattataccacaattaataagttgcacatacaatcaaaaacctaaccctggaaagggaaatatatcaaataggagaactataagcagagtaatcaaagcctggtcttgacataaatttccaaatcgcgaaacatcattgtatgttccaaatatgtacatggtgcaaccgatcagctagttcctttgctttcgtaatctctttcttcatcttttctctcctctgtttcctcatctccatgacttgcttaagcagctctctcccttctttagtgtttagtatttgagctctggtgcgtttatatatgttccggataagctcaggtttacctctcacaaagtcaccatcagcaaattccctttgctcagagtcaagtttcctaaacccgtatcggtcaagcaacctggtaaacaatgagaaattgtggccagagccaatatcgtggtagccaaagccaaagattcttggtaaaacatttatctcacttacgagctgttgtcgatgtgggataaatataactaacgaaaataaacttggaaaattgggcttcttattgggccttttttgttttctaattagattaagttaagtagagactagacatgattaacggtaatctgaggaaacattgttcaaatctcttgatattacatttggtaagttcatctcctaattacaacaacaacaaaaaaagaaagcaagaatctttgttatcacttcttcttagaacccaatgactcatcatcatcatttttccaagctgcttgccattgcttatcatacaatgtagtctcatcaaacaagttcttgagtttatccacatcctcattcttacgaataaacaaaactccagccacagccacaaacaatagtgtcttgcagaagaaattccccatttgatcaacaagtcctactccggtaagactatcgacaaagtaagccataaagaatcctatcatcgccgcacgacctacaaagagtaagagtaagtaacattctttgtgtatgtgtttgatcttttgagagaggaaacaaataccatttaagagttcagcttcaggtaagtggtatctcttaatccaagcccaccatggaataatcgatgtatcgaaaagcactggttcgtcgttactcgttgtttctggattctcttctagccattttcttctctttgcctcttcaaatcaaaacacattaaacatcaaattcaaatttcgaattttcaccaaagtaacagagcaaaaaaacttaacgaggatctaattctaatctaaccagcaacgattacagaatcccaatcggtttttccatctttctcgaactgtttcagatcccaagttccattaatccatctcgcatcctggaatttgacaacactctccgttgttttcatctcttcaccttcgacggcgacatttttagcggtggcggtttcttcctttttaaccgccggtgttgattgcggaggctctttaactatcacttccacgggctcaggagcctccacggagacggcggcggtgggagaggttgatccactgtcggaggaagctcgagtgacggagaggagagagaagcggttactggagaggagggagaatgaaaatttgggaatgaaattgggattttgaagagatgaagaagagattggcggggagaacaacgccattgttgtggtttcttctttacttcagagtttcacaaatcacaactagtggttctaaatagacttgttatcgtttaaagatgtaacatgtatgtcgtttctttctcccaaattgagactacgtaacgtgttttttttccctctacacatacagaaacaaaaaagtgactgttatcttcatgggctcgtattaaaagcccatcccagtattttggtgttgttatgagggtatcaaacaaagaaagtcaacacatttacctgattaatcaagcaaagtttttattattattttgtattcaactaagcaatgtaccttacaatattttccattttacaaacaatttaaggtttaactttttaaaaggaaaaattgtactaaactaaattcattaataatatatttaattaaaattttaattaatttttttttctgcaaactgaattatattaaccaattgagattttacaaagtagtttttgtaaccaaggtggttgacgacctgattaagaataaaaatctccatgaatacaattagaggttgagaggtaatgagctatactattatttacacgctttgtgaagccaaagaagattgaagaaatttttaattaatttaaaattttgaatcccataaagtatggtgaaaagaaagctcaacaaaaataaatttgtaaagaaaacataatatttcttttaaaacataaaaagcctaaaaaatgaattctaaaatatgttttttaccttgatgccctaagccatgacttcacttgattgtgtggaatgtcgggcttgatttattatacataaatgcattgtatttgttataatgcaacacgatgaccaaaggatatatgaagttgattttcaagtatgatttgtatcatgtgttatgatgaaaagtgctattatatattagactctaaacttagtacttgttaagacaatcttagtgaattccggattataaatgtagatttgtcacaaccggttgttacaatagcatcttatacaacttaattgtacgagataagctcactttcagttctttaccaatcttgaatatgagtgtcggataatcaaggcgtcgcataatcaaggcattttgaatatgactctggagaactctttaaactaatcaaggcgtttgaggagccgatgccgacatatatatg

SEQ ID NO: 6701 - DNA, 3000 bp, Unknown; identical to SEQ ID NO: 6672
  misc_feature (1)..( 3000): cDNA_ID_1027047_gDNA_ID_1621100_Annot_ID_55878 3000 nt of promoter + ATG

SEQ ID NO: 6702 - DNA, 3000 bp, Unknown; identical to SEQ ID NO: 6671
  misc_feature (1)..( 3000): cDNA_ID_1815133_gDNA_ID_1621100_Annot_ID_55881 3000 nt of promoter + ATG

SEQ ID NO: 6703 - DNA, 3000 bp, Unknown
  misc_feature (1)..( 3000): cDNA_ID_1815321_gDNA_ID_1621101_Annot_ID_55882 3000 nt of promoter + ATG
accaaccctgcctagtttctccatggcacgtgcaaaatcctcgaagaaagccgtctgattattcgcatataattctacaaacggtctcgtgctaggatctttaaacaatatatggtcggaagctaacagtccaagacctcgtttcaagttcttgaaatacatattatcgaattttcccggtgtcaccggatcgagaaatgctgccatcgtcttattggtttcgaaattcttgcatagatctttaagaactcctgcgaatttcgcgttgagttctggatcaaccttcgggaatatccggttgctgaattctttgcagtgtgagaatccgattgtgtgcccgccacttaacgcaaccagctcctttagagtgaaaccattcttcttgaatatcgataacatgtcggggacggattggttcgctaaaggtaaatttcctttgactttatgggcttttgactcaaaaccatctttacggcccagtttgacttcatagaaaggcccaccaaccattgtgacaaggtcacgtgtggcctgagccaggatgtctgcgcaggacaccaccccgggacaagacaattcaagagcggttttgatgcgagtcacaatgtcgaatgcatctcccggaagcgactcgttgaggtcatcgtcacgttcggctttgttgaaagaatttgtagcgataaggacggaagcatcacatccttccatgaaacaatcatggaaaaagagacggagtgttccagcagctgtcgttggctgctggccttgctttggtgtaacggtttcacgtacgattttattgaaatcgggacatgttttttggtaataatcttttgttaaatttggtggtggtgccgagtatatagacgggacaaagactaggacgacgaagagaacatttataaccgaagacattgtgtatttcacgagactcgtatcgatttgtgaaagaaatattgtttgtaaaatatggaaacggaattgaaatgtaaagagatgtctatgaggtagacttctttattgaattgttatcggtgaaatatagaagcatgtacgtgtggttggagtttggcttttgttatgttctttttatttcagtgattggtctatatttagtttgtttttactttcatttttcattagaaacgttttctaacactaattcattataaaatcgattggcttctaggttaattaaaccacaaacatggaatgcatgctaattggggaaatgtgaaggtgattaatcactcaattgatttgttttgtattactactcctgtttttgaaagaattttggaatggtgattaatcaactaaagcatctacagaaaacattattgatggttagagatatgaaaatttaaattgataggctaaacatacaagcaaacttttacttaatctaatgttgctcttgatttgaaatataaacaaaaacaaaattaagaaaaatgttgacttctgagttctgaccactaaaatcatgcaactgcttgacaatggacatgccatccatcttatatcaatttgttgcttaccttgccaccacatttctagatttttatgtcatcttgttgacatttattagtatataaattcctaccattctttctgaccaacatatgctagaaccaaattatttgttgttagatatcaattttcgctaacgtgttactgtttataaagtattaaatcatgcctatatatattattatgtttcatactcctccaaacattttgataagcttgattttctttttatatatagttcaatttttgtaatctcatgtatacgctatggcaatgtgtactgatgacgaaacattatgtacctatatgtatcatgtggtaagtagaacattgtttgtttgctagaatatgtatgtcgcttatcgttttgaaaaagactcaccagcatatatataatatgcaactgtgaagcataatatcaatgaggaaacgtgaagtgcaccaagggataatctaatttgataccttttatttgaagaatatatgacgtccgatccattaatgctttatatgcatctagccatcgacatggatctagacctttcaataattgacgactcctccgttttctttttataatatcaaaaattgggacattggttatattggaagagtggtgaaggatttatcctatacatcaaacctagatatgaatcccaaccaactatggaccgctattgttctctctttgttttttttttttgctatgaaactatggaccgctattgttagctttttatttagttattgtaaacatcttaaatgaaaaaaaaaaagaaatactcggttcactatatgcatcatgtaataataatctaggttttggcccaagatctatctaagttataattaaaacgaaaaaaaaaaacaaaaaaaaaaaattgaaaaagaaaattgttaggtagctaaaaccctcaggtactacaagattaacgaatacatctacagattattcatctggaacatgcaaatatgtgatgtatcgactgatctaaaatggattagtttggttgaaagacggtttggtttagttaggttggaagggtctttgggaagagtgttacatcgttcacatcttttaattttgattcagtctctaaattatactatatagtctatattgcaactgaagaatgattgaaagagtactagtactaaggaaaaaaatagaagtagatgcaaaaaaaaaatggtaacattagtgtgaatcatgcatataatgttgaaagctttaaaaagacccacaagtctttgtaccctttcgtccccctcccctctaaaacctcatcttccccatttatttctcccattctttctccttttctttttcagttcttaattcatacttgaaaaaatcaatacattttcatcatcatcagcatcatcatttcccatatacacaaacacacatgcatgcccttattatctgataatgaacgcataggtctcttctctgatagctcaatg

SEQ ID NO: 6704 - DNA, 3000 bp, Unknown
  misc_feature (1)..( 3000): cDNA_ID_1815313_gDNA_ID_1621101_Annot_ID_55884 3000 nt of promoter + ATG
tatataaaaaatacacctgcatgaaatttaagagatgaagatacattaaaaccaaaactgaagtctcgtcgtcacttgttgtttgtcttgtttattggtttaattctttgtcctccttgaaatcggagtttggaattataccgaacattacgaacttggtggctgggtgcctaagaataaattgaatatgatattgcgtctaattaatacctgaaaaagcttttctttttccttctatatattgtttgtggagaaagtgattttgtttacgtgataagataaaatttaaggaaaataagaaatgggaaaagaataatatcacattgacagtgagatatcaccttaaaatatatattgtatatagtttcgattatgtttattagtaattttcaaaacaagttaacattaaaggttttttattccacgaagcattaacttcatttccatcaaaatactatacgacattaatttaattttggccctagtgacaccgatagacagtccaagatttgattcccaaaacgccctttgataattcatgtcccctaagcccatacatcgacagataatgttggggacgatccttagattcatttgtttttttttatatttttcacatatttgattaaactaagaaaatctgaatccaaaaataggtttccgtaaaagtcgaacctttttccagttttagttccggcagcacgaggaacgatataagacaaacggaaaggaatttttatggaaaatcgatagagaaaataagattaaagaatataatttaatttacttgattggaggcactaccaaccgacgatgcataagacaaagttagaagctcaaaaacattactaggttaggagataaaatcttattcttttttaaccgaatcattaaataaatcgtattaatcgaatcttatttgtttttcagcaatccgcgattaactatcatcactagtacttgagttttgtagcaatgaatcttatttgttcttctcgtcgtcacatacaaacaagaaactaatcatgataagttctgaggggtcggacttaagtgacgaataaataggagaaatatcaaaaactattgaaaatttatagtggtcaaatagagaacaaaggttcccatcaatttgagtaagttactccgacacggggacgtaagagtgaaacctagtgaaaagcatgctgtccacttcacttagtgtaaaattgtaagacctttcagggcacacagtttgttgtatattttagatttttatttcgtaaggttatccgtatatacgaatcaatttcctacatatatatatatatatatatatatatttccttcataatgtgatgaaaaagagaagtacaataggaaaaagattgattgaaaaatgaaaaagtagaagcacacttaataaaggagtagaggagaaagatttggagtttatagaataattgcccccacgaatctttttttgggagatattttaagcaaatcttaactttggggaatttgataagaacccacatttctattcggacaaaagagttgcttgcaaactttaagtcgaaaaattatttatctggtattaaaagaaatgaattaaaatctacaagggaaaaaaaagaaaaacctaatcttagctagctggttatacgtgtgtcatgtaataaaatgaaactatttgactaagttcatattgggtgggactggtatcactggactgtaaggaatttgtttttaataataatattgttatggtagaggaattcttatttttttagtagattggtgtgttattggtttgataattttttaagattaggattatacgatgcaagttgaattattgaatttgttttgtcaattgtaagaaatgacaataatttacgcatctaaatgctgtggggaagatataagctttttgtacagtaataatggttacttactattccatcaactattaaaaatcatgtaaagaataaagacctaccactttcattgtttgctagctagtatatatatatttatggttagtaaagtaatagaaaatcagtacaaagacaaaatttaaggaaatgaattaagagttcttggttttggtgcatgtggaaatatttgaggttaagactgtttactgttggaaattttaagcaaacaagacataatcaatcattgttttaatttgggatgtaaaaacaatttttttaatgcctaagaacaaccttttgttagtgtgtgtatgtatatatggatacatattatttaataaatcattttctattgtgtgtgaacgaacatataactcaaaacataaaaatactaagatttactaattcttgtttgattagtataacaaaattcacgaaattatattaatatgcacatatgtgttttttttcacaaaaagtttattgggccacaaaatctagccacaaatgaatcgcattggccaagtttctacttgatcgaacaactaaaaaagcttagggtcactaaacattttattacttttgggaatcagatatctctggaaatctcatagaggtttgtctacttagaagtttttaattgcctaaaattcgttgtcataaagaatggggctgaagaagatgtgtaaataaatatataaaattatgtttcagagaaaaactcccgagtcctcgcatcctcttcatatagtcctatttattcgtttaggaccattgaccttcttcttcaagaatacctctaccatagtcaacacaaacctacaaatgcagaaggagataattaagatggttaataacaatttgtttcttcaaaagcccgatgtttataaaaattcataaatggacaaactcgacaattgtacattgggttgtggaggcccaattaaggcccatatatgaatctgcagtttaatggcatatagcgtggaggaaacgtaatagattattaaacctttataggcatcaggcgtcaaccgattgcttccgccaagcaaagcaaaagttgagaaatttagtg

SEQ ID NO: 6705 - DNA, 3000 bp, Unknown
  misc_feature (1)..( 3000): cDNA_ID_2992663_gDNA_ID_1621101_Annot_ID_55887 3000 nt of promoter + ATG
tacataaaatcacttgacgggctaattgctctaatcaaatttttgattttaaaataaaaatcgatcggtatttggttcagttaaccatgatgattagcccggtttaaataagtttaagaaaaacgaaaagaacaaaattgttttctttttaaggtctaattaccaaatcgaccatgaatccaatgttacaagaacacaagtcttcgtcctaaataacaagttcaatcttcatcttcaacaatctgagagagattagttccaagttttaccgtttacaacaagaatcagaaaggtctttgattgcatatctcaaggttgagccggagcaggagctgaagccataggtggaggagattgttgctgcaatggtttcgattgtggctcaagatgttcagaatctttctttgcttcaggagattcagagagttttgattcacgttcggcttcttgcgttgatgaagctgcctttggtgattcagacaagtgaactctagcaaactcatcaaccactttcctcttatcctcttcctcagccataccaactttctctttagccttttgtccaacttcttctgcagctttagcaactttgttgaatgctccagtaacccacgtggcacctgtgagaacataccggttcttcattatagctgaacctgcattgctcactgtctgctccgctgcagcgattgctgatttggttttctctgagacttggtacttctgatcaacttccctgaccttttctcccactaccaccgtgcctgtgttgatcttatcagtgaaaccaattttcttgtcaaaagatgcgactttggctgatgctgtagatgttagctggtgcttctcgtcaacacttttggctttagctatggcatcttttcccaggataaagccctttgcaagcatgctgctcacaacatcttcggcttttctcaacacggagtcacctgccttgggagatttattgctgtccttgggttcctgtgaaaaagatgaaatggtaagattttaacttgtgaaaaaactcagaagagatgatgaattacgagcttaccaaggaagctaaagcctcaggggacagttggtaatcaggagccatagagacaatgactgaagaatcaacaatcgttgctccctgaaatgaaagaattacattaatactcagtcactcaaaggatacagtcatatagaggaactaatacaggctaagaagtaaaaataccgagagaagaaccgcagtttcagctccttgtagatccttaaaagtgacatatgccagtttagtccgctcagtctcgctgtacaaacatgtcaaaagagttaagaacctgacgaactaaaagctgtaatctaaaactttcaaaaggaacaatagagaggaaaccaaacctctgcgtctcaaggtacagaatatcgccagaaaaggaaaagaactccttgagatctctatcggttgctcctagagaaacattgctcactttaactgttgtcatctgcaagtgaaatataatctcgtgtgacttaaaaactaaaatttcaaaccatttcaccagctaaacaaaatctcagacttattcattagttgttcgattacacatttctcgattccttatcgcctaaaacaatgactaaacacacacacacacactcctaaagcaaccaatattatcaatacaatgatcagaaaacacagaaacattgcatcatcaatacaagaagataaaaagaacctcagaatctaggaaaagcaaatacttgtctcaaaactaatcctatggcacagatcagatattaacagattacaaaacaaaacaaatgctaaagtgaatatcctaatccaaacaaaagcaattttaccctaaaaaaaaatttcttcatatcagaaacagtaattttcacccaaatcaaaaacagagaacagcttcaaatcctctaaaataaaaaaactagcgattcttcactaataatcaacgccatttctcgcaaaacaaattagaaaacaacaatcaaaatcaacagatctgttcacatcttcctcaatcaaatcaacagcaaaaacatcgacctttctcaggataaatccaaaacaaaaaccaaaactaactagtttcaaaaagcgaagagattagataagctcaccgtcatgaagaaaatcgcgttgacgcggattgaaatggaagattgtttttccttcacacaggaggaacaatatttgaaacgaaacgaaacgaaaaatcaaaggaaagaaaaatctctggtcgcggatttgatgtgaagaagagtgaaaaataaaagaaaaaagtgggacctgattttaaacgccttggaaaaacgagtcttattcgggtttggcacgtgatatggtcggaaccttctcacgtgcgatgattaaaaaagagtcctaattttaaacttcttttgcttttgaccctttttagtcacgtaaagttctatctagagattttattcattaaattctggactaatctatcataatccttaatctaattctaattaatccgtaatctgttagtatcttggttaaaataatcaattaacgtcgtgacataatcactttctccaccaatgtctaccatccacgtgtcctgagctcagagcaatgtaatcatcgtagaccatttatcactttataataaaaggaggatataccgttaagattctaaactatagagtcacgtttggaatattatagaaaagttaaggatcaaaaaatgaaaaaagtacaagctttttccgttcatacaggtaatgtgacatttcacgttttgctcaatctctctctccgcggttcacgttttttctcaatctgtccggagagagagaaactcaccggggaatcttgaaatcaccatcacatcctctcttccctcgatctccgttatcgactgtaaatcgaattttgttgttgctttgttttcttgggcgaataaaagaggataatttagtggcggggttttcgagaaagagagagaaaga

SEQ ID NO: 6706 - DNA, 3000 bp, Unknown; identical to SEQ ID NO: 6703
  misc_feature (1)..( 3000): cDNA_ID_1815321_gDNA_ID_1621101_Annot_ID_171415 3000 nt of promoter + ATG

SEQ ID NO: 6707 - DNA, 3000 bp, Unknown
  misc_feature (1)..( 3000): cDNA_ID_1815301_gDNA_ID_1621101_Annot_ID_55888 3000 nt of promoter + ATG
agattacacaagggggttccttttgaagactgatctgtacacttgaaccaggccattcaagatcatctattgcttccttcaacgccgctgactgatagatacattatcaattaccatttgagaaaaagctcagactaacaatgttaaacgaaaaacgatactaaactatgttactacctttactgtaaaagtaagtggcgcgattcccgcctgctcaaagttgtagtcccaagtaacagtttcgggaattctagttcttatctcagagtagatgcaagagtttaaggtatcaacagatctaatcaaacactcacaccaatcagctaattactcgtaatccgtatattcacaaagcaaaggatcatagtacacatacttgagaagaagctccatatcaggtcctggatacttgatttctatagtattagaatgtccaggtgatgaaaatgtgttcaagcaatcaacaagaagccctaagctgattccgaatctcggcctaccttgagctccatactcgtatttcgtgaatagctactcatataacacatcaaacagatttcggattcaatcgaattttaggggtttagaaaatttaagataaactcagaaatcgatacctcgcgttgaagataaactttggcttgaagacaacctgattcttcaacaatcaaaactattccgtgttcagataattctactaaagcatcctggaaacggagaagttttcagaaaatcaaagaagaaccctagattgaatttggggaggatggagataaaaacctggtggcgtttccatcggacgcaagtgagtgcatcgaccattccttgaacattatcgagctggcaaatcaggtccggtgtgtctggttcaatcgccggcgacgaggacgaactcatttctctctctctctctcactctccttcctctgctttcccgccagaaaatgtatgccgacaatatagcaattaaattgattattattatatttgttttagcaggcccagttattaataaagttgatctttttggcccacacacaaactaaaaagaaaaataaaagcccatctttatgatatcgcgtttatatctgagtcacagagaaataaaagggtatgtttgtaaatttcaaatacttctctttctttatccgtacgaaaatggacggtgttaccggcggaggaacgaatatcggcgaggctgtgacggcgccaccaccgcggaatccgcatccagcgactttacttaatgcgaactctttaccgccccctttccttagcaagacgtatgacatggtggaagatccggcgacggacgcgattgtctcatggagtccgacgaacaatagcttcattgtttgggatccaccggagttttctcgtgatcttctacctaaatacttcaaacacaacaatttctccagctttgttcgccagttaaacacctatgtaagtataaattctctcgcgccctaatttctccaccattgatttctctaattgtactgtgtatagattatgatttcgttgaataatcttagtgcttgatgtgtttgataagatttatatgattcatgtgccaattttgatgaacagggttttaggaaagtggatccagatcgatgggaatttgctaatgaaggtttcttaagaggtcaaaaacatctattgaagaagataagccggagaaaatctgttcagggacatggtagtagtagtagtaatccacaatctcagcaattatctcagggtcaaggttcaatggctgcattatcttcatgtgttgaggttgggaaatttgggttagaggaagaagttgaacagcttaaaagagacaaaaacgtgttgatgcaggaactcgttaagttacgccagcagcaacaaacaacagataataaacttcaggttttggttaaacatcttcaggttatggagcagaggcaacaacagattatgtctttccttgctaaagctgtacagaatcctactttcctctctcagtttatacagaagcagactgatagtaatatgcatgtaaccgaggccaataagaagcggagactcagagaggatagtactgctgctactgagagtaatagtcatagccatagcttggaagcatcagatggacagatagttaagtatcagccacttagaaacgattcaatgatgtggaacatgatgaaaacagatgataagtatccgtttcttgacgggttctcatctccaaaccaggtatcaggagtcactcttcaagaggtactacccataacttcaggacagtcacaggcatatgcatctgtaccatcaggacagcctttatcatacttaccctctacttcaacttctctcccggataccataatgccagagacttcccagataccacaattgacacgagagagtatcaacgacttccctacagaaaacttcatggatacagagaagaatgttccagaggcattcatctctccaagcccattccttgatggtggttcagtcccgattcagcttgagggaatacccgaagaccccgagattgatgaactaatgagtaactttgaattccttgaagaatatatgccagaaagcccagtttttggagatgcaactacactagagaacaacaacaacaacaacaacaacaacaacaacaacaacaacaacaacaacaacaacaacacaaatggtagacatatggataagcttatagaagaattgggtcttctcacatcagaaacagaacactagtaaaggattatgtttagtatccattgtaaagtctttctctactaacattatcgttaggactcagtagtacggttgcaactttgtgcagaaatctttccttggataatagaagagttgtatttattattaaaaagaaaatgccattttttctaatttattgtagaaagtgactactttgtccaatcatatttgtagtcctttttcgataagaaaaacagagttggaattttcccggggaagctcttttcaatg

SEQ ID NO: 6708 - DNA, 3000 bp, Unknown
  misc_feature (1)..( 3000): cDNA_ID_1815282_gDNA_ID_1621101_Annot_ID_171436 3000 nt of promoter + ATG
atgggctttattccaactttcatttactatgatattgtcctttttgagcttatatcttcaagcccgcaaagatttgttattgggttcctttccaaaagacctcatactagttggagttggacttgacttatatattaaaaactctttttctaaactttcgatgtgggacatttggtttgtacccaacaatttgtagctgttttttacatttaaatattctcaaaaatacagagagcatggaatttaaatacatatactgtaataaacttacattttcaaattcaaactaataaagctgaaaaaaagtagtgtaaactttgtggcacatgttttgtcaaactgatgttttagttttatatcaccccattacatgtatattcgtcatagtctttcagttttgttacgtttttaaatatcttataacgtattaatttttaataactttaaaataaactatctaacaaaaaataaaaaaatagaattagtgtccgtgtgcttattttacctgcaagtacgggcatgaaggcaagggatttgatagatagccaatacgaacacgcatcacgtgcttttctaaacgcttcgatcactctgaagacgccacgtgtaaaaatctagccaaatagagtcagaacttaccatgtgggcacgtgcgattcccgcagctctaacatctatgtatgcctccatgactccatgtgatcatttgagccaatctaaatatattttgcgtattctttttcagtatacacacattggatacgaattgattttaaattttttacacatgatagattgttttgtaaatataataatactaatattatgtcatcgaaatgcaccaagtcgttgtttatgataagatcattaatggaccgattaggtcttaattaaccaatattttgtttcacggaaagcaatatgacaaagcacgtattaattagtgaataaacaatagccaatagcttggagacatgaaatacaataatgaaccgaatcacacaagacttagtctatattattttctgaaacatgaaatcatcatgttagttttacagtcaagaaaacaatgcgtctataaatttatttcaaatcaaaatcttatatagtaaatgttgacaaaagaaaatcttatattacatatgatcaggattttttcttttcatcaagtatctgttaaatagataaatatagagaaagatgtgatgggcggccaaaggtcgtcgtccgggagaagcggtcgtttgatagctgcaaaaggattctctttgctcccaaaaagcttcgctggcaaaacgtcattgtttgcttctcccttaatctatctttcctttattctcaacttcaatacaataatatagttatatacatacaaacgttttgacccaatgagatatacaagtaccaacattggtatatatgtttaactcggagatgcatattatcgggttaagcttttttcaacatcgttcgtctaatgtttgtgatggataaactcgaaaaattatatatgcttataattaacttatgatattaaaatgactggaattattgaaacttttaacccaattttaattagcacttaaatttgtacactcattgtcaattaattttggattaaaatcatatagtgttcctataaacaaacatattttatcactgatcatgatgaagtttttttcgcattttaaacaaaaataaaataaaaagagcgttaaaaggcctaaattacgtacttgtccaacggcccattgaaagcaaacgcaaggatccataatgacctttatttgggctgagatttatcattgtactgtaatttgactattttccaaggaaaattaagtccctttttatgtttttatttatttgaaaaacatgacaaaacaaatgcaatccacatggtccaacgaaagagcgatctagttgaaatctaactaagttcccaacgaaaccactgttaatgtaactttacatggcaaatatctttcggatatcaaggcccatcactttcagctcttctgtttttcatttttttcccaaaatttgtattgtttaatattcctagatttcaaattgtaataaaattttcatttggcataagaaaaaaaaataatatctttttctacatagaaaataatatatataatatgagttcatacaccatacatgtgtgtctatatacatatatatagttttgtaatgtatgtatatctcgaattgtagccatatgtaggatgattatctaaaatatatggtcataatgtcacagtgtaaagctactctagtcatttgtcagattctaacaagagaatcttagtaatgatcacgcaaagctaagatctttgcttcaccatttaaagcaaacaaactttgtcttaaccttacataggacatcaaagtcacaaccaactttttcctctgtaaatcttcacctatttatataaaatgcacactatttttttatttataattgggcttcctatattaattaaatgcatagcaatctatgatttaatgtctttttgtaacaaagtaccaacgaagatagaagaacacacctaaaagtgtagagttctataaagacgtaaagtttatgtaaatttctgaaagtagctaaatatatgtaagtaattaatagaaaatgagatttcatttttacttttctaacatatataagttactaaaatatgtttgcactggatttaatagaaagaaagtatattatatttgcaaattttgaattatacatgtgataatcaaaatgtgtgtgctcttacactcagtaaaatttattatggtaaaatttctttcatttactgaaaatgatattttgaagataagtgacctatctatgtatatatttcgggtccatctttatatttattattgaatttacatcattatccaccaaccccatcttcttcttattcttcatcttctactgagatttctctttttttttcaaaaaaaactcatccttgaatgaacggtggtgcatgg

SEQ ID NO: 6709 - DNA, 3000 bp, Unknown
  misc_feature (1)..( 3000): cDNA_ID_1815297_gDNA_ID_1621101_Annot_ID_171424 3000 nt of promoter + ATG
tagactatatatagttcattcaaaaaggagagattctcgcatgtctcagtgactcgctaggttcatcagttttattaactctagtaagaattttttccatgtatattaggtctctctggtctatacatctatatacattggtttatacgtacatcggtacatatacatacacaaatgagacattgtacgtttagtatacagaaatgattagcatatcattcgataaattcccaccgtttatatgtgtgggtgtgtgtgcgcgacatagacatataagtatattatataagcagcattgatgtatgtttgtatcatgattaggtccacaaaagtgtcaataccatcattaatgtcaatataaatggtaacacgtccccaccatataatgcctacaaatctacattaggtgcacatacataacaatttgcgtatatgtgtgagttcttgtcgattcatttaattattcttctataaactatttccaatagatggtagtgatatatgatatcatgtcaacattattggtaattttctttacaaaaaatgattaaagaaaacacacaaactgctaactttagtataaaatcatcacccaaactcttctttaacaaacgtaatcattttcttaagaagattagaaacactaatcatacgatttactttttctttttgtcaacataatcatatgattttctaaaattatattttgaagacttttttttggtgtttggcctcgagtcatttatatttctttctcttttgagtgtgatttaataatcatgagaaaaaagtccaaccaactttgaaatagtgagaaagctacttggacgtctgttttaactccacgtgtcaagcttagaacatttaaaggttttgcttacaatttttatttatttgatccaaccaacaccaacccatctcagatattttcgccaatcataatcagagatcaaattataacggtgaagctatttttaacttgtatattaaatagtaaaatatacatgttacacatccggatccgtggcgcaatggtagcgcgtctgactccagatcagaaggttgcgtgttcgattcacgtcgggttcaatcccccgaactatacacccggtttcttttttcggtatgacatacctatgtctccactgcacgacgtcgttcagcgatataacactaaacgacgagacatctgagctaatttagtgaaaccacacgcagtttttctttgcaagccttaaactttttctttctttctttctgatactgatactgatagtattgagagactgactaaaaagaagaactagaattacaaagataaagtaactgaaggagaaaatctattaatcagcaggctcttcaggcttcacaaagaactctatataagcaatccgactcggtggctgataccctgcggattccacttgtggagctaaagctttagaaactgaaaccaagtgctgaactttcaacattcctcctcttcctattgttagtttgcttcccctgttttctctcactacgtttcccggtatgtttgccgttgttgctttcaaaaacttgtatttgtacctacaatcaacaatgagaagtttagcaaatgtatctggctactattcttgattggtaaatcaagcgtaggagcgtgtgttttaaccataaagctacggtagagaaagaattgagttcattgttacccgtaagagacttcggtatcacaatgaaaggcaaggagaagatctgtgttggcataatacatgaagtctatctgcaaagaggatagatcgaaatatgttccttgattctttcacattaagataatatacatcaccaagaaacaagtgagaaacaagacctgcaagtctccatgtccttctcctctaaagattacacaagggggttccttttgaagactgatctgtacacttgaaccaggccattcaagatcatctattgcttccttcaacgccgctgactgatagatacattatcaattaccatttgagaaaaagctcagactaacaatgttaaacgaaaaacgatactaaactatgttactacctttactgtaaaagtaagtggcgcgattcccgcctgctcaaagttgtagtcccaagtaacagtttcgggaattctagttcttatctcagagtagatgcaagagtttaaggtatcaacagatctaatcaaacactcacaccaatcagctaattactcgtaatccgtatattcacaaagcaaaggatcatagtacacatacttgagaagaagctccatatcaggtcctggatacttgatttctatagtattagaatgtccaggtgatgaaaatgtgttcaagcaatcaacaagaagccctaagctgattccgaatctcggcctaccttgagctccatactcgtatttcgtgaatagctactcatataacacatcaaacagatttcggattcaatcgaattttaggggtttagaaaatttaagataaactcagaaatcgatacctcgcgttgaagataaactttggcttgaagacaacctgattcttcaacaatcaaaactattccgtgttcagataattctactaaagcatcctggaaacggagaagttttcagaaaatcaaagaagaaccctagattgaatttggggaggatggagataaaaacctggtggcgtttccatcggacgcaagtgagtgcatcgaccattccttgaacattatcgagctggcaaatcaggtccggtgtgtctggttcaatcgccggcgacgaggacgaactcatttctctctctctctctcactctccttcctctgctttcccgccagaaaatgtatgccgacaatatagcaattaaattgattattattatatttgttttagcaggcccagttattaataaagttgatctttttggcccacacacaaactaaaaagaaaaataaaagcccatctttatgatatcgcgtttatatctgagtcacagagaaataaaagggtatg

SEQ ID NO: 6710 - DNA, 3000 bp, Unknown; identical to SEQ ID NO: 6707
  misc_feature (1)..( 3000): cDNA_ID_1815301_gDNA_ID_1621101_Annot_ID_171423 3000 nt of promoter + ATG

SEQ ID NO: 6711 - DNA, 3000 bp, Unknown; identical to SEQ ID NO: 6705
  misc_feature (1)..( 3000): cDNA_ID_2173453_gDNA_ID_1621101_Annot_ID_171422 3000 nt of promoter + ATG

SEQ ID NO: 6712 - DNA, 3000 bp, Unknown
  misc_feature (1)..( 3000): cDNA_ID_1013294_gDNA_ID_1621101_Annot_ID_171421 3000 nt of promoter + ATG
tatactcgataacaagaaacaagagaccaatagtccaacagactaaattgtaggaacaaagagagtcgtgacaaacatatactcattgatgcttcttgattgatgatgaagcacttgtccatgcttttatgagcttggggaaatcaaactgcgagcactataataacaatcatgagcacgataccaaaaatcaccaagagcaagcacgtctacaagaaaaagaaaaaacaatggaaagaagaagttagtaggctgatctgatcatccaaaatcctcaaaaacacatttcatggtacgatcaaaagctttaatatattaccagagaagaatttgatctttgtgtctttgatgccttacgagatgggattttccttgggcagttgcagcgtaagagttatcgatgtgagtaccaatatcatctacacaaaaataggtcttacgtcttaggttttgaagacataagtgagagttttagcataacaagagttggaatcagttttacctatcatgtttccttgatcgtgcaccaacactgccaagtctttgaagatctcgtgcacctcgccaatttgctgctgaatttcttgtatcccttgctctctttcctcaataacagcctcattgaacgcaatctcattgtccaacagtacaagttcttgtctgcaacaaaaaacaacaaaccaatcaatagataactcatcaaccgaacaaagatggacaccattgtctgtataaactaacctttttgattccacaagaagggcacgctgctctggatgcttatctccattcacatctatctcactggatgtgtagctacattaccaaagccaggaaatcaatacacaaaaccacaaaagtaaacataaaccatcaatgagcattaaccttgagggaagagatggcttgtggacaagaggagcatatacggtttctctttcagcagcaagacgctgagccttttgaaactctttcaacacagcttgaaagtcctttgcaagcttagcatccacaatcttcttcttttgctaaccaaccaatcaaattcctattaatcaacagaagtagcagaagaagaacaagaatcttcctttatcataaatgactcacatttacacctctttgatgatcagtttcactagcttctttaagtttagctgatgtatctttcactaactgtccaatatataatcttgtcttatgcctaaaacaagcaaattgactcaattagaaacaatttcaagtaccctaaaactcaaaaaggagataactttaactttgagaagtacttacagcttctctctgagctcaggcgtatctttaggagtaccaagagtattgacaagacgatggaaagtggaaacacttgtattgatctgaaatataccagaagcaacatcttgagtcgtgtcttgtctactaccaccaccattgatgttccttgaagaagctaatgatcttcctcttcccgcctctaaatcttgaaaactcattctttctctctctttctcgaaaaccccgccactaaattatcctcttttattcgcccaagaaaacaaagcaacaacaaaattcgatttacagtcgataacggagatcgagggaagagaggatgtgatggtgatttcaagattccccggtgagtttctctctctccggacagattgagaaaaaacgtgaaccgcggagagagagattgagcaaaacgtgaaatgtcacattacctgtatgaacggaaaaagcttgtacttttttcattttttgatccttaacttttctataatattccaaacgtgactctatagtttagaatcttaacggtatatcctccttttattataaagtgataaatggtctacgatgattacattgctctgagctcaggacacgtggatggtagacattggtggagaaagtgattatgtcacgacgttaattgattattttaaccaagatactaacagattacggattaattagaattagattaaggattatgatagattagtccagaatttaatgaataaaatctctagatagaactttacgtgactaaaaagggtcaaaagcaaaagaagtttaaaattaggactcttttttaatcatcgcacgtgagaaggttccgaccatatcacgtgccaaacccgaataagactcgtttttccaaggcgtttaaaatcaggtcccacttttttcttttatttttcactcttcttcacatcaaatccgcgaccagagatttttctttcctttgatttttcgtttcgtttcgtttcaaatattgttcctcctgtgtgaaggaaaaacaatcttccatttcaatccgcgtcaacgcgattttcttcatgacggtgagcttatctaatctcttcgctttttgaaactagttagttttggtttttgttttggatttatcctgagaaaggtcgatgtttttgctgttgatttgattgaggaagatgtgaacagatctgttgattttgattgttgttttctaatttgttttgcgagaaatggcgttgattattagtgaagaatcgctagtttttttattttagaggatttgaagctgttctctgtttttgatttgggtgaaaattactgtttctgatatgaagaaatttttttttagggtaaaattgcttttgtttggattaggatattcactttagcatttgttttgttttgtaatctgttaatatctgatctgtgccataggattagttttgagacaagtatttgcttttcctagattctgaggttctttttatcttcttgtattgatgatgcaatgtttctgtgttttctgatcattgtattgataatattggttgctttaggagtgtgtgtgtgtgtgtttagtcattgttttaggcgataaggaatcgagaaatgtgtaatcgaacaactaatgaataagtctgagattttgtttagctggtgaaatggtttgaaattttagtttttaagtcacacgagattatatttcacttgcagatg

SEQ ID NO: 6713 - DNA, 3000 bp, Unknown; identical to SEQ ID NO: 6709
  misc_feature (1)..( 3000): cDNA_ID_1815297_gDNA_ID_1621101_Annot_ID_55889 3000 nt of promoter + ATG

SEQ ID NO: 6714 - DNA, 3000 bp, Unknown
  misc_feature (1)..( 3000): cDNA_ID_1815286_gDNA_ID_1621101_Annot_ID_55892 3000 nt of promoter + ATG
gttttgctggaaataaccaaacatatgcgtctccaagagacacgatcacggatgtttcgcattagtataggacaactctttagaaacttttgcaaatggatattttatatgcaattatgtttatttgtttcaaaactcttgtgtttgtattctatattgcgtatagacaaacctttggtcgttgttcatataattttacacgttaactgttttttccaagattttccatctaccgaattatatacttccttgtcaagaaagggagataggagcaggagaaaatttatcccaaactcatctctctttactttattgaccataacatcataaatactgttacatatatttttttttttcttttttttttttggcatttgacacctactaatttgatttcttttggtattaagtgaaatcaaaagtctctttccaactcaaaatttagctcaatagcaaagaagcaatctttgtcttataacctattgaacgatcccaattcataatttgaatttgatatactgtgaaagataaatttggtctattagaaatcgacccataaagatataagatttggatttagggtcacggaaagatctacagcaaatccgcattctgagtcaagctagagaatattgttatcaccaaacgagagaagagttcacgattttcatcgttatccacacaaaaacactggtgatgggacgagttaagcgttacttctaatatagtacgaagacatcattatgccaactaactcagtatgcatgttctgattatgtgttttagagatcacatccgatccatgcagttgttatttttttttgctaaagcacatccatccaacgtacgtacgctaacagttgttctctaattgaaaccagtttccagcttttatgactttaacatacgttggatggtcgttggaacttggaagatactcttggtgcctcaagcgaccttcactgttttctatatggtgcaagtttataattcaaagatcgatcggtttccaaagatgttcaagagtaggaacaaaaatccaaacaagaaaaaagataaccgatctagactgaaagtttatacaatgttatgaactcatttgaattcggaagtcaattttagctacagagaccgaaagagtgaagcagccattgaattacaaattgacgactatgtatctgttgcgtaagccgcgtaacaataacattacatagaattttaaggcttgtcttatctatactcgttgacaatgtcaaataaatatagcataggaattttatactatatggtgctactaattacatggaacccttaatatatacgactgtttaaatagtcaacgtgataaatagagagttggtaagtgtttggttttaatttgacaatgtgaaacaagcctgaacattgaccctttaaaccataacagtaatttaacggtaaaaaaatagtaattaagtatgtaaacaagatcttccgtgagagtgaaattaaacctcattatttaaattatactagtaaacattttctccaaccgtaggaaatttcgttttatgttttttttctaatttgtcgtgatccttctcattcctttgaagacaacaagattctattatgaaagattttttcaaagatccaatagtataatacaacgtaatatataataccaactttatagttacaccttctaataaaatccacttactcgtttatgtgttcctcacgctatcgacttaatgtttggaacccgcgagagaagttctttaattaaattagtcaatcgaaaaaagctatccatttcctttatcaaagtaaatcaattcgaaaatctcgtattaacttgatcatccaaatccatatgtatattttcgaataatataaaacagaaattgagataacctatactaaagagagtttcacgtaaaaaatttatattttcacgtaacaaaaaattacaaaacaattaaacaaaaaacaaatgataatagcataggtaattttttgtgacttgaaattcagaacgtatggtaggcacaaacgacggtttggtaacaataaggagaataataataatcttcgtttgaattcaaatagaggaagaagaagcgaaagggtaggctttgatcaaccatgagacattgaagcaggtagagataattctttgaatgcggtggaagcaatcacataatgataaatgcaagattccaattttgatgaactttgcaatgagaacataatattgcttttcaattaaatattagttaaatatacccttcaagaaaagtagttaacaagtttaatttataatcatgcatttatgcgaaattcttatttgtaggttttaatctaaatagagaaatatacacatatataggaaatattcaaaaatgatcacatgcatgtttaatttttgaaaaatgtggctttcttttataacataatttcaataagattagtttgaattgcagattatgaaatagtatataatttgtgattgttttacaagtaaaagagcgtaagaaatttggtcccaaaaaaaaaagattttagtagggaaatatcaacattttattctaacatagctagggcaaatattttatacatctaacccacaataacaaaatccattaatgcattaacaattattcgtattcttttatataaaaattatttgtttgaacatcatccccacgaattactcttcgaagttcgaacgccatgacacatatcatattatcagtacctaatcttgattttgttataactattttggttatttaactgatttattgaatgactcatatattgtagacttatgacacactatgaaaaataatatttacaccaaattctgacgaatgcatacacaactttactttagttatgtcatgactgcttttcacatctatatatacatacaaacctaatcgtagggagcgacgaaacgaagatcatatcttcaaaaacctctgataagttttggttcttgatataaacaaaatg

SEQ ID NO: 6715 - DNA, 3000 bp, Unknown; identical to SEQ ID NO: 6708
  misc_feature (1)..( 3000): cDNA_ID_1815282_gDNA_ID_1621101_Annot_ID_55895 3000 nt of promoter + ATG

SEQ ID NO: 6716 - DNA, 3000 bp, Unknown
  misc_feature (1)..( 3000): cDNA_ID_1815379_gDNA_ID_1621102_Annot_ID_55898 3000 nt of promoter + ATG
acatgtaacccatgaaatatcactaacagttaccgggaacattgttttgcagtttcgtttcagctatatgatcttaagcagcaaggtttcatagagaggcaagaggtgaagcaaatggtggtggctactcttgctgagtccggcatgaacctgtcagacgaaatcatagagagtataatcgacaaggtgtggttccttcctaccctgctcgatactatattcttgttccactgttgtatagccaactcatgatagcagttgagaataaagtaaagagtggtttctaagtttcttctttcacagacatttgaggaagctgatacaaaacatgacgggaggatcgataaggaagagtggagaacccttgttctcaggcatccttcccttctaaagaatatgactctccagtatcttaagtgagttcctaaaccaagacttatccgaggtttaggcaatgcaacttccaattttttctgtgttattattaacaccgatctctgatattgtgtgcagggatataacaactacatttccgagctttgtgttccactcgcaggtggaagatacctgagaaaaacaatagcatattagcagaggagacaatttgggaattgtgtttgttttctgattatgtatcatgtctatttgtttcaatctctctgaacattttcaagattttgttgttacttgtgtgaattaaaagtaaagaaaacaaatctgtatttttgctactcctgattttgattgctgattttctcctcgcatctgtagatatactactaaccttgagacatgaatcctattaataaagagcaaactgatgaagtgataatagagagcaaaaaagagagaacccaacaccaaatgatcgggtatgctctagtctgaattctgaagtcaaaattgaaatcaccgatttgatcgaaccggatgcaacattacaacaatcggatttgttagtcttgtggttgactttgtcagttagagttgacaaagtaattagcaaagttagtgacgattgtgttctgcataaacacgtttactttgaggaataaattacttactctttcggtctttcctaatatatatgttttccctgtctcaaagatctgaataggtatcagagcgcgttgacaatctctttttttgatcatcgatttgttctctctttcttggctaaaaagtttctatctacacgactctccatggattcaacaagaaattcagcttcttccaactccacgggatgctttacggatcagaaaaagcgaaaggcactctatgaggtgtttaagaaactcagcggtgttgattgccaaagaaacgaggttcgtataaattatatgtaactttcttgctaagtacgcatatgatataaatctgtgtttcttcgttcagggtaacgttgtagaaggcgtaacgtgttattatggtgaaatgaacaaggtatttggaattatatataaatatatatgtctttcttgccacgcactccttcttttcaacaagtcttacagattttccataacgtgtcctgttgtatttctgttgtatcaggaacagtttcatgtagccatattccagactgacaaaaatgagagcttgttttcagagagggtattttatttttgttctcaacaaaaaaagtctttgtaatccatttgcaaacaatgacattaccctatcacacaggtcttcgatttgttcgacacaaatcatgatggattacttgggtttgaggagtttgcccgagctctctctgtctttcatccatctgctcctatagatgataaaattgaccgtacgtctctgatctcaaaaactagacccgatatattaaccatctacaaacaaactgttcacatgctacctatatatattccatgaaagcttattaacggttacctggaacattatttggcagtttcgtttcagctatatgatcttaagcagcaaggttttatcgaaaggcagggggtgaaacaactggtggtggctactcttgctgcgtccggcatgagccagtcagacgaaatcgtagagagtataatcgacaaggtgtgttttccttccttctattttttggttcgactctagtctatagtatagccaactaagtttaagcagctgatgaatatgaagtgaagagtgatttttgagtttatgaggcagacatttgtgcaagctgacacaaaacatgaagggatgatcgatgaggaagagtggatggacctagtttttagacatcctcttcttctgaagaacatgactctccagtatctcaagtgagctcctaaaccaaagactaacccgaggtttagccaatgcaacttcaaatttttctgcatcacgtattattaacaccatgatatctgatattgtgtgcagggatatcacaactacatttccgagctttgtgttacactcgcaagtggaagatacctgagaaaaacaatagcatattagcagaggagactgtttgggaattgtgtttgttttctgattatgtatcatgtttatttgttttcaatctctctcaacattttcaagattttgttgttcctttgtgtggaaaaaaaacaaatccgttgatgattttctcctcgcatctgtagatctactactaatcttgagacatgtaaaagcaaactgctagagcattgaaagggcaaactgctagaaaaaaaagagagaagaactcaacaccaatgatcggctatgctctaatctgaattctcaagtcaaaattgaaatcgccggtttgatcgaaccggatgtatttaacaaaataaacaaaataaacaaaaaaagaaggaaaaatagatcctcacgcgttaccgtagcgcgtatttttttcacaacaaaattcataagcagtgtgggtcccacaggtccactaagtttagtggtgggttgctccgtagctaatctcatctctcactctttttcttatccactatccatagaagaagaagaagaagactgttgacgacgacggcg

SEQ ID NO: 6717 - DNA, 3000 bp, Unknown
  misc_feature (1)..( 3000): cDNA_ID_1815375_gDNA_ID_1621102_Annot_ID_55899 3000 nt of promoter + ATG
tggatgaaatgcccacttctgttcacacttctgcactactgccactacattcttggactgcttctgccgctatattcccaccacaagggaccattcttttattattagacaaaacaagttaaatccgattgaaaagtatacagacaaaaccttctactatagaaataaataacccatatcatattctagattagatccagcgtaacaccctttattaattctcacttaatataatttattggagcagatcaagccattcaacaaagcctctctctcatgtgatgagatctctgacctaattgaatcgtgattagatctagatcttgttacattgtcttcgtcaattatccgcacttaaacatttcttcgttattttacactattagtatacgttgtaacacatatttcatctttctgtactaataaagagtacccacccataaactactctttcataaacaaatgtcttcatcaacaaatgtcttatataacgtgaagtttcatatccaaaccactggttataaagtgttttgtaacgttaactttcactattagactcatcaatgtttgcctatgtaatcatacaacagtagtagttgtataaattataaattggtgtagagaatttaggaataatgtttggatgaaagggtgttgtcacccaacaaggagagggaccattaataaccgataatcataataagatttgtgaaagaaatgtttcactgatttggcagaagtacagttggaggttctttgtcttttctcttctgcaccttttgttctctttacttccttcttgtttgttggtttttgttcttttcttattttttttccctaccataaatggaccattaccattcatttctctctttttcttattatttgctgtatttagttgattttgttatatccgtttaaatttgtgtacatataaacaacgacgtctataagtttttataacaaaaaaaaggattatgttaggtgaaatttcgattcgttttacgtgtaggatcaacgtgaaagaaagtcgttgtaggtatgaaaaatatggaccgactacgatacggctgcttgagaaaattagatgtataacgtaaagtgaaatagtgaatgttaaggcaattagggaaactaaaattaaatattcaattggtatgtagggaaacgactttttatttattcacatgcacatgacctctctatgtcatgtgccttaagttgccgtgttcgatctttttataatttgttcgacccgttaccctaaatttaaaaatcatttctatttttttattattatgtccaaatctgatttctttttcatgtgtcatatatataaaactcattttaattaaattacaaatttgaaaaaatatttttttttgggaaatttaagaccgacaagatgagcaagggacatggttgtaaactaattatttctttaattaatcagtcacaaaaattcctagcttgcatgtgcaatttcactctccaagattccatgttttacttcaacttttatcactagtttatactatcaaagactcaaagtagatgatctgtattctacgctaatagtaaataattttaatataaccactatttacccacttctgttttctctcaaaataaaaacagaatccacattatatacatggtttcttgtggttactagttacacaatgtactagctacaagaagtgcttctgattaaaccatgtacagttttctagttcaaatacacatggttcctcgttactagttacacaattatgtcgacattcatgggaagttcaagggatttggatacttcaattcttactatgagaaaccctatttaaatgtaactactaaaacacaagcactttttgtcgtggatataattggttaaaattatcggtgcgtttaatgtgttgagaattcgttgaacactttattacctattattaaaccaaaaagaagcattaaagttcatcgtgccgctttaagatccacaagttttgtttcttcgattcttcgtggtgaacgttgcagccatctttgggctgtactattgtcattatatttaacgggtcttttcttttgtaagttagagctagtatatatgaattaatgatatagttaaatttaaataacttgtaatgctcggtctaactcttaaaaaaacgtttgaatgtgattgaacctttcgtaacagtttgatactagtttaatggtaaaactggccacatggaacaagacgtcaagacctataaatgatcgcaaccttttatcgaagtggagaacacttctcgttcacatgttataagatcatgatacgatgctctctgattagtggattggagtgaaatttcgacaaaattcgtacatgcaaatgtcgtaaaaggcaattacaatatagcagcggaaaagagaggaggactatttgacatgtcggtctcaaaaccatgaaagttggtgccattgtaagagggctattgttttgacatgtcattcttgattctcagatttcgattttcatataaattatagcatactatttttgttgcataatatttgattattttcttactttcaaaaattttggtggtcggccataatatgtttttccaataaataaataaaaaaggtttatctatgtaaggtatattccttgaagtcaaatccaaatttaattacaggattatgtttcaaaacgttatctaaaacttgatccagctatttcaagagtgaactactttgtaacttaattaggactatttagggtaattgttttttcaattttacaaaaatcaaaagcaaagattaaaataatactaaagggttagtgatagaaactttgttgggatcaaaaaccttcctttgctacttctctctctgctctgtgtttatttatatatttcctataaacaaaataaaaccaaaaccgatggattggttcttcgctttacaatcccaacgcacttctctcattcttcttcctcatcttcgtcttctccg

SEQ ID NO: 6718 - DNA, 3000 bp, Unknown
  misc_feature (1)..( 3000): cDNA_ID_1017738_gDNA_ID_1621102_Annot_ID_55900 3000 nt of promoter + ATG
gctctcctttctaactgcattcctagaaaatattaccctaaaggcctttgtcttggcatcctcgtcctcttcagcaggaactcatctgtcttggaagaattattaccatgtctgcttttgtcagcaaatacgaaggtaagtacacttaatatgcactcttctcttcgtgttccagtaatcttcagttctccattttatgtgctttctgagttcagatgagctgatcaagacggccaagtacattgcaacgccgggaaggggcattttggcggcagatgagagcacagaaaccattgggaaacgattcgccggaatcaatgttgagaacactgagtccaaccgccaagcttaccgtgagctcctcttcacttcccctggcagttacccttgcctctctggtgttatactcttcgaggaaaccctctaccagaaaacctctgatggcaaacccttcgtcgatctcctcatggtccgtctcggaaaaagcaaactccagctctagtcttagtcattgggtccaagagttgcagagttgaagctcttgacatgacccaaatggaacttactgtttcagtttggatctgatttttctttggatcaggagaacggtgttatccccggaatcaaagtggacaagggtttggttgatctagcagggaccaacggcgagaccactactcaaggtctagactcgcttggtgcacggtgtcagcagtattacgaggcaggagcccggtttgctaaatggcgtgcattcttcaagattggggccaccgagccaagcgttctctccatccaagaggacgccagggtgctagcccgctatgccatcatctgccaggagaatggacttgtcccgatcgtcgagccagaggtgctgacaggtgggagccacgacatcaagaaatgtgcggcggtgactgagacggttcttgctgccgtgttcaaggccttgaactaccaccatgtcctcctcgaaggcactctgcttaaacctaacatggtcactcccggctccgacagcccaaaggtatccaaactagatgttgcaatccggttttgttttggagtcgttgttttattggtcttatattttgaaactgaaaccacaaccaaactgtatcggtgtgatgctattttatttaaatttacatgcccggtccttacgtaaccacaatcaaatgaatcacagagacatcaatacctcgaaatgcaacgttaatttgctacaaaacgctaaaatagttcttcttacaggttgcaccggaactaattgcggaatacacggtgactgctctgcgccgcacagtcccaccagctattccgggaatcgtgttcctctcaggcatacagcgcgaagagcaagcgacactaaatctaaacgcaatgaacaagcttgatgtgttgaagccatggacgctcactttctcttttggcggagccctccagcaaagtgctatcaaggcttgggccggtaagcccgagaacgtagccaaagctcaggccaagttcctgaccaggtgcaaggctaacaaggacgctaccctcgggaaatacaccggctgggcttctggtgactcggccgctttcgagaacttggttgtgataggatacaggtactaggatcctttgagaacgggcgtttgcctttgatgcggtttgagtagatatctaatgtttcgtgtgtgttttaactgtttgaatgttcaattttgcagactgctaataattgttattttccggttactgtcaaactatccatgtgaaattcacgttttgaaaagctaataataatgtttttattgtatgagaataaatttagaaaactaaaaattgttaaggacatattacaagatatctcctcttttcgctttgctctagtgcacattgttagccaattcaaacacacttgaagtgcttaatgacactgaaattgaatatgatcttgtccggaaacacagcggctgaagctatcaaccttcttataagcaatgggcgtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccataaaacatcaccacctctgttgtcatctcatgaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaaccatg

SEQ ID NO: 6719 - DNA, 3000 bp, Unknown
  misc_feature (1)..( 3000): cDNA_ID_2990142_gDNA_ID_1621102_Annot_ID_55901 3000 nt of promoter + ATG
actcattatcatattgttacttgatgtttataaatttgagattcctttttcattttctcactgcctctttctgtaacaatagcaatttcttagatgtcaccactggcttttatctggttggggatttaaggggagatcaatttaatcttatttgatgctaggattttgaaaaacattctgcaggtaaatcctacagatgtaataattcttgaagggatacttttgttccatgatccacgcgtccgaaagttgatgaacatgaagatttttgtttgcacaggtaatttgttgcctcttcccgttataattattgtaaactcttgtttcgactacattccatttcccttttgtagattcacttggctttttttttctacaaaatttcacatgatggaacaacttcttatgctttaagattttgctgtttcacattgcttattttgttttctgcgtagatgctgacgttcgtttggcaagaaggataaaaagagatactgtcgagaatggtagagatatcggcacagtacttgaccaggttagcccgtcttagtattgttactgtatatattatcatcaagaacaacaagaaatggtttacctcttgcattttaaatattacattgctctgatctgtatgtttttttctcatattagttcggcgttttcaaatctatatgtttctacccatattttatatgatgtcaaccttttgatgcagtactcaaagtttgtgaagcctgcttttgatgacttcattcttccaacgaagaaatatgcagatattataatccctcgtggtggggataatcatgtagctattgacttaattgtgcaacatatttgcaccaagctgggtcaacatgatctctgtaaaatatatcctaatctctacgttatacactcgacatttcaggtaattgatatatcaatctcatctacatacgagtaacattctcttaactaccaaacaagatccagaaaattgatttctcttgcagataagagggatgcacacccttatacgagattctcagacaaccaaacatgattttgtcttctattctgatcgattgattaggctggtaggattattaaagctcatttaaatggctgaccaaattctcctatcacgtctcatttctgttgtctgagtttttttcttatatttatcaggttgtagaacatggtcttggacatctgccttttactgaaaagcaagtgattactccaaccggtaagcttggtgatttttgtttttgcagtgttgttcgtgaattcacaagattattatgtatatatttagaggttaaactcgtgactaataggtcatagatatcccggttacctgtctcaggatgtgtgtattctggtgtggatttctgtaaacggttatgtggtgtctcggtgattaggaggtactttcctatatcttagctttagtttatacaataggaacttccccatcctttcatatcccactctctcaccaacttgatggtgttttgaaataatgctagtggtgagagcatggagaatgcgttacgagcatgttgcaaaggtatcaagatcgggaagatcctaattcacagagaaggtgacaatggtcaacaggtaaacgagtcactcctatttcattccaggtgttctgtttcatcactgttgatgtctgtatcactgtgcagcttgtttatgagaaattgccaaatgatatctcagagaggcatgtcctattgttggatcctattctcgggacaggtaattaacccgtctttcttcatcactttttactgaaaacattttatttcatatttctctttgctgtaatacacatttgttagccaattcaacacacttgaagtgcctagtgacactgaaattatacatcttgtcaggaaactcagcggttgaagctatcaacctccttataagcaagggcgtacctgagggaaacatcatatttctaaaccttatctcagtaagctaacacacaccctttgcgtatcatttatacaccccttgtgattactccttatccatgtttatccacaagaatgcagctggattgagatattttttttctttgttcaatcaggcacctcaaggtgttcatgtggtctgcaaaaaattcccaagaataaagatagtgacatctgaaatcgataatgggttaaacgaagagtttcgtgttattcctggtatgggggagtttggggacagatattttggcacagacgatgactaggccactgtgttcctgcagcattagttgtcccatccatgtcctgcatagcagtttactgatgcattcaccatcctattctctacaacggctacacaaactatcaaaggaatcacctttaactttgttggttttcccatttaaaccccctcaaggtgttgggaacagttttgtttacttataaatgcccaagtgaggggttgatcgatcccgggacttgggattcggtgtaccatatataattacccttggaactcttgataattcatctacaactcttgtgtaccatatataaatatccttggaacccttgatactccataagcataatacatttggcttcgaaaggaacatgtgggccaatggttgcaccacctctgttgtcatctcatgaattcaggttcggacctggtctctctctctcccaagtgggaggtatatgaacggcccaattatgacaaaaggaaagaaaattatatttggcttcaatgtccaatatatctaagtttggtggtgacttatgttggttgaagtgtgagagaggtattatagaaaatactctgctcgttctcctccacatatccaagactttggagataatgctggtatccttggctagcatttggtagtgtcgaagcaatcattcctcgggctctcctttctaactgcattcctagaaaatattaccctaaaggcctttgtcttggcatcctcgtcctcttcagcaggaactcatctgtcttggaagaattattaccatg

SEQ ID NO: 6720 - DNA, 3000 bp, Unknown
  misc_feature (1)..( 3000): cDNA_ID_3091954_gDNA_ID_1621102_Annot_ID_171468 3000 nt of promoter + ATG
ctgaccagatagatgattcgaataatgagagatatgatcttggggtccattcctgaataaaaactccaagagttgatgtgagacattagttgagtgatgcttgatatgagccttgactctggctttcgtccctcctctgcgtcaacgaggtcgtgtatttgattaatgagtgatgccatctccgaatcctccgaatcctttatttccttgaggatacgagatattttataagtgactgacgtgagcctccattgtgactccgtgggatccaagtctgtagagctggtgatagagataattcgagtcacgagtgataccaactgtgactctggtccagaaacaaccttgctgagagagattatttgcctaacgagtgatgtgatcttcggctcctgcttcggctctgaattcgaatccatatccagtgattcgatgagaggaataagttgattagcgtatgctatgaaatctcttgccacctcttgacacatatcctcacctcttaatgtagatatcattttagaaatgatatagaacatgagctccgactcccaattcatatcatctgtatagccgtagataagatcatctttttcttcttcttcggtggtgagaggcggcacttgttggttattgatgagcttctgttcctccgtctggacgagactggccacctcagaaaggagtgaaaagagctccgattcctcgtccattgccatgatgagagcgaatatttgagaagtgagtgacatgagctccggctctgactccttgagatcaaaatctatagagccgatgatagagatcattttagtcaccactgataccgactgcgactctggtcctggttctgaaacagagttgctgacataaattatctgcttaattagtgatttgagcttcgactccggctccggctgcgaatccaaatccagagagttgaccagagagattagttgacaagtaagtgctatcaactttgacttcagctgtggtgtatgtgtgtcttccccaccgcctaagatagataacagttgagaaataagagatatcatgagctccgactcggaatccatagagaaagggattgtttgaatattgatgagtggtatgagagatgattattttgagtataagaaacttactgctctctgtatgtatatatagaactcgtagcttgtcggatcacgtgacaaaacctcaaagctgtccgaatactaagtcaagccatcaatttatagagagataataatatctcaattatataacgactagaaatttagcatcagatgtgaggcaaggtgggcctatcttatttcatattttattcgaaaacaggattgccttattaatgatcgtgtactgtttttagttttggtcaaatcatttaaacgataaactctgaattttgatagcgtcatgaacgttaaacttagggttttccacatagtgtgacataggtctatttttttaccgaacgtagcttgcgggtctttctttattatacataactggaaataattgaagcagtacggcattacaatttagtcacgtcgttcgaacgaaaagtcaatgatcgatttttagagataaagatcctctaattaacaatttatatttttcgagtttctagactacattaattaagctcatacgtatattaccgttaggtcggcctgtgcacctttcacatttttattgaagaagttatgattaacgaaatggtaatatatatcattaacaaaggataatactaatatgtttgatcaagcagttacagtgaaccagcggtaaagtagagaaatcgtcaaacaaacacttttgcatgtcgatttctgctagtgatattaaagatcatggaatctgattatgtggtaaagaaacagctcaacaaaggtttgaaataattagttaacagtagacattgacttcatctaacgaaagaccaaatcaaaaccactttcaacaaccacaatgtgtagaattacagcagtttcgtgactaatacgcgacaagtgttaattttaaaacggttctttagtaaacattaaacaataatcttccaagtggaggaatacttgatatttgttcaatcgcatatatcaacttttgagttctataatattgttcccgtagcttgtggattttgtcttggtgtaatgcttaatttgagatgattactaaaaccaaaagcatgagatcatcttaaagtttacaggcgagcgcaaagtcaatgaaggatttaaagattagaaacctaaacgatgttaaaaggtcatgacaatttatattcgagttatttaggtcggtttatgggaaaaaagctgaaaaatctccatttaattttaatttgcctatttaatatccgtgctactaaatttgtccaaaatacctaaattagtttttatgtcttttaaatatttttattttttattttttttgacaaaatcagacatccgaattaacgagcgttaacagtggtaacaaaatcgttatttgcagttaaaacttaatcatgtgatgtttattagttatatacaattgttttttctaatgcatacgaatatatcgttttagtcaagtagttatatgagagtttattatcttcatgaacacgagtacgagtcccatatccgatgtttttttgttgcacttgatacttgtcttgaaagaaaactgtcacagaatcacaatctacgaaattccgagagaaatatctaagtgcaccacttagaaacgtagtggcctattagctcagttggttagagcgtcgtgctaataacgcgaaggtcacaggttcgatccctgtataggccacattttttggctttcattttgatcagactaaaacgttgtcgtgtgtttcagcttctttttttttttttttttttttttaatccttttttccggagatattttgttttttttttcaattttacggatatcgttatctgcttctcacactaacacggcgaagcagaaaaagagctcgaaacaaaa

SEQ ID NO: 6721 - DNA, 3000 bp, Unknown
  misc_feature (1)..( 3000): cDNA_ID_1815332_gDNA_ID_1621102_Annot_ID_171467 3000 nt of promoter + ATG
attttcgattctttttcatcatggcgcacaagctcatcttcttcttcttttgtttctgttttaactgggggtcctccaaagctcatgtggttgtattccaacaaagaactcttgtcaaactcgtatccaggctctgtacaaaccgaacaatatgcattgaagttatatcacaagcagttaaatcacgaagaatcaagcaaatgatccacagaagttacaatgagattcctacattcatgactgtgttgcagatggaaacagaacatgataacaaaaaatacgtttggttgatacttacctcttcttgcgtttattctcttctcaaagagacgaattgggtcagagccttctaagcatgcggcataaagtattacactgtcaatatcatccagcaacatgatcagagagggtagatacatcattcatattgataggagataatcatatcaaagttcaattttttggctgaaatcaagtaaaaagagagaactaatggcttaatacttctaccctcgagaaaaattgactgttgagtgaggcaaggttctgggtttagggttttaggttaaaccttaaaacccagacaatggaacactaagttgagacttattcttgtcacaccaagccgcatagatgactgaatcgtttccaattctagtaaaggcgaattttcatttgcagctaaaatttccaatttttttcaaatcaacgaaacgattacgatttcagaaacgcttaaagtgagaaaacgaagcttacagagcgagctcgcgtgcggctcgaggactgcttaatcggccgctcttatcaatcttcggcatcgggacatctttcacctcctccgcggaaatagtcggcgtacggagagcgcttctagtcggagagagaaatagccgtagtgaagacgatgacgaacgtttatttcccgttcgcagggaaaccaagttcgttggccggagcgaatcaaccaatgtaaatcctatagaacggtgagaatctggtgaaacattactggagaagtaacagaggttcgaagaagaacgtaagcaaagcggcgagaaggttccctccatttttgtttcgagctctttttctgcttcgccgtgttagtgtgagaagcagataacgatatccgtaaaattgaaaaaaaaaacaaaatatctccggaaaaaaggattaaaaaaaaaaaaaaaaaaaaaaagaagctgaaacacacgacaacgttttagtctgatcaaaatgaaagccaaaaaatgtggcctatacagggatcgaacctgtgaccttcgcgttattagcacgacgctctaaccaactgagctaataggccactacgtttctaagtggtgcacttagatatttctctcggaatttcgtagattgtgattctgtgacagttttctttcaagacaagtatcaagtgcaacaaaaaaacatcggatatgggactcgtactcgtgttcatgaagataataaactctcatataactacttgactaaaacgatatattcgtatgcattagaaaaaacaattgtatataactaataaacatcacatgattaagttttaactgcaaataacgattttgttaccactgttaacgctcgttaattcggatgtctgattttgtcaaaaaaaataaaaaataaaaatatttaaaagacataaaaactaatttaggtattttggacaaatttagtagcacggatattaaataggcaaattaaaattaaatggagatttttcagcttttttcccataaaccgacctaaataactcgaatataaattgtcatgaccttttaacatcgtttaggtttctaatctttaaatccttcattgactttgcgctcgcctgtaaactttaagatgatctcatgcttttggttttagtaatcatctcaaattaagcattacaccaagacaaaatccacaagctacgggaacaatattatagaactcaaaagttgatatatgcgattgaacaaatatcaagtattcctccacttggaagattattgtttaatgtttactaaagaaccgttttaaaattaacacttgtcgcgtattagtcacgaaactgctgtaattctacacattgtggttgttgaaagtggttttgatttggtctttcgttagatgaagtcaatgtctactgttaactaattatttcaaacctttgttgagctgtttctttaccacataatcagattccatgatctttaatatcactagcagaaatcgacatgcaaaagtgtttgtttgacgatttctctactttaccgctggttcactgtaactgcttgatcaaacatattagtattatcctttgttaatgatatatattaccatttcgttaatcataacttcttcaataaaaatgtgaaaggtgcacaggccgacctaacggtaatatacgtatgagcttaattaatgtagtctagaaactcgaaaaatataaattgttaattagaggatctttatctctaaaaatcgatcattgacttttcgttcgaacgacgtgactaaattgtaatgccgtactgcttcaattatttccagttatgtataataaagaaagacccgcaagctacgttcggtaaaaaaatagacctatgtcacactatgtggaaaaccctaagtttaacgttcatgacgctatcaaaattcagagtttatcgtttaaatgatttgaccaaaactaaaaacagtacacgatcattaataaggcaatcctgttttcgaataaaatatgaaataagataggcccaccttgcctcacatctgatgctaaatttctagtcgttatataattgagatattattatctctctataaattgatggcttgacttagtattcggacagctttgaggttttgtcacgtgatccgacaagctacgagttctatatatacatacagagagcagtaagtttcttatactcaaaataatcatctctcataccactcatcaatattcaaacaatccctttctctatg

SEQ ID NO: 6722 - DNA, 3000 bp, Unknown
  misc_feature (1)..( 3000): cDNA_ID_2176318_gDNA_ID_1621102_Annot_ID_171460 3000 nt of promoter + ATG
caagtttcagctttaacttgggctcaagctgaaacgtgattaggtgttacatatatgacacagagcagttaacatggaactaaaatcttaaaaaattattgtaattaaaatggaaacagagcagttttttttatatgcaataagtcttttgatggagatacaagagtgattaataccttataacaatgaagataaaagagtgcttaatacctgatttactaatatacatgcaataagtgacacccatcagactttttatttcgccgtttagacagtaagagagatcgaaacatcgaaacatggacttgtctatgtctctctgtttttatgggttgatcacacaaaatgatcaatataataaatcttctgtagtagaaatctcttgctcttgctctctctctctctcgttcttgattatcgtttaccctcaacacaatgaaaatgtatatcggcagaaaaactacaagagatttacacagcttggttagataaaatttctccttaactctctaacaaacaaaaaagtttcaatttgttttctccaattgtgttaattaatcagttccacaaaaatcaccaacagtttaactatttttagaaatagagttttgtgcaaaacaaccttcaactttataaacgttttcaaattattttttatttttatttttttggtaaaagtagacagtgctgtgcccaatgacgtaaatgttgaagttacaaaaatagatgattttgaagatatttttacacaaaacccttagaaatatacattatactttcttttctctaaacagacacctataagatatgaaataccatttatttgtgtttagtcttcttatgtatatggtaagctatatctttcatatagtctaatcagtgcatgtccatcaataataccatgcatgagccttcctccaactattcacaacaggagctgaatattaaactggcaaattgatgttctaccatatatacctattatatcacaaccagcatagtctatagtggttttactatagctaatgtaattagtactaattaaagctagttgttagaaaaacatgagcaaaaaatctaatttgcaaactatatttagtatataagtgattaagttacaataatcaattaatagaaatacttttttcaataatattccaaccacagaaaaaaccaatttctatcattttggcagataaacttggtttcgctagtttgttaaacgaactagcagtatagcttatttgtttttgtttatatatagaagaaactcaagccagttgggttacctatcttgtttatgaattttcgttaatgtttgcaatatttctgattttttgtgaaagactaaattgtagaattgtatccacattttattctttccgttcatgtcgtagatttttagtttatgtttcggtcaacaagtcgtggagttaaaatatactatacaataaactgaaagttcaaatggaatggggttcaccaactttttaatttacttattcttgtggtcactttctttcaaaatgtactaaataattttatatattctcataatgtctaaatataaacaataaatatgaatatgaaaataaacataaatatgaaaataatttttcttttataaaagaattaataaactaacgataagtgattataaaaaatatatgtctttggaaaccaaacaaaatagtttaggcttcaatcccattaaattctcatctaaaattgatgcatgtagcatgtagatatgatcatgacaaaacgatgatttacaaatttttatttttcatttgttcgtcataaatatttgatcgtttatgataatattattattagacatgactgattgttattgcacaaataatttacattgtatatagaatttgcatcgcatttttatttgcgtatcaatggctgacactgagatttatgaggccacaaacaatttcggttttgggggcttcatgatctatatataaattttttttaccgtttgggcctcaaaagctatacatactacttgttaaaatttgggatccaacaccgatgttccactaggatatgatcagttacggattatttattgtaactcttgacaatattgcacaaaaaatttcttgattgtaaacattcgggttgcaacgtcagaccatctcactttctatcctcaaaataaaacatttccaacatgccatttttaaaattctaatctcataagcatgatattatttggacatgaagtgtatacagttatagtgtacaagcaggagagtagaagtcacgcgtcttacagatgaacttagtgctagtttaccaaagaagctgacgtggcgttttcatgctttccgtctttgtgctaataatatatggtagaaaaaacttttgagacgcaaataaaaatgcgaaaaccccaaaatcgtaatcagcagcgatcgagattttcgccgctgaaatctggagactgattattacaaacttgttcgtcgtgttcttcatcggagagacactagatcggaaaatttaacctcgatttgattgccgttgccgtaacatttgactgttgttttgtggtggggaattctagggttcttgtttgatgaagaagaactgaagtgaaaatgaccattaaaatctcccatgagatgattgtgtccgttcattcttcgaaatcggacaacggaatcgaatgatcgtcatattctgtaagagagaaggttagatcttcaccgaatctggaactcgagatccatcgttttgttcgattttctattctttcgcacaaggattggtctgagaagaacaagttcaagttagaagctgttgtgttctgtccggtgaaacttatttgagctgctgcaaaaacttcaaaagttgttactttttctgaaataacttaagcttcttggtattttgagactaaatggtttcactactcttgtgaattcctggaaatcagaactgttattagttttttttgtatatttagggacaaagatg

SEQ ID NO: 6723 - DNA, 3000 bp, Unknown
  misc_feature (1)..( 3000): cDNA_ID_1378577_gDNA_ID_1621102_Annot_ID_171459 3000 nt of promoter + ATG
acaatcagctgcctccgcctctgcctcctccaccggtgcagcgtagaagcagtggcggtgacgttttcatggaggcaggtcgtctagcaacagagtacttggtttctcaaggtgttctaccacaaactgtgctttccagtaaatggcagaatggtaattttaggaagcaagctggagagtttcagagttccaggtctcaagaagaagcccgaatggatgtttcagctccagctgcagagaaaaggaggtatattgatggctatagctcagctggatccaggaatagcttgaaaggaaggagatcccaccgttatgactcggattttgggaggagcggatcttggtcagagagaagtaaagcttttgagactgagactggtgacgactctgtgtctgggcatcaagaagagcagccgcttgctgaagatattgctagctcggttcagcggtcagcctctggtgaatttatgagaaaatgtgaaggagcaggtgattccgagtctgtgttggacaagtacaatctccaggatgaggcacagtctaagacaggttcctcgagtgccgggaaagatatagtacaggattgtgaaatctctaaagtatccgaaggctcttctagcttgagtgctggatcaggagagatgaaaggtaggtctggtggtaatggtggagaggatgagaaccagactgctatcgaagatggatctatccatcaacgttgtgaagatgcatctattgatcaacagtgtggggctgatgaatcattcaccaagagtggtattgatttggcaacgctgtgtaaatttgagaaggtgcctacgaggacacgctcttctctgactgcaaaaggcccaaagctttatttgagtcataatatcaaggatacctctcataattctggacttgaagaagaagatcaaaccgaaaatcgatgtgagactcgaggccaatcatctggaaaggccgatagtactggtgatgaaaatgaccaagttgaagattttgctcttgttcaatatattgagaacagtaaatgtcataggtctaattcttttcccagtagcattctcagggataacagtgagaaagaatcaggattagaattgcctaatctgcacagatcacattcggtggggaaagtaggtgagaaaaggcctggtgaaggcagtgacttggaggagggatcaaaaagacagagagattgggtggcagtttctgaagctaatgaacgcttcaacatgtttaaaacaagcggaaaccaatgcgatccggaagaagaaggaaagacaagctcgttcaacaaaagactgattgacggtgctgctggaaaaagggtcagccatgaaagtctggttaataactctacatacaataggacacacactggcagaacaggtccagggtatgctgaagaacatcagctgtttcctgcttcgtttaagatgtgtgacctaaatctagggggagcgtcggatgtgaatgatgggataaaggaatctcgtcaagctgttgattttgatctctcaatcagcagttctagtaagtctctcgagtttggtacgagtactcggatgagcaatggtaaagagatagaagtgattaatttggatgatgatcaagaagtggtaaagtccagcaatgatccaggaagaaagtacggccaagtcctactcttaacacttatatatacacacacctattacattttggctaatgggttttcatatctaacaggcaagaagctgctccatatatgggcatcgatgacgtcccagactacaatgaaagactcatgatggtagagtatcttgattcctttactccaataaaccagggaaccagtagtgtcccacagaataacaacacagttagccttcaagaccgagaggtacctactctacttgtcaagttttatgtcacatagaatgtttgttgttgctaacagatcctgaaaacgtctcagggagctattggaaatgaccaagtaccaaataatacagacgatgattcgatcttcatgtcactcggagaaataccattgagtaagaccaatatcaaattctttctcttttctattttagcttcttaaagagctgagattcattatgtctttgcaattgtgcagcattcttgcaagcttgggaccaacctccagctcgaggctacgagaagcctttctgattctctttttttttgttatgtttcttcagtctgtgtaatgagtgtgtagtagcccaatttcgtttgtgctaatctcaatcctctcagatgatgtaagaatgtgacttgtggtgttttatggttgtatgtaccctttgtaattctctgtttattctcacactgtccccatgttttaggtcagttcaacaattttctgaaattgtaataaccaaaatgataattattaacggtatatatatgtcgtgtccaatctcacggtcaaaaatgaagaaggtgatgctgagaggtcaggcgattccgacacgtgttatattccaaccacccacacgtaattttcaaaaaggaacaaaattgatcatgagggaaaaaagaataaactttttcccacaaagaaactttccacattgaacgagagaattatagatctgcgaatccgatcattggattagggttttcacttttcaccctcctttttccatctctctgctgtatacccttcctttctccaaaaagaccaaaactttgcgattcaattcgaaatctgtgttcttccattgagctggattttcatttttggaatcatttcttctcttctttgatccgatagatggtggcatggtaggaaattttagacctttatatttctatttaaccgtcaaggaaccaatgaatttgtatagcttgttgagttgactttttgattgtgtatgatcgaatttgggatcctcatttcgggttttgggttattgatctgagctcctgttacttctgaaaccgatgtgaatttggtgggggatagatttttttgtggagtcaatg

SEQ ID NO: 6724 - DNA, 3000 bp, Unknown
  misc_feature (1)..( 3000): cDNA_ID_1815368_gDNA_ID_1621102_Annot_ID_171455 3000 nt of promoter + ATG
tttctataccgaattaaaggtaataatttgaagtttcaaatacgatatttaagatcctaattatgagtagaattgaatgtgaaacggttttattagtacaagaaaagggtatatgaaagggttaagcaattaggttcgaaatataaacacgcacagaactcgaagagccgaatttaacaatgaacccaaaattaaacgacactgaagcaacctttgtgttgtgactctatatgagtgtatatatatatggtttatagaatacaaagtcttcagatatgtaatggagatttcagaaaaatggataagacactatagtagcacacacaaaatccttctagttggagaaggaaacttctcattctcactatgtctagcttcagcttttggctcggccatgaacataactgcgacctctctcgattctgaaggtatgtaaaacccattttatatgaacatttataatatacatctatcgatcactagtcgtaactaatgtattgacttaaatcaataaaattttacatgtagatgaactgagcataaaatatatggatgcggtggataacataaacatattgaagagatacgggtgtgatattcagcacgaggttgacgtgcacacaatgagcttcgataatagtttgagtctgcaacgttatgaccgcattgtcttcaattttcctcacgcagggtctcgtttctttggtcgtgaattgtcctctagggccatcgagtaacgaaatatattctttcattttcttactataatatatagtttatgatttggactgatgtaatgataaaatgctgtgttttggatcaggagccacaaagagttagtgagaggatttcttgagaacgctaaggagatgttggaagaggacggagagatccatattacacacaagacaacgtatccatttagcgattgggggataaagaagctgggtaaaggagaaggtttgaagctgcttaagaaatcgaagttcgagctgagtcattatccgggttatatcaccaagagagggagtggtggacgtaggagtgatgattatttccctgttggtgaatgttctacttacatgtttacccaatcctaactttgggaaatcttgcttaatttttttttggtattatgataactaaaaaaaagaattgggcattacaacatcaacaaggtaacaataatttggtccgactggacacgttcattcagttccttctgaaaactcaaaagcaattggtatataaaaagatcaaaaagttatatgaactatgtactttgaaaaagaaaaaaaagaagaagttatatgaactatgttaataataaagatctttaaactttttaatctcatttttgtttataatacatcgatttttattgagcttatacaagttcccgtaactgactttatatatagtttcatgtattaatttatacataattggccaataagtaggccttttttttgttgttttctcatgtaagtataattaagtgtgtaatcatatgaatctctataatctatatgcatacatacatgtatatagaatatatctatttttcgccaacaagaaaaaggacgaggaaactaaattggttgagattaacactttagtttattggttggtccaagagttggtagatttctttgtcgtttctctatagttggaacatgcatttatgtgaacttcgattatgacgatatgcatccatactacatgtaaaatttattgttgttttccgccaacaaaagaaaaacgaaaaagctaattaaattacgtacgagtaaattgaacacttggagaatcacatggatcctggagctctgctcatgcttaggagtgctcgaggccttagatctttcctatatgtagacgttgatccttgtgatctaaaaggtttcgaggtcttggaaatctatcacccgtccatgtctgatggctttgtgaactcggtaatggtcgcacgcaaactcactgatcgattaattaagtacgagtggtgtactggaactcgatcactaaattcattaaaaaaaacaaggcaagtgatgattccctaagaaattaggtcaagattggagccatacttgtggaacaaggcagatgatgatttccctaatgaggctctctgactctcccttactagttcaatattagttctgtcttttgtcaacgtgttgacgaaatcaaatctatattattagttgttgttttctctctatgcttattgtgattatgatgtcactagatcaaatactcggtttgaatgtttccttataaatgtatcagcatgaccatttttctcatattttacgaaatatttagcctgacaagcattaagcagttctgttaaacataaaacatacaatatccatgaaagaaaatcctcaatgtacatgagtcattaccaaatgcaagccatttgatcagaagtaagctgtggctgaaacacaatgtacagatgagtcatctttttgtttgtttgcttgaatagaaacgcagcgtttttgactaatcgagtaaccaattttttttttacaagaccgaaccggatcaattcaacaaacgtgaaataaatcgaagcgggccaggtcaagtaggtagccctctcaatgattaagagggaaccagctgtatccagagaccctctgagtcagtaagaagcttctaagagggacaggaaacggtaaaaaaaacacgagttatgtccggtaatatcaaaatggcaaaaatcattcatttcaagaaagaaaagagtagagagagtctcacacagctataaaggcccaaaaacaccaatccaccgacgagtattgtagatttagaggtctacaactaaaagcctttgtgtgtgccagattagctccctactaatccgccgccgcacctcctcgatctccgcccagctcccttcttttctatctatctattcagttgtttctccggtaacaaccagctgaggaagaagaagaagtagtagccgtgatgatgatg

SEQ ID NO: 6725 - DNA, 3000 bp, Unknown; identical to SEQ ID NO: 6716
  misc_feature (1)..( 3000): cDNA_ID_3048845_gDNA_ID_1621102_Annot_ID_171445 3000 nt of promoter + ATG

SEQ ID NO: 6726 - DNA, 3000 bp, Unknown
  misc_feature (1)..( 3000): cDNA_ID_1388618_gDNA_ID_1621102_Annot_ID_55902 3000 nt of promoter + ATG
ggaatgtaccaaaatccaaaaattagatgtaaaatcaattgtggggttgattatgaataattagaaagtatacgactcttttcataaataaggaaaagaaaaagatatctagattttttttgttttgttttgaagcatcgtcttcctggttcttcgttctcttgcgttcgtcacctcaaacacgtccgccattattatatatcaaatcaatcatgtccgaatccagcttttaccaatgtaagcaattaaattaaattaaataaaaacacttttatcaaatttaatcaaattaaaaaactgtccctttcttatctgagattctattgtttctgtctacttccacagaaagaaactgcatctccgtttttttttctgatttgaggctttccttagatccttgagagcaaaactgaatctgggtaattttaaaaatctcatttttacgacttatctcttttgaacgatctgttttttcatgtaagtacgatttcacctcgagatgatcgatcattgctcttctggttcttccatgtttgattaaatgttataacttgagggttttgtttcttttggattgttctcgcatttgttgatctatggttatcaaaagagtttggatttacagtttttggttgcagctgaaatttttcactcttttcttctctgttttgctggataaagttggatttgattcacattgttgtttagaatctagatgaagttgtaagattccttgtattgtgtttgcttatgcatgattgtgataaagatttaagttattttaccaatgtacaatgtccagaattgtcgtcgggatgggttctaagtccgttgttgacatgatcgaagctgcctcgcgggcacatttttctggtttacacgtgaatgggcacatgaatgggttggaaccaagtgcacttaaggaaaccacttctgcatcagaagatatccaaagacagccttttgtaataggtgagttctgcttttgctttcatttttgattaatatatggtcgtggataaaaaaagcttgacgaatggtcttgattgatatgttgtgacttgaattggttaggtgttgctggaggcgcacatcgggaaagactactgtttgtgatatgataatccagcaactgcacgatcagcgtgttgtacttattaacctggtaattttgttttgctaataaagtttcatagagctaagtgataaccaccggtttgatttgtgtttcgaatgtatatgaagtcaattgaattccacacaatttagagatctaaaaggagaatattaccagctaataacttatatatggctgaagtttaacattgttcaaccttgtcaccattgtttagatatttatgtcagtctatttatctaattctcaaattcctttggcatcatgataaaccacaaattgctcgacttaatatcctatgataatgatttttggcaggactcgttctatcataatctgactgaagaagaacttgctagagttcatgaatacaactttgatcatccaggtgagaatatatttggagtgtaattgctttctgtaatctactcttgtcaatacatagtgtcatcaggagtaaaaaatctttcctagcttctttggccattttttttttttttataatacttctttgggataattaaggcataactaacagccatattattcagtgatatcttactaattgatgtattctcttttattaaagcaatttcatccctgacagcacattactagttgctgggagttatgagaaaaagtcttgtgcattactctttgtcatccaccgttaatttctttttatccaggattctaatgaattgttgttgtttctgtagacgcatttgacacagagcatttattgtcttgtatggagaaattgaggcaagggcaagctgtagatattccaaaatatgattttaaaacttacaggagcagtgttttcagaagggtaccaccttccctctcagcatcactcattatcatattgttacttgatgtttataaatttgagattcctttttcattttctcactgcctctttctgtaacaatagcaatttcttagatgtcaccactggcttttatctggttggggatttaaggggagatcaatttaatcttatttgatgctaggattttgaaaaacattctgcaggtaaatcctacagatgtaataattcttgaagggatacttttgttccatgatccacgcgtccgaaagttgatgaacatgaagatttttgtttgcacaggtaatttgttgcctcttcccgttataattattgtaaactcttgtttcgactacattccatttcccttttgtagattcacttggctttttttttctacaaaatttcacatgatggaacaacttcttatgctttaagattttgctgtttcacattgcttattttgttttctgcgtagatgctgacgttcgtttggcaagaaggataaaaagagatactgtcgagaatggtagagatatcggcacagtacttgaccaggttagcccgtcttagtattgttactgtatatattatcatcaagaacaacaagaaatggtttacctcttgcattttaaatattacattgctctgatctgtatgtttttttctcatattagttcggcgttttcaaatctatatgtttctacccatattttatatgatgtcaaccttttgatgcagtactcaaagtttgtgaagcctgcttttgatgacttcattcttccaacgaagaaatatgcagatattataatccctcgtggtggggataatcatgtagctattgacttaattgtgcaacatatttgcaccaagctgggtcaacatgatctctgtaaaatatatcctaatctctacgttatacactcgacatttcaggtaattgatatatcaatctcatctacatacgagtaacattctcttaactaccaaacaagatccagaaaattgatttctcttgcagataagagggatg

SEQ ID NO: 6727 - DNA, 3000 bp, Unknown
  misc_feature (1)..( 3000): cDNA_ID_1815372_gDNA_ID_1621102_Annot_ID_55904 3000 nt of promoter + ATG
gaacgtgtccagtcggaccaaattattgttaccttgttgatgttgtaatgcccaattcttttttttagttatcataataccaaaaaaaaattaagcaagatttcccaaagttaggattgggtaaacatgtaagtagaacattcaccaacagggaaataatcatcactcctacgtccaccactccctctcttggtgatataacccggataatgactcagctcgaacttcgatttcttaagcagcttcaaaccttctcctttacccagcttctttatcccccaatcgctaaatggatacgttgtcttgtgtgtaatatggatctctccgtcctcttccaacatctccttagcgttctcaagaaatcctctcactaactctttgtggctcctgatccaaaacacagcattttatcattacatcagtccaaatcataaactatatattatagtaagaaaatgaaagaatatatttcgttactcgatggccctagaggacaattcacgaccaaagaaacgagaccctgcgtgaggaaaattgaagacaatgcggtcataacgttgcagactcaaactattatcgaagctcattgtgtgcacgtcaacctcgtgctgaatatcacacccgtatctcttcaatatgtttatgttatccaccgcatccatatattttatgctcagttcatctacatgtaaaattttattgatttaagtcaatacattagttacgactagtgatcgatagatgtatattataaatgttcatataaaatgggttttacataccttcagaatcgagagaggtcgcagttatgttcatggccgagccaaaagctgaagctagacatagtgagaatgagaagtttccttctccaactagaaggattttgtgtgtgctactatagtgtcttatccatttttctgaaatctccattacatatctgaagactttgtattctataaaccatatatatatacactcatatagagtcacaacacaaaggttgcttcagtgtcgtttaattttgggttcattgttaaattcggctcttcgagttctgtgcgtgtttatatttcgaacctaattgcttaaccctttcatatacccttttcttgtactaataaaaccgtttcacattcaattctactcataattaggatcttaaatatcgtatttgaaacttcaaattattacctttaattcggtatagaaaactagtttactcactgtaaaataaaatatcttggtcattctatggttaaaccaaattattgccaatattaaaacacgtgaggttttatcaagatattagtatattactgattaaatatgaagttttgttgttattctcatatttgtttcaggttagctcttatgcttatctctaactttcttctctttgtttagaatcgttttcacttaaacttttccttcatacttttatgcaatcttactacaactcttacactcatacttatagtagactttcatctactacacacacttgcacacatactttcattttacctccagacactagactgactcacctacacaagcagcactacttatgcgtagactccaacaactcttaattagctaactctttaccaaagcaaaatacagcattttgcttattatttgggcctgaccaagttaatgccccaataaaacttcttaacccaaaagcaaaacaatcttcttgttaactttttttgtgcttcatctgctcattcttgtctgtctcaattgtaggatcaatcaaaggtagtcaactttcaacaagtttttcagttgtaataagagtctctttcgcagttatcgttgtatttatttgtgaacaaaacctaacttactgccattactcttaataaaatccaggagtttggaattatcaaattactatggaaagcatgatcattgttaaaagacaaaaatggaattattataactttttcataggtaaaaagctttttcttagtgctgaagtgttttatggatccgcaactaaccacacattacaactaccacaaaaagtgagaagaaaaaagaagcacaattacccaaggaacaaactcattttgattatcttcacaaccaaagataaagcccaaaaatgttttttcaaaccttagacaaaacctaaaagcaacttaaagaataattttgtattcatttacttttttttatttttttatttttttcttttctactcacaatagtttttcaatcgaaaataaaataaaattaggttaatcaaaaaattttttttatctaacatcgttgttttatcatactagacataaaatagacaggaaaaaaaacacattgttttatcatagtgttttatcatgcatgatgcttctaacgatattgtttagataggcattaactagaatttttaatgaaattttttattcttaaaatgtcaaataagtcctatattgaaatattttttaatggtatactaatttttatatccttttcctaaaatacataagacttttaagtttgttcaattaacaagtatctgtcccctgtaatcaatcaaaaccttttatctcagatttaattaggaaaagccacttgttaagaagaaggaatattaaacgaaaacgcatgtagttttcaaactttaatccaccgagatttgctttactagttcttcaaaacgacacgcatggtcccactcattacaaaaaccaaaccccattatgcaaaagctctcttcttttgcccaaactctcgctttcccttttttacacacaacaaaaaacaaaagttctgttattttcctatttaatccataaccattacacatttccaattttcctttcattgatcacataactcatgccaaatctacctcatcttcctcctccaccgcagttgcaaccgcccgaaacgccatcatgggaaacaccatcgtctgtatggtatactccaagaaccacaccatggagaacaccacagagcacacaatccacaccagttggccaaatg

SEQ ID NO: 6728 - DNA, 3000 bp, Unknown
  misc_feature (1)..( 3000): cDNA_ID_1815368_gDNA_ID_1621102_Annot_ID_55905 3000 nt of promoter + ATG
tagtacaaactccgatctcggttcttggatagagttcactaggtctttttcttttatacaagttgtgggtaagcaaatagaaatatagttgaataaacatgccaaagctaaagactttgaagatgactactgactcagagaactgtaccgtattctttttcatttcttcgtcgtgcaattacgagaaatcaggattccggttggtggaccggtcatctgaagttggcacctcccgtgcagctgataagagtaatgaatcattccaaaatgagctttgactttgaaggtacctctaatctcatattctatcttgttgttttccagctgtctcctgagttccaccgcgtggtttacaggcaagcctaccaaactagagatcaaacggattggttccaacctcgtctcatgctttttctgcaagaatggctggaccacttgcgctgcaatcaatctattgaagaagaagagctcaatccgaagcttctcaaacttcacttctatcttcttattagggttagtgaaattcaccagcatggacaaatcgccgttgaaaaactccggcgtgtcgaagtagatcgtgtgtaggtttgcgtttgggatgtcgaaaacaggtattcttggtctaatcgcaagaaacactatcaaagtggcaatcgcaaaaaagataagcaaaaggctgaacacaaaacagaaaccggcaacacaccatatccagagactggtcctgctactccttggctgacggagaatcaccctatctttcctcggctctgcatcaagaccgttgaatctaaccgttgctggctttgttaagaccatttggccaactggtgtggattgtgtgctctgtggtgttctccatggtgtggttcttggagtataccatacagacgatggtgtttcccatgatggcgtttcgggcggttgcaactgcggtggaggaggaagatgaggtagatttggcatgagttatgtgatcaatgaaaggaaaattggaaatgtgtaatggttatggattaaataggaaaataacagaacttttgttttttgttgtgtgtaaaaaagggaaagcgagagtttgggcaaaagaagagagcttttgcataatggggtttggtttttgtaatgagtgggaccatgcgtgtcgttttgaagaactagtaaagcaaatctcggtggattaaagtttgaaaactacatgcgttttcgtttaatattccttcttcttaacaagtggcttttcctaattaaatctgagataaaaggttttgattgattacaggggacagatacttgttaattgaacaaacttaaaagtcttatgtattttaggaaaaggatataaaaattagtataccattaaaaaatatttcaatataggacttatttgacattttaagaataaaaaatttcattaaaaattctagttaatgcctatctaaacaatatcgttagaagcatcatgcatgataaaacactatgataaaacaatgtgttttttttcctgtctattttatgtctagtatgataaaacaacgatgttagataaaaaaaattttttgattaacctaattttattttattttcgattgaaaaactattgtgagtagaaaagaaaaaaataaaaaaataaaaaaaagtaaatgaatacaaaattattctttaagttgcttttaggttttgtctaaggtttgaaaaaacatttttgggctttatctttggttgtgaagataatcaaaatgagtttgttccttgggtaattgtgcttcttttttcttctcactttttgtggtagttgtaatgtgtggttagttgcggatccataaaacacttcagcactaagaaaaagctttttacctatgaaaaagttataataattccatttttgtcttttaacaatgatcatgctttccatagtaatttgataattccaaactcctggattttattaagagtaatggcagtaagttaggttttgttcacaaataaatacaacgataactgcgaaagagactcttattacaactgaaaaacttgttgaaagttgactacctttgattgatcctacaattgagacagacaagaatgagcagatgaagcacaaaaaaagttaacaagaagattgttttgcttttgggttaagaagttttattggggcattaacttggtcaggcccaaataataagcaaaatgctgtattttgctttggtaaagagttagctaattaagagttgttggagtctacgcataagtagtgctgcttgtgtaggtgagtcagtctagtgtctggaggtaaaatgaaagtatgtgtgcaagtgtgtgtagtagatgaaagtctactataagtatgagtgtaagagttgtagtaagattgcataaaagtatgaaggaaaagtttaagtgaaaacgattctaaacaaagagaagaaagttagagataagcataagagctaacctgaaacaaatatgagaataacaacaaaacttcatatttaatcagtaatatactaatatcttgataaaacctcacgtgttttaatattggcaataatttggtttaaccatagaatgaccaagatattttattttacagtgagtaaactagttttctataccgaattaaaggtaataatttgaagtttcaaatacgatatttaagatcctaattatgagtagaattgaatgtgaaacggttttattagtacaagaaaagggtatatgaaagggttaagcaattaggttcgaaatataaacacgcacagaactcgaagagccgaatttaacaatgaacccaaaattaaacgacactgaagcaacctttgtgttgtgactctatatgagtgtatatatatatggtttatagaatacaaagtcttcagatatgtaatggagatttcagaaaaatggataagacactatagtagcacacacaaaatccttctagttggagaaggaaacttctcattctcactatgtctagcttcagcttttggctcggcc

SEQ ID NO: 6729 - DNA, 3000 bp, Unknown; identical to SEQ ID NO: 6722
  misc_feature (1)..( 3000): cDNA_ID_1815356_gDNA_ID_1621102_Annot_ID_55908 3000 nt of promoter + ATG

SEQ ID NO: 6730 - DNA, 3000 bp, Unknown
  misc_feature (1)..( 3000): cDNA_ID_1815348_gDNA_ID_1621102_Annot_ID_55910 3000 nt of promoter + ATG
ctagcttcttccctaacacctcaaccaccgtttccaccgtggaaaacgtgttgtctccgattgcgcaacctaaatcggctattttcaggtgagaggagcaaccttcggtgagctttatggagttgatggctgtcgtcagcattggtttgctcaaggctaaacgtgccgctggaccgtaacagtttttgacgtagctcgcgtcatcctcgccaccttgcatggagagcacgtgctcgaggctccgtgacgactccatatatagttgtaaatgtgtaagaaaaggtgtgaacgttatactaagaataagtaaattaaagaaggattgatttggttttagaccttgatggctcaacgaggatcaaatgtctctatatatacactcggtaacagtgtgcagtcaaaggctagtgcgtcgtcgttttaacttcagtttaacatgtttacatgtccttcaaataacttagaatacaatttatgaaagatcctacaaaaatattataacttttgtataaaaaaaaattaccaccaaaatcctaaaattctagctggaatttccacatataacttaattagttgtttgtgtcattaatagagtttcgaaactcttcctaaaaccgaaaatagaagagaatctgttaattggtagtggtaaccattgaaacttgcacaagtgtggatcaagttggatattaagttacttgaattagtgaaactgctgagctgagattttccatattttgctgtccattggtttttaataatgttagtctccatggagaattagttaattggtatatgattatacttatatgggttatagcgtgaaaaaaagaaacatctactttaagcaacagcagaaagcattaaagaatagataaccccaatttccgagaggaacgttaggagaaagtttttgaaaatttacaaaactttctgttagtagatgcttaatttcatcagtgttttccaagcaattttgaattaaggattaataaaattgttatgtatattatgaaataatgaagatatttcgctatctctagagtctaaagagattagcagttggtgccttggtggttgacaaaagaaaagaagaagagattagcagttgcgtttaacattggttttatctagaaagatgaactgatggttacatataaaactagtcgttgtctgtcagtgtccactaaagactattttcttcttttgatatacatttctaaatatacaacaatatcatttctccgaggtttgtgaattgtttaggtataaaatagttttctacaataacttttgctatcgggtgcaaagacattctaccatagaacgagtttagtatagtgtcatttcgtagattctttattcggattggtttttcaatatcaacaaaattctggttcattttcttccctcctataaacgaaggtaaaaagaatgaagaaaaaagaaaagaaagaatattttgttaatgcattatctaacgtgttaatgtgtcactttcatttttcttaatcgtttgttgaaaactttttgcagttgatttcaggaaaacggaacacacatatatatatatatatgtcttttattttcaatacggaccaaatccatcatttgctaatcagtgagaaaactaaatcgtggtctactagtttatataaattgaaaaaagaatcataaataatatgtcacatatccaacctaaagatttatgtctatacatgtaaaaatgtaaatgagcatattcccaaatttcccacaagtatatagcactacctacactcacgcttcttcaaagtgaaggcgatggtggaaaaaagcgtagacgatgacttgataagattgactgaagaaaagaaaaaaagttatcataagtcaaaaagcatgtcgttagagtttgacgagatcccatgcatgattatattgtcggatacaattgtttgaacaatacggttggaaaaatctaccgtaatatgaagacttgaatgacataactaaagattgtaccttgcaagccagcaatgtgttaatgatatgagtaagggtgcagaggctgcggctggtggctactggctagtgataagcaatttacgatgtaatgacagatatatcataggagactaggagttatatatggtatatatagaatctaaaataacatatttatcaatttactatattaagttttatggttccaaactcaaaactaattgtttatgagtagatttggtttatatactgtatattactcatattctatttccacttttaatgtgggatttctcataaactatatacagttatatttttaattaatgaaataacaataatacagatttaaatgtagccttaactatttttatgaaatttaaatgaaatttaatttaaaagattgcattcagaatacaaaactgtaatattctgtaaaatattgataggtactacttacaacataggaaacatatttaaagatatgttatataaactaaaaatagtttaaaatatcaatatatatatatatatatatatatattacgaaaagaagaattaaaacagactacacacataataaaattttaatagtaacacttacaaacatatccaataatattaaataaaattaattcattatgatctttatgttatttctatatactcaaaccaaaaaaaaagaagtaaatgattcaaaatccaatcataattatttttcaaattcattaaaatacaagaaatttcatattaaaaaaatagatatttctttcaaagatttatattcaaattataaatatatactaaaacgctaaaaaattaagtacatgctataatcttttccattatttttctaacaaaagaaagttatatatgggctaaacttagaaggaaagcccaagaggccaagactatataaagattcatgacccgagtttaagatccgatttcagaatttgggactaaaggaggacaacgacaagcgccgggaaaaaatcgagagcgacaacaatg

SEQ ID NO: 6731 - DNA, 3000 bp, Unknown
  misc_feature (1)..( 3000): cDNA_ID_1815344_gDNA_ID_1621102_Annot_ID_55911 3000 nt of promoter + ATG
tatcaagagcaggatcgaatatcagctcgaaactgttgaagatctcaaccgtacgacctctctggagaccgatgacgcagccataaaccctagggttttgcagtaacatcgcgtcggcgttgttggagccattcccggtggcgcaagaagcggcgggaggattaagctgagttttaaccctagtgaagtgatcggatatgttaagcatcaccagaggatgtagcttgaacgtgagaccgctcgacgaagaaggcgccattgttgtcgctctcgattttttcccggcgcttgtcgttgtcctcctttagtcccaaattctgaaatcggatcttaaactcgggtcatgaatctttatatagtcttggcctcttgggctttccttctaagtttagcccatatataactttcttttgttagaaaaataatggaaaagattatagcatgtacttaattttttagcgttttagtatatatttataatttgaatataaatctttgaaagaaatatctatttttttaatatgaaatttcttgtattttaatgaatttgaaaaataattatgattggattttgaatcatttacttctttttttttggtttgagtatatagaaataacataaagatcataatgaattaattttatttaatattattggatatgtttgtaagtgttactattaaaattttattatgtgtgtagtctgttttaattcttcttttcgtaatatatatatatatatatatatatattgatattttaaactatttttagtttatataacatatctttaaatatgtttcctatgttgtaagtagtacctatcaatattttacagaatattacagttttgtattctgaatgcaatcttttaaattaaatttcatttaaatttcataaaaatagttaaggctacatttaaatctgtattattgttatttcattaattaaaaatataactgtatatagtttatgagaaatcccacattaaaagtggaaatagaatatgagtaatatacagtatataaaccaaatctactcataaacaattagttttgagtttggaaccataaaacttaatatagtaaattgataaatatgttattttagattctatatataccatatataactcctagtctcctatgatatatctgtcattacatcgtaaattgcttatcactagccagtagccaccagccgcagcctctgcacccttactcatatcattaacacattgctggcttgcaaggtacaatctttagttatgtcattcaagtcttcatattacggtagatttttccaaccgtattgttcaaacaattgtatccgacaatataatcatgcatgggatctcgtcaaactctaacgacatgctttttgacttatgataactttttttcttttcttcagtcaatcttatcaagtcatcgtctacgcttttttccaccatcgccttcactttgaagaagcgtgagtgtaggtagtgctatatacttgtgggaaatttgggaatatgctcatttacatttttacatgtatagacataaatctttaggttggatatgtgacatattatttatgattcttttttcaatttatataaactagtagaccacgatttagttttctcactgattagcaaatgatggatttggtccgtattgaaaataaaagacatatatatatatatatgtgtgttccgttttcctgaaatcaactgcaaaaagttttcaacaaacgattaagaaaaatgaaagtgacacattaacacgttagataatgcattaacaaaatattctttcttttcttttttcttcattctttttaccttcgtttataggagggaagaaaatgaaccagaattttgttgatattgaaaaaccaatccgaataaagaatctacgaaatgacactatactaaactcgttctatggtagaatgtctttgcacccgatagcaaaagttattgtagaaaactattttatacctaaacaattcacaaacctcggagaaatgatattgttgtatatttagaaatgtatatcaaaagaagaaaatagtctttagtggacactgacagacaacgactagttttatatgtaaccatcagttcatctttctagataaaaccaatgttaaacgcaactgctaatctcttcttcttttcttttgtcaaccaccaaggcaccaactgctaatctctttagactctagagatagcgaaatatcttcattatttcataatatacataacaattttattaatccttaattcaaaattgcttggaaaacactgatgaaattaagcatctactaacagaaagttttgtaaattttcaaaaactttctcctaacgttcctctcggaaattggggttatctattctttaatgctttctgctgttgcttaaagtagatgtttctttttttcacgctataacccatataagtataatcatataccaattaactaattctccatggagactaacattattaaaaaccaatggacagcaaaatatggaaaatctcagctcagcagtttcactaattcaagtaacttaatatccaacttgatccacacttgtgcaagtttcaatggttaccactaccaattaacagattctcttctattttcggttttaggaagagtttcgaaactctattaatgacacaaacaactaattaagttatatgtggaaattccagctagaattttaggattttggtggtaatttttttttatacaaaagttataatatttttgtaggatctttcataaattgtattctaagttatttgaaggacatgtaaacatgttaaactgaagttaaaacgacgacgcactagcctttgactgcacactgttaccgagtgtatatatagagacatttgatcctcgttgagccatcaaggtctaaaaccaaatcaatccttctttaatttacttattcttagtataacgttcacaccttttcttacacatttacaactatat

SEQ ID NO: 6732 - DNA, 3000 bp, Unknown; identical to SEQ ID NO: 6721
  misc_feature (1)..( 3000): cDNA_ID_1815332_gDNA_ID_1621102_Annot_ID_55915 3000 nt of promoter + ATG

SEQ ID NO: 6733 - DNA, 3000 bp, Unknown; identical to SEQ ID NO: 6720
  misc_feature (1)..( 3000): cDNA_ID_1815328_gDNA_ID_1621102_Annot_ID_55916 3000 nt of promoter + ATG

SEQ ID NO: 6734 - DNA, 3000 bp, Unknown
  misc_feature (1)..( 3000): cDNA_ID_1815437_gDNA_ID_1621103_Annot_ID_55922 3000 nt of promoter + ATG
attattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccatcaacaacgacgtaaattgcgtttattgtaatgtaaatcaaatttctaaggcaaaaccggaaaaaaaatgttttgttttttgttttgtcttaaatgctttgacaccaataaggcaaatagcatatatggttaaaggaatggcaatatgaaagaaaagaaaagaaaagaaaatgatttaaaagattcatcaatatcattgaagattttacacaccagaagtagcaaagccgtaacacacaaagcttttcgctacaaatgcatcatacataaatggagttttgagagtacaaggggcgatacagatgtaacgtggaatgtagaaagtgttttatatagcagaataactgaagtcaacactatcatcattggagacggaaggagaaggagaaggagactcagcagaagcagtgagtaccacaaaggcaccaaagagaatagtgataatggccgtgaagttgataagaaatgcttcggatccatacttgtcaagccctccattctccaagaaagtcagcttttccagaaaccctaaagctgcattcccgacagcaagtatgtaaacaaacaggccaagcattgcgtgccacggaagcaatccgcttttcaaatttgttgatcctcctgggaagaagaacactatgaagctgtacacccactgtaaagttcaaaactcttgttctggtcaggaacaatatacaacaataggtaaaaacatttttccatagaaattgatcaacttgttagccattttctatgaatcagccggtccaatagctttatatacagtgttttctgctgtctgtaattgttctttcagtttgatacagagaactcagaaacatttataaggttgatttagtagctgaaccaaatgaaacacttatcaaaaggattcctatgtaaactgattacatgtataatgggaaaatgtttgtctaaggagcaaaacgctatggaatttacctggaagccataaagagaaatgactccaataccaatccaggaatggagactgtagagattagggatatggctttcattgtggttcttaaaggctgcacagatgccaaatatcccaagagccagagcaatggcatggagtataaggtggatcaacttcttcactggtttctccagcggaagcgatttgtaacttatgatggctgcatttccattttcaacaaacaggtttatataaagtgatcatcatcaacaatactaatcaaaactgaaatgaaagtaatatcttatttctctcgttgttgaacagatgttgttatcagttaccttctcctcccaagattataaatccgatgagcatcagaacaggatgcagctggatcacataagaaaacaaaatggatcagaacacaaacacagacggattaaaaacaactgaagagatgtcccctttgctttggtaacacaacgataatgtcgatttttggatgctagttgtgaataccatcaactaaacctaaaccagaagatcgaaacatcatcttacgtacattcactcacactgtaataaacagaatacgaccccaacaacactcatagatcctaaatcacgtccatagcaaaacttgggacaaaccagaggactattgcttccaaaagagtcattttacaagctataacagatatcaagacaacaaaagaattctcctttacataataaagtcactcactcagaaacagtactgaggaacaaataagaagcttcgcagtcagatacaagacatacaaaaagtcaacgcagatgcgagagacagaaaagagaaaactttaaaggagattaaagaaagaaacatacattgaagatgagattcttgttagtagcttcccaggccaatccacctctgtaactgatactccaaaccagtaccataatcgccgctattaccgccagcgcgtgcgccacaaacgtcaccgccatcgcgtttatccggacagccatatctctttctctcctgcaactgtgtttctttcttcttgtcgttttttctactcttctaatctcctttgtccgattaatcttcaacctcggcctctgagacgaatcaatcctcagattttccatttcttcttttcaataatccactgtgggcccttcttcgcagacacgtgggcctcacgatccattttcgatttatctattcagacgtgtaatttcgtggggcagttctcgataaacgactaatgtttcgccacgtggatattgtagtagctgcatctactagttccgcttccgcgcttcgtgtctgtttcttctaccaccaaccaaaccattaaaccgcgatagagcatactggatcttttttaaggcccattatgtacatttctgttggaccaacccattgcgcaatggaaactattcatatgatatcatttcttgtcgttttcggatttcagtgactgtgttatgctgtttttccaatgatcgaaacggcatgttgttggaatgggctagtgggctaacttgtgaaagaaggtaacatcgacggttcttctcggataaagattaggctgagagcgccacgcacacaatcaagagcctgatacgtggcatgacacgtggtatttcgtaagataaagtacagaggacacagccatccagaggtagttcggctatgcgtcttcctcctctttcccatactctctgactctgtataaaactttgaagaagctcctcatattttctcagaaacaatttggatgcatagaaaggaaaagaacaaaatcaaatctagcaaataaaatg

SEQ ID NO: 6735 - DNA, 3000 bp, Unknown
  misc_feature (1)..( 3000): cDNA_ID_1839096_gDNA_ID_1621103_Annot_ID_55923 3000 nt of promoter + ATG
tgaaatctcttttgcaaaggcatagaaccttgttggcctgcctcacctcctcccgaacccgtaattcccattttattccctaaccatcattacaccaaattaaaagtcattaccaccgtcaaaagccgaaaacgttgtttaacaggaagaggcgtgtattaccaatggtggagccaagtgactgtgtagagtcttgaacagattctgtagacttttgcgtcacttcttccgtcgtaccagcgatccaagaagtaacagctcctctcagcttctccgcaatccctccttcgcctttctccgcatatgcttcaccctgtttcgtagctgcttccgagctcggatccttaaaccctcctaaccttttctccacctcctccgattgtgtcactatccctctcttcggtggcgcagtttcgccaccgcctcctccaagatgaagcttctcagtgaccacttccgacaaagccttgtcttcctctcccggactcagtttctccgtaaggaattctttcgccgagacgcccctgtcttgtccttgctctgtcccggtcccggtgaatggtaacttcgtcattacactagctcctgtctctttaaccttctcgtaaactggagtcaccatacttgcgaccgtacttccgtatccaccagcggagctaggattttctgctccttccacacgattctcgtggccgccttccccggagtaacctaacttcgaagcgacggcgtttttcgccgccacagctttgtctgctacgaccgaagtcgctaatgagatcttatcggtgtagctgctctgattaggctggtgcatctcctctcctctcctctgacctctggaatcaaaaccctgagggttttgtataccttgagttctcgtcggcaaatcttttcccagatcaaattcatcactccgctccggagattctttccccaatctagatccatagtctcccgccggtatgtgcttgcccatttcaggtcttgacttagtatcaaaaccatgacttttctcccggagatctcttcccagtcccatgtgatcatcttcacctgtttcgttcctcctcccaaaagctgcgacactcggttgttctccagctcctagaataaagaaaggacacaagtcaaaagatataaattcctgaatcagaattccgagaagaaaaaaaacttacctttaccggtgggatcagtaactttggactgataactcgacattccaccatgagatccctgagcagtcggttttgtatcaaggccatggcttttcttctgcagatcagttcccaaccctaaccttccaatagctgagacagtcgatgctgctccaatttctccagtagctagataaagaaacagacaggtgaaaagagttgaaacttcttagcaaaaaacgtagagctgaaactttaaatcaggattaagagactagagaaaagatcttacattttccgatggggtcagtaactttggactgataatttgacaacccaccatgagatcccggagcagctggatcttggtccaatcctttgggtctgtcgatattaactttactttggtttcgagacttgtgttcatcaggaacaaatgttcttgtcacatcttctgttgcagatagtaaagacacgggagtgttatgcggcgtcagtgtaggagcccctcttctctcttctttctccggtacaccggagtgttttataggacgagacattgcttcgtggccaactcctctcactggctcagagggttttgtatgtgaagaggaaacaactggaaaagctttcgatcctggagggactatctcctccttcaccggaatatgagcttttcctcgtgctgctgggaccaatccaaaacattaaatactctgttttggtcaatagagagatcaaagtgaagcgaaggactgacaaacctggtgcaccgccgtggagttggttgtcgttgtagtcatcttcatcgtcttcttggtctagatcgtgatcgtcagggatgtgttctccacgatcgtgctcatgaccatgtccatgtttagtaagaacattcttgatcttctttgctttttccttcactttcttcagaacttttgatggtcctttttcatgatgcccttcttcctctgcattcaaaacagaggaacacgtaaaaaacattcattaggctctctcacttccagattttagaatatcaatagaaaaaaaactttacattgagattagaatctggtttcgcaatacctggatggtgaatccttattggctcctgtgcttggtgatgaccatgagtacgttgcaactgcgcttgtgaatccattttatttgctagatttgattttgttcttttcctttctatgcatccaaattgtttctgagaaaatatgaggagcttcttcaaagttttatacagagtcagagagtatgggaaagaggaggaagacgcatagccgaactacctctggatggctgtgtcctctgtactttatcttacgaaataccacgtgtcatgccacgtatcaggctcttgattgtgtgcgtggcgctctcagcctaatctttatccgagaagaaccgtcgatgttaccttctttcacaagttagcccactagcccattccaacaacatgccgtttcgatcattggaaaaacagcataacacagtcactgaaatccgaaaacgacaagaaatgatatcatatgaatagtttccattgcgcaatgggttggtccaacagaaatgtacataatgggccttaaaaaagatccagtatgctctatcgcggtttaatggtttggttggtggtagaagaaacagacacgaagcgcggaagcggaactagtagatgcagctactacaatatccacgtggcgaaacattagtcgtttatcgagaactgccccacgaaattacacgtctgaatagataaatcgaaaatggatcgtgaggcccacgtgtctgcgaagaagggcccacagtggattattgaaaagaagaa

SEQ ID NO: 6736 - DNA, 3000 bp, Unknown
  misc_feature (1)..( 3000): cDNA_ID_1815434_gDNA_ID_1621103_Annot_ID_55924 3000 nt of promoter + ATG
gaccttaatatatagtcacaagctttatggatccaatgaacttaacctgcacttaataagagtcataaaagtgaagggtgccatttattgatgcatcttattgttccgtttctttcattgtttgtatgcaccattgcccttccaagctttaatattttcccatggagtatcatatgcttcaaataatttgcgtttgagtctagcaattactaccacctaatttgatttgattttagtgatatctctctaacctaagattcttcttaataccttatgctgcttaacatattaggtgcaagaacacaaccatcctcatatacttctgctacaaattggtaacacattctgcaaacttccaggtggacgcctgaagcctggtgaaaatggtatacagttaccacccgttagtaatactttctacactgttatgagtttcttggctgcttaagttttgggtgtactatgttgtgtctgcagaagctgatggtctgaaaagaaagctgaccagtaaacttggaggcaattcggctgctcttgtacctgactggacggtactattctggtttcttctttttcgttgagtgatagtgacaagatatttaggggtagatagatgccttaaaagaactaggttggtgttgcatgtgcttgctcttaaagcaaacgagaagcaattgaaattattttggttattacacttaagcatgccaggaatgagggttcataaaagaaaacaaggataggcctggtagctttgctagagaatcatatacgtactagatgaagaaagaagactttgccatgagtccacagttgtctgattgagttatgtatatagctctgtccctgatccgttgggtactttatgtccctttaacaggtaggagaatgtgttgcgacatggtggcgtccaaactttgaaaccatgatgtacccgtattgccctcctcacatcacgaaaccaaaggtagtaaaaaaacacaatgtaaagcttctcagaatttccctttactcttctccttatatctcctcttttttgtggaatggcaggaatgcaagagactctacattgttcacttgtctgagaaagagtactttgctgtgcccaaaaatttgaagctcttggccgtccctttgttcgaactctatgacaatgttcaggttttgcttatatccagaataccaacctttggaaaatggtttttacctcaaacatctaaccgtatattattttcttgaaacagagatatggaccggttatatcaaccattccgcagcagctatccagattccatttcaacatgattagttcgtgatttcgactcggtgtgttcaagaacaaggaacctatcagatgggtaagttacttaggtacggtagagagctgtagctaccggattagagatggggttttccaatgatgcgagttgggttttttgcattatagacttgttggcttttatgtagaaccggttcaaagtgtcagcacaaaaaacaaagattattgtatctcatttttaaaagcatttgtcattgtttgactaacgcctgtcttctctaaccgtaaaacatgtgtttcattcaatgttgaatgatgtttttattttggtgcataaaactaagccatgtttaaccttctttgtcaacatatttcataaagttttatcaacataccacaaggcctaatggtcgaaggaggagaagttttgttgtagacgaacaatctaaagtatcctagttatcataacattagatgtataaaatttattctccgagggctaaggattaagtcatcataacattagatgtataaaatttattagtcgtgtttcattggggattagtttgacggcaaattatattatgttatcaagacgaccaagacaaggtagacacttttttattgtttccctctcaattttctttactcgtcattttccacaggccaaaagagccaacaagtaaaaaacaaaatcagagtatttttaaaattgggacaggccatttcgatcgggacagaaggaattcaaattgttgaaattcacaatattcctcaaataactcttattattggtccacttgtcagtgtgaatgtaagaaaaacatcgtgagaggaaaaaatatgaaataattactagcagcaaataggagctcaatgttgacttcactacaaaattttataattaagagaaaaagagctctcaaatcatataataattatttcaagtacttgtattagcaaatgcaatttgtctgcttgctaatgatgctttacgaaaagattaacagattggatgattctctataatcattacttcattattcacaatcattggattgaatcagacagattattccacccggatgatcgtttctaaccaaaaaactcattgacgcgatttaaacataaattaaagaagtcgttaatataaaattcttgccgacattttagagatttttggatatgaagatgttatctgattagtgtgtaaattcttaaggcatcgtccattataaatgaagtaaatataaggaaaacaaacaataagaaaacaaagtgaaagaacaaaaacaagcaaagattcttctttttttttttttttataggtaggaatctcaaatcttatatatactgaaaattgctaatttattttaagttggaacattatatcaataatttaaatttatccaagcagacttttgacacctaattaatccttacatattccattatgacttttctcctcactgcttatacaaatgcatacagtatactcataagaaattaacacataaattatatcccaaattttcataaaaatagaaatatatatgtcatttgtcatttactctaagcaggcccatttggtcatttcttaacaccaagtatgtaggctctatctgtggacgtttggtgatatatatgttgtctcaatcaccatatatagtattgagacatgttttcttgtatcaggacagacagctgactaaagagaaatg

SEQ ID NO: 6737 - DNA, 3000 bp, Unknown
  misc_feature (1)..( 3000): cDNA_ID_1815430_gDNA_ID_1621103_Annot_ID_55925 3000 nt of promoter + ATG
cacaaagataccaatacgctgtattatttgccaactcacttcagagggattttttaatgattagacttggtttatcaatatacatgggggcgatttaaacttcctttgtggacaaaattattacagtattgcactatatgagttgaactaacttacacaggcacatacataagagggcaaaggacaggccaaatttttacctctgtggctttagcagtccgatgaaagattcttgttattccacgttgaatatcagatgatctagacatagctgtcaagactgaggagagcacgagataaaactcaggtgatacaattgctctctcagaaccttcttcaaccaactcactgctgagctgggaagaactatgagatcccatgcaagcagaaatctcagaaacagcatcaagccgagcagatatcaaatttctatcgcatagaggatgagtcacctgttgaaatgaaagtgtccacaaatcatgataagagatcttttaaaaaatttccctaccacttagcaaaaagtcaatgaggagtaagtacagaaatctcaaatctctccccttcaaaaactgaaagatgccagtaaagtcttttttttctttactataagacgacttactgcatctatagaactacaaataaacaaagcccttttgcggaaaatctaagaagaaaagagattgtgtcttacccagtgtctaagaagcctggaaccatatactgtaagtgtgtgattcatattatggaataaggagccagattccgatccatctgaattatttttcacaacctgaatatatataaaaattattttaagagaaactcagttaggaaacttaaaactgaacatgtgactagccaaataaagcggaaagtacctccaactgttgcagagtattggctgagagagtcatctctgtgttacttgacaaagagcgaaatgaggccccttggtaaaggatcctttcaaatccaaactgtttgagatggcaaaacgttagggcgagggcttgaacagtcagatgtggcatgttcataattgtctgcaccatcaacgaaggaataaattagcaggaattgcagtaagcatttaatagatgaaaaaaactttttgaaagcaagatgtggtcattaacaatatcgcattaacagatcatcataaaaaataaaataaagggaaagtttttagaaagtcaaatgacatacatgaactgtcaagcaagacattcctttttcagcagcctccagcttcatttctttatcatcttctaagttacctgcgctgattttttcacataatgaaataacctcatctactgcattaccattgctgaaacaatccagtgaggcacgttccactcgaacgtttgaggtaggtccagcatgtgccaccaaaaactgccaaacaaagataccacacgaacatctatcagtacatgtatacacatcgaccaagaacagaagttctagtcttcaaaactaatccatatagtgattatacatacagacaaagattcttgtcaaactgttcatcaggaaggattcagggattagtatagacagaatcttgtaaaactaactgaggagctaaattgttcaaaattaatcaacaatgcttgaattagtaatatttactcgtacacagataaacgtaccttctcagtttgttgtgaaagaggctggccaagcaacagctcagctggtgacaagctcaaaatcacagcctctaatccacttctcatgaaattatcattgaactcttcataaacaacttcacctgtcgaaatttcaacgccaacaacaccgactctaacatcaaaactcatttcaataccacagcctaatgtctccgacttaactctctcatccacaacacaaaccaagaaattactctgtgaaccaaaaccttcttcaccaccacaaccaccacttatatcctcagccgcttcaagcgtggctttggtatacaacgccgacagtccccggaaaaaagggccggtccggtttgcaccatgggacttaatggctgcagtttcagtctgcttcactacaccaatcttgtatcctgcattcaccagtcttctcacatggaaattcaatcgaaatgttggcacactcgccgtcatgaaattgtgatccatatgagcgtaaatacccaacacgcgtgctgcgatctccgcgtcttctccgaagaatctgtacctgtaaccaacttccaccatcaaaaccacatctgggtacttgctctttagctccaccacttgctgttccaatggtgtgtatttcctcgatgatgacgtttcgggaacatattcctccggcgagggttccagaaatctctggagaaatctttggtgtaaattgggatcgggtactgggttttgagtgtgaggagaaagtttaggctttttgggtgacgcggcggcgaggtggtcggagagaagcttacgcttggaaggagagaaggatacagtggcggatatcttcggtggcggtgttgatgattcggctaccggattcggttcgtgagtcggggatttgggtttgggagcgaagaaacgagaaatcgtctgctgcttttgcttgcccataattgctttattcgtaatctcctccgtttaagagaaatggaaggtcgtggtcgtggctatggcgaacttgggttgccaattttcgcgcgctttcttaggttgccaatctctctaatccatcactgtcactgaacaacaaagtgacgaagccatcggttcggagcggttattatgggccgggtctttataaatgggccggtattttttaaatgggcctaaagtgccactataacaaatgagtatactctagaagttggtggtgtcattaattctccgtcgagatcgcttctctccccgttgccgtccgtccccaccgctgagtgatagatcgaaacagagaaacacacacggcgaagaagatttcaccatattttgtctaagtggattctgttgagagagagagatg

SEQ ID NO: 6738 - DNA, 3000 bp, Unknown
  misc_feature (1)..( 3000): cDNA_ID_1815418_gDNA_ID_1621103_Annot_ID_55928 3000 nt of promoter + ATG
acataagcgaaaaacagacaaatcgggaaccaaaatcattctctaaacaaaatgtaaaaaaatctgatttttggctgaaaaaaacaacaaaaatctgattgtcagtatcctacaaatcgataaatcgtaagaagaaaacataaaaataatattaaagttgtgtgctaaaagcaaccttaaacaaccaaatagcacttcgaccaatgtcgaaaagcaaaaaccgtaaagcggtgctcgtatgaatgttgaatgggataaagagcggcgcaagatctgatatttggctggaaaaaacaacaataatctgattgtcagtatcccacaaatcgataaatcgtaagaagaaaaacataaaaataatattaaagttgtgtgctaaaagcaaccttaaacaaccaaatagcacttggaccaatggcgaaaagcaaaaaccctagagcggcgctcgtatgaatgttgaatgggataaggtatatatgagattctcgacggaaagatgtatgggcttcgataaagaatatatgagattctcgacggaaagatgtatgggcttcggcccataactctttgatattagtatagaaccataacaaaagaaaaaaaaaaaaccttaaacaagtaaacactaaacccaattgattctttactaaatttagtaatcaatggttattgtgaaatgaaatttaacttttctttcatatgaaaaaaaaaattgaaaccatccatggatggcctagttttatttagataactaaatatctatgttttgaaatagtaatctattacatgacacaagaacgaagattaactaaatcgagaaagaaaaaaaagtgtagatttggtagacgctgaatatataaaaaaactaaagtgataaaacaaattgtctttttaaaaaagtatggaattttcaaatttcccattctttcggtatatgatgagaaccttcacatggattttatttttaacaacaaaaatcaatgttgaaaagtgtatgtacctatgaaacaaaatcagggtcttaactagttttttgttttggttttggttttaatcttttctagttgctttgccttatttataagcgcagatgaggaagagaaaggcgaaggcacatcagctgcatgggacgttgctgaagctgtggcgctctcattgtgtgatatcttcaatctctgttaatagctttgtaatggtggtaacaatccaaaaatacccaattacaatcttataagtaccaatcatcatccatcctatggtttttcttttttaaacaaaatccgatataaaattaataaaaatctattgtattaacactaaaggtctatttacgaaaatttatagttacaatgatatgaaatgatagaaaaaatgaaagattataaaattgtattgaccgaaaaaagaagtttaatatatatatatatatatagggatactcattagaaaatctatatgcttagtgaaaaatgactccttcccataatattaaaaacagataaacgaaattgttaactaaatttattcaacaataataaacttttaacaatgacaggtcacactttaaatggaaatatgcattgatagactttctcggttgaagttgtaactctagatttatttttgtagaatttaaagatgtattttgttccttttgttgtgagctatgaaattaataccttataattgtaggttttaggaagcggttgatgtatagcatgtgcagagtaagctcgaaatggctgagacgaaaaaaagtgtcgccacaatgatttactttttactactatacttttgatcattgggacctaatggatgaatgttgtgtgttgtggacgagtttatgacacataacaatattgtagacaaattgtctaatttgagtagagatactaaaatttatctccatataattgtatactgtatatgtataacaaataattcaattcattggcctaagatgttttattgtatctttgtagaattttacactttagagaaaaatcattgcaataactcgatgaaaaaaaatgtttatcttatcctagttacaactaactatctatctatctctttgtggtaggagatttgcatctgatcgaacgattcatatggtgccacgtaactatggtcccacttctattacgagatctactaagacatcagcacgtgtcggtgtcgtttgatccacgaggtcggtgacgcttagagctagttgaccggtacagtcggttattaccggttatactatatgtatgttttttggtcaaagatttggagctattttatagttaataaatcaagagttttttttttccacaactaggtcttaatttgtgattgtttttttcttccatttttccaaaattctcttatcaatttcaggttagtatttttgttactgtccctagcttttgactattgtactactgtataccctttttttttggcttgagaaattagattttgttatgtttgcgtaaaatatttgtgaactcaaaaataaaatctctttttttttcattgccgatattttttcttccatgaatgctgctgtaaagtattaatttccctctctactgagtttcttccaaatttctgatttttgggatttgtgcaactcccaagtcgatttcagtttctgggttttgatttgagttcgccgattggatttgaagttttagtctttgttggtaagttctatcctttttgagatgttgaatttgctcttctgataattagggcttctgattattagcctaccaatctttgatttggttttcatttccttcagctaaatatttgtaattcttggatcctgaatgattaaccatcttagtttgattggtgaaagtataccatagctgcttaggatccgtttggctttgttatttgctcagattctgaaaggaagggtttaaagtttcaagcttttcattccgctgaatcagtccttgtatttggacggcttgatctgttatctgctctcgtgggtggggc

SEQ ID NO: 6739 - DNA, 3000 bp, Unknown
  misc_feature (1)..( 3000): cDNA_ID_1977112_gDNA_ID_1621103_Annot_ID_55930 3000 nt of promoter + ATG
gccaacgccgcttcagcagccgctttttggatatccttggcgcatgttgactccgggattcgtagccgccaagccgagtcagcgaagttgagacatgctgatcggccacggagggctaatgcagcgacgtcgtgagcacgagctgccatctcagcggtttggaaagtcccgagccaaatcctggttttcttgtttggctctctcacttcagaaacccacttaccggagtttctttgacgaactcctctgtaaattgggtgacgagtctcacgaaacttcttacggcccgccggtttcttcggacaactcgtggccaacgtcggacaataatctccgccttgaggctcgtaatcggagccaaacatttcagaaaaagctgaaaatgagttcattgatcagagtactctgtttcaagaaactggataaggtttaagtagtacgtagttactagagttctcagtctttttggattaataaaagatagtatatctgtcttggtaaagctatttatatctctctctcttttttttcttttcaggtagattctttttcaagtgtgtagttagtataaaaagtgagagtgagaattggtgtttatattggccggaggagagataacggatatgtggggagcacacggagtttttgtctctgtgaatgacacgtgtatagtacatagcgaagcaatcccacgatgttccactcgctgtctgacgtgtgtcctttgacccttgtaaagagacttttgactcttcactcgttaacctttatgagttctttaaattctatcgagtgtgtgcctgtgtggttggctggctgctgttgttacaatcgtttttaaattcctatgaataaacaaattgtcattaattgtcacccgtctataacataatagacataaatatctctgtgaaatgatattttaaatactcatgtagtatttgtattggaagtagatgtcctaatatttaaccaaaaataatactacaatatagaaaagcttgattttttaaaaaaattaatcagatttggtaatggataattatcaatttcgatggacggttaaaaatgagtcataaatgcatatgatgaacaaaattattcagtttaaacaaactataaccaaaaacatgtaaatggaccaggacaggactaagcgaaggattagaccaatacaaaatagcaagttatcttgaatcccaataattcccacaaaatatctcaatctcaataatagctatattgtattgacaaaaaaaaggtataaaaaatcttcacaataagatatgcatgaaatatattcgctgacaaaaatatctctctcgttacctctcgctctcacgttattgacatttaggagaaaagaagacacaacaaagagggaaaaaaagagtggtaaggtgaagaaaacaacaaaattggctttagtggaaaatagaaagtaaagcttgagagtgacgtatggggccagtgaaggctggtggggaaggtagggacagtgtttccgcggccgaaccacgggtttagaggattttgacgtccccacgcattatcttgtggaacccatctttctgtttttggaaaatcgtacggacgttcgtttttgaattatttgctgaatcgggttgtttgggtttctactctgttttgggattcttcagtggattggactggatcttttgtagctttttgttggtagatttgagacgcctctattttatgaatatcttaatagctttttgttgcatattcaagcgagataagaagataattgaggctttatggcatatttgaaaagtcgaaactcgttctcattccacgtgtgatgatatgttcgtggccacatatcattcggccttgaaagcaactactaaactcttaacataagtgaagcaatccaatgaagaggaaaacaatttatttaattaattgtaatatataaatatacacatttctttataacaacaattattaaacttactaacaaactcatatgtttcatcgaatccaaaacttgacatgtgggatcttgagagtgttaagttgcaagactttttaaaaacttgtatgcattattcattgtgtagatgttatgtgatacatgttctagttctattaatcagtatattctaatcaaaattaaaaaatctaatatttgtttgtcttcataatctgttattgttttgtttttttagaaagcagcttcaattttgtttacttgttgggcttcttataatttgtttaacatataggcccaatactcctaaaaagtagacgttctcgacttctcgtccttcagacaaaataagaaagtcaaaatgtgttctgaaaaaaatatctttgaaactaaaaagaaaagaaaataaaataaaaatccaaatgatctctcttgccttctttatctaaatcgtacctaactctgttttcagtttcacctatctctcgacgcgagcttcttcttcttctagggcttccacgcgactacgcctgccaaaatcattctacaggtaaattgatgcagtttattcactctctatatcgtcgtggttctcatctccttcttccttcttttttttttggttggtgaaaagtagaacaagagaattggtccatctcgttttttataagttgaatctcatcagagccttctttgtttttctggtatgaaagattcatgctttcgtggattgttctcgttttctctatcttgtgaatgatattcagatctaactgtagttagattagatctgttgcattgtacttttgattctaatactgtctagttcagttcctagatttaactgatttggagctcgaatagatgagtttcaagtcctaatttactgcaaaacaattcgatttagtgtgagggctctagtttttagtgttaaaagttttcatcttggtgacaaattagttgtgatattcgtgtttaaattatcatttaaggaagtctcatgaatcttttttactattgtggttgtctatacaggaagcatg

SEQ ID NO: 6740 - DNA, 3000 bp, Unknown
  misc_feature (1)..( 3000): cDNA_ID_3100805_gDNA_ID_1621103_Annot_ID_55932 3000 nt of promoter + ATG
tgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatacaaaacaaatcgttttctacttctttgcttcacataagttaaaagtcaaatatttaacaaaaaagatattaaaagtcatattgtagttgctttcaaggcaaaatatgtggacagatcattacacgtggatgatgtttgtaaatatgccacaaaacctgcattacattattttattctatctcatgtaagttacagatcttacaatttagcaacagaaagccacaaaatattacataaattggctcgtctcgaatctagcaaccaaaaaaattcagcccagttcactataaagaatataaaaaaaagtttcctaaaatagtgtataaaaccgaaacaaactaattcaacaaacccgaaataaacaaatccgtacgacaaccaaaaatatctttcagatgggttccacaagataacccagtgccaatcagaattctgaaagcgtggctcgaccgcggaaaccattgtccataccttctcttctttgtccccccttacgtggctcgctgtggagtctcgtaccacgtgtcgcgtcacttcactctttactttctattttccactaaaatcataatttgtctttttcttgaccatacccactcttttttcttctcgttgtcgtcttgcttctcctaaatatctcaaataacgtgagagacttgagtgtgagaggtaggtaacgaggcagactttttttggaagcgaatataacttatgctgatattttatttagctttctgattggagttgagatattatataggtattattgagatattatatacgtattattgagatttgagatattttgtagattttatagttctatcggactaattcttggcttaatccactaacatgtttttgtttagttaattaaactgattattttctgcgctatagttttgttaaacaccttttagacgtaacaaagcaattacgcttgatcatccatcgtagactctttttctttttttacatctcatagaagttttgtttaaacacagcaggaagtaaattattttcttattacgtacgtatgattgtttttagactattttagtactttgagaagtaaaattggggatacgagataaaagacaattgattaacatgctttttattttgacttccgaaactaatcatggttgtctatgtttataaattgtgttctttttgttgaaaaactcagataatgattaaatcagtagcgaatggatggagaacacatgattttagattgcataccgtaaaacaaaaaaaatcatgatggatgtagaacattcaaatgggtcaaataaatacgtatgtgatcaaaagaaagtatgtgatcaaaagggttagcacgagtaccttgggaggaaattcttctaattatgaattatgcaagaattttcgtcaagggaaggtggggaagaggtagctaaagaatagagaatcatatgactaaggacgtggtggttgaaggaaatgagagaatacatgaagaagagaaacttctttgagtgagaaggaagtgcgctggctggagagaaaagagagaaaagagtttcgagtgagagagagggcgttgagattgtgatcaacttaatgtaatatgttcttttattacattttctttttgtcatatactcaaaccttttactattttgtctcataaatctaacacaccccaccatttgttaatgcatgatggtagaaaatattaaatataattaactacttttatgtgatcaaaattaggtttcagactcgtttcgcgatccgatctacaattacaactgcatgcttctaattgatctaaattctaaattttttatacatattaaaaaaacaactttttgttaaattctcaatcatcatttttgtgattaacaattttttataactctaaaccaataatatttgattatttattttatatgtataatgatgattgagaattttaattagcagtctatttagggttttcctaaagttacaatatgttgttacccttctagttaaattttccaaaataccatatttcataacttttcaaactgtttattaattcaaccgtaaaaagcactaaaatgttacatttgatcattcacccaaattaaattcaaaagtttttccgccaaaactacttggtgacttacgtgcttatatacggacgactattattatgttctatacttttttatactttgttgcacaaatatctactctcccaattcatattctagaaggatgtgctataagaatgggagaaattacacaagaagagcatctttaaatatcctctcacaatctttatgtctaatacacgggtgaacaattaacgacaatttctttattcaggaatataataatgaataacggttaccctacacctagtacactaaatccttaacagccacacattcatacgcaaagagtttataaaactcataaaggtataataataacgagtgaataagtcaaaaaaagtcttctctggacacatggcagatcttaatgagtgaatccttaaactactcattttacaattgcttcgctgtgtatagtttacgtggcattaccagagacacaaactccgtcttcgccttttcttttgcctctaaaatatcttccgccattataaaacagcatgctctcactccaacttttatttatctacaaacattaaatccacctgaactagaacagaaagagagagaaactattatttcagcaaaccataccaacaaaaaagacagagatcttttagttaccttatccagtttcttgaaacagagtactcttctgatca

SEQ ID NO: 6741 - DNA, 3000 bp, Unknown
  misc_feature (1)..( 3000): cDNA_ID_3048857_gDNA_ID_1621103_Annot_ID_171501 3000 nt of promoter + ATG
cttttttagaatggatcttcttctttttttggttgtgagaaacgaatgtaaatggtaaaagttgttgtcaaatgcaaatgtttttgagtgcagaatatataatctttggtctccccataagcaacaaatcaaaatataatactattacgtaattcagtgaattgaaaacaaaaagtttgggctcacctgtaaaattaaagttagatgattctggcatttccgtgtctaagaaaagttctaggcacttatgtaaatagcaaaagttccaggttggttgatagcaacagtttctgcctttctgctaattcagcaaatatcaagactcaaggacgtttggtaaatatccaaagttccgtgagtttttgtaaatatgataaattataggcactatatagatatctaacgtttcaaaaaatgtttgaccccaaaaaaaaaaaaaagggtttcaaaaaatgtctgcaaataaaaaaaaaaggatgcggagacacttttaatttagtcaaagctttaggcagtaatgtaactgagaaacgatcctatgtaaatagcaaaagatacaaaaaaaaaataaaaaaaaaaaaatagcaaaagatacaagatagtgatagtgtataagtagtatcaagagatttatatacagtatttatggaaataacaaatgtttcgagattgtaaagagaaaatgatccatatagtaaaaatctacgggatattttattggtgagtagcagtaaaatccgaacacttgtatatagcaagatacctacccggcaaagcacttcacataagtttcgggtacttcgttgaatatcaaaagatctaaggcagtaaggctctttggtaaatagaaagttgggtaacgctttggtaaataaaattttgggtaacttgggttatattcttctttgaatagcaaaagaagaagtgagcaactggggtaagtagtacagttttgatgatagcaaaagttccaagtgctatttggatttctcaattaggagacatgatgatcaattttgatgacagctaaagtttgcatcgagtccataacccaagaagaactttcacgtaaaccttttcttttggaaaagaaaaaagtgtaactatcatgatttttgtttttctttgttttgatgacaagtatttctcctcgtgaaatcagttttttttttcttttaatgaatataaagaataaatcagattattgagattcacaaaaatccatcatcgcaagttcttacgtattcgaaagacgttactacggttactaacttactgtatatgtatgtgatgtcgaaaaagaagaagagaagacgttacgtcactacttgtatgttcatcgatcagtccacgtggctttttgtaaggtccgagagaggaaagtgaaattcagacgccgcttttttttttttggatgaagttccaaaattagccattttatacagtggttaagctcgttggaccaatatcaatggcgtctgcaacgactcttctcttccaccacggttccactcgagtcctcgtcgctcgtagacggtgccaagcttcagtccttagaccctacggcggtttaaagccctttctttccttctgcagcttacctaactccactgcgccgttccgggattcgttgagagcaaaatccgatggattggctcgggcctatgttaccggagcgccgcctatcgtggaagaaccagacccaaagattgaagaatccaaatctgaggctgaatcgaaggatttaattagttgggggcttctgtggagcttgatgagcaagcacaagctcaggctcagtgtttgcttattgactctccttggatgcagtacttgcactctctctatgcctgttttttctggtaatcggttcttcaatccactctcccaccattagcaaattgtaactgtactctttttttctctttgggtttgatgtagtttaagtttgggtatgatgatttagcttgtcatctgtgtttctctttatcttggtgaagctgttttataatggtaagtgttattgttttgagtaaaggtagattctttgaagtactgattggggtgagaccggagcctttgtggcggctgctgagcaaaattgctgttttgtactcgttggaacccatctttactattgcttttgtgaccaacatgactgctatctgggaaaacgttatggcaatattaagagctcagattttcagaagggttttgatccagaaggtatgttttgtttagtatgatcaaagttcgcttaagctatattgttggctgtattgaaatatcattgatgggtttcttttttttgtcttttatatattcaggcagagttcttcgacaaatacaaggtctgttccttttattcttggtttgctcaggtttgagacattttggcacaaaccttccttatgttagattgagttcatttgttttaggttggagagctaacggggctactcacgtctgatcttggtgctctgaatagcattgtgaatgataacatctcacgagatcgtggatttagggcatttacagaggcaagccatttctttactatgcaaatgtgagatttttgtgtttgtacatacatttttcataatgaatacagatttaatcttagcctggtgttggtgtctgctgttatttttggagttctataaatgacaaagactatcctgttgcatctcaagaatgcccagttctcatggcttatgcgttatcccttttgtaggtttttggaacaatatgtatcctatttactctatctcctcaacttgcacctgtacttggtctattgatgctagctgtgtcagttctagttggtaaattctctatgtctttttcattctcctaaactttttatttttggtaattactttggtcatctttgcttactttgcttacctctacatctactccctcggtcaaatctcaaaagctgtgtacaagagatcgactgttcctgtttataaatcgcatggattagctcaagcaaca

SEQ ID NO: 6742 - DNA, 3000 bp, Unknown; identical to SEQ ID NO: 6740
  misc_feature (1)..( 3000): cDNA_ID_2990367_gDNA_ID_1621103_Annot_ID_171498 3000 nt of promoter + ATG

SEQ ID NO: 6743 - DNA, 3000 bp, Unknown
  misc_feature (1)..( 3000): cDNA_ID_3073941_gDNA_ID_1621103_Annot_ID_171496 3000 nt of promoter + ATG
atttataaacatagacaaccatgattagtttcggaagtcaaaataaaaagcatgttaatcaattgtcttttatctcgtatccccaattttacttctcaaagtactaaaatagtctaaaaacaatcatacgtacgtaataagaaaataatttacttcctgctgtgtttaaacaaaacttctatgagatgtaaaaaaagaaaaagagtctacgatggatgatcaagcgtaattgctttgttacgtctaaaaggtgtttaacaaaactatagcgcagaaaataatcagtttaattaactaaacaaaaacatgttagtggattaagccaagaattagtccgatagaactataaaatctacaaaatatctcaaatctcaataatacgtatataatatctcaataatacctatataatatctcaactccaatcagaaagctaaataaaatatcagcataagttatattcgcttccaaaaaaagtctgcctcgttacctacctctcacactcaagtctctcacgttatttgagatatttaggagaagcaagacgacaacgagaagaaaaaagagtgggtatggtcaagaaaaagacaaattatgattttagtggaaaatagaaagtaaagagtgaagtgacgcgacacgtggtacgagactccacagcgagccacgtaaggggggacaaagaagagaaggtatggacaatggtttccgcggtcgagccacgctttcagaattctgattggcactgggttatcttgtggaacccatctgaaagatatttttggttgtcgtacggatttgtttatttcgggtttgttgaattagtttgtttcggttttatacactattttaggaaacttttttttatattctttatagtgaactgggctgaatttttttggttgctagattcgagacgagccaatttatgtaatattttgtggctttctgttgctaaattgtaagatctgtaacttacatgagatagaataaaataatgtaatgcaggttttgtggcatatttacaaacatcatccacgtgtaatgatctgtccacatattttgccttgaaagcaactacaatatgacttttaatatcttttttgttaaatatttgacttttaacttatgtgaagcaaagaagtagaaaacgatttgttttgtattgaattattttccactcgtttctacaacaataaaataaaataaaatgaaggaaccattctaaaaaaaggaactagaatattttcaaactatagtacaaaaatggaaacgactatcgaatattagtaactccaaagcgacacgtcaccatctccttcgccgtcataattatgattccattgaacagacggcggcggtaaaagcatgccttcagccatattatccaacaaagtcggcatcccaaacattgtctcctcatccatataaaacgcaccttcgctctgttccggtgtataaatagcttccaccatcgtctcctccatgtccaggccatgattcgtggtcgtcgtatcacacgtctcatcttgaaaagccaacgccgcttcagcagccgctttttggatatccttggcgcatgttgactccgggattcgtagccgccaagccgagtcagcgaagttgagacatgctgatcggccacggagggctaatgcagcgacgtcgtgagcacgagctgccatctcagcggtttggaaagtcccgagccaaatcctggttttcttgtttggctctctcacttcagaaacccacttaccggagtttctttgacgaactcctctgtaaattgggtgacgagtctcacgaaacttcttacggcccgccggtttcttcggacaactcgtggccaacgtcggacaataatctccgccttgaggctcgtaatcggagccaaacatttcagaaaaagctgaaaatgagttcattgatcagagtactctgtttcaagaaactggataaggtttaagtagtacgtagttactagagttctcagtctttttggattaataaaagatagtatatctgtcttggtaaagctatttatatctctctctcttttttttcttttcaggtagattctttttcaagtgtgtagttagtataaaaagtgagagtgagaattggtgtttatattggccggaggagagataacggatatgtggggagcacacggagtttttgtctctgtgaatgacacgtgtatagtacatagcgaagcaatcccacgatgttccactcgctgtctgacgtgtgtcctttgacccttgtaaagagacttttgactcttcactcgttaacctttatgagttctttaaattctatcgagtgtgtgcctgtgtggttggctggctgctgttgttacaatcgtttttaaattcctatgaataaacaaattgtcattaattgtcacccgtctataacataatagacataaatatctctgtgaaatgatattttaaatactcatgtagtatttgtattggaagtagatgtcctaatatttaaccaaaaataatactacaatatagaaaagcttgattttttaaaaaaattaatcagatttggtaatggataattatcaatttcgatggacggttaaaaatgagtcataaatgcatatgatgaacaaaattattcagtttaaacaaactataaccaaaaacatgtaaatggaccaggacaggactaagcgaaggattagaccaatacaaaatagcaagttatcttgaatcccaataattcccacaaaatatctcaatctcaataatagctatattgtattgacaaaaaaaaggtataaaaaatcttcacaataagatatgcatgaaatatattcgctgacaaaaatatctctctcgttacctctcgctctcacgttattgacatttaggagaaaagaagacacaacaaagagggaaaaaaagagtggtaaggtgaagaaaacaacaaaattggctttagtggaaaatagaaagtaaagcttgagagtgacgtatg

SEQ ID NO: 6744 - DNA, 3000 bp, Unknown
  misc_feature (1)..( 3000): cDNA_ID_2175786_gDNA_ID_1621103_Annot_ID_171494 3000 nt of promoter + ATG
gctggtgagccttttttttctttctttctttcttctgcctcttactactctgtctttgtggttaacctgaatgaattataataagcagtattgttatccactaagtacaatgaaaaagcgaaattcaaatgcatttcatgaaatccactctcgtcttcattccatccacgagaaggctctggtggactatctccctttggaaggagtactaaacattgaccacattcacctggccacctgatgcagcctgcttgaactttggaaagtacttcagaggaataagatttttagaaaaaaaattagtgtaaaaccgcattttctttgacgcaggatgtgtttgataatcttgggacgcctatactcacacctggccatgaatggaccatagggaaatccatctcttatccctcaaaatcagtcactttccatccgcattagcactgccatcttaattgcatttcattcctcatcactttgcacacttggacatgcctctgcaatggagaaggctctctattttcattcatatccccgtctgacttccacattttcagttgttccttgacatattaattccataatgcaaggtctgtaactgcttcactggtcatttggagtttttttaaggttctaggaatgttcaaaatttaatatgttctaggagttaagttaggcgttgaaggagggaggacagtgttcgtgtatgttgaaggttcttaatctggtccacttcctcactgttaatgtactcagatctttgcttttggctttttcttttttctccagggtttgcttttgtatacatggaagatgaaagggatgcggaagatgccatccgagcacttgaccgctttgaatttgggcgtaagggacgcagacttcgtgttgaatggacaaaggtaggatacttaccccaggatttatttctttccagacttagttatgaggtttgaaatactgataacataaatggttctgtgtatatagagtgaacgtggaggtgataaaagatctggtggtggttcaaggagatcctcatccagcatgagaccttccaagactctctttgtgattaactttgatgcggataatactaggacccgggatctagagaaacactttgagccgtatggaaagatcgtaaacgttaggatcaggaggaattttgcatttatccagtacgaggcacaagaggatgccaccagagcattggatgcttcaaataacaggtttgttctgtccattttagtatctaatcactttcctttcttagactcacgtttcatctgtgttttcattcagtaagctgatggataaggtgatctcggtggagtatgctgtgaaggatgatgatgctagaggaaatggacacagtcctgaaagacgccgtgataggtcacctgaaaggagaaggcgatcacctagtccttacaaaagagaaagaggaagccctgattatggccgaggagctagtcctgttgctgcctacagaaaggaaaggaccagtcctgactatggtcgaagacgtagcccaagtccttacaagaaatcaagacgtggcagtcccgagtatggtcgtgaccgcagaggcaatgatagccctcgcaggagggagagagtcgcaagccctactaagtacagccgcagtcccaacaacaagagagagaggatgagccctaatcacagcccgttcaagaaggagagtccgagaaatggggttggtgaagttgaaagtcccattgaaaggagagagagatcgaggtctagccccgagaatggccaagttgaaagccctgggtcaataggaagaagagacagtgatggtgggtatgatggtgcagagagcccaatgcagaagaggttagattctgaaataggtcgatacttgtttatatattattgatgacatgaatcgtaaaccatttctcttgttgttgcagccggtctcctcgttcgccaccagctgacgagtgataagagtggatccacaatctctatcaaagtaggatgttgtaactgtttgtagtcaacaacgctatgtcgtcgtgattagtttttgtcgtttggtttttgatagattcgaactcggatcacttttattgtcggattgaaaaacttatgtcaagttactacatttccgtttttttttatcacctctcagtttgaaccccaatcatgtaatgctttcccgtgacaataagatgcgaacctcaaaacatcttgcatcgaaacaccttgagagtgacaaaatcgaacgcatcgttaagtaacttaaatggtacgccgaaattatggaaggcaagaacggttctattgacttaattgggtctaaaaactactctaaacgcctcttgtcaacgttcgaactagtccctaacctttgactcaaatataaatattggctacaaatagacttatagttctgcctacattggtcgtctgctttagtatatttgttaccaagtaaaatgctgctgtagagtttaatgatctctttgtctactgggtttctccaattttctgatcgttgggattcgtgcaagtcgagagagtctacttggttgaaactttctgggttttgatttgagttgcccattggatttgaagttttagtcttttgttggtaagttttaccctttgagatatgctcgtctgatagtatagggctttcgagtgttatgaaaaattcgccttttcgtcttctgatttggttttcatttccttcagctaaatcttcgtaatacttggatcctgaatgattaatcatagctagaatccgtttggctttgttatttgggtcagagattctgagaggacgctttaaagagtcaagcttttcattcctctgaatccgtccttgtattggacgtcttgatctctgtatgctctcctggagctatcgaatcgagtttctcattgactgatgctcttggttccgaagctgtatatatgcagaggagcagtggcatcaataatctgcatatcccgacttcgccaatg

SEQ ID NO: 6745 - DNA, 3000 bp, Unknown; identical to SEQ ID NO: 6738
  misc_feature (1)..( 3000): cDNA_ID_1815418_gDNA_ID_1621103_Annot_ID_171493 3000 nt of promoter + ATG

SEQ ID NO: 6746 - DNA, 3000 bp, Unknown; identical to SEQ ID NO: 6736
  misc_feature (1)..( 3000): cDNA_ID_1815434_gDNA_ID_1621103_Annot_ID_171489 3000 nt of promoter + ATG

SEQ ID NO: 6747 - DNA, 3000 bp, Unknown
  misc_feature (1)..( 3000): cDNA_ID_1839096_gDNA_ID_1621103_Annot_ID_171488 3000 nt of promoter + ATG
agccgaaaacgttgtttaacaggaagaggcgtgtattaccaatggtggagccaagtgactgtgtagagtcttgaacagattctgtagacttttgcgtcacttcttccgtcgtaccagcgatccaagaagtaacagctcctctcagcttctccgcaatccctccttcgcctttctccgcatatgcttcaccctgtttcgtagctgcttccgagctcggatccttaaaccctcctaaccttttctccacctcctccgattgtgtcactatccctctcttcggtggcgcagtttcgccaccgcctcctccaagatgaagcttctcagtgaccacttccgacaaagccttgtcttcctctcccggactcagtttctccgtaaggaattctttcgccgagacgcccctgtcttgtccttgctctgtcccggtcccggtgaatggtaacttcgtcattacactagctcctgtctctttaaccttctcgtaaactggagtcaccatacttgcgaccgtacttccgtatccaccagcggagctaggattttctgctccttccacacgattctcgtggccgccttccccggagtaacctaacttcgaagcgacggcgtttttcgccgccacagctttgtctgctacgaccgaagtcgctaatgagatcttatcggtgtagctgctctgattaggctggtgcatctcctctcctctcctctgacctctggaatcaaaaccctgagggttttgtataccttgagttctcgtcggcaaatcttttcccagatcaaattcatcactccgctccggagattctttccccaatctagatccatagtctcccgccggtatgtgcttgcccatttcaggtcttgacttagtatcaaaaccatgacttttctcccggagatctcttcccagtcccatgtgatcatcttcacctgtttcgttcctcctcccaaaagctgcgacactcggttgttctccagctcctagaataaagaaaggacacaagtcaaaagatataaattcctgaatcagaattccgagaagaaaaaaaacttacctttaccggtgggatcagtaactttggactgataactcgacattccaccatgagatccctgagcagtcggttttgtatcaaggccatggcttttcttctgcagatcagttcccaaccctaaccttccaatagctgagacagtcgatgctgctccaatttctccagtagctagataaagaaacagacaggtgaaaagagttgaaacttcttagcaaaaaacgtagagctgaaactttaaatcaggattaagagactagagaaaagatcttacattttccgatggggtcagtaactttggactgataatttgacaacccaccatgagatcccggagcagctggatcttggtccaatcctttgggtctgtcgatattaactttactttggtttcgagacttgtgttcatcaggaacaaatgttcttgtcacatcttctgttgcagatagtaaagacacgggagtgttatgcggcgtcagtgtaggagcccctcttctctcttctttctccggtacaccggagtgttttataggacgagacattgcttcgtggccaactcctctcactggctcagagggttttgtatgtgaagaggaaacaactggaaaagctttcgatcctggagggactatctcctccttcaccggaatatgagcttttcctcgtgctgctgggaccaatccaaaacattaaatactctgttttggtcaatagagagatcaaagtgaagcgaaggactgacaaacctggtgcaccgccgtggagttggttgtcgttgtagtcatcttcatcgtcttcttggtctagatcgtgatcgtcagggatgtgttctccacgatcgtgctcatgaccatgtccatgtttagtaagaacattcttgatcttctttgctttttccttcactttcttcagaacttttgatggtcctttttcatgatgcccttcttcctctgcattcaaaacagaggaacacgtaaaaaacattcattaggctctctcacttccagattttagaatatcaatagaaaaaaaactttacattgagattagaatctggtttcgcaatacctggatggtgaatccttattggctcctgtgcttggtgatgaccatgagtacgttgcaactgcgcttgtgaatccattttatttgctagatttgattttgttcttttcctttctatgcatccaaattgtttctgagaaaatatgaggagcttcttcaaagttttatacagagtcagagagtatgggaaagaggaggaagacgcatagccgaactacctctggatggctgtgtcctctgtactttatcttacgaaataccacgtgtcatgccacgtatcaggctcttgattgtgtgcgtggcgctctcagcctaatctttatccgagaagaaccgtcgatgttaccttctttcacaagttagcccactagcccattccaacaacatgccgtttcgatcattggaaaaacagcataacacagtcactgaaatccgaaaacgacaagaaatgatatcatatgaatagtttccattgcgcaatgggttggtccaacagaaatgtacataatgggccttaaaaaagatccagtatgctctatcgcggtttaatggtttggttggtggtagaagaaacagacacgaagcgcggaagcggaactagtagatgcagctactacaatatccacgtggcgaaacattagtcgtttatcgagaactgccccacgaaattacacgtctgaatagataaatcgaaaatggatcgtgaggcccacgtgtctgcgaagaagggcccacagtggattattgaaaagaagaaatggaaaatctgaggattgattcgtctcagaggccgaggttgaagattaatcggacaaaggagattagaagagtagaaaaaacgacaagaagaaagaaacacagttgcaggagagaaagagat

SEQ ID NO: 6748 - DNA, 3000 bp, Unknown; identical to SEQ ID NO: 6734
  misc_feature (1)..( 3000): cDNA_ID_1815437_gDNA_ID_1621103_Annot_ID_171487 3000 nt of promoter + ATG

SEQ ID NO: 6749 - DNA, 3000 bp, Unknown
  misc_feature (1)..( 3000): cDNA_ID_2175774_gDNA_ID_1621103_Annot_ID_171483 3000 nt of promoter + ATG
atccctcattttgcaatcattatcacccacctacctgtgatacctggtttcttctttctagcgatgaatctagcttttaatccaggatttgttttctactttttgcagtcggaaggagctccgagataaagaaattacgagtaagagtgatgatacacaggcgagttatgttttaggatctaaatttgtggacccgacacgtgttcttcaactttcatggctaccaaggtcaggtacttctgattgatatctggttctaccatcatggatcatttctgcacataggaatgtatgttttactgcttcaaattttaggggtctgaagcaatttggtatgtatagggtctttctataccgcgggttcttgtcggaggaagagtgtgatcatctgatatctctggttaatttccagttcttttgtgtttgagatatagtgatacattgttctttgtgtaatggttacttcttttctgttagagaaaggagactacagaggtttactcagtggatgctgatggaaagacgcaacttgtaagttctttgtattcttcaactttccaattagatattgtcatgttcttataacactatgttgtaaagacgctagtgttgttgtagactttgagatatatgtttggagttttatgtaacaccctttctcatatattgtcaagttaacacaaatgatttcacaccctagtatagcagtttccatcttggttgatcaaaatggcctttacaattgtcatgttccgttccttattttggtatcattttggataaactaggatccagtagttgctgggattgaagaaaaagtttctgcgtggactttcctcccaggaggtaactttacttatcttggttttgtaatctacggagactttgtgattgctcttggaaggtctcttttcttgtggccaaactgctggcttatgtttctctcttgacgcacatttttcagaaaatggcggctctatcaaggtaagaagttacacttctgagaagtcaggaaagaagttggattattttggagaggaacctagctccgtattgcatgaatctttgctggcaaccgtcgttctctacctctcaaacacaactcaaggaggagagcttctcttcccaaattcagaggtcagtttgatttctaacctgagaggcaaaaagatgacttttatttggcacaccacaatgaatgttgagttctcctttttttccagatgaaacccaaaaacagttgcttggagggcggtaacattttaagaccagtaaaaggaaacgcaattctgttcttcaccaggctcttgaatgcatctttggatgggaaaagcactcatttgaggtgccctgtggtgaaaggagaactgttagtggcaacaaaactgatctatgcgaagaaacaagcaagaattgaggagagtggggaatgcagtgatgaagacgaaaactgtggacgatgggctaagcttggggagtgcaagaaaaaccctgtctatatgattggctctcctgattactacggtacctgcagaaagagttgtaacgcttgttgattcttcaatcttatcgcaaataattgaacattttcatactcaagtacttgagctgtttttggtctataagatagaataaatagtgaatagttaagggtcgtggtggtaattaattcctcttggccataggagaaaagaatatactcacttagatcttctttgatataactagaagtctttgtctatgttgttatctatgtttctctcgaatcataaatttgcatcttgctgtttcttacgcagcatagtccctttctcttgctagttccaacatttttaaaattgcaatttcctataaatactagatattttaaaaacatatcaaccagtgtacttgttggctaaccaaaaaaaacaaacaaatgttttatcacaagttagagcactattgatgaaaagttggactagtttaacatgttatggtcccatcgaagagattatgatctaagcccaaaatttcatagtttttaaaaaatggtaatcaaaagttaagtagttaagtatacaggaaaaattttaaattgtaatattttttcctataaaaattggatatttatctggagaaaataaatactccatttggttccatcaattttgaaaaaaaatcagaagaaagaaaaaattagaaattgtatcactctcctatcatcggaccaacaagatctagacaattgttcatgaatcataatttttgtatgtctatcccaataactttcttcaaacataacagtctattctaatatcttacatgttaagaaataataaaataaaggattgataaagaaaaaaaaaagttttttctttcttagttatttttaaaacaaaaatacaaatttactgatcaaatatttgctggatttttttgtgatttgagcctcaagggttgttttgtttgcccgtactaggcctttataatttttcttccagagctcttttgcctcctcctcctctctccgaaattttctctcatttttctctcttctccttttttgcgtcccatcactttctctgattttctcggcgactttcttccgtcccaagctcctctgaatccccagaaggatcgctctcgattcttctcttcctcctattctccgcccgatctgttactgtttttttttttactggtacgtgatcggactaaccattctcttctcatgaacacacactaaatcgatttgaattcattccttcgtctatacatcactggtatttgattagatttcaaaccgcgaatactatgatttcaattccgatttttctctgttaggtggcttagtcatggaggaaattaggcatctgtctgtgttagtgattttgacgctatttgaatcgaatactgttgatttatatagttgcttaggggaagaatcggttcagtatataggtgctttgtttataggaatttgtgttttgtgaatgtatgttgcagtcgaattcaatg

SEQ ID NO: 6750 - DNA, 3000 bp, Unknown
  misc_feature (1)..( 3000): cDNA_ID_1815395_gDNA_ID_1621103_Annot_ID_55935 3000 nt of promoter + ATG
taaagaataaatcagattattgagattcacaaaaatccatcatcgcaagttcttacgtattcgaaagacgttactacggttactaacttactgtatatgtatgtgatgtcgaaaaagaagaagagaagacgttacgtcactacttgtatgttcatcgatcagtccacgtggctttttgtaaggtccgagagaggaaagtgaaattcagacgccgcttttttttttttggatgaagttccaaaattagccattttatacagtggttaagctcgttggaccaatatcaatggcgtctgcaacgactcttctcttccaccacggttccactcgagtcctcgtcgctcgtagacggtgccaagcttcagtccttagaccctacggcggtttaaagccctttctttccttctgcagcttacctaactccactgcgccgttccgggattcgttgagagcaaaatccgatggattggctcgggcctatgttaccggagcgccgcctatcgtggaagaaccagacccaaagattgaagaatccaaatctgaggctgaatcgaaggatttaattagttgggggcttctgtggagcttgatgagcaagcacaagctcaggctcagtgtttgcttattgactctccttggatgcagtacttgcactctctctatgcctgttttttctggtaatcggttcttcaatccactctcccaccattagcaaattgtaactgtactctttttttctctttgggtttgatgtagtttaagtttgggtatgatgatttagcttgtcatctgtgtttctctttatcttggtgaagctgttttataatggtaagtgttattgttttgagtaaaggtagattctttgaagtactgattggggtgagaccggagcctttgtggcggctgctgagcaaaattgctgttttgtactcgttggaacccatctttactattgcttttgtgaccaacatgactgctatctgggaaaacgttatggcaatattaagagctcagattttcagaagggttttgatccagaaggtatgttttgtttagtatgatcaaagttcgcttaagctatattgttggctgtattgaaatatcattgatgggtttcttttttttgtcttttatatattcaggcagagttcttcgacaaatacaaggtctgttccttttattcttggtttgctcaggtttgagacattttggcacaaaccttccttatgttagattgagttcatttgttttaggttggagagctaacggggctactcacgtctgatcttggtgctctgaatagcattgtgaatgataacatctcacgagatcgtggatttagggcatttacagaggcaagccatttctttactatgcaaatgtgagatttttgtgtttgtacatacatttttcataatgaatacagatttaatcttagcctggtgttggtgtctgctgttatttttggagttctataaatgacaaagactatcctgttgcatctcaagaatgcccagttctcatggcttatgcgttatcccttttgtaggtttttggaacaatatgtatcctatttactctatctcctcaacttgcacctgtacttggtctattgatgctagctgtgtcagttctagttggtaaattctctatgtctttttcattctcctaaactttttatttttggtaattactttggtcatctttgcttactttgcttacctctacatctactccctcggtcaaatctcaaaagctgtgtacaagagatcgactgttcctgtttataaatcgcatggattagctcaagcaacaatgtctgattgtgtatcagaaacgttctctgcaatccgaactgtaagttcttgacttcatcgtatttgtatcttttagggcagattaaattatctgaagaaactttgatttacccttgaagactcaagtaatttgtatctctttataggtaagatcattcagcggcgaaaaacgtcagatgtctatcttcggtagtcaggtcatatttcagacttcttactagctaaaactgatttcttctaaacaattgttcttttttctaactgatccataatctattaatctaaacttttgtttgatgtacagattcttgcttacaagcttagcggcttaaagcttggtactttcaagtctataaatgaatctataacaagagttgctgtttatatttctctgttggctctttactgtcttgggggaagcaaggtgaagacggtaagatatacctgcctgtaagacttgttgattgccattatgatcattcaagttgaaattatgcttcttgccccctaaaacataaagagaatcgtgtttttatgaatttctattgcagaagatagtgttactcgttgtttatactttctggaacaaatgactggatgtttctagctagaatcaagttactaccttctgaatttttaaataaaaaaaaactaagaatcaaatttctctgtatctctcttttgtgtagtttcttatgttgttacattttagctcttttgcactttatttttcttggttcttattcttaaaatttctccaacccagggtgagctcgctgttggaacagttgtttcgttcattggatacacattcactctaacatttgctgtaagtacctctgtctacacatcatttactgtcacacatatgctatacatgtaatttagtttaccataaccagtgattctgttatccaggtccaagggcttgtaaacacgtttggagatctacgtgggacttttgctgctattgacaggatcaattccattttaaacgcggtggacatagatgaggctcttgcctacgggttagaaagagatatacatacaaagaaagtccaagatgaaaaccttaaattgttcttgtctgctggcccaaatgtgaatatccgtcacctcgataagtactacatgtcaaatctgaaatcaactaacaatctacgtaccctaacatgggctggag

SEQ ID NO: 6751 - DNA, 3000 bp, Unknown; identical to SEQ ID NO: 4715
  misc_feature (1)..( 3000): cDNA_ID_1815496_gDNA_ID_1621104_Annot_ID_55939 3000 nt of promoter + ATG

SEQ ID NO: 6752 - DNA, 3000 bp, Unknown
  misc_feature (1)..( 3000): cDNA_ID_1815488_gDNA_ID_1621104_Annot_ID_55941 3000 nt of promoter + ATG
tttcttatgatgtgaaataacatacgttagtaagagtgtgtttttccatagttggtacggacgaatatatctatttaatgtcactatcttatttatgtcattcgaatgagcattctttgtttaaaaattttatgtttaaaattttataatattgctttaaataaaaaaaaataaaaaaaaaagtaaacgaggaaatatggatctacaacagacggattaaatcatgtaaataaaacttaaaaaaggggatcaaaatggctgccaaaaaaaaaatcggatcaaaatgacatggaactaggtatgcatgtcaaaacaacttttaacagcatgaaaactttgacttttgaggttaagaaggatagagataccaaatttgcttgctcaaagaatatagtactacattgtttaaaaccgaaccgaaccaataacccaatatgtttattaatttaattaactaattatattaataatattgtaataactaaactaagtaattattatctacaaaattctaacctttaaaaatctaaggttctacttctaactaaataactaaactaaagtatttattatttctaaaactttaactcttaaaaacctaaggttatacttctaacttctaaaaaataaaactcaaaaaaaaactttcgtatttcatttgttctttcgtttatacggctaattgatttttttgaagtaaactaataccaaaccaaatccaaccgaactaaaactggttcaaacacaaaccaaaataacttcggttgagtatggttagagtattacaaaacccaaataaaccgaacccaaaattaaaccgaaatgcacccctgataaatattattactatataaaatatatataactttaataattacataataacacctaaaaatgacataaaaagcaaaaatcccataatcatattttctacaaaattgtaaaacgaaaacctttatctgcgcatccagggaatcgaaccctggtcagtaccgtgggagggtactatgataccactacaccagatgcgctatttctgacaaacaataatcgttttatatacttatatttacattttctcggttcaaaatcgttattcctgtaatatattgatccatcccacgatcttcttttcttggtcgtcttctgaaacgctaatcggatccagaagccatggacaaaagcatcagcatcacctccaacgttagcacgacgacttccatggaaaagatcgaccacgccgctagctggatcagcgcaaccgtaatatccgctttcttcacctccctcgaacgctgcgcctgcgtcaatctctccacctctcatgacgacgacgacgacgacgacgacgaatcccatcaccgtcctctcgctctctccgccgctcctcatccaaacgacaccgtttagctctgttttttaacctctggtaatttataaatttaatccctcgtttgtttcttttgataatcgattggtgtggatttgtaatttcttgatttgaaaatgtatgtctactgtgtgtaaatgtgcatgtctcagaatttgattgttttgcgtgtatctgactttatatacttgggtttaaaatcagaatgaatcatcgtttttgcatttacattgaaaaaatatcaagaagagaatttggtagagatcatttgtttgttttgaagttttcttttgtgatcaatgtttctcgatttacctttttcatttcatttctgatctctgcgttcaactattaaaaccggaacagcatcagtttcatgttttattttgtcaatgtgtcagagatcctgtcactttagatttcatagtttcaaaagtgattatttgatcatgtgggtccctgctgtgagaaccagtgggcactggcctttagtttggttaaaagcaggattcaaaacttcatactagtttctttgttctaaaatgtatttagcctttttcaaactcaagttgcacttgttgtacaaaagacacttttcttttgaatctaatttaacattacattcaaaaaaaaaaaaaacttcatactaagtaaatgtcgtgtttgatccaaacttttcccaatttgtttgcttagcagggtgcaatcttgtttaaatatctttgtcatgtataatgtgattccatctcttcatccatatagagaaaatcttgtttaaatgtcttttgtcatatgaccatattctcacttgggtttctagaaaaagttttgggttctttgagtttgttgaattggatctccttatggcttagaccgtcgttccaactgctgaagaagcaagtatgttgactcaaaacagtcacgttatatctctgtctctttgataattcttggcttttatgtgttgggtgcctagtatcatttgttttaaaggtttagggaacaaaaggtcataaactataataagaatactttttacaatgttatttcctcagcaaaagtagcacgcattcacattctccaagtttcatcatttgttatttatgaacgcaaacaaaaaaactgtactattaacaagcttttgttaagaaaaaagtaaggaaaccctcttaggatatgtatgtttcaacaataagcttatatctttactcattaagcccactagacaactttgtgagatagatcttataagaagcgtatcactttatccccgtgattacttctcaaaacaacgagttttgatttgtgctactttattaaattcacgttctgttttcagaaattttgttttttctgataggttcgtattgaaattgacctctttggaaactggatctttcataagatagaaagagaggtccccatttcccaagtttatcaaacaaaaagaaaaaaaaatctaaattgttctcatcttgagacaaccaatcagaatgaaccatctgagtcagccaaagggtttaatagtcaccatttgccaattgtattcatactctttcctttttggtgcgttattctaagagccctagtcagaattcaaacatttggca

SEQ ID NO: 6753 - DNA, 3000 bp, Unknown
  misc_feature (1)..( 3000): cDNA_ID_1808204_gDNA_ID_1621104_Annot_ID_55942 3000 nt of promoter + ATG
agtatatatcaacatcatcatgattctaaagatgtactttgggttgaatgttgaaagtgacgatggaaagcatactcaataaccaattttcaggaaataaaatgcagagacgagtgtattacttaagtaaataaggcagagatgatttcatgtgatatattttatttacataataaatgttaattttaatacacactaaatattgttaatcgaccttcacaaatacaaataaaaagtattagtccaaggaagccgtatgtatgtaggaaatgaaaatgggtccccattttcgttggctagccaatacaagtgctcttaaaagctgattttccattatctctatatttccaatttttccctttgtcttaaaccgaaagtgatttttactttttagtttaagtggttaagaaagtaacgttttcaatcttttttggacagatttttgcctttggcatatactctttaacattgccatgttgatgaggcgacaatatcgatatttttttttttcacaagtgtgattggtaattatatgagccacacaacttttctcatttggaattcatagtcaatcgacagtgtcagttgcataacaaaattcatagtttgatccaatattaggtcattgaactgaagcaagtttcttatatagaaaagtctctgacaaaactagagtactcgaagatactagatcaaaaagagtactttctacacattatctccaagaaaaaaaaaggtgggtaagaaaacactgattgagagtaagagttcaatattcactcgaactcacttttggataagcgtaatcgagctaccaacgtgacaatgagctggaatcttgtactcaagacacaacaaggacaatacgaaaaaggcaaggagggagagaagctttgcatccccaatcatctattgtcgtttgtatgaaagggaacacacatgaagctctcagatgtgccaaacaagagagataaagaaagcttcacataagcatcatggtttttgaatgtgttcaaagtttgtaaagaatgagattttttgtgtgaatttggggatataaacgacatgtgaatatgtgataaactgaatatattaatttcgttctccttctacaatttaacagaattttatttttattatttttatcaatttcatacttgtaaaactctctgtccttctcttattgatatttgatttgatttttttgtatagtaaatatgttcatccgtgagagatgcatgtgagctttatatgttcaacaaaatttcaagcatatataatcattggctgaatccttacaaaaacttataacaatatgacttaaaaacggtattggatgttacggagactgaattattgaaaaataattgatcattagcaaataataaccaaactaattagtaaacaaattaaatatatttttttgtctatgaccgtgttccaagggagaggagaagcgatccagcacgcggtgagtaaacctcacgtgcgtaaaccttctcacaagattcttctttaacgtttctacgagactaattacttccttattcatccacataccacattgcctctcctgccgttttcacgtttactgctctaactactcgttgtctccatgtacttactttatattgtctacggtagtcccaagaccgcgcttattccgagattgatataggaaatacaagtatttaaaaaaaattaggattagtaaatgaggaaagaataatgagataatgagtgacactaagtatacaactaatacgtcacgattgtataattgtcccctacaagtagtcaaaccttagcccttttgaccgttaatatcttgcatttgacgataatcttttccgtgttttgatctgtttccactgtacaaaactaaacgttaataagctcagtattgggtacgttagtaaaaaatcaatcataaaatataaaataatctcactttaagctccaaccagagactgacagctgttagttagtttgaatactcaatagtaatcaattaggtttgaccaaaatagcttcataaattattcatcaatccaataagtcatttaagtgataattaccaaaaggcacatgatagctctctaaatatagatataccaaaatcaatccataccaaaagttgatgatttctttccctctacaccatcgatatgttgaatagtttagattttttccaatatttgtttaattattatttatattgcctttatatatcaaaagtgaaaaaatccaaacaaaatcttgtcaaagaaattaacactggataaatatttagttatttttggataacttgttttgaaattgagtttaccattccaaaatcagcttaactttgtccaaaaataaggaaaaaatcagtctatatttaacacatgtattctttgtaaagattaaatctaaaattctttaagacaaacttgtgtttttttttctgtatacattgtttccctagtattttatgtttcatcgtaatgcagcatcttttgctaacctctctagtaggttttaaacaagaatgaatattgttgacaataatatcataataaaaatattatactgtatacaacaactagacctaccactacgaaatgatttaaaacaagaagagagtacaagaagaatatgataaatttaattttaaaaaaattcaccgatcgtattgataaaaaagttgtatctacttttctctctttttacctcatcaattaaaaagttgactataaataacacattactatttcttctctctcgccaggcggcgttgcctacaaaaacctgacaatcgaaacacagtttttctgataataatatagacatttaccattatgcccttctaactgaaaacggcaattacgttccttgttatttgttttcttccttctccttctgtttcttttttgtggctttaatttttttcatattaattcggaaagagaaagactcttcactcccataacagtcgccggtaacagaatcactccg

SEQ ID NO: 6754 - DNA, 3000 bp, Unknown
  misc_feature (1)..( 3000): cDNA_ID_1815477_gDNA_ID_1621104_Annot_ID_55945 3000 nt of promoter + ATG
gttttttttttattgtgagtgagtgatatatacgcatatggttgtgatcgcataaatcattgtgaacgcaccaaacattcaaatattgttcgtaaaatatatgacttgtaagcttcaacgcattgctagaacgaaaacaagattaataaaacagaaattgaaaaacacatgaagatcaaagatggtcaactcatatagaaccggatcatgttttaatttgcagtcttttcatgtccttttaactaaaccttcacactgtcaagttttccttggtcacatacacggatacaactagtttcaactttgcacctaggtctgaattatttgtctcaccttgtctcaaactagttacattaacaccaacaaattagtgattcattgtagatttactaaaaaacacgttatctctcttcgagaaagcccaagtccatcatcacttattgggccgagagatctgagtgctagtttggggttacttcacgatccaggaaacccgaaagtgaagtctgtcatgagggtggctgagacggcggttttgggatctgatccggctaacggcggagcttacttggcagggatggcgacggcacaggacaaagccgtggatctaaagtcacgtgggtatcacatgatactcggagctactgatgtgcctttgtttaagaaggcggtggttgacgacgtcaaaagttttaagcttgggtcttcgtaaatttattatgatatattttgacgtaattataagttttatatgatgatgaataagttgtttttgtcggagatgttttgtgccaaggatatgtatgtaagagcagcctcaacgggaggtctaagtagggtactaaacacaaaaagatctaaaaattaaaccatttgtttgtcgtagacgatatgtaatgaaccatttgtttttcgtagaacaattgaatttgaaagcaattttacttgttctctttgatacgaaagatgtttaaactacctgtgtcaaagaaaatctagattgtgagaatgagacaagagaaagcaattgctcttgaggatgaacctgacaagagacctgatgttacacaactgagctcttttacaatcttttcttgcctttacttggttgattttagtgcatggggttatctcccggagatcaattccacaagacaaaaagttagtagctcgtaagaacattaggcgtgattcttatctgaattagcctaattttggtacgattttcgaatggagaaagaaaaggtcggagatttcaaagcacaaccacgatcaagacgctctacgactatgttgattggcttgggatcttagaaagcaagagagtatagtttaatatcaaacttcctgaggacaatgtacggtaaagacaaactctcgatgtctctgaaagatacatgtctgcatcctcaggcgagtctcttcataagcaaaaaccagataattctcttttgtttcttcgtttttatgtttcgtatatgcatgagaatcttgagcgcttaggttagatataatgtaggggatcctctagagtcgacctgcatttggtactcatgaaaaaaaaaaaattggttgattatttttccaaacataaacgatatactagtaatcttgaatgcacaacacatcaatatatgaaaaaatcattaaaatctcaattaaataaagagctacattatgattaaacaaaaaaaaacttcatggcgaaataccgataaatatagcaggagcgatatgctattctatagaattaattttcataattagatagttcataatagaaaatagttaagaagcagtaggatgaacccgatcatgataaccaatacaaccccatagagcaaacgcgatgaggatgatgaccataaggatggtggcaacgattgttacgatgaacgaagtatccatattgtttcttcaccgcaccaaattttttatttttttctaacctttcctcgtgtcttcttcttcttgaaattacatttatattgtaagtaaattggaaatagtggaagtaatttacattttgtcatcaagaaacatactagcaaattttttgaaattttacatttagtctcttaaaaatattacctaggagtaaaaattttgtaagtaaatcgggaaaagtggaagcttttacatttgtcatcaagaaacatactagcaaaatctggaaaattttacatttagtcacttaaaaatattaactaggaatatatataatagaaattttacatcttttggtattttgttggtcgtcaaagtaaacatgactatgttgattcgcttgtgcggttgtacgaagacaatgtactgtagagacaaactcttgatgtcgacgctatctggagactgcagtcttagataaccttttcatcgagttggaaataattagagaaaccaaacaaaatgcaagaccaacttaattctcttctcttgtaattctggagcttaagttagagattgggtgttgtcatattaaatttgttaatcatactgattactttcactcacatttgttcttgttattgtttatgttaaatcgtcactcacattgtatgcacatgtcagattcagaccaatgttaaaagtgcattattttgtttggaagcgtgtgagaaaacaaaaagtttatgtacataacataaatccaaaagtactactcgaataaagtacaaactttatatcttttaaactccacgtaataactcatttttgtttgttttaatcaaaaattcaaacgtctaaaatttcgtcttaaataagaaatgatattaagaaaaatatctttggattaataacagatcaccgaaaattagaatatggttttaccaacccaattaaattctcaaattaattggaaagagaataatgttgacaacaacaaaaaggaaataaatcgcatgcaatgaaaggaatgaatcttcttcttcttcttctctattaacgcttcttcttcttctccttcttcatcaccctcctccacttctctcagtcaca

SEQ ID NO: 6755 - DNA, 3000 bp, Unknown
  misc_feature (1)..( 3000): cDNA_ID_1815474_gDNA_ID_1621104_Annot_ID_55946 3000 nt of promoter + ATG
gtacggtaaagacaaactctcgatgtctctgaaagatacatgtctgcatcctcaggcgagtctcttcataagcaaaaaccagataattctcttttgtttcttcgtttttatgtttcgtatatgcatgagaatcttgagcgcttaggttagatataatgtaggggatcctctagagtcgacctgcatttggtactcatgaaaaaaaaaaaattggttgattatttttccaaacataaacgatatactagtaatcttgaatgcacaacacatcaatatatgaaaaaatcattaaaatctcaattaaataaagagctacattatgattaaacaaaaaaaaacttcatggcgaaataccgataaatatagcaggagcgatatgctattctatagaattaattttcataattagatagttcataatagaaaatagttaagaagcagtaggatgaacccgatcatgataaccaatacaaccccatagagcaaacgcgatgaggatgatgaccataaggatggtggcaacgattgttacgatgaacgaagtatccatattgtttcttcaccgcaccaaattttttatttttttctaacctttcctcgtgtcttcttcttcttgaaattacatttatattgtaagtaaattggaaatagtggaagtaatttacattttgtcatcaagaaacatactagcaaattttttgaaattttacatttagtctcttaaaaatattacctaggagtaaaaattttgtaagtaaatcgggaaaagtggaagcttttacatttgtcatcaagaaacatactagcaaaatctggaaaattttacatttagtcacttaaaaatattaactaggaatatatataatagaaattttacatcttttggtattttgttggtcgtcaaagtaaacatgactatgttgattcgcttgtgcggttgtacgaagacaatgtactgtagagacaaactcttgatgtcgacgctatctggagactgcagtcttagataaccttttcatcgagttggaaataattagagaaaccaaacaaaatgcaagaccaacttaattctcttctcttgtaattctggagcttaagttagagattgggtgttgtcatattaaatttgttaatcatactgattactttcactcacatttgttcttgttattgtttatgttaaatcgtcactcacattgtatgcacatgtcagattcagaccaatgttaaaagtgcattattttgtttggaagcgtgtgagaaaacaaaaagtttatgtacataacataaatccaaaagtactactcgaataaagtacaaactttatatcttttaaactccacgtaataactcatttttgtttgttttaatcaaaaattcaaacgtctaaaatttcgtcttaaataagaaatgatattaagaaaaatatctttggattaataacagatcaccgaaaattagaatatggttttaccaacccaattaaattctcaaattaattggaaagagaataatgttgacaacaacaaaaaggaaataaatcgcatgcaatgaaaggaatgaatcttcttcttcttcttctctattaacgcttcttcttcttctccttcttcatcaccctcctccacttctctcagtcacaatggcgaccaaaaaatctctgaaatcacgtctccaagatggagaaaagcttctcggccactttcttctctccttttctccggagcttgcagagatcgctgcaagagctggatttgacttcattgtcgtctaccttgagcacggtgccggcgggattcgtgaagcgcttcactgcattcgagcaatcgaagccgctggttgctccactgtcctccgtgtacccgacattagtcaggcttgagctaagaaagcgttagatctcggacccgacggcattatgttcccaatggtcgaaaccggaagatctgcatccgaggcggtctcgttttgcctgtatcgtcctgacggtgttcgcggctgtgcttactccgttgtgagagactccagcttcggatttaacgaagggtatttgggtaattacgctgataagctcttcattatgtgccaggttcgatcctcaaatcccctttgattttcaattttattggacgaaattgttaaattgaattctaaaatgcctacttgtgaaaaaaatggaagttagaatttttatgcaattgatatattttgtgcagattgaatcagaggaaggtatgaaaaatgtgaaggagatcatagccgttgatgggatggattgtgtgatgatggggccgagagatctgagtgcgagtttggggttacttaacgatccaggaaacccgaaggtgaagtcggtcatgagggtggctgagacggcggtgttggcctctgatccggcgaatggtggagcttacttggcagggatggccacggctcaggacaaaaccggtgatctcaaggcacgtgggtatcacgtggtgctcgggtcaaccgatgtgtcgctgtacaagaaggctgtggttgatgaggtcaacgcttttaaagcgtagtgtcggaattagattagagtctgaataaaacgggaattagagtgctttgtaataagtgatgagtttatgtaccccatgattatcttctactttgttagttatgtctactactttgttagttttgacttttgagcaagtcttgttaagattcgcattatccaaaagaaaatttaaagccgcattaacagtgtttagctctggtgttactaaagaaaaagtgattatgcgggtcaaacacttctcaaatagtttgctttgatttctttggagaactgaaatgcatgccgtttcgaaatattagaatgcatgtcgtttcgtggatttcagtaccagtaaaggctaatgctgatgcatcgttgcattttaaaaatcgtgtcgtttttcattccgttttagtggccactcttcgcaaccagataagaactcgaagattttctttttctttatcaaa

SEQ ID NO: 6756 - DNA, 3000 bp, Unknown
  misc_feature (1)..( 3000): cDNA_ID_1815470_gDNA_ID_1621104_Annot_ID_55947 3000 nt of promoter + ATG
tcgggtcaaccgatgtgtcgctgtacaagaaggctgtggttgatgaggtcaacgcttttaaagcgtagtgtcggaattagattagagtctgaataaaacgggaattagagtgctttgtaataagtgatgagtttatgtaccccatgattatcttctactttgttagttatgtctactactttgttagttttgacttttgagcaagtcttgttaagattcgcattatccaaaagaaaatttaaagccgcattaacagtgtttagctctggtgttactaaagaaaaagtgattatgcgggtcaaacacttctcaaatagtttgctttgatttctttggagaactgaaatgcatgccgtttcgaaatattagaatgcatgtcgtttcgtggatttcagtaccagtaaaggctaatgctgatgcatcgttgcattttaaaaatcgtgtcgtttttcattccgttttagtggccactcttcgcaaccagataagaactcgaagattttctttttctttatcaaaatgcaatctttatctctgcaatcgcttccatggaaaccaaattcagtgactttacctgaaattaatcttttgaatcccaagcaattgactgcctcgagttctcagtatcgtagaactcgaaactggagaattagaagttcgtcggaagataatgtagcaatttcgagtgacggcggagatttgaagaattctctgtccggtattgtgggaaatcaagtggaggagctattgagcagagaagagaacaaaggtttgcttgatggtctggaaaaagcttcgttgagagtggagattgcgaagagagagctcgaagatatagagagacaagaaattgaggcgaaattgctacaggattatattaatcagctcgaatcaagagccgcagaggtgagagcttgttctcgaaatggtgttagatatgaaaatgattgaacatttgattcttttgctctttggaatttgaggtttttgggaggttctactatagagtatagattaaggttgcattgagaatgattggtttatattacaatggactagtgaatttgtgcagtatatatttatatgccaggataagctcaagttgtgcattgtatgcttaggataggataggtaattcaaagtatcaatcaatatcaatggtgttgcttttgtgcttgaaacctggaaatggggtttctcttagtttgtgtgaaggtacttcattagataaggttactaactaaatcatgagtttggttgcattttgtgttttctcgtgttttggaacaaagtctctagtttggttttgtatttgtagacagagcatgttaatcttattcaatatctgattcaagattgcagaatgccagcaggagattgacgcagcaagatcaatggttgaggaagcagaacgctccttgtcattagcagataactcgacaattggaagttcggagaaaggttattcgattgataaagacaaggagaggttagaatctgcaaaagcggcagtgatcgcagctgcggttgggaccattgcggaactcccatttgctctttctcaagtcgcaagcatggagcagcttgttctgcccctgggaatagcgtttgcaagctgtgcattgtttggagtcacattcaggtatgcagtcagaagagacttggatgataatcatctcaaatccggagccgttgcagcttttgggtttgttaaaggtaacaacacatttgattactgtttctatctaacttctttgaattgttcaaaagcaattgcgttttgtgattgaataagcttaacagaaatggtaaaagaaaaagactttctttgtctttgtcatgttatatattgtgtggaagtatgagctggcaaagttcccatcgttgtcccgccctttggttgtttttaaattataatctgccagtaatagattactaatcaacgatttgatttattctaaataattgatgagttgattattagtctctgacctgtattatttggatctgtctttttttaaaaacagatttattatagattcgattttttttaatgtgttatataggacttggtatgttgagcagaggaccgccattggagctgagctgggaaagcttgttttcacatgggatagacggcgccgttttggtgtctcagagcgtcttgatatttgcgtttgcgtccataggtttggacttctgtttcaagatgaagctcttaagaccatttcctagctctgactagattgaagagcaaattaaaaatgtagaaatgaacaaaatcttcttttgaagactttatttgtttttttttatattattaattttggtctaaaatgtaaatgtttcatcctagatttttatgatctttaacttgtcacaaaaaaagttacacctgattttaaaagcatgatcataaggaatattgaatttagaatgatgaatccatacataattcaaattttgctataaaaaatgaatcagttgggataattctttcttttaactttgtataaaaagttatgaggaatatttatctttgtcaagtgatgaagtgattagtgacttgtgaacttaaccaaagaggtagatggggtcaaggccattcctagccattcattatttatagtaaagccacgtgtaataatcttagaagcttacagatataccacgtcagcacaaaacagttcttttgtctttcgatcgctctcaaatcgcgttttgtcgtggaggtcaactgatcagaaaaatatagcaagcagaaagtgaaaaacagctgaattattatttttctatacaaaaaattaaaaaattagtatccaatttcaatggggtttcgacttgttctcgagtaaactactagtctctatctctctcagctccagattttgtttcttcttcttctgtgttaaattcatttgatttgttgtatctgaaggcgaaattactggtttctgatttttggtggtattcagggcggttttaaagcgacggaagaag

SEQ ID NO: 6757 - DNA, 3000 bp, Unknown
  misc_feature (1)..( 3000): cDNA_ID_1808803_gDNA_ID_1621104_Annot_ID_171528 3000 nt of promoter + ATG
ttgggggaagaatggaaataaatattgcggcaaaaagataatttaaagaataaaactacttatatccttttatcaattgggtaactatagttgtctacttgtctttgttgtcgtatacccctaattataggaccactcacctaggttcaaatgtcaaaacatatggactattaagttcattgttagtaagtgatatatagtaggcctaacttaatcggtggttatatagtttttaataaaacatgtgtgttttaccaaaagaggactacattttaaaaagactccaaagtgaaccccaactttttggaaatcaggaaccactccaataagagacacaatgctcatataaactcatgataatatatgtgagcatttgtctacatatcacaaacatagtcgaattaaaccatctatattcctttgtacggtctacaaaatgacacaaatttcaattatggtgataaaagaatggaacataccttcaacatcaagctcataatggcatttgtcgactaacaatagtttgcttttatcctgcttgcctctgtaaatgtgagcattaacctgatcagaaagaagtaaaaatgtgcgtacaagcaatgatagattcagagataagagtcacctctcaagaacagagttggaaagaaccgacttgtctacgtaaggaatcccaagaagcatcctcattgttggaatgactagaatttcaaactttgtgcatttctcaaacaaatcttagttgctgacaaaatcttacttgttaaatgcactcttgtatgagaaatatcacttcaaaaaatgatagacattttgtctcttcatattccattgtcttctgagtaaaaagacacgtcttaacgtgaacttggtctctcagagacattaatcaaacaagttgaatgcaaaactgcaagtaacaacaaaataaaatttgggcacaataggagaggaaaacaaacacgagcgactctgatctgtattacaaaaagactagtgtctagtgacataagatcgtcgatgatctgagatgcgacggacgtttggtatctgtacaatctctggctagggtttcttgacttgccgatcacgacaccttcagcctcgcatgggccgctataatagctcaataatggcccactactaaaaatccatatttctgttattgagtaatcaataacttaacacatgttttaaattccccgccaaagtatgatcatgagagagaacaaaaattatgaactttttaaaatggaaattgatcttcttcttctttttctggttaaaacattcaacatttgtattgtagtatatgtagtaaattttatggactaaacgaaagatagaaatatataggcaaatccaagggaaataaaaattctaaatatatatatgaaattgcatggactgccacgcagtacgataaccaaatatccaaatttatacaacaaagaaatagtattgcgtcaaaattaaaatacactcgggagtgaaagaaacaaatttaatttgatagaaagacatcataccccaaagatcatgtatgtcattttcttaacctacgtgatccgtaccgttttacagttagatgtgtcgattatttatttaacaccggaatgttaggaagtcttgatatatatttgtcataactagtataatggtatattagttgttgccttggtggtacgagtgaatagaatttttcacatataaggacgaatcaaccatatcgccattagaaaaccttatacgtccagaaacggcaatgtaacaaacaaacaaaaaaaagaattggtgatatattgtttattaaaacctctacgttggtctgaaaatagatataattgcgtgtcatgaaacaaagaaataaacgagttagataagaaataattggattagcaaggtttagaggaacaagaaatgattattcaaatggaaaagtaaatacttttgtaagaaaataaaagcttattgaaatgaagaattgtgcatgatcatttgataaagccaagtcatggactgattcttctgtttcacaggacggttcaaccaccatgcacctctttttctttgggcgtttaatgacacaaaccacatttatctttttatatccttttttgttttgaatttatttggttacaactgttatttacctcttttatcttccaatctttctcaatttctaagttttttccatactaagtattttgttcatctgaagaatctggcacctttgtacattcaagaaagttttaaatgttttcactgcaagacaaacaatactgtgtgtacaattatgatagaaaacatttatatatggagaataatatagtcatgtgatacaattatgtaccacatctatacatatagaagaaacaaaaaccaccaatttgtcactcccaacttcattcacaactcacaagttaagaaaatacacatagtttctcttacacgcattactatggaaccttctgaattcgtttccagcaaaagttattttcttatttcaaaaataagttccatttttttatgtataaaaaataaagttaattgcaataaattcgccatcttcctatcaacatatatagatttttcgacaaattcatataaggagagtctaaaattaactcacagccacatgttatttagccaatgtttttaataccagaccggtcaaaccggtggatccgtgaccttatatagtaattctagagtctttaacaaaatctcaacttatgacatcatattatatattaatcacgtatcatctatagactatatacattcatacgactctctgattcttcgtttctctccataatatctcctagtctcaactctcaaatagagagagaaaaacagaaagacagagagaggttctatatattatagataaagtacattacacaattgtacaagtggaaaaatcatcacggatctctcttcaaatatataaagaagatttgtatatcaaactctctaagcttttgttgagccatg

SEQ ID NO: 6758 - DNA, 3000 bp, Unknown
  misc_feature (1)..( 3000): cDNA_ID_1815462_gDNA_ID_1621104_Annot_ID_171527 3000 nt of promoter + ATG
ggactaagattctcaagaaatcaggatttgttgcgaaaccattcacaagacaagagaacacaatgattcagacatctgctgttgcttgttacggcatcgctgtcggaggttaatttaagaacataaatttgcttttatttatttcttaatagtttattttcttgcgaaacaagcaaagattcagtgaaaggatctgtgaaacagttccaaacatactaaaatatattaactttttgaaaaacttttgggttagttgagtcacaaaaaagggttgatattgcttttgcttttgggtatgatataaaatctaagttgtaaaattttgatttaaaatatttgagtatttgtttttctttttcaggtgggtttgcttcatatcttctggggttaaaccataagacatatgtgttgtctggtgtgaacttggaaggtaactctccaaagagtgtgaaagaacctggccttggttggatgactgcttatctctttgttgtctgtttcatcggtctttttgtcctaatccctctccgaaaggttatgattgttgaccttaaattaacatatccgagtggtttagctactgcggttctcatcaatggcttccacacacaaggagatgcacaggccaagtaagttcattaacctattttacaaaaagtgatattgttacataagtttcctaatctttaattggaatcgatttgcaggaaacaagtgcgtggtttcatgaaatacttctcatttagtttcttgtggggtttcttccagtggtttttctctggtattgaagattgtggctttgctcaattcccaacctttggtttgaaagcttggaaacaaacgtaagcattaattatacaaaaacaaaacaaaaatatttcagtgaaacgagttcttgaatcatataataactaaaaacttttttttggtaggttcttctttgatttcagcatgacatttgtgggagcaggaatgatttgttcacatttggttaacctttctttgcttttaggagctatcctctcttatggcttaatgtggcctcttcttgataaacttaagggctcttggttccctgataatctcgacgaacacaacatgaagagcatttacggctacaaagtcttcttatccgtagctctaatcctcggcgacggtctttacactttcgttaagatcctctttgtgaccattgccaatgtcaacgcaagattgaagaacaaacctaatgatctagatgacgtaggtcacaagaaacaacggaaagatctcaaggaagatgagaatttcctcagagataaaatcccaatgtggttcgcagtttccggatatcttacattcgctgcggtctcaaccgtcgtggttcctctgatatttcctcagctcaaatggtattacgttattgtagcttacattttcgcgccttctctggccttctgtaacgcttatggagctggacttacagacattaacatggcttataactacggcaaaattggtctttttgtcatcgcggctgtgacgggaagagagaacggagttgtagccggactcgccggttgtggactgatcaaatccgttgtttcggtttcttgtattttgatgcaagatttcaagacggctcattacacgatgacgtcacctaaggctatgtttgctagccaaatgattggaacggtcgttggatgcatcgtgacgccgttaagtttctttttgttctacaaagcgttcgacattggaaaccctaacggagaattcaaggctccttacgctttgatttacagaaatatggcgattcttggggtgcaaggcttctctgctctgcctcttcactgtctccaaatgtgttacgggtttttcgggtttgctgttttggtcaacgtcgtcagagatcttactccggcgaagattggaagattcatgccacttccgacggcgatggctgttccgtttcttgtcggagcttatttcgcaatcgacatgtgtgttgggactttgattgtgtttgtttgggagaagatgaatcggaagaaagcagagtttatggttccggcggtggcttcagggctaatctgtggcgaagggctttggactttacctgcggcggtgcttgccctcgccggagtaaaacctccgatatgtatgaagttcttagcttcataggatcagtcaaagagataagaagacttgtgaagttagagtacttagaagacgtcaatgatattaaaatcatcctattcttagaataacaggtagacttctgaacaagaacatctcttcttctaggaattaagactaaaatctacttacatccggatgattcatgctctgttttttggtttggtataatttgtcaacacatctagatctgttccatttccggttatcttctattgggttatctctgaaactgttatgggctcggcccataaatttaaaccttggtgtaacaaaaagtaataaaatcagctatttaatcctatatatttgtttctttttttattatataggaagaaatccttgcctttagattgcatacactagaattttagtattttcaaaaaagaacactatatttcaaataaaaatggtatatatgataagttttgttaagatattatattcaataaattgcctaattcaataagcatattttagtaaaaaatcgcaaaatattcatcatctactaaacaggtcaagatgtatttgactatcttaagaaagaaatattaattcactttgaccaaataaatggacaattaggtaaccaaacaaaaaccacatgaaagtaacaagacagagaattaggcaaaccaaataaataactcacacaacccaccgctcaaccacctaccccttgtaatatatctctccccttcttctttttatttcattatcttccaaaatcctcaccacaaaacattatataatttcctcttcatatttcaagaaaactttaatctttttttgtgtgtagaattctatatttctggtaactaa

SEQ ID NO: 6759 - DNA, 3000 bp, Unknown
  misc_feature (1)..( 3000): cDNA_ID_2123342_gDNA_ID_1621104_Annot_ID_171526 3000 nt of promoter + ATG
tgctggttttgggttctcttttcaactcacacttcttcaaaagcgaatttgcttgtaacatgttaatataaaattattattaaatctataggattgtccttaatgggccggccttttacgatataaaatttggttcaaataaatgtcgaatacgtcttttcgttcagcccatgaattgactaaacaaaggggattagaatccaaacaatcaaatttcttctatagtttagtttagaacaagaccatgaccatgaccaatattatatatatcgattattcgtttttatatgttctatatgcttaaaccaaacttaaaatgtaaaagaaaaacactgtgaatcattttcagagttatgatgtattttgttaggaaaccaaacccctgttaaaaactaatactgaaagtctgaaactatgacgatattcactttcaattggattttttttttctatttgatttaaggaagtacttttgaacccgaaaactaactgaaacttaaccacacacaaaaaaaaaggatttgtatcttatattgaacactacagaatttcgacattagattttttatgattttggttttcataagagtttaaaaatgtgatcatctgttttggacactgcaaatagagattttaaaacaataaaccaagtagatataatagtccgtatagtttgtccttatatataacattataggtgtaaaacacggactacataaaagtggacacataaatgcaaaattgttactacgaaactttacactgcatgtgactgatattttacgctcattacatttggatcattcgtagtgataaattaattcagggtaacatggcaagtaagtgagaacgtggtcattaatttcccccaactagttactaaaataactaaggtaaccttcgaacaaaaacaaaactttggtaaaccaaaatacaaaaacttaggtaacatgacaatgaaagtaaagaatatatagtacttgttgataagaatatagtactcgttaataaaacgctgtcggtagaagcgggtttggacgcaatcgcaggaattagatggaaaacaaacaaaaaagaaaaagaaatagagttttagcaaagagtcaaaaagagtcattttcatatatagtttggggtcaatgtagggctataggaggataagttgtgactttaagagtgaatgagattctttctcaaatgaatggtgtcaaggactagtattcattttttcttctttcgtctccatccacctatcaatatccccaatcttttttacatttttgaaatgttttttgttttgttttgttttcctcaattttagataataagtagacgaatctaatccctactaggcctaatccctatataatacacgcattttatgtcatattagaaagcaacatgttagttgaaaagtttaaagtgttttggtttcagctttgtacccactattagattttaattactaatttttttttgtaactgatttatcgtttttagtattgatagatgttaggaactttatatcaaaaataaggtgagacctaatgtataaaagagaagcaatcaacacattaccaattcagtttaaatagaaaatttgctaaacttaaccccgcatgcccttgcgtaaagcattcaaagcacaagtgaaaataaacccacacttcagaagttatatgttagtcaattgtctaattttgattgctattttccttttctctttctttattttcttcatcgccgatgtggtgttccacaatctattattcacgtttacttaggttttgttaatatatattttcttcccctcctacgtgttttcaacatattttcattaattttctctattttcattctgggaattagatctttaacatcgtcactactcatcactgtcaccagtaatgagaaaaaatacaaaataaaaccacacactctcaaagctggatttcttgtcattgaactatcgctaattaatactgtggaactcgtagaataatcaagacgaagggattgcgtagaaagagaaacgaaaaaaaagaaagaagaaagtgcattgtccttgtcatgacatgtggaagtatcggtcttatatggtccattgagccacactcatttagaatctcactactttttcaccattttcacatctatacacgattatagcatctatatacatttactttttcaattattctgctattatgggttttggatattcatgtcctaatcattataattctcttaaacaaatatcgaatttcgaatattttttaaggttattggctatatgtactatatttctatagaatagtttttgttaatatcatcgatcgatcttcagtcttattttgaactatctaatatattcagtggcttttcatatggacataaaacctaggccagtgtcgaaagttcataaacttcgaagtcaaaactagctataatggttatctttgaaaagtaactcaaatataaggagagtagaaattctacacgtaatgctgtccgagacatttaattatggacgatgtgattgcagaaacaattttgttttcaaaccctctcttgatcaaaaaggacatttaaatcattgcatccacttcaaccacacacattcatttggctgtaataacatttcaaagattcttacaaaacaagtgaaatgtcattaaatgtccttttagaacaagatgctaacgacaatctacttggccacttgacttgtataccaaatttctcccaactttttgttcacagaatttgcgtttacaactttggcgtttgtgttttgacggattcgtctaagtgggacaatgcgcgtgtcggacatgcgcacttaagagggtagagacagtgagttctttagctttccttatattctctttcaaaccaaaaaagagactactattttttgtacacttagactaaggaaagcaaagtttcatattcctaaaaattctggttttataagtatcaaagacaaattcagtctcc

SEQ ID NO: 6760 - DNA, 3000 bp, Unknown; identical to SEQ ID NO: 6756
  misc_feature (1)..( 3000): cDNA_ID_2175659_gDNA_ID_1621104_Annot_ID_171523 3000 nt of promoter + ATG

SEQ ID NO: 6761 - DNA, 3000 bp, Unknown; identical to SEQ ID NO: 6754
  misc_feature (1)..( 3000): cDNA_ID_1815477_gDNA_ID_1621104_Annot_ID_171521 3000 nt of promoter + ATG

SEQ ID NO: 6762 - DNA, 3000 bp, Unknown; identical to SEQ ID NO: 6753
  misc_feature (1)..( 3000): cDNA_ID_1808204_gDNA_ID_1621104_Annot_ID_171517 3000 nt of promoter + ATG

SEQ ID NO: 6763 - DNA, 3000 bp, Unknown; identical to SEQ ID NO: 6752
  misc_feature (1)..( 3000): cDNA_ID_1815488_gDNA_ID_1621104_Annot_ID_171515 3000 nt of promoter + ATG

SEQ ID NO: 6764 - DNA, 3000 bp, Unknown; identical to SEQ ID NO: 4715
  misc_feature (1)..( 3000): cDNA_ID_1815496_gDNA_ID_1621104_Annot_ID_171513 3000 nt of promoter + ATG

SEQ ID NO: 6765 - DNA, 3000 bp, Unknown
  misc_feature (1)..( 3000): cDNA_ID_1395585_gDNA_ID_1621104_Annot_ID_171532 3000 nt of promoter + ATG
cgttgagaaacttagagaggagactctcagagacaggagtcatcttgaggaacttctttctatatgcgagagtacttgagcaaaacttatttcttctttctttcttcataatttagttattaccaacaactaggtatatattgaatttgtggatttttttgcagctcagaggaagattggagagacatctttaaatgagattagctccagatctcatcagattctccgactggtactcactttcatatcttttttttttccccctttttgcattcttgatgaaagtttttgttcatgcagacaattgaaagctcgagtcaacaattttctccagagagctcagcgactcttgcagcatcagtgtgctttgttgatctagctggaagtgaacgtgcttctcagacattatctgctggttcaagactcaaagaaggttgtcacattaatcggagtttacttactctcggtactgtcatccggaaactaaggtcacttttgcaccaatttagtaattctttgctaggtctcatatcacttcatctttgagctgatatgagtcttttattgaaattactacagcaaagggaaaaatggacatataccatatagagactcaaagctaactcgtatacttcagaactcattgggtggaaacgcaagaacggctatcatctgtacaatgagccctgcacgtagtcatctcgaacaatcaagaaacactcttctctttgcaacttgtgctaaagaggtgaccacaaatgctcaagtcaatttggttgtgtctgagaaagctttggtgaagcaactgcagcgggaactggcgagaatggagaatgagttgaagaatcttggacctgcttctgcttcttcaacctctgatttctacgcgttaatgctcaaacagaaagaagagttgattgcaaagatggaggaacaaatccatgaacttaaatggcaaagagatgtagctcaatctcgggtcgagaatttgcttaaatcaacagcggaagagcggtcatcttcaagttcaatggatagcagaagaagaagaataagctacgattcaacggattttgatgagcctcgaatgctaaataacttggggaagagtaacttgtactctcctgatgaggatggtttcctgctggatgatactacccctcaatttccggggcataacctacatgataaatgggaggagatggctcaaagcaccacccaagaaccagaagatgcttgcaaagaagttagatgcattgaagtaaacagtggagaagcagaaagagttcaaatccaagactcactagatgacattgttgaaaagaaggaatatgaacaaaactatgagtcccaaaaggatgatgctgattcatctataaaaaacatagatatggagttgagtttatatactaaacctgaagctgaagatggggtaagtgtaaagaaattaatagaagacgtccaagagactgagcaatctgtggagaaacaaaagcaatctccaaagaaagaagaaatggaacagtatttgtctagagatatgtcagagcaagtaacgaagtcactccctgaagaagagcaatgtgtacaagaatatggagcctatgataaacttgaagctcaagatgtgctaactataaacaagttagaagaatcccaacagactgagcaatctgtggagaaggaagacacaaaaaagaatttgtcttcaaagaaagaagacttaaaacagaatttatctatggatcagtcagagcaattatataaatcacctccagaggatgagaaatgtgtagaggtgtatgaagggtctgataaagacgataatacatatgaggctctgaagaaaaaggtcaaggaaatgcagaagacaattgagtactttatgagtattcaatcagcagaagagaaacaatctccttcgtttaatattatagatgatactttgagtccaggagagtatttcaagatgagaagaagccgaagttgcagagaaaatctcttgtttacaaaggcggcggctgctgctgctagtagaggtttcatattcgagaccactaacacatcctttgattcagatatcactgtctccatggacgcacagagcatcaaagattctgatacagagactagcagtagcagcttccatgaatttatggcaggacttagagaaagaacaatgcagcaccattccacgcatagcgacgatactgatacaaagacgatgaagccagaaaacacagatgatggcggcgagaaaacagagtttgagagacaacaaagccaaataattgagctttggcaagtatgtaatgtacctttggttcacagaacatactttttcttgctcttcaaaggcgatccatccgactttgtttacatggaagtcgaactccgaagactatcttttctaaaagactcgaccgagacatcgaggaaacaaactgccaaagcagtaacacgcgagagggaatggttagctaagcaaataccaaacaagtttggaaagaaggaaaaagaagaagtttacaagaaatggggtgttgaattgagctcaaaacggagaagcctgcaagtaacacacaaactatggaacaacaacaccaaagacatagagcattgcaaagagagtgcttctctaatagctacattggttggattcgttgactcaactctaacaccaaaggaaatgtttggcctcagcttaacacctacaacattcaacatcaaaccctcctctggctggaaattttcaaactctttctctcgtattagcttcactggatgataaataatgaaagcagaaatattcagtctttgtgtgtattgtgaaagatgagtatgtattgattggaatcaaactcaatgaacagagccaaaaaaaaaaagtcgtatatataaagaaaaaaaactgactttgataaaagagaaaactttatagtttatagagtgtagattagataaagctctgaccttggaacgattttgccggagcttgca

SEQ ID NO: 6766 - DNA, 3000 bp, Unknown
  misc_feature (1)..( 3000): cDNA_ID_3048879_gDNA_ID_1621104_Annot_ID_171531 3000 nt of promoter + ATG
tttagccctgtttctgggtcattgtttcttagaggacgaaatgtaaaaggagagttttttaggttctatattagggatacgctgcttattagctcttttgggatgattactcttcaggacgccttatgtacaagagcaagtcagtattggttcaggaccaccaggttctaaaatcaggtggtttaggtctacgagcaatgagtcacgttacatcaacactgttacatttgatgccaaggagggagctcctacactcgtcatggttcatggttatggtgcttctcaagggtttttcttccgtaattttgatgctcttgccagtcgatttagagtgatcgctattgatcaacttgggtaagcaactttggtatcattcaacttgtcttcctcaactgtattagtcacaatatggccttttggttgcttcaagtgttaaagatttcatgctgttgccatcacttgattttaatgtcttaaaaatcgaagacaggatattgctgcccattttaaactacttgtatacattgtgaatgtataataaggtagttctctctttttcttcgtaggtggggtggttcaagtaggcctgattttacatgtagaagcacagaaggtatttattccctctactgttaatgaatcgtggctaaactttcattggtaccctctcagtctcttaatggcttgtatatgagttgatataccagtaatgaaactgcattgttccttctttaattgtgcagaaactgaggcatggtttatcgactcctttgaggaatggcgtaaagcccagaatctcagtaactttattctattaggacattcttttggaggctatgttgctgctaaatacgcgcttaaggtgaattctcatatttggtataactaaattagtaagtggtgacagtttttgattattatgatatctgacttttcattgggcatatctctggatctttcagcatcctgaacatgttcaacacttaattctggtgggatctgctgggttctcagcagaagcagatgccaaatcagaatggctcactaaatttagagcaacatggaaaggtgcagtcctaaatcatttatgggagtcaaatttcactcctcagaagctggttaggtatgctcatataatcatttcccattcaccaataggttgattagatagatactcatttcgttgatacaaatttatggcactcaattgagcatgggaacacttattcgatgaaattagttggcaggagtaatatattcactatatttctgtaaatgtgctttgtgtgcagaggattaggtccttggggtccaggtcttgtaaatcggtatacaactgcaagatttggtgcacattcggagggaactgggctaacagaagaggaagccaaattgctaaccggtaagtaattgtttctttaagttccatagaagttatggagagtgataatgcaatcgctgatagtgatggttcgttttgcaatgtagattatgtgtaccatactttggctgcaaaggctagtggagagttatgcttgaaatacatcttctcatttggagcatttgctaggaagcccctcttacaaaggtatgtccaccaaaaacattgctgataaagtttctgcatactcacactcgatgactcctcttttgtgtgcagtgcatcagagtggaaagtgccaacaacgtttatctatggaatgaatgattggatgaactatcaaggtgcggtggaagcgaggaaatccatgaaggtcccttgcgaaatcattcgggttccacaggtaaatctctaaacacattcatttgttttctcatttaagaggtgaatatagagaagaagatgacgcttacaagagattttgtttgatcgcagggtggtcattttgtgttcatagacaacccaattggttttcattctgcagtgctttatgcttgccgcaagtttatatctcaagactcctctcatgatcaacaactcctagatggtctacgattggtttagtcatagtatcttgttccttttaccttccaaatttattctatatgtgtatacaagtatatatgaaaaagaacataaaaaagaattactttctttatttgaatattcggttgtgtattggagtttcaagtcctctttccatgtctaaaagttctatttgtaacgttcttgatttcactctaaaacctcttaaagtgtttcaaatgtgatctcattatcgacatccaagttgtaatctttcacaatccacaataatcttttatctcattttttacattttacatatgaaacaaaattatatgtgcttgaaatggggaccactaggtctggtaaattcttattgttttagacttttagtcatcaacataaggttaactttccttgtacagcaaggaaatagtgtatttaccgtagcgggaagggtaaagagaggttacaatttggcatcattcttattttagtagagagacctggacttggtggtcgaaacatttccaatggccatgccgacatgttctctctcagacagctcaatcagctgaaaacttgaggaagaagaaactagagagggttttttgacctgattatttattttggctgactcattcttctcacatcccaacaaattttcgttgatatctgtctctgtcttcatttccgacatggaatttgttcaacatcaattcttttctttagctttatgatccctcacaaataaataatgtccctctctcaatttgcagcaaaccgctgacgatcaaaaggtgagccaagtcttttacatgtcgataattaggtttggtcaatgaaatgtttgaatgtttcattcttggtttctgatacgatgagaagaagtttggtttcaacacatttttttgttgttgttgtgatatctaaattctgatcatttcaatttgatcaaatgatcatcaactgatttaagcatccttaaatgggtttggatttgcacaatagagaaatatagaaagcaaggaaag

SEQ ID NO: 6767 - DNA, 3000 bp, Unknown
  misc_feature (1)..( 3000): cDNA_ID_2123338_gDNA_ID_1621104_Annot_ID_171529 3000 nt of promoter + ATG
ggagatatcctccagctcaatcttggaacgtccgctacaagaaaatcaaacgaaagtaaatttcaaatattctactcctagggaaatattggccagtagttctaaaaaaaatgcatgtcaaatgttatagtaaatatgttaaatgatagtaagatatttcgttgaggtaaaaaaaaacagaacaatcacatgtaatgatgtaaaataaatagctatagattatatgagttttatttatttattatagatatctattatatattagacgaaaagattcattattgtctcttgaaatattacggttaataaaacctgtttagaggctctttttaataaacacatctttgaacaattctgatatagtgatatgagtacattttgcattaattaataaaacataaacaataatgaatatatatacccgagttcttgaagcggagaaagagtgaggatcttggactcgccattattgtgagacaaaaggatcttccctcgagttgtggtgatgggttccttgtccgacaagcaatagcaaggcttccactcggcttcgaagagataatcagctgctttgtagaggagacaaagaaatgaatcaacgatgtctaagatacagaacacgacgaagctaacggcttcgttcagccatgttcctgctacggtcgctgctccttttatcttcatcacagccatggctcaacaaaagcttagagagtttgatatacaaatcttctttatatatttgaagagagatccgtgatgatttttccacttgtacaattgtgtaatgtactttatctataatatatagaacctctctctgtctttctgtttttctctctctatttgagagttgagactaggagatattatggagagaaacgaagaatcagagagtcgtatgaatgtatatagtctatagatgatacgtgattaatatataatatgatgtcataagttgagattttgttaaagactctagaattactatataaggtcacggatccaccggtttgaccggtctggtattaaaaacattggctaaataacatgtggctgtgagttaattttagactctccttatatgaatttgtcgaaaaatctatatatgttgataggaagatggcgaatttattgcaattaactttattttttatacataaaaaaatggaacttatttttgaaataagaaaataacttttgctggaaacgaattcagaaggttccatagtaatgcgtgtaagagaaactatgtgtattttcttaacttgtgagttgtgaatgaagttgggagtgacaaattggtggtttttgtttcttctatatgtatagatgtggtacataattgtatcacatgactatattattctccatatataaatgttttctatcataattgtacacacagtattgtttgtcttgcagtgaaaacatttaaaactttcttgaatgtacaaaggtgccagattcttcagatgaacaaaatacttagtatggaaaaaacttagaaattgagaaagattggaagataaaagaggtaaataacagttgtaaccaaataaattcaaaacaaaaaaggatataaaaagataaatgtggtttgtgtcattaaacgcccaaagaaaaagaggtgcatggtggttgaaccgtcctgtgaaacagaagaatcagtccatgacttggctttatcaaatgatcatgcacaattcttcatttcaataagcttttattttcttacaaaagtatttacttttccatttgaataatcatttcttgttcctctaaaccttgctaatccaattatttcttatctaactcgtttatttctttgtttcatgacacgcaattatatctattttcagaccaacgtagaggttttaataaacaatatatcaccaattcttttttttgtttgtttgttacattgccgtttctggacgtataaggttttctaatggcgatatggttgattcgtccttatatgtgaaaaattctattcactcgtaccaccaaggcaacaactaatataccattatactagttatgacaaatatatatcaagacttcctaacattccggtgttaaataaataatcgacacatctaactgtaaaacggtacggatcacgtaggttaagaaaatgacatacatgatctttggggtatgatgtctttctatcaaattaaatttgtttctttcactcccgagtgtattttaattttgacgcaatactatttctttgttgtataaatttggatatttggttatcgtactgcgtggcagtccatgcaatttcatatatatatttagaatttttatttcccttggatttgcctatatatttctatctttcgtttagtccataaaatttactacatatactacaatacaaatgttgaatgttttaaccagaaaaagaagaagaagatcaatttccattttaaaaagttcataatttttgttctctctcatgatcatactttggcggggaatttaaaacatgtgttaagttattgattactcaataacagaaatatggatttttagtagtgggccattattgagctattatagcggcccatgcgaggctgaaggtgtcgtgatcggcaagtcaagaaaccctagccagagattgtacagataccaaacgtccgtcgcatctcagatcatcgacgatcttatgtcactagacactagtctttttgtaatacagatcagagtcgctcgtgtttgttttcctctcctattgtgcccaaattttattttgttgttacttgcagttttgcattcaacttgtttgattaatgtctctgagagaccaagttcacgttaagacgtgtctttttactcagaagacaatggaatatgaagagacaaaatgtctatcattttttgaagtgatatttctcatacaagagtgcatttaacaagtaagattttgtcagcaactaagatttgtttgagaaatgcacaaagtttgaaattctagtcattccaaca

SEQ ID NO: 6768 - DNA, 3000 bp, Unknown
  misc_feature (1)..( 3000): cDNA_ID_1815466_gDNA_ID_1621104_Annot_ID_55949 3000 nt of promoter + ATG
actcacacttcttcaaaagcgaatttgcttgtaacatgttaatataaaattattattaaatctataggattgtccttaatgggccggccttttacgatataaaatttggttcaaataaatgtcgaatacgtcttttcgttcagcccatgaattgactaaacaaaggggattagaatccaaacaatcaaatttcttctatagtttagtttagaacaagaccatgaccatgaccaatattatatatatcgattattcgtttttatatgttctatatgcttaaaccaaacttaaaatgtaaaagaaaaacactgtgaatcattttcagagttatgatgtattttgttaggaaaccaaacccctgttaaaaactaatactgaaagtctgaaactatgacgatattcactttcaattggattttttttttctatttgatttaaggaagtacttttgaacccgaaaactaactgaaacttaaccacacacaaaaaaaaaggatttgtatcttatattgaacactacagaatttcgacattagattttttatgattttggttttcataagagtttaaaaatgtgatcatctgttttggacactgcaaatagagattttaaaacaataaaccaagtagatataatagtccgtatagtttgtccttatatataacattataggtgtaaaacacggactacataaaagtggacacataaatgcaaaattgttactacgaaactttacactgcatgtgactgatattttacgctcattacatttggatcattcgtagtgataaattaattcagggtaacatggcaagtaagtgagaacgtggtcattaatttcccccaactagttactaaaataactaaggtaaccttcgaacaaaaacaaaactttggtaaaccaaaatacaaaaacttaggtaacatgacaatgaaagtaaagaatatatagtacttgttgataagaatatagtactcgttaataaaacgctgtcggtagaagcgggtttggacgcaatcgcaggaattagatggaaaacaaacaaaaaagaaaaagaaatagagttttagcaaagagtcaaaaagagtcattttcatatatagtttggggtcaatgtagggctataggaggataagttgtgactttaagagtgaatgagattctttctcaaatgaatggtgtcaaggactagtattcattttttcttctttcgtctccatccacctatcaatatccccaatcttttttacatttttgaaatgttttttgttttgttttgttttcctcaattttagataataagtagacgaatctaatccctactaggcctaatccctatataatacacgcattttatgtcatattagaaagcaacatgttagttgaaaagtttaaagtgttttggtttcagctttgtacccactattagattttaattactaatttttttttgtaactgatttatcgtttttagtattgatagatgttaggaactttatatcaaaaataaggtgagacctaatgtataaaagagaagcaatcaacacattaccaattcagtttaaatagaaaatttgctaaacttaaccccgcatgcccttgcgtaaagcattcaaagcacaagtgaaaataaacccacacttcagaagttatatgttagtcaattgtctaattttgattgctattttccttttctctttctttattttcttcatcgccgatgtggtgttccacaatctattattcacgtttacttaggttttgttaatatatattttcttcccctcctacgtgttttcaacatattttcattaattttctctattttcattctgggaattagatctttaacatcgtcactactcatcactgtcaccagtaatgagaaaaaatacaaaataaaaccacacactctcaaagctggatttcttgtcattgaactatcgctaattaatactgtggaactcgtagaataatcaagacgaagggattgcgtagaaagagaaacgaaaaaaaagaaagaagaaagtgcattgtccttgtcatgacatgtggaagtatcggtcttatatggtccattgagccacactcatttagaatctcactactttttcaccattttcacatctatacacgattatagcatctatatacatttactttttcaattattctgctattatgggttttggatattcatgtcctaatcattataattctcttaaacaaatatcgaatttcgaatattttttaaggttattggctatatgtactatatttctatagaatagtttttgttaatatcatcgatcgatcttcagtcttattttgaactatctaatatattcagtggcttttcatatggacataaaacctaggccagtgtcgaaagttcataaacttcgaagtcaaaactagctataatggttatctttgaaaagtaactcaaatataaggagagtagaaattctacacgtaatgctgtccgagacatttaattatggacgatgtgattgcagaaacaattttgttttcaaaccctctcttgatcaaaaaggacatttaaatcattgcatccacttcaaccacacacattcatttggctgtaataacatttcaaagattcttacaaaacaagtgaaatgtcattaaatgtccttttagaacaagatgctaacgacaatctacttggccacttgacttgtataccaaatttctcccaactttttgttcacagaatttgcgtttacaactttggcgtttgtgttttgacggattcgtctaagtgggacaatgcgcgtgtcggacatgcgcacttaagagggtagagacagtgagttctttagctttccttatattctctttcaaaccaaaaaagagactactattttttgtacacttagactaaggaaagcaaagtttcatattcctaaaaattctggttttataagtatcaaagacaaattcagtctccatggaaatagagcaaagaaggatc

SEQ ID NO: 6769 - DNA, 3000 bp, Unknown; identical to SEQ ID NO: 6758
  misc_feature (1)..( 3000): cDNA_ID_1815462_gDNA_ID_1621104_Annot_ID_55950 3000 nt of promoter + ATG

SEQ ID NO: 6770 - DNA, 3000 bp, Unknown; identical to SEQ ID NO: 6757
  misc_feature (1)..( 3000): cDNA_ID_1808803_gDNA_ID_1621104_Annot_ID_55951 3000 nt of promoter + ATG

SEQ ID NO: 6771 - DNA, 3000 bp, Unknown; identical to SEQ ID NO: 6767
  misc_feature (1)..( 3000): cDNA_ID_1815458_gDNA_ID_1621104_Annot_ID_55952 3000 nt of promoter + ATG

SEQ ID NO: 6772 - DNA, 3000 bp, Unknown
  misc_feature (1)..( 3000): cDNA_ID_1830973_gDNA_ID_1621104_Annot_ID_55953 3000 nt of promoter + ATG
tccaagcaccctcctttaaaacgccgttacacttaacggagctttatcctcatcttcatggtacgatgtagtttgagaatgagacaaaaagagaagacgttacctaaggtcgaagtaaaagcttttgaagaggcggtgtaatggagagagtgttaacggcgttagtgtaggaaacgacaacgtgggatgctgctgtctgtgtcagggagaagagagagagagagttaatgaagatttttgtctgtattctgaaacaaggtcgaatgttggagactaaggaaacaaaaataaagctttttgatggcttatgagtctttgaaatagctacaccgctcctctcaccttagtctttaacctaataacccccccccccccccccccccccccccaattttctctccctatcctctcatttttgtagtgcgcactgagagagacaaaaaaacaaaaaaagatggagcctttgtttttaaggttttctttatgttgaggacattaggctaagacaaaaagctctgttttctttctttgttggatttttgggtgttgcttgtttgaagaaataaagctttgagtatctccaaggtttccattacagagacaaaaggggtatttgagcttagtttctctgtttatgtgtttgttgtgcttttaaatcggggtttaaggtttatagaagtggtgtttctggtaacagttgagactttttgaggggatattacagagttcaggaaataaaaaatatagaaatttgtgttttgtgtttaatgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggtttcaagttctcacctttttgttgacttctgagctatgaaaaaattgaattttgttgttatgtgttggttttgatgtgattttggtggataaaatccaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatggtaagatctccctagcctctcacttaaacgtttcccatttttgtcaatttgtcttggtttcatgtgttcttgatctcttgttatcatgtttgatgcaactaaaagccattatgatggtattagaatgtcaagttttttaccagtgttacctcttagtggatacatataggagtggaatgtttagtatttatgctgattacaagaatctgccgttgtctatgtggatgacagtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacaggtgcttttacttacattcttgtagtcaaagtattcaaatccttcccctttgaaatcatttgaaagactgaaacttagtggttgatatgtgaagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaaacaaatggcgctcgagttccggtttagtgattagaaaccatcgttgttagtgttttgtttgaaaaactgagaccttttagctttctgttggtgttttacggttggattttgcagtagactgctcttatgaatggaaaattgtttgagacaacgctttactttcactgctggattagtgaaaagtcagaataatcacttttgctaaacatttgactaattatttcaagagttgaccagaccgacaggtccaagtattgccaacgggaagcttctgtgattttgcaggatacgtgacgtcggcaatgacgcgtgcgaagaacaaattaaaaagcatatatccccttaaagcgacttcgcagcaaaacctcttgtctcgtttatctatataaagaaaatttagtagcaaacttctcgattccttgattcgtgggaaaaagaaagtctagatttttgtggattttgattttgtgattccgtgattgtatgaacttgagccgttttgcttcgagattaaga

SEQ ID NO: 6773 - DNA, 3000 bp, Unknown; identical to SEQ ID NO: 6766
  misc_feature (1)..( 3000): cDNA_ID_1815454_gDNA_ID_1621104_Annot_ID_55954 3000 nt of promoter + ATG

SEQ ID NO: 6774 - DNA, 3000 bp, Unknown
  misc_feature (1)..( 3000): cDNA_ID_1815548_gDNA_ID_1621105_Annot_ID_55958 3000 nt of promoter + ATG
cataatcaacaacaaaaatcgaataaaccaattcgaaaacgaagatttaagctaacattataaaatcaaacctgggaaacgcaagagattcgacggcgacacacagctctacttacgacggcgaagatgggttttcacggcgagtaaactcattatttccgacggcatgggattcaacggcattcacaatttccgatggaggaagaagagagagaatgaagaaatgaattaggtctgtggatagctcattaagggtaatttggggagaaaagtattagaaagggtagaaatgaaaatggggaaaaaaagggtagagttgcaaaagggcattgaaaaaagggcattagagtgaattattcaaaaaacaatacactattctcactatcttaatggaaaaatatcgaaaaaactctaaactttcaaattttggatgaaaaacttttaattaacttctcaataattaaaaattaaacgtaactaaataataatagatttaattgcccgttaaaaaccaaaatgacgtcgttttaaagctaaaaattatacgtaaaaaaaagttatccaccatgtactcgaatcaaaaacatgggaaatccttaacaggcttttgaaccatgtagtcacttaaatctgttatcattttgttaacaaaaattgaatgttatttcttaaacgatctgattaacaaaacttaaattttttattgaaaagtcaattaaaacttcataattaaaataacatttttaaagtttaaattttttcgtctgacatttagtttttttttggacatgtttccctatcttgattcaatacctgaaaacgcaaatcttttaataaattaaaaataaaactatatttaaacgataaacatgaactacattatcttttcctaactttattccgtgtcaactatgtcgccatctgaatcttgaattacttgcactatatgaacaaccttttgacacgtgggcttaaggagagaagaaataaaagtttgaaacttgagagtagttccaaatatttttcatttgacaaaagttttaaaaaaaaatgaataattgctaagaatgatctttcaatacgggaaaaatgtcaaaacaaatcacgaactttcaaatttgggacgatttaattttgaatttcaaaaaaaacaaataaatcgtaattttcttgttgactttcgaaataaataacaaagtttttgttgacttgtcatttgagtcatgtcgttaagtaggttaacaaaaaaaatttacggcgttaatgtctcctttatctcctctgttagaacaaaaaaacgttgtttattgcagttcgttttgtctgttgacacaaatttaaaccctaaatccccaaatcgattttattatctgcgattttgaagtcaatgtgggtctgtgattttgagataataaaatcgatttggagatttagggtttatatttgtttcaagagacaaaacaacgttgttttgtctcttcaataaacgacgttgttttgttctaacagatcaaataaacattaacaccgtaaaaaaattctcttaacctatttaacgatatgactcaaatggcaagtcaacaaaaactttgtcatttatttcgaaagttaacaaaaacttcacaatttatttgtcgaagtttaagattaaatcgtcccaaatttgaaagttcgtaattttttgacatttttctcttttcaatactatctttttcaattatgttattttctctttctcatttttatttaccctctcttttattttttaatgaccatttacccatattttgaaaatattttaggttaacaaaataaaatattgatttgtcccgtctaaaatatttccgtcaaaaatttccaacaaaatttatttttgagaaaaaatactctcgatatatttttttagcgggaactagatttacaaagatttttgaatgatttacaagagttttaaaaccctattaaaactcttgtaaattttgtcataaccttttgtaaatattcacaagagtttttcaatggttcaaaaagagttacaaatgtattcaaatttttacaaatttttttaagagtaaaaaaatggtttaaagattttataagagttttaaaaagatttacaaaagttcctaaaatccttgtaaatcctttaaaaactcttgtaaatattttaaaattattgtaaaagattttaatatgatttacaattaaagagattttaaaatatttacatatgtatttaaagattttataaaaatttaaaaaaaaattaaaataatttataaagattttaagaagttttaaaatgatttataaagccttttaaacactttacaaagcttttaaaaaattttataaggttttttaagagtttttaaaaatttctttacaattttacaaagatttttaaatatattttttttgctggaaaatattttattacgggaaaaaggttttggtgggaaaaacttttttgaccgggaaaaaaataattttgttgtctgtcattttaaggaaggatactgttctctgtcttttactttggggttcaacttaaaaaactatttttcattcgtctgatgcaagcccatatcgagattgtttcaaaacatagagattcttttttgggccatacttctttaggttcagccgttttcagggtaacaacttctgatgaaactgaaaccaagtaaattacccattcttcattttgtgggcttaatagacatatatttgtaaagtgaggatccaatttcgaaaattttaggtatcctattttccacagcgtgatagcgacaatgctaggccacatgtcattatttccttggtccatcttctgaccattaatacaaattaacaaaattacaaaacattaaattcaaaaatctcagcaaatatagaggatttacgttttagtgtatccgattatggttcgacagagagcatagaaacaaaagtttcctccacttgttgtttcaacaaaacaaaatcctcccctttcat

SEQ ID NO: 6775 - DNA, 3000 bp, Unknown
  misc_feature (1)..( 3000): cDNA_ID_1815544_gDNA_ID_1621105_Annot_ID_55959 3000 nt of promoter + ATG
cttaaaaaaatacattaaacttgcaaataattcaataaacttgcaaagaattcaatacaaatacgaaaacataaaacatagtacatcacacttacaaataatataatacaaatacaaatgaacttagttgtattggttgaaccctttctgcagttggccaggttgttccggtttaaccttttctgcattagacttaatcttcctcaggctgcagccaagcctccaaatttattctcctctttcgcgcttcaccaactgatggaaaccgcttctcttgatttcgtcctggtccttttggtgtgtattccggcggaaaggcaactaactctttaatatgggcaggaagaacccaaaccgactcatgtgggactacatacaacgtccggtaataggccaatgcccaactctctatcaagtaatacacagagcagagtccgtagatggttgtattcgcatttctcccttccttgcgggcgaggtgcctggctgcggccatagcatggacacacgggatcttgtctatatcaaaacatttgcatgaacaacttttcattttcaaatccaccagaaaacttaccgagttgagatcaatcacgttgtattcttggttgtaactgttaagctcaaacacagttaatttggctgcaattggacatctaatgtgcaatatgttctcgacagtaggcacaacttgtgctgtgattggacaagaacttgaatcttgcctatgctcgttgaaccattcagaaaacttagaaatcatcacatcaatcattggtaacaagtgatattttctcgcttttttaaacacaccattaatggactccgcagaattactagtgtcaatgttatacttgtctcctttaaaatggcacctcgaccatttctcaaaccctactttcacaagaaagtcagcagctttaggccataaacttgtaaaatgaccaaactctttctcgaactcactctcagtatatgcatgagcacaatccctgaacttgacagcagctccatccttgtcaattttcacacgatctctcatgttttgacacaaatgccatatacaagctgcatgaagcgcattcgggtacaccgtcttgacaaccttctttatgctttgatgcctatcactaataaagaccaatccgggaacatccgaatatacagttttcagcttttctaagaaccaaatccaacttacatcattctcgctatcaatgattccaaacgcaagtggataatgatgatgattaggatcttgtgctgttgcaataaccaacatcccaccatacacagttttaagatgagttgcatccacaactatcactttccgcattgtcctaaaaccttcaatgcaagcgcctaatgcaatgaagaggtacttgaactttttctctccttccaactccacataagttactgtccctggatttaccttctctaacatgtaaagataagaaaataacatcgtgtagcttctttccggagtccctcgcacatcactaacatgtagcattttgcctcttaaggcagtggagtatgaacaatgcaccccaagtcttcctcttacaatcgacataatgttgtttggagttggggtctctaaatttccgggatagtcacaatgcaaaaccgatgctatcaatcttggtgtgcctcgctgtatactgttgcttgtagtctcaacactccgagagcatgtatgcatctttctatgcactctaacactccaaaaatgagatttcttagttctcgcaactcttagataccaagtacaccctttagaagcttggcggcatcgtagcataagtctcaacgggtctgacttaatagtatagactccaaaaacttcttgctttgcagctctgttaaccaattcccacacagcctcccttgaacaaaattcttgaccaatttcaatacccgtaccatcatcccattctataacctgcggagtaacttctacacttcgtggaatattgtgaatatcatcataatcaatcctatcatcctcatcttcttcctcaacagaattcaccggcctttccatcggcctttcgacagccacgatctccgtacctactacattctcacaatcattcacatcattatcatatccatcatgcaccatctcacatacttcatttaaaacatcatcttttcttacatttacaccaactgaacttcgacgctccggtacagaaatttcctctctcctctcaactcctataccatttaatttctccacatgcaaaacaggaatccgactctcttcatcagattctgttaaaaatataaagacatcctcatcatctacaatatatgtctctctcctaactttagacagattgtaactcagtttcaacttcacagaagcttcatcaatcgcaaccttcttcatgatcttgtcaactaacatgaaaccccccaaatctttaatatgaaatctcggaattcaaattcaactcacattcaacctacattcctttgctcatcacctcaaataacgtttcggcaacctctaatcgattactctttactttgcaaaccaatcatcaaactatcaaattgaatctgggaattatatataattcaaaatcctaatctaaaatcacaatgcaccaatgtcaaaggaaatatgagaagaaactgacctaattcgttgccttttacgacggatttcaagtcggcggcggccggaatcgatggtggccgacgaagaagatgaacgtcgacgcaagaagaagaacacgacgacgaagaagagagaacggagaatctcgattttctttatttagcttttgaatttcttttttatttttttaatcaactcattaagggtacaactggtatatcacattttcggtgacattcactgatggcagtccagatcagttttttaaaaaaagtggcataagtgataaaagttctcttctccgatcgatctccttcaaaatttcaacttcaaattccctctctgagatttcaaaatccgccatg

SEQ ID NO: 6776 - DNA, 3000 bp, Unknown
  misc_feature (1)..( 3000): cDNA_ID_1809157_gDNA_ID_1621105_Annot_ID_171557 3000 nt of promoter + ATG
tggtgtgaacatggtttaaccttttgtattgttgttataatgaaaacaggttgatctttatcatcgattcatttccaaggaattatggcatttcaacgtatacttattttacatctccattccaatatgaatgaaacattttagcatcaccatcagtcacaaattaacaaaatgttcatttttattcgctttatgtgtttgaaaaaaaaaaatatacgtatagatatatcatatttgtaatggatacatatttgtactatcatgcaaagtatcttttgcctttacgtcaatatatcaaagtattttatattcacccggcaactaacaaaagatagaaattggattgtgcgactaattaatgaaattcataaagagatggatagtggatttgaccctgaaatcgttccaattgcaacaataggtacacttctaattagtctgatccacgtccaaagatatgctatgtaaccaaattaggcgactagtgtatctcatatttttttgataaaccctaatgtatgtatctcattaattattgacaaaaagatgtacagattaagttaaaaattaagcatagaataatagaggtgatgttaacaaaataacatgtaaaaaaattgttcatttggcgactaatgaatcttatgattacatttttgtttcaagttaaactacttaattaagataaatacacacacatatatatattggtcaaaggaaagaaaaaaggtctataatacattagtttgggagctgggatttggtttcacatgcacttatctgatatctcactgctctttttcaatatttaaatttaaagagtttcacacttaccgttttttttggacaactcacacttacttcaatcctctttcaaccgtcaaatttaagagttcaaacttatctcaatatgctatctttcaatcgtcaaatttattcagagtttcacatcccgttataaaatttgaaaacgatcttaatgccattagcattgctttcttaagtgggttttaaaattttaatattcatttttgttggtgtcgctttatctaaaacgtctcttacaatttcttgcaaaggcacgtcaaaatgcaaagaagccaacaatagctatatgcacgtgatgcgtcaattgtgatccataaatttttggggtcacgaacttacgatacggcggccgacatatatatcactttgtagtggttctatttaaaattcaactcattaccaaaaaaaaaactcaactcttatcttaaaagtatatctcactttatataaagtaaaaaattactatatctccaattgcaactcttattttagtcagacaattgaagaaaaaactcactttttttttttccttgtatatattacttgtttcactttgtattttacatgactcgaagtgttattgaacttcagtattagtctattagaaatgttttcagaaaataaggcacatcgaaatttgatggagaaggcaacaataattatatgcatgtgatgagtaaatgcgatccataaagttctggggttactaaagttactatacggcccataccatatcttgctatatagatttgtaattgatgtattcagaactcaactcttttcttatatctcattttaatttcagtcgactataaattaactaaaatatcactttattaccctttttctacatgatattgtgttacttattacttattagcaaaaataaatattgtgttacttcatatatgacataagtcagaactgttggaggatgaaggccactaccaccgattcacgtggtcgtgagtattgatcgcattattttttctttttcttttgactaagaagatcgcattctttgtcacatgtcaatgttaaactaggtaactacatacgtcatgtaggaagtaggataaattgataacaatattaatttttaactttttccgtccaagaaaaaattaagtatggataatgccataaggaacaacatttttttggtatgctttatacatcaagtaacttcgaccggtcctggcaataaattatagaatttaagtttggatttggaagcaaataatgaagctttttgagctcggccttttctatttttgtttgctatttgttgttggtatgataattagacagaattaaaatgactcgctactttcactaaagagagacttaaattttatggaagatctccttagctgccacagttactcaaggcatagcttttcctcactcaaacctcttcatggattttgatgattatcgaaattaaaatggtattactctcattcatcttctcctacaaatgtgaacctcattcaacattttatgtttcaagccatgatctacttcttattggaagaaaaaaaaactccttgacgcgagcacgactcttttcttacccacaactttgaaagttttccctcctaaaaacgaattacacccactaatatatattctgaatagtacccattcctttttgtatcaagaaatcatttgtacaaaacatagatggagacttgaagtggatgtttttgttaactatataaaaccaagacgtacaacgacaccatagagcgggcctaacataacaggtttttgacaggcctagattccacaaacccaaacaacgcaaagaaaaatattatggtccaaaactaaaacgtcaccgtttttgttgctttcaagtaaaaacaaaaatgaaaactttaattaaaaccctagagaataaaaggtcttccttcttcaccaccttcctccgcagttgcacacaaattcacaaccgcaaaaaatcctctcccggcttaaaaacggtaaatattcatctttttttctctttggatccttaatttttgtgggttatatgaatcggcaactataaatgataaaaatacgatcttttgttgaagttgtgttgggagatttgttctgtgttgattgaatctgttcttatatatgtgacttttgcagagtgataaagaggtgtaacaaaacatg

SEQ ID NO: 6777 - DNA, 3000 bp, Unknown
  misc_feature (1)..( 3000): cDNA_ID_1815526_gDNA_ID_1621105_Annot_ID_171556 3000 nt of promoter + ATG
atttagacatgtaggctaaattttgattgcttcaaacgcaagtattaatgatgtagttaatgttaatctgatacatcgatcaaaattcaaaccctatatttgactactacgtacatctaatttgtattttaaggatatcaacttttggggctcaacgtacatcacttattttgctattcctcatcttcgaaaaagcaaaggaaaaattgttgtgatttcttctgctacggcaattatacctttgcaagcggcaagcgtctattcagtaagataaacaaaatccgtaagcatcattattggtggtatcttagccaaattcttaagctaagatttgtaaaaaaagggctcttatataagagcttttaggcttatatttaagcttttatataagaaccctttcttcacaaatcttagtttaagatttggctaagataccatcaataatggtggtcttacacgctttttttttatatgttatctttttacatacttctcatatacatataaaatttatatgatattgatactacttggtatgaccgtatgatgtaggcaagcaaagcagctttagtaaaattctttgaaacattaagagttgagatcagtcccgatatcaaaataacaatcgctcttcccggatttatatctacggatatgaccactcctcagtttaaagaaatggtcagtgataactttcttgtacataatttaataccttatatatatgacattaacgatgttatgtgtaatgttttttgtgctttgttgaaaattagtatggttcagatttcatactttcggaatcagtgagtcgatgcgcaaaagcgatcttcagaggtattggtagaggagaggcatacgtcatagagccatcttggataaaatggatctttttgataaaaaatgtttgtcctgagatcgttgactacttactcgactatatatttgttagttatctaaaaccttatttcaagcgtgattgatcatatcgatctatccaagttctctctggttttcaactgtggttgtgttgtcattatggccatgaaacttatactttatgttgtattagttattgcactaagtcttggcctttttccctttcttcgtatatgtttcaatttgttttagaaccaaacatttcatatagatagaggatttcttaattatttaataaagatgattcaaatgtatataattgttcaactagttcagttcgcttccaaaaaaacagcgacgtcttctctctcacggcgataaaaacagagaaccttccatttgtttctttgagcgcgtgaccggcgcgtggcggcttagttagcgccggcgtcggtcctccagtctggttttctttagggtttcattctctacttagtctggttcgtttttagatcctgatttgatgttggcaaggtgaagaatttttggatcttagatctgtaagagccatcgttgtgggctttgattcgtcgaaggttttgtgcgatcggaactcccttttctctgttttgagaaaattatgggtttctcctttgttcttgcagatcttgtttccgacgaaggttgcaaacgaaagttatgacggcggctaatgttattggtggtctggctccttctttgggatagggtggcaacggtacaccggtattttagtgttagttgtctcataattgggttttgcgctttcgttaaccttgttctcttcatttctcttttgggttcctatcctttagtcttcattgttggcttgttggtagcgtttatggaatcaactttattctcagtcttttgtggtctagtatcttgaactcttgcctattctatgtcctgccgagtttgcttgtttctcgatccgattcgttctcttgccgtctccagtcttcggtttgttgcgaattgtatgggctcggtccttgtctctacggtttagacttgatcgaggtctctcttttgcattggtgtcttactaggcgtgaaccaatcttggttttgtttgcttcgatttcgccgtttccagaagttgtgtgggatttctagtcgtctcccattcttgctggtatggatgctttggttctctttatttgtgaggtagtcttcatttggtataggaagagtcgctatccggtgtcgtggattttctcgtctccattggctagccactaattcaagcgtttctcgtttttggattgataatttgcaagatgtttggtgctagattctgagttatgagttttaattccctctgatgtttgctttcttagccgtcagtgttttgacttgtttcttttgtagtgttgttatttgctccccattttcttggacttagtttcctaggatatcttgttatccttcgggttagttttcgggatcatgtattgatcgtcgactccttgtatttcacctagtactcatcaatgaaaattaatcttccagtgaaaaaaaaaaaatgtatataattgttatggaatttctgtgtccagtccatattaagctttttacatatatatatagcatcgaccgcgaagtccgtaacaccatctcttctagaagactcggatttcattggcagaggcgtatgctcctttggatctgatagttaaaacaccaaatcttgtgtaactttcttgtatataatgctctgtttaactttcatttttttttagtaatatttacattcctagcaacaaatatttatttatagcaattaatatatatttttagtaataattacattcctagcaacaaatatatatttattttttaacaaatacacaaatatatttttagtagcaattaacctattttcctaacaagatacaacagaagaataagaaaatagtagacagatagatccacttgctaccatttcctctccctgtagccttctgtgtctattaaaatagacttcacttgtaaagtaaaagtttgaacattttaacatataaaaaaaaaaaccaagtagagaggtaagtggtggtattggttctgcaaaagaacatt

SEQ ID NO: 6778 - DNA, 3000 bp, Unknown
  misc_feature (1)..( 3000): cDNA_ID_1815529_gDNA_ID_1621105_Annot_ID_171555 3000 nt of promoter + ATG
gcgcttgacataattccacattcagtaatatttggtagttgaatcatatttatatttcagtgttgcacttgtactgatcttttggtttcttacaatggatcatatatacatttttatttttatttacctcatcagaatattctttttttctagccggtatatacttccactgaataattaccacactcgatttggactctgcatcaaaagtcttgcaacgagatagtacgttctgcgaaacatcacgtttccatgtatatcgtgactagacaatgagtcgaaatctactttgctcatttaacattaacttcccttaacttacacggaaactctatattttgaattttcattacaatgtaatatttttttaattatataattccaatcttcggtaattgacagccagataatgacattgacattttctcatggtaaacttttaaacattttcacggtgaaacaaaataattaaatagcaaagtgttatggttaaaacatttttgcagctagataacaaataaactggaactgatttgccacttaaacattagtggtatataaacgttagaaattcttgcacggttgatatgaaaatggctttgggttctcatacacaattcttgttattttatttagtaatgtgttatcatgtaaaatagtgtgtcatcatgtaaaaacaacagtctataaagcatgttatcatataaaaagtaacataatatatatcatgtaacattagtaatgtgtcatcggataaatgaacatgttatttattttcaaattaaacaaatataaaatcgttaattcttttgggttaaaatcttaaactcacctcaaaaatatttagcaaattaaaaaaaaaaaaaccaataaatcatgtctcatattacttcctaaaatttggctatcttttgttgatgtttttggtctgacctaaaaaaaggtttggctatctaaatctacctaaaaacacacactaatacaattcgatactgggcttcaaataaaaacaaactccttcattattgggccaccataatgatcgacctcacaatatctcagcccaaggttactttcgtcatttaaactctcctacacttaaaaaccctaatctctctaccgtcaataaacctccctatataaacacttccacacacaaaccattcctctcacacaaaattcttcagccgattcattctctagggttcatagcttagtcctcgaatccatatatctctgctgctgtgttcttcaattgctttagtattagcttgttcttagtgttcatagaatttagggttattagaatggcttcatcagatagtcgatgtggatttgtccgttcccatatgattcgttcccttgaagcaatattaatcgtgttgctctcgttctctaaattgctctctaatcatcaaagtaatcatacggttaattctagtatgataccgattagtgagcataacttgagcagctacataatcttctcttacgagggttttgttttgtcttaattcttgttttgttgtggaagaacagtgatgagtcagtttacagacctgtaatgattgcggtaatgatcgcattattatgaacatctaagggactgagttcttctatccattgtgttttagttttctttttgtcttggtggcttttacatgatagaaagattcaggctttgaatatattttagatgtgaagcttgttgtgaagtgtaattgcctacattgaatttagtttccctcgctatcctgttcttcaattttcaatgatgtttcttaggacgtcggggaacaatatgttttatattgatgttttgttattttgcaatgggatttcaaatgaggaatactttgccaagttgttgaatgctcagatttttctgggttttatgattcacttgtataggaagatctgatgatttccttttgcattgtgtttttgttttttgtttgggaagccagtgatgattagattcaatggttgctgaacattcaatgttgaaaagcatctaacttgactaggacggtctgaggcttttaatgaactttttgtttgctctatcgttagttttgtgtccatgattcaggattgttaatgttttgtgatgttttggatgatgagaaacaaaaatcaaaatacagttatccctggcttagggtttaaagcccgttgctgagtcttttgtaatctgacacacatcacaacaatttctctttacgttcttttggtacgatgcttttgtgttttcagtttatcttaactttgttttatttctcaattttacgattcatggttctgtaaatccatattgggcagtcttttcataaacaaaacgaggtgtgatgctaaatttcattgggacaacgctatattgtagaagacggtgaagattgttatacgttttgcaaggcagggatttatgatgacactctccggtcgttttgcttccttgatgcaattgtttttccaatttaggttttgaattattactcactattttatcagggtagcaacattacctgaaagtgtctctgagctatcacaaagattgaaagaagtttatgtgatcaaaactttccttttaactttattgttttcagtattagctatcttatgttatgtatatcaatgaatgtttttaacgattaagcacaccctttaatacagtcttgtttaagaatattatggatcaagatcaaaaatttagctgtacgttcaggtaatgaatgcgatgttctgaatgagaaatgaaactaaaatcatgcatttagataactttcacatcacttgatagagagggacgatatttttgcaggatttaacttcgtaattatggctaacaaagctaccgtctttacattatttgctcggggataactgaaatacctccctttctagctttaaatgtcacttaaatagccttcgcttgtaaaataaaagtttgaatatttaaaccagaaagctaagtagagaggttgtgatgggtctgcaaac

SEQ ID NO: 6779 - DNA, 3000 bp, Unknown
  misc_feature (1)..( 3000): cDNA_ID_2175455_gDNA_ID_1621105_Annot_ID_171554 3000 nt of promoter + ATG
ttaagatgtctaacatcaaactaatcatcacgtaattttgcacaatttagaatggttttaaagtgacaaaacaaataattttcttattttgaaaaccaaaaaaaaacagaggaaaaatgtattgcctgcgagaaagctcaagaacacgaactctcttggcctgagaatcatcggaacatcctaacacggcaagtattccacacatgttttttttttgaagaaagtgaaaaagatcacgaagaatgagaacagaaaaacagaattttccgaaactttaggggatagatattgtaaaaccccaaaaagagattacaagaaaatgtaataaacagacagatgtccaggaagagaaaggagaaaattgcacgtagaagtgtactatcgatattcgtgtttttgatgtcttggttttctacgaccgattgctctatttatagacactaaacggcgccgtgatgtcgcgtttggttctgaaggagtcgtgtatgggaacaaattatttttttacttgtaaccggataagttaccggataactctgaccagctgtttccacgtgttaattaaccttcttacgacgtccgatgggttcttacttcttagtctttacattctcttttgtccggtttcttccaattttgacggtggggcaaacttccggtttagggtttatccggctgagtcagcaagtggataggtacttatctgacggtgtaaaaactgtccaatgattgttctgattgctttagagccgtacacgtgttatcacgacaatggtgtatttgattgtaggattagcattttatcagaaagtgaacacatttcaaatgaaaatgataagtaaactgtgttaggaaaaattgattggtatttttttccttttgattaaaaatgagaagtaaagttaagacttaaatttaaaaaaaaaaaaacgttaaaaacacatatagaagaaatatatcgtactatagttagtaaataattttctcttcctataattagtaaatattcaatatcgtcaacgaattattatttgtatagtctaatagtacacacatattctcaaccttggaatcgaattataacaatacaaactgtaaaattaaaacacgaccctatatggctattgcaaatggtgatttcacaaactttatcataatattaaaaaatacatttacttcttactaatatacagtaaacaaaagtctttgtgttatagttaagcctattttggatatatgtgtatttaaaaaatatatatagagagatttgccatgtgttatataacaaatatataggagatagtggatcatatgcaactttccgcgaaatgaatatcggagaagtattcgagtgtatccataaatcatgtatattttaatataccggatcacatgtgaattgtaggtataggcatcgcacatgcctcacacgttgctacaatgtgcaagggcgagaagatgaatctcagtttataatctttggactttggataatgctaatatataaatcatcaaaataagaatatgacgtgttttttctttgattggacaaaacgagatatcagccctattcttgaggcagcaagacccaatcgcgacatgatacattgtaaatcgtttgatatttttttcttttttatatgtaaaaattgctggtgtccctatctatctatatggtacaccttcagctataaatgattgaaattctcttacaaagactgtaaatacatatccgaacagtttggatactagtaccaaaaatgataatgtggtgatttaggcgacgtgagtcgtgagtgtagctgttattattattttatcaatacttgagacgctaataattgttaagatccatgccgtgtcatgtttgtataagccagtttcgttatcaaataaacagataacgaagaagattcttatactttgtgaaaggaaaatagaaaaacagatgacgtataacagtttgttcggtgaaggaagcagataaaaacagcctaatattcaaatgtatgccaacgcaaaaattgtgtttaatatacaaaacacacaattagttacaagtaccctacaatgttaaccaaacgtcattttgtaaaagtaaaggactttcaaacgcctcatagtcctcacaaagcgacatcattcgtaatttaattacttccggctggtcataacatacttatatagttggtcaattaatgaattagtaagtgggattgcgtaagagaatatcccattagttaaaaaaataacagaagaagaaaatatcacgtttataataagtttgggcataattaaaaaaggtagcgactcgtcgtctttcatgaggtcacgatcctagtctatctggcaaatcatcatctacgagctacggctagaaagaaatagacgctaccactcgtgcacggccgtgccatgtcatcttcgggcataaggatccgaaccttagccagctggttctccgacttcaacttacattactagtttttcttaaatattattattacattacataattagtttggttaaattgtttttctcttattgaattcatataattgtatcttttgtgagttatgttcttgcaatataaatctgttgatctttttttcatcaatataaaaacaactaatattaccaaaataacaaaatcataatagatacggcaattcgacttttaaatgaatcaaagagttaatatccacagaggattaaaatagtagtttggaaaagaacaaatggtgatgaaactcggtcgcaaggttgcgtagtacatttcgttatcactgttctaaattaaattagaaaaatctcgtcatttgtctgactataattttatttcttaaaagttaattgtcatgcactcatgtccatttctttttttttatcaaacataaatattatccatctaagttttgaactttatatttttctcggaaaagtacgaaaacttttattattgtcattcacacaattcagagaagaaacaaaagttgtaaa

SEQ ID NO: 6780 - DNA, 3000 bp, Unknown
  misc_feature (1)..( 3000): cDNA_ID_3048914_gDNA_ID_1621105_Annot_ID_171553 3000 nt of promoter + ATG
tagagagcaatttagagaacgagagcaacacgattaatattgcttcaagggaacgaatcatatgggaacggacaaatccacatcgactatctgatgaagccattctaataaccctaaattctatgaacactaagaacaagctaatactaaagcaattgaagaacacagcagcagagatatatggattcgaggactaagctatgaaccctagagaatgaatcggctgaagaattttgtgtgagaggaatggtttgtgtgtggaagtgtttatatagggaggtttattgacggtagagagattagggtttttaagtgtaggagagtttaaatgacgaaagtaaccttgggctgagatattgtgaggtcgatcattatggtggcccaataatgaaggagtttgtttttatttgaagcccagtatcgaattgtattagtgtgtgtttttaggtagatttagatagccaaacctttttttaggtcagaccaaaaacatcaacaaaagatagccaaattttaggaagtaatatgagacatgatttattggtttttttttttttaatttgctaaatatttttgaggtgagtttaagattttaacccaaaagaattaacgattttatatttgtttaatttgaaaataaataacatgttcatttatccgatgacacattactaatgttacatgatatatattatgttactttttatatgataacatgctttatagactgttgtttttacatgatgacacactattttacatgataacacattactaaataaaataacaagaattgtgtatgagaacccaaagccattttcatatcaaccgtgcaagaatttctaacgtttatataccactaatgtttaagtggcaaatcagttccagtttatttgttatctagctgcaaaaatgttttaaccataacactttgctatttaattattttgtttcaccgtgaaaatgtttaaaagtttaccatgagaaaatgtcaatgtcattatctggctgtcaattaccgaagattggaattatataattaaaaaaatattacattgtaatgaaaattcaaaatatagagtttccgtgtaagttaagggaagttaatgttaaatgagcaaagtagatttcgactcattgtctagtcacgatatacatggaaacgtgatgtttcgcagaacgtactatctcgttgcaagacttttgatgcagagtccaaatcgagtgtggtaattattcagtggaagtatataccggctagaaaaaaagaatattctgatgaggtaaataaaaataaaaatgtatatatgatccattgtaagaaaccaaaagatcagtacaagtgcaacactgaaatataaatatgattcaactaccaaatattactgaatgtggaattatgtcaagcgcaggccacattttacaacttttgtttcttctctgaattgtgtgaatgacaataataaaagttttcgtacttttccgagaaaaatataaagttcaaaacttagatggataatatttatgtttgataaaaaaaaagaaatggacatgagtgcatgacaattaacttttaagaaataaaattatagtcagacaaatgacgagatttttctaatttaatttagaacagtgataacgaaatgtactacgcaaccttgcgaccgagtttcatcaccatttgttcttttccaaactactattttaatcctctgtggatattaactctttgattcatttaaaagtcgaattgccgtatctattatgattttgttattttggtaatattagttgtttttatattgatgaaaaaaagatcaacagatttatattgcaagaacataactcacaaaagatacaattatatgaattcaataagagaaaaacaatttaaccaaactaattatgtaatgtaataataatatttaagaaaaactagtaatgtaagttgaagtcggagaaccagctggctaaggttcggatccttatgcccgaagatgacatggcacggccgtgcacgagtggtagcgtctatttctttctagccgtagctcgtagatgatgatttgccagatagactaggatcgtgacctcatgaaagacgacgagtcgctaccttttttaattatgcccaaacttattataaacgtgatattttcttcttctgttatttttttaactaatgggatattctcttacgcaatcccacttactaattcattaattgaccaactatataagtatgttatgaccagccggaagtaattaaattacgaatgatgtcgctttgtgaggactatgaggcgtttgaaagtcctttacttttacaaaatgacgtttggttaacattgtagggtacttgtaactaattgtgtgttttgtatattaaacacaatttttgcgttggcatacatttgaatattaggctgtttttatctgcttccttcaccgaacaaactgttatacgtcatctgtttttctattttcctttcacaaagtataagaatcttcttcgttatctgtttatttgataacgaaactggcttatacaaacatgacacggcatggatcttaacaattattagcgtctcaagtattgataaaataataataacagctacactcacgactcacgtcgcctaaatcaccacattatcatttttggtactagtatccaaactgttcggatatgtatttacagtctttgtaagagaatttcaatcatttatagctgaaggtgtaccatatagatagatagggacaccagcaatttttacatataaaaaagaaaaaaatatcaaacgatttacaatgtatcatgtcgcgattgggtcttgctgcctcaagaatagggctgatatctcgttttgtccaatcaaagaaaaaacacgtcatattcttattttgatgatttatatattagcattatccaaagtccaaagattataaactgagattcatcttctcgcccttgcacattgtagcaacgtgtgaggcatg

SEQ ID NO: 6781 - DNA, 3000 bp, Unknown
  misc_feature (1)..( 3000): cDNA_ID_1815533_gDNA_ID_1621105_Annot_ID_171552 3000 nt of promoter + ATG
aagcaaattaggagggtttaagcaatggtataatcctccttggttcaatgaatctgttccttcaacgccttatgagcctcttgcgataagacgcgcctttgaaaacgtaagaaaacatctcttctttttaattgtatgtggtgtgtgagagggtaatctgaaatatgtttgtttttctctctaggctgtgattaagcggttgatgactgatgttccatttggagttttgctctctggtggtcttgattcttcccttgttgcctccatcactgcacgtcacttggccggtactaaggcggctaagcaatggggtcctcagctccattccttttgcgttggtcttgaggtgagatatagaacagagttcctctgtttccaaagcagagttggatgattttttttgataggagagttggatgatttaaaagtgttttttctaattcgaaattcaaacttagcatcatttatggttgttctgttagggctcaccggacttgaaggcagggaaagaggtggcggaatatttggggacggtgcaccacgagttccacttctcggtgcaggacgggattgatgcgatagaggatgtgatttaccatgttgagacctatgatgtgacgactatcagagcgagcacaccgatgttcttgatgtcccggaaaatcaagtctctaggggtcaagatggttctctccggcgaaggtgcggacgagatctttggagggtacctctatttccacaaggcacctaacaagaaagagtttcaccaagaaacttgtcgcaaggtattcaattcaaccaccaaataagacatcatcaattttttttacttatcttgatatgattgttcggtgataacttgcagatcaaggctcttcacaagtatgactgtctaagagccaacaaatctacctctgcctttggactagaggcacgtgttcctttccttgacaaagacttcatcaacacagctatgtctctcgaccctgaatccaagatggtaactacaaaactcacatcacaaactcaataccttccttcacaagttaacgttgaacaaattttctatatgggtttttctagatcaagccagaggaaggaaggatcgagaaatgggttctaaggagagcctttgacgacgaagaacgtccttatctaccaaaacacattctctacagacagaaagaacagttcagtgatggtgttggctacagttggatcgatggcctgaaagatcacgctgctcaaaatgtacacataaaaaatttcatatctcccctaattagctaaaatataacatttggattcatgttcagatctaatgattctgttctgttttaaggtcaatgacaagatgatgtcgaacgcggggcatatcttccctcacaacactccaaacactaaagaagcttactactacagaatgatctttgaaaggttcttcccgcaggtgagagtcttataagtctccatgatgtaacagaatctcctattcgttttgcgttaactaattcacaaacttccgtgttacgttttttctaagaactctgcgagactaacggttcctggaggtgccaccgtggcttgttcgactgcaaaggcagtggagtgggatgcaagctggtccaacaatatggatccatcaggaagagccgctatcggagttcacctttcggcctacgatggcaagaacgtggcattgaccataccaccacttaaggcaattgacaacatgccgatgatgatgggtcaaggagttgtgattcagtcataacttcgaaggagaaatggatgaaatatgtgttatatcttcccaatgggtgaagtgttttgtatgattttaaaaataagaatgtgatcctttttttttcctatgaagatctgaatgtataatctatcttgtaaaaatttgtttctttgtaagatttgaatgtaccgcttttacgtagatcgatgtacatcaatcttataagtttcaattatgtattatattatgtcgatttgccaaaaataaatctaaaacctcaaaaataaatctggttttagatacttgtatatagtactaactcgatgaaaaaatgattttttttttgttactgaatctgaaatataattataaaataaaaatactaattattaataaatcaatttaccaaaaattttaaattttgataacaaaaaattaaatctagtcaatttttaaaagttcttttttgatatttcaaatatccgaattcgaaataattccaaccgaattcatagtcgactcaaacatataaagtactcaaatgggtcgtaaaaaactaaattggaacaaaaagaccagaaccaaatctgaatgagtacccaaacacttcatcctaaacgtatcgacggctatactcacttcggaaattattcaaagaaatataccgttattctctgtttaatttatcaagtggttaatctaccatttagtttttctctttgggcctaatgggggttgtgagcttatttcaaaaatttattgggtgtacttgtactttcaaaacatgggggtgtaaaagtgtaatattacaaaaatattggacgttgtcatctatttaacacaattgacttcttctgttgtcttctccggagagctcacctcttatgccattattggagaagaaataatcactcgtgccattcttatgtttggaataatattattgatttttattaaaatcgaaaattgaggaaaggacgaaaaacccttgcgaaaccacgaaaactacaagaaaacttaatttgttggactcgggcccaaagaaaaatgtaaatactcggcccagttgtattatttaccctagaaactacagaaaaaacctaagttcttcccccttttcacttctcgacttcttcctcttctctccgtcgtcgtcttctctcgtctccgacgacaccaatttcaccggaaaaatcaatctcttctattcttctttcttctccgttttcgttcgtctttgtctctttcatatg

SEQ ID NO: 6782 - DNA, 3000 bp, Unknown; identical to SEQ ID NO: 6775
  misc_feature (1)..( 3000): cDNA_ID_2175436_gDNA_ID_1621105_Annot_ID_171548 3000 nt of promoter + ATG

SEQ ID NO: 6783 - DNA, 3000 bp, Unknown
  misc_feature (1)..( 3000): cDNA_ID_1029444_gDNA_ID_1621105_Annot_ID_171547 3000 nt of promoter + ATG
taagggtgcctttaatgtgtgaacatgagagattttgtgttttcccaaagaaattatagaccatttgatttctattgttcacatattaaagacaccctcatttttaaagacatctcttattttgatgaccaataaggatggttctgtcattttattcgaggaaaaagacacatataccaatattgaagttggtgtagaaccataaaaaaactgtattgcattatgttttacttttaatactcttgtattttactttgaatacttttattcaattatttgtggtttagatgttacacaatctccttagcaagtaaaactttaccctcattgatcccatccagctcgatcatgaatacaacaaccatttgccaacataacaaacatgtgaatcattgcttcttaaagcaactgcggtaacttccctcgtagaaggtatgccatcattattattaaataagattatgcaacttgagcatgaaggttgttttcgagatacatagaaaccaaattcttggatattctggacacataatgtgcgagtgaaatgcttggagcttaatttaaaacataccatcaaaatgcttacacttacattatggttttacaaacttatgaggtgtaaaggcaatgccaagactctatagacacaaaaagtttttcacttgcaccatagcgtatagctctaatggaatcgtcatggaaacccatcaaattcatccaccaaaataactggatatttttctctgtgaataaaacatttaaataaattaaagtaacaatcatattgaatactagatagatatataaacactcatctattctagcaagtttttttttaaagctagaaaatcaatctttgtgcaacaagataaaaaaaattacaatatcaatcttttaggaacatatggagtacaagttactaactacaacgatgaacaatgttgagtaattgtatgataaaaaaatcaataagccggtagggagaaaagagagaacaaaaaaaagtaaacaacttcttaaacacatgacaaaactaggtaaacctatttaaaaaaacacatgacaaaatttatgtgagttagacacggattgaatattataaaatatcaaaatatatgaatatgaatccgaatatgttggataaaaaaaaagaaattatatgttccgccagcgaatatatcaattcagatatataaaaagagttgaaaataataatataagagtatgaaaaactaaaaaaaaaaattattattaatatatatatatatatatatatatcatagaaaagttttcaaaatgattttataaacaagttagaacatcttataaataaaagtaagatttcacactatccttattaatccacttggcaatttatttacaaaaaaaatattttcaattaaaccacaaataaaacacatttaatgagagtcaaatacaatttagctgggttcaaagagagtcaaatatggtagctgattctttagcgaagcaaccgatacaaggaaatgtttcatctgtgtttcatttctatgttccttttaatatttctgatgcatttgcatcgtgactatgtagtatcatgttcttgattaataaagctgatgttcaaaaaaaaaaaaacacatttaatgatatataattaagtcacactattttttggtgcttacatttaactcacactttaatataaaactaaagtcatataaattatatatttactatatttctctacaaaattttattcacacacaatcaattagaattttcaactctcatatttatttttaaattgtaactctatcacttcccatcctacaaatattcattctctcattgactcatcctcttccactatatctcaaatctatttttattttttgtggttgttgttgtatgagttaaaaaaaatcaatttaaataccattgtaaaagcttaattttttcaaaaaaatttctaatgccaatacgttatacttatcccttctttatttttatttattttttatttattttgaattaacatatgtaaaataaaagtttttttttaattgacatatttttatttctgaattgacatatataaaataaaaaattgatggctataacaaaactttcaggtttattctcaaacattaccaatgtgtaattgtaggcttgtagctatgttcctggcttttagctttttggttccaatatgttttgttttgtttttaacatttgtgtattttttgttttttaatttttaataaaatagaaataaaagatttatgaaagacatattcaaaaatataccatacttttctatgtactcgatatttattttagttgatgttttagaataaattgtttttttaatttagatgatatttcaaatttcaatgcaaaattaattagatttcatattgattttggctatttatattttgcatattgttttatcatttgttaaatcatgtttagatagacaataaatattattttcgtttagaactaaacaaaagttaaataaattttttaattgatgtgcaaaaacctccaacatcaacaaaaaaaaaaacacggagagggtaatagacaaatgtggatccatatcgaaatccggaacaataatctgataatcccatgaacttcaggtatcgtatttttcatagcatatcgtatagatctgggattgagggtagaatttcagacattgtgcaccccttgatgtgaacaaatgtggggacaattctaagccacatgtcactatttccttggttgtcttccgaccattaataccccatctcccaaactaacactcttctttaacacacacacacacacacacacaacaacaacaacaacaacaacaaagaggctttaatgttttagtctcttgttcacgtgaaaaaacaaactgcaattggataaccacaaccagaatcgattttgaatcatcatttctataaatatatacgactcatacatacatatacatacctcttaaacaaaactgag

SEQ ID NO: 6784 - DNA, 3000 bp, Unknown
  misc_feature (1)..( 3000): cDNA_ID_3042610_gDNA_ID_1621105_Annot_ID_171570 3000 nt of promoter + ATG
ctgcatgaatctcaagagcttttggtccatagaatgtgaaacatgtttccggtagagcctgcaatatgtcaagtatgttaaaaaattctgatatccactgtgaaactgaaacataattctagtaataatagttattaccttcaagatgtcaatcctaacgagacctccccagaaaaatgtataaccgtttaagctctcacccttgggactacttgacgattgagttggcaaagttgaaatctgtaaggaacaaaaagcacaggaagatcatcacactggtgttacggtaaaataatctttacctggccgtaataaagcagacttacatcgaaagattggcctctgagacgattttgaggagcaagggcgggtaaatcatctgaatgaacgacagctgcttgcctgtggtgtaggtgcacacccggtgtgtcatacaacttctgtggtaataatgtattcttttagcagaatgtctactattgcaatttttggaaagttctagaatctgatcttggtttaagtttatacctctcctccgacgaaagcgttgatctgaattggacccaaggtggttccagggacagcagattgaattggtttgtacttttgtgccgctgctgcaacaggatccctttcggccatcgtttctgtatggtgaagtacatatacaatcattcaaactctctttataaattgtggagaaattggccatactagagatcaggctaaagcagcacccagaccatattcaagcagatacaaacttcaacaacaagtgacacaaacacaatggagaacaaatgacttactcagcaaagcattgatgaatgctgacttccctacgttagctgcaccctgtgaaagtatgaagaaataataaatgaatattttctaaaccgtcaaagaagtttctttataaatgcatagcctctatctccagtaaacgaatttatgaattagtggatcatatcgagcagtgttgtgtcgagtttgttgttctgatggacatccgagaaaattgattttcactaagcactgcctctatcatttaaagtgtgttaagctattaagtaaatagtaagaactcgcatcagttagcaataggtttacaaactaaaactctattttgttggtgacaaaattacgaatgcacataccagaatgtagacatctcgtccctgaaacaaaaacagggatacagaggtcaggttacagaaggtaaataaagagaaggttatattgtccgacactgagccataatggaaacaaaatgtacgctaaagaaaacagctttaaggtggtgcaatatataaaaaaaacgctacctttttctccttctggatctctgatgcaactccgctaactccatccagggactttgaacttgtgagatggacactcaagacactgaaaagttatatcacacccaaatcaaacactagctccagaaacattacatcactttctagcaacaaccatagtagataagtacttgatacctacttaagctttttcctcatggtcacttccacaacccaatccccgatacaattcatatccgttccttttggaagaagatcaatctaacaatacaaaacacaattatttaccatagttagaaagaattgaagaagtagccatgttataaaaccttaccttagttataacaagtataatcggattagctccaactaaatcacgaacacgagctaaaaagcttccattaaaatccactatatcaacctgcaacacaacaagttgacgatctcttggaacataaaacagaaaagagaagttcattctaacaatatctactcaccaatttaacaatcaaagctttctcatggcgtaaatgagaaagtttctcacgaagttcatcagctgatacaaattgtttcccacctggataacctccattaccaccaactgctgtaatcatatgtccatgtgacaatagctgacatcttccacatatcatagttcttaactggtgatgcttcttcttctacaataaacacagaagaaaccatctctaattcatcaatcaactaactcaaaattgagattctcaagctcgaattcataccaattcataagtaaccaaatcgacaaatcccggagaatcgacgtcggaagtttgtaacggagctccgcagccgtaacaacatgagactgaggtatcaacaactttccgtgcaataatctcctctttctttttcttcttctcctttttgatctctttcttcactactttctgagcttcatgagctcgttggttctccaggaacctttctccaggggttggagcagccgccgcaaatccatctcgttccgagagtgaaactggtggttctgaattagctattgatttacagacgattgatgtcgtcggattacggtaaatgacggtgagattgggttcacgtctcgtcgttgtgtggcgacgaggaagagaaggaaacgttgagagtgttcgtagcgccattgctgagatttttcctcaccagctgttgtttgttgttatgttatctattaaacccagagagagaacaagagagactctaactggtacagaggttttactcgaaagaagaacctctggttgattggagacggttatatccgcccgggacaaaataaccggaatcgaatacccgaaatgaaccgatccaaaattagggtatagattagaaattcagtttcccgctcttttgctaccaaatctcagaaggcccaattttaaagagaaaattatgtttttttatttggtaaattgaaaaaaagaaaaaagaaaaattcaaatttgcttgtaataatcctctcaaagagaattcagttagacgattcgtctctacttctcctgcaacggttagattttgaatctacgctctcaatttcggaagcttgttgtgatacttccgtctgggtttccatttctagggtttatggggtttagtttctaaattagggtaaaatttggggaagaagaagacaacaaag

SEQ ID NO: 6785 - DNA, 1554 bp, Unknown
  misc_feature (1)..( 1554): cDNA_ID_3048898_gDNA_ID_1621105_Annot_ID_171569 3000 nt of promoter + ATG
cttggataattcacgtgtcacttcattagacaatgaatcaactttgtcagacaaagcttttacttctcctcccatactagcttcccttgcttgagtcaaagctttaatctgtttctccagttccgatatttcaccctgtgtcttatctgtctgctcatcaataccagtcatttttatcttcatttcttcaacaacatgtatcgaattatctctaatcttctccgcttgcacatactcaaaagcgacacaaaacctctttaaccgatctaattccgcattaccattagcccactgcatatactgcgacttttctctcctcaacttctccaaagctggcaatatatctttctcaagaagcttattaatctcatcaaccttagtttgctttttctccaacgtctttaacgcagcctctttcttattctcatacattctcgtaccagcagcttcttcaagcatagataaaatctccataggtttcatgtttaaaactttggtaatacgcccttgcataatcagaaaatgaggattgttcacattaagctgcaccgaatggaaaagattctgaacttgatttggttgtgcaagcttcccattgatcaaatacttgttctttccaccaactacaatcttcaaacacacacaaacaaacaaaattcactcttaacaaaacttaaaaacgaaaccttttttcactaaaaccttaaataagacttacttgtctagttactgtaatctctgaatgatcttcatgacctaaaggacttcgatttctctcggaattgtcgaaggtaactgaaacagtggctctagtgattccagcttgtccttgcttgtaaacgagttcctgtagattagcagctcgaacttgttgaagattagtgatacctagaacgaagcagatggaatcgaggatgttggattttccggatccgtttagacccgtaatcgcgttgaaatgcgggtcaaaacccggaactactgtcctcgttgcgtatgatttgaaaccttccaagcatatctcctttatatgcatctttgttgtcttcttcttccccaaattttaccctaatttagaaactaaaccccataaaccctagaaatggaaacccagacggaagtatcacaacaagcttccgaaattgagagcgtagattcaaaatctaaccgttgcaggagaagtagagacgaatcgtctaactgaattctctttgagaggattattacaagcaaatttgaatttttcttttttctttttttcaatttaccaaataaaaaaacataattttctctttaaaattgggccttctgagatttggtagcaaaagagcgggaaactgaatttctaatctataccctaattttggatcggttcatttcgggtattcgattccggttattttgtcccgggcggatataaccgtctccaatcaaccagaggttcttctttcgagtaaaacctctgtaccagttagagtctctcttgttctctctctgggtttaatagataacataacaacaaacaacagctggtgaggaaaaatctcagcaatg

SEQ ID NO: 6786 - DNA, 3000 bp, Unknown
  misc_feature (1)..( 3000): cDNA_ID_1815508_gDNA_ID_1621105_Annot_ID_171568 3000 nt of promoter + ATG
acaatgcgactagcagaatgtatgtactacataatcagattttatatattcttgataatctcttacagattttttataacaactgattatatgtaatatatgagtttagtgtcaaagaaaattatgataatatttttagaatcttgaaaaattaataacaagttatttacgtatggctgtggctgcttcattagtcattacgttagtcttttgaaattttcatgaccacaagaaaatatttcttccggttttgagatttttcgtaacaaacaaaattgaataatcgatgtacatcactaacttctacgtggcttgtgaccaagacaaatgactgtataaagaaaagaagtcgtcgttagggggaactcattttttatatttctagggctgatatttgatttgacaaaaaatattgtccaattatatgaaaaagtattacttaacaattcttctaaccattataatgaaaacatttctagggctgatattttagttttttgtaagaaaatcatgaaatgcattttgttttgtttgttttattacatgggccaagatatgaactctcaatttccaaatacagagacagctgaagatcaaaggataaggagtattttctttttctgtatacgtttcttggtttcatatgaacaaaattgattatgagaaaaagaaacaaccattagaaatatttattttatctagctatcttcaattattttgcctaacttgatgtgtcctttaggctttaaaaaaaaaacttgatgtgtccttttaagtgacacatcaatgaaccatatgtatagtctcttgttgttttataaagatcgattgaatttgattttcctctctatctatacgtttttgtttgtttaaaaatgtcaaaaatttgggtatccaggatgttcgaacgcaggacacgtatgaagtgacgtctttcaccgccgtaaatctttggattgacagtccggtaaaaacagattaatagcttgatagtccaaaacgcacgtataaaagtttttgcatgttgaaaatattcgtatccacacaacattagagatcaatcatgaaaccgatatattgaaggtcacccgacgtcaaatttcccctgaaagggacacctcaaaattacgtggttcgtgtaatcttttttcctttaagatagggatcggattatgcagtataaaattaagcaaatcgtatttggtgatatatcggttctaatgcataacatcttttatattcacacaatgaaatagctatttgttttcagtttcgagctaaagcccaagctccagcccaaatcaaacccatttgtacaaagaacctcactcatctatttgtgcacaaattctcggatttctccaacgctctcaatcattttataaaaattagaattatcttcaatctcgatatacgaacctaaataattgaaaacattttttttctttttatgtatttttcttttttatcaaatttctttttatgtatataaaatatttgtgaaagtttcttccacacatataaaagattaaatttctttttttatcccaagcttgaatatcaaaacatgagacaacaagagcaagtattagccaccacaaagcaatcatcttaaaactcaaaccccaaaacaaacaaaagacaaaacccgattgtttcgagcacaaacgtcacttgtggtttacatcgtcttcatcatctccataacttcatatctcctctccttccgctgccaccgttagcgatgtctttggacactgtggacaaactggtggtgttcttggccaagagagacggaatagacaagcttgtgaagacattccaatacgtggccaagctcgcgtgctggcatgttgaagccacacgacccgaagccgccgataggttcaagaagtgggaggtcgcctccggtctcagccgcaaagccttcaggtcccacatctttttaatattaatcactttatcgacaaagtggcatcatcgtaaatatagtttaatagatgaaatgaaatgaaatgttttagtcacttcttgattaatatcttatctcatctagcatatttgaatagtgactagtacgatacactttatattacaagaaaaatataattgaatagtgattatggtcgaattatgcgaacaggaccgggagatctctcacggggttcaatgcgctgagacgaaaccccggggcaaccccgatgatccgtttcttggcggtcctagccaattcaggggaaatggtttacttcttctttgatcattttctttggttatcaagaattggttcaatagacgccaagctcgccaagaaaatgagtttcatatccgcttttggcgaatctttcggctacactttcttcatcatcattgattgcatcttcataaagcaaagactcaaatccttaaaaaagctccagcattcgaccgatgaaccgaaagaagaaatcggcgccaaaattagcgagattcggggagatatagtaatgaggttgatgggaatttcagccaacgttgcggatttacttatagcattggcagaaattcacccaaaccccttttgtaaccacaccattacactcggtataagcggtttagtttcagcttgggccggttggtataggaactggccatcgtgagatgtaataaaatcaaatgtttgttgttttgaatgaacgtatcaaacgtgtaatgtaactcacttgaatatatgaaacatttctattttacattatctatagtcaaatcgaaatcaaacaaaactaagggtatacaaaagtataatccacatacgtgggggacatttatgaaattcataaaacttggtaactgtaaaatagtaacttcccactctctcaccctcttcactgggacggttatttttttttttaaattcatttgcatcaaaagtcgttaccttccagtaatatttatagatttataacgatgcaatactcactaaagaaacagaaacagagataattttttcgaaagaaattg

SEQ ID NO: 6787 - DNA, 3000 bp, Unknown
  misc_feature (1)..( 3000): cDNA_ID_1815512_gDNA_ID_1621105_Annot_ID_171564 3000 nt of promoter + ATG
caattgttatttcccttaaatactctaaagcacgtgaagaatgcgaaacccaattcatgcacgaacagtactcattaatttctgattatgattttcttcagttttgggactaccaaatccaataatccaaatgagaatactaaaagtttgttgtcacatatcacataagaagaaaaggacttgaatactacacgaaagggggaaaggtgtagtttacacattacacaatacatatagaaatatatattaaaaaaaaaaaaaaaaactaaaacttgtgaaagttgattatgaaagttgacccatctaactagtgaacccatcgaagttgattatctaaacatgcttaatatatggattgatatttggaatccacatttgccaataacacataattgggttcataaaaattcaacccaaattaacacctaagctctagccaataagattgaatttacaaagtgtttgttttcttcttttgttccaaaccacttgtatcaactactatgtcctcaagttcccaaaacaattttattgtttacgataacaaatccctaggaatgactttagtataatacagtatacaaaaaaacactaaatagagtacaaattagtagatgtggccgaggttgaggtgaggaccacgtatccaaaatatttacagtccttttttttgtttttgttaaagatatttttgcattcgtacaaaagtatttgcataaaaggcacctaaccatttgttttaccgtatataaaatttttttaactgtctttgcatgccggtttttatcatgaagttcgaaattttttatatacggtaaaacaaatggttaggtgcatttgttacctctttcttttattatttatcatccactaaaaatcatcgtgtaacgtagaccacgcataaattctaaattattcttgaccctgaattattagtacaccaattaaaatatttgaatatcaaactgaaccaattctcaacagttttagtgtacagttctcaaaaaaacaagttttttggttcaaaaatagtatttacaaaatattaaaaaaagaaataaaagaaatggaaaatttaaattttgaaaaacatatagtagaatgctatatttatttccagcttcaagtttataaaatataaaagaaaaagaaaaatatatttgtcagtttagtaattctagaaaatgtaaagatttagtttttaatgagcataagaaagatctagtatgcataatgttaaaagtcatacatgaattgtatatctagaacatttcaacaagtatttagtaaattaagaaaaaaagaatctagcaaactaatatttaaaaatgcatattatataattaggtatattacgtaggaaataaccatcgttcgacttcgttcattggcgtggtttgacaactagagacgcaactagcaaggttaaaactgtaattccatatctgacgaatatgatttgttgatagaagggtgagatcgtaatttcagatttataatataaaaaaaaacaattttctaattgggtcgactattgagcacaaatgctataaactcgtcgccgttgcttcaagctcctaaaacgtgtccaagtatcttttgcatcttcaaagcaaaagaaaaacatcaattttttccaaatttttatcattttctcaatcgtcagtactcagtatttagagtcaaaaatctcgtcgaagaatttcttttggaggaagcgttatttttgctaaaggtactaattcaacttatttttcgttttaaagtttttgttgtgttgttactgtttatctttgaagtgaacttggaatgtttctggttttgagtcaaatctttggtatcaagttatcttctattttctcagagatttttgttctgtccaatggaatattctagtaattattacagattttacgaaggaattcttcaaatcgtgatatgcgtcttcatcgttctatatctttcttcatcgtcccccgatggttcttttatattcttagcattcttcgagattcgaatcttaagttgatcctgttctgttttataatctgtatttaatataattttgaatatttcaaaggatgagttttattttcttgcatgatttcaacaaatattatcaagatgaacttggatcaggtcatgagtaaactgtttaaggatttgatgaattttcaagctctgttattttttttgtttaaagaatattccttaaatataccaatttagtggtcataactcataactcatataaaggtaaagaatatctagagtaaaaataaataaattaaggtaataaaatctgagttatttaactaatcaaaacacttcaaatagtttctcttgagagttcataaaagagacacaagtacaaaatcacgatctgtcactcattccgacacgtttctagagattcctcactagatgtaacctttatgtaacgccaagagttaaaaaagtaaaattctatatgaaatattcgaatatactcttttttgatactttttttttatctaatatttatttctccaatctttaggtcaaacaaaacattggatttcgagaactgaagaacaagttttgatgggttctctaatgcaatctgaaccagagatggagaaaaaaccgatagggatacgattcttggaacgtatcaaaggctcaaagctctcttacagtgcttatcaagccatagtgttgatcgtgacgtttctcgcttacgctagctatcacgctgcaagaaaaacaacaagtattgtcaaaagtgctcttgatcctcaatctccagatacaggactaaactcacttcttttgagatttacttcgtttggttcctctgtaaaagaagaaggtggttgggctcctttcaatggtcctgatggtacggttttgctcggtgagatcgatgttgcgtttcttgcggtttacgctttcggaatgtatttcgctggacatttgggggataggatgaatcttaggatcttcttgactgttggaatg

SEQ ID NO: 6788 - DNA, 3000 bp, Unknown
  misc_feature (1)..( 3000): cDNA_ID_1815516_gDNA_ID_1621105_Annot_ID_171561 3000 nt of promoter + ATG
gaagtcatggtatcgaagttaatgttcttggagaagactttgagagtaaagttcttgaggtatctatgtcttcttactcttcaatttgaagttaattgttaggattctgttaactaaatgttcaagttcttataggatgctcggaaatcgtgtcttcttgtgaatgctcctttgattcatagagcttgttctcgagttccgttctctgttcttaagtatgccatgactcttgatggtaactatttcaacctccatttcatatgtttgtaggatagctgttttagctaacgttttttttgtttattgataggtaagattgcagcgagtagtggacatgcagcatggataagtagtaaactctctagaacccgagtgttcgagttgcgaggaggaagtgatgctgtgatagttggaggaaacacagtacgccaagatggtaaatattgtatcttaaatctcgcatctttacggatgcttacaacatattgaatagatatgtgaaagttgtgcaattttgtaactgcagatcctcgattgactgcaagacacggacagggtcacacccctacacgaattgtgatgactcagagtcttgatcttcctgagaaagctaatctatgggatgtctcggaagtatctaccatagttgttacccaaaggggtgcaagaaagagtttccagaaattgcttgcgtccaagggtgttgaagttgtggagtttgacatgttgaatccaagagaagttatggaatatttccatctccgtggatatctttctatactatgggagtgtgggggaacattagctgcatctgctatatcatccagtgtcatccacaaggtacccattatactatatccatacttatttgtagtcatcttatgtttttgtctggctaaacctcattttcttacacttctttctctcaatgtaattcatttttcaggttgttgctttcgttgctccaaaaattatcggtgggagtaaagcaccttcccctgtgggtgaccttgggatggtagagatgacacaagcattgaatttaattgatgtttgttatgagcaggtaatttttttgctttatgaattaacattcactgtgacaagttaaccatgttactgaatctggcctcttagttccgtgggtttaatctaaatccttgaactacaggttggtcccgacatgcttgtcagcggatttcttcagcccataccagacctcttacctgttatcccatcagaggatgcaactgtcgagattgaccccagtgttgacccctttgaacctagtatcatattcttctacaaaacatgggacctctatggaagtttctcaaatttttctccacatccaattcgaatgccctatggcgaggagaatgatgattacatgacctggtccagtgtggaacattactatcaggtaccacacaacagtccatgtaaaatggtatcttgctctttcaaaaaaacataatctcttgatccttcacccaaaaactttaaaggcaaacaagtttgttggggtcgaaaatccaaaggcatatgattgcgttgagaaaattagaacagctagaagtccagaggaggcagctctgataggcagatcaacactgagacagaaacctgaactggtatgaataaaagttgaattgtccagtttcgagcatcaaagcagttttcactcgtttgttgatctctcgagaatcgagatcgttattcaggggatcaataatactgcattctcgctttaatgattgttttaggttcggaatgattgggaagatgtgaagatagaagtaatgtacaaggctttaaaatgcaagttctcaacttatcctcacttgaaatcaatgttgctctcgacaattggaacagttctcgtggaggcttcaccgcacgatctattctggggaggtggccgtgaaggagaagggcttaactatcttggtcgactgcttatgcagcttcgttctgagtatctgggcgaatcctctgtttcagctgaaaagacttcttcggcctgatggatgatgatagtctttcatatttattccaaaaagttatcaataaaactttcagttttcctcaattttgacatttacattgttgtaattctttaacctatataacattattgtaagtttgtaacattatgatagttttcctagaccatttgattcacattaactcatactgagtattttaaatggtaacggtagagtttttatttgctttgttcggttttaaaaccaatccaacatattcaagaatccaattcgatttggtccggatcagtgaaaattccaaggcttataggaacacctttcgtaaagaagacactaggtggtcgcaacttttcgagaagaacagacactaggtggtcacgaagacactagctggtgacaacgtcagaaaatactcaacataaaagtaaaactcttaaaagagttacataacacaaatattaaaatatgtatcatataatcatcatagtaacataaacaaggattgttgtaagagtttgcgtatgcttgaaactacaagagtagaaactgagctaaaagcacatggaaggttactttaacattggaaaaacacatctttcttcttcttcctttcaagtcacttttcctcttcttttctttcattttgacatttctttcttaatactttttaaatatgtaatggaatcaattatagacctttatataggtgtttgatattatatgattttataatcataggttgctaaataagaatgtaagtcatgatatcatatgaatacaatcccaagcaaagacaacacacatcatcatgttctcccctcaataacaatcacttgcaaagtacatacacacaaactcaaaataataattctagaaaacaattattaactaatttaatatacaaaactaaattccctttaattagttaagacatcacaccaagaaacttctcaattccccatacaaactcatacccaagaacttcaaaaaa

SEQ ID NO: 6789 - DNA, 3000 bp, Unknown
  misc_feature (1)..( 3000): cDNA_ID_3048908_gDNA_ID_1621105_Annot_ID_171560 3000 nt of promoter + ATG
ttctgagatgcatactgaatgatttattatgtaaagtattttgttttccgtccattacatcatcatcacagatacttgatataatcatattacaaaatacaaatgacgatcaacccatcgatcaatctagaaaaacggcgaaattgaagaatgctaaattgatcaaaggataaacttttgggcttaaataaagttttgctgaaaatatttcgggcttatatagggctggccctattagactacaacttttttttttcttctttgacagtaaacgacgacgtctccctttttttctttcttcgatctccttctgccaaacactctcttcttcttcttcttcaatcttctttcttcgatctcttctttttcaaaatctcttctttgattgtgagaagccataagtaaaggttcgatttctctctatatgtctttcatctttctcatttttatattctcatagattgatagattctctatctttggaatctgattcataggattggggtttaatggttttcgaagaaatctgggttaaagtgtgttcgtgtgttctctaaatttgattcactaaacgtgtgttcgtgtgttctctaaattgaattctgtgtagctatgaacttgtgagtcgctgtaaaattggatttgaacttgtgggtcgattcatgttttctttcacatttggggaatcagattcttcttttgggtctgtttttgtatgttgaagtgtcgattttctattagtagttcatacattcagacatgttatgtatgtgaagtatcgagtttcaatttgctgaggattgcttgagaatttggcctctgttgcttccgtttatatcggtgtttttgggtttctatatcattgattctgcaacacattgaacaagaccagagactacatataaatgtctttttggttggatatgtttctgtttgaatttgtatgtttatagttttgactatagactgatctttatagctcaccaagaaaaaacaataaggaagggacgaaatttgtgtcaagataattgcagacgactctcctctgtctctcttttcattaacagctttttagttttgaaatatggctggaactttggtaaattagttgtatatgtctttttggtccagagtagtatgatagtgtgtatatgtttactcattagtgagtctgtgattaaattagttgactgaccaattaaattcaacttatttgatgtcttttataccgtacttcttgaatgaatcagctttgacattctttacaattccttgtgttttgccttaagttttgcacataaattatgcctcatgattttggttgaaaatgcaggtgattgaaatctataataggagctgccattgtgtgttgaatgggtatcaagttcttcttctaagtgatccaaatcctgcttccgattagctcaaatacttggtaataatttcttctcttttcgcagtttctaagtgacccttttatacatttcgcactttacataattcgtctgctttctctttacctcacagacacaaagagttcctgcaaaaagagctcaaagagtttctctttacataatccggtgatgtactgtctttctttcctgtatcagttccaactctttggtaagatttttctcttgatttttagtttgtttctgaaacaaattaggttatgtgtctgagttggtttctagggaaaatctatttgctttatatgttaagtcatcatcatatattcttttgcagacacttatgtctgcactggatttattgatattgaagctccataagcacgaattgatgatattcctggctttgtttattggaaatcgagttggttatgttaactttaggagagcttggatgcattagcactgtgactatctctgtagtatagtctctgtttgaatctggaagttgagtaggtgaaattatttagttcagctatagaaacaaaaatgaattgttgacattgatagttgagactgttactacggcacaaagcactgattagagcctgtcaatagaaactagtttgattcttggggttggtccaccacgctggatcctgactcatactgcatctgtattgctacacttgtactcttttcgagctagaattgaagctgttcttaggttgagtattgagtagatgataatttagagaacttgagatgtatgatatgtcactctcattggcttcaaagttggagctgcctacttgaatttgggtgttccttgtttcagttagtatttgcagtacgtttcttcttcttgagttaagattcttggattgttacttctcatgaatactctacttgtgattgaaattgttgtctttgttggcgtatagtttacttgtatttgcagttttggttttatcttgtggagtcctatattgggttgatatgaacttgttgcttatctttatgcatttaaaagtaaaccttttctatctgaaaccgcaggtatttcaagtgtagtgtctgatcttaaccatagaaccttctttgaattggcatgatccatacattgtgaaaagtaaattatgaagatttgtcaactatctgaaaatacaaaccaatgcttaattattaagatccataatgttgattgttattatgctttggttcttatataaaatttttttcatgaaaatggaagtttaaacaatgtgttataggcacaactatggcctagttgtggatttaacgagtgcacttacctttatcattgccgttaaatttgttattatatgaaagaaaactcaaaataataatgtcttatactaaactgataaaaaaacatttggtatgggtttgtgacagaatggatcaaatccctcatcgttgatcacgcagataatgttatgtataatagatttttcttattgggcctatatgggcttcttctttatgtctcatgagcccaaataacattgcataacttttaaaactttcttttcttcgtttgcacagattaggcaaatcgattctctca

SEQ ID NO: 6790 - DNA, 3000 bp, Unknown; identical to SEQ ID NO: 6774
  misc_feature (1)..( 3000): cDNA_ID_1815548_gDNA_ID_1621105_Annot_ID_171544 3000 nt of promoter + ATG

SEQ ID NO: 6791 - DNA, 3000 bp, Unknown; identical to SEQ ID NO: 6781
  misc_feature (1)..( 3000): cDNA_ID_1815533_gDNA_ID_1621105_Annot_ID_55962 3000 nt of promoter + ATG

SEQ ID NO: 6792 - DNA, 3000 bp, Unknown
  misc_feature (1)..( 3000): cDNA_ID_2993944_gDNA_ID_1621105_Annot_ID_55963 3000 nt of promoter + ATG
aaatcgagtgtggtaattattcagtggaagtatataccggctagaaaaaaagaatattctgatgaggtaaataaaaataaaaatgtatatatgatccattgtaagaaaccaaaagatcagtacaagtgcaacactgaaatataaatatgattcaactaccaaatattactgaatgtggaattatgtcaagcgcaggccacattttacaacttttgtttcttctctgaattgtgtgaatgacaataataaaagttttcgtacttttccgagaaaaatataaagttcaaaacttagatggataatatttatgtttgataaaaaaaaagaaatggacatgagtgcatgacaattaacttttaagaaataaaattatagtcagacaaatgacgagatttttctaatttaatttagaacagtgataacgaaatgtactacgcaaccttgcgaccgagtttcatcaccatttgttcttttccaaactactattttaatcctctgtggatattaactctttgattcatttaaaagtcgaattgccgtatctattatgattttgttattttggtaatattagttgtttttatattgatgaaaaaaagatcaacagatttatattgcaagaacataactcacaaaagatacaattatatgaattcaataagagaaaaacaatttaaccaaactaattatgtaatgtaataataatatttaagaaaaactagtaatgtaagttgaagtcggagaaccagctggctaaggttcggatccttatgcccgaagatgacatggcacggccgtgcacgagtggtagcgtctatttctttctagccgtagctcgtagatgatgatttgccagatagactaggatcgtgacctcatgaaagacgacgagtcgctaccttttttaattatgcccaaacttattataaacgtgatattttcttcttctgttatttttttaactaatgggatattctcttacgcaatcccacttactaattcattaattgaccaactatataagtatgttatgaccagccggaagtaattaaattacgaatgatgtcgctttgtgaggactatgaggcgtttgaaagtcctttacttttacaaaatgacgtttggttaacattgtagggtacttgtaactaattgtgtgttttgtatattaaacacaatttttgcgttggcatacatttgaatattaggctgtttttatctgcttccttcaccgaacaaactgttatacgtcatctgtttttctattttcctttcacaaagtataagaatcttcttcgttatctgtttatttgataacgaaactggcttatacaaacatgacacggcatggatcttaacaattattagcgtctcaagtattgataaaataataataacagctacactcacgactcacgtcgcctaaatcaccacattatcatttttggtactagtatccaaactgttcggatatgtatttacagtctttgtaagagaatttcaatcatttatagctgaaggtgtaccatatagatagatagggacaccagcaatttttacatataaaaaagaaaaaaatatcaaacgatttacaatgtatcatgtcgcgattgggtcttgctgcctcaagaatagggctgatatctcgttttgtccaatcaaagaaaaaacacgtcatattcttattttgatgatttatatattagcattatccaaagtccaaagattataaactgagattcatcttctcgcccttgcacattgtagcaacgtgtgaggcatgtgcgatgcctatacctacaattcacatgtgatccggtatattaaaatatacatgatttatggatacactcgaatacttctccgatattcatttcgcggaaagttgcatatgatccactatctcctatatatttgttatataacacatggcaaatctctctatatatattttttaaatacacatatatccaaaataggcttaactataacacaaagacttttgtttactgtatattagtaagaagtaaatgtattttttaatattatgataaagtttgtgaaatcaccatttgcaatagccatatagggtcgtgttttaattttacagtttgtattgttataattcgattccaaggttgagaatatgtgtgtactattagactatacaaataataattcgttgacgatattgaatatttactaattataggaagagaaaattatttactaactatagtacgatatatttcttctatatgtgtttttaacgtttttttttttttaaatttaagtcttaactttacttctcatttttaatcaaaaggaaaaaaataccaatcaatttttcctaacacagtttacttatcattttcatttgaaatgtgttcactttctgataaaatgctaatcctacaatcaaatacaccattgtcgtgataacacgtgtacggctctaaagcaatcagaacaatcattggacagtttttacaccgtcagataagtacctatccacttgctgactcagccggataaaccctaaaccggaagtttgccccaccgtcaaaattggaagaaaccggacaaaagagaatgtaaagactaagaagtaagaacccatcggacgtcgtaagaaggttaattaacacgtggaaacagctggtcagagttatccggtaacttatccggttacaagtaaaaaaataatttgttcccatacacgactccttcagaaccaaacgcgacatcacggcgccgtttagtgtctataaatagagcaatcggtcgtagaaaaccaagacatcaaaaacacgaatatcgatagtacacttctacgtgcaattttctcctttctcttcctggacatctgtctgtttattacattttcttgtaatctctttttggggttttacaatatctatcccctaaagtttcggaaaattctgtttttctgttctcattcttcgtgatctttttcactttcttcaaaaaaaaaacatg

SEQ ID NO: 6793 - DNA, 3000 bp, Unknown; identical to SEQ ID NO: 6778
  misc_feature (1)..( 3000): cDNA_ID_1815529_gDNA_ID_1621105_Annot_ID_55964 3000 nt of promoter + ATG

SEQ ID NO: 6794 - DNA, 3000 bp, Unknown; identical to SEQ ID NO: 6777
  misc_feature (1)..( 3000): cDNA_ID_1815526_gDNA_ID_1621105_Annot_ID_55965 3000 nt of promoter + ATG

SEQ ID NO: 6795 - DNA, 3000 bp, Unknown; identical to SEQ ID NO: 6776
  misc_feature (1)..( 3000): cDNA_ID_1809157_gDNA_ID_1621105_Annot_ID_55966 3000 nt of promoter + ATG

SEQ ID NO: 6796 - DNA, 3000 bp, Unknown; identical to SEQ ID NO: 6789
  misc_feature (1)..( 3000): cDNA_ID_1815520_gDNA_ID_1621105_Annot_ID_55968 3000 nt of promoter + ATG

SEQ ID NO: 6797 - DNA, 3000 bp, Unknown; identical to SEQ ID NO: 6788
  misc_feature (1)..( 3000): cDNA_ID_1815516_gDNA_ID_1621105_Annot_ID_55969 3000 nt of promoter + ATG

SEQ ID NO: 6798 - DNA, 3000 bp, Unknown
  misc_feature (1)..( 3000): cDNA_ID_1815512_gDNA_ID_1621105_Annot_ID_55971 3000 nt of promoter + ATG
gtattaataatcggtgataacgacctaaacattgacatatatactcatacaaatacttttatttttctaaaatcgtatatctactttgaccgtagaggcaaattatgtactatccacgttgacaaatattttatcaaccacattgatcaaattaataataagaattattgatgacaaaatgtgaaagccccatgcgctaatccatgagaaacttgcattcaccacaccacatccacatattactttatgtaatgtagttgtttccaaaacttaatttctttcagagccctttctgatctgagcgttgtggggtcttcaaattgtataccccggatcccaaatgatactgaacattttttctgtggtggttgtttatttagtttccaattgttatttcccttaaatactctaaagcacgtgaagaatgcgaaacccaattcatgcacgaacagtactcattaatttctgattatgattttcttcagttttgggactaccaaatccaataatccaaatgagaatactaaaagtttgttgtcacatatcacataagaagaaaaggacttgaatactacacgaaagggggaaaggtgtagtttacacattacacaatacatatagaaatatatattaaaaaaaaaaaaaaaaactaaaacttgtgaaagttgattatgaaagttgacccatctaactagtgaacccatcgaagttgattatctaaacatgcttaatatatggattgatatttggaatccacatttgccaataacacataattgggttcataaaaattcaacccaaattaacacctaagctctagccaataagattgaatttacaaagtgtttgttttcttcttttgttccaaaccacttgtatcaactactatgtcctcaagttcccaaaacaattttattgtttacgataacaaatccctaggaatgactttagtataatacagtatacaaaaaaacactaaatagagtacaaattagtagatgtggccgaggttgaggtgaggaccacgtatccaaaatatttacagtccttttttttgtttttgttaaagatatttttgcattcgtacaaaagtatttgcataaaaggcacctaaccatttgttttaccgtatataaaatttttttaactgtctttgcatgccggtttttatcatgaagttcgaaattttttatatacggtaaaacaaatggttaggtgcatttgttacctctttcttttattatttatcatccactaaaaatcatcgtgtaacgtagaccacgcataaattctaaattattcttgaccctgaattattagtacaccaattaaaatatttgaatatcaaactgaaccaattctcaacagttttagtgtacagttctcaaaaaaacaagttttttggttcaaaaatagtatttacaaaatattaaaaaaagaaataaaagaaatggaaaatttaaattttgaaaaacatatagtagaatgctatatttatttccagcttcaagtttataaaatataaaagaaaaagaaaaatatatttgtcagtttagtaattctagaaaatgtaaagatttagtttttaatgagcataagaaagatctagtatgcataatgttaaaagtcatacatgaattgtatatctagaacatttcaacaagtatttagtaaattaagaaaaaaagaatctagcaaactaatatttaaaaatgcatattatataattaggtatattacgtaggaaataaccatcgttcgacttcgttcattggcgtggtttgacaactagagacgcaactagcaaggttaaaactgtaattccatatctgacgaatatgatttgttgatagaagggtgagatcgtaatttcagatttataatataaaaaaaaacaattttctaattgggtcgactattgagcacaaatgctataaactcgtcgccgttgcttcaagctcctaaaacgtgtccaagtatcttttgcatcttcaaagcaaaagaaaaacatcaattttttccaaatttttatcattttctcaatcgtcagtactcagtatttagagtcaaaaatctcgtcgaagaatttcttttggaggaagcgttatttttgctaaaggtactaattcaacttatttttcgttttaaagtttttgttgtgttgttactgtttatctttgaagtgaacttggaatgtttctggttttgagtcaaatctttggtatcaagttatcttctattttctcagagatttttgttctgtccaatggaatattctagtaattattacagattttacgaaggaattcttcaaatcgtgatatgcgtcttcatcgttctatatctttcttcatcgtcccccgatggttcttttatattcttagcattcttcgagattcgaatcttaagttgatcctgttctgttttataatctgtatttaatataattttgaatatttcaaaggatgagttttattttcttgcatgatttcaacaaatattatcaagatgaacttggatcaggtcatgagtaaactgtttaaggatttgatgaattttcaagctctgttattttttttgtttaaagaatattccttaaatataccaatttagtggtcataactcataactcatataaaggtaaagaatatctagagtaaaaataaataaattaaggtaataaaatctgagttatttaactaatcaaaacacttcaaatagtttctcttgagagttcataaaagagacacaagtacaaaatcacgatctgtcactcattccgacacgtttctagagattcctcactagatgtaacctttatgtaacgccaagagttaaaaaagtaaaattctatatgaaatattcgaatatactcttttttgatactttttttttatctaatatttatttctccaatctttaggtcaaacaaaacattggatttcgagaactgaagaacaagttttgatgggttctctaatgcaatctgaaccagagatg

SEQ ID NO: 6799 - DNA, 3000 bp, Unknown; identical to SEQ ID NO: 6786
  misc_feature (1)..( 3000): cDNA_ID_1815508_gDNA_ID_1621105_Annot_ID_55973 3000 nt of promoter + ATG

SEQ ID NO: 6800 - DNA, 3000 bp, Unknown; identical to SEQ ID NO: 6784
  misc_feature (1)..( 3000): cDNA_ID_3042610_gDNA_ID_1621105_Annot_ID_55975 3000 nt of promoter + ATG

SEQ ID NO: 6801 - DNA, 3000 bp, Unknown
  misc_feature (1)..( 3000): cDNA_ID_1815585_gDNA_ID_1621106_Annot_ID_55978 3000 nt of promoter + ATG
agtgcctggtgcaaaaggtccaaaatggtaacctcctcttgatccatgtcttgattcatgaacatcaaagcttttgttataagaactctctggtgttgagtgctttttcatctttagccttctctctgtagcgttttcttgggacgaagatgatgatttgcttctcttaacattgacgtttgtaatatcagttccgaaagctctttttcttgactccaattgcaacaaatcgctgctcagtgtgaaagtaggctcaccattgtaccctaaccacttgaaagctggtttcctagaatctaaggtgtgagtctgccaccagagaatacagaaactagtaagacttaaatcacagcttgaaatcatagatggttcacaactgttgtagctattgataactttgacttaccttctctatgagattcattgacgacaagacatttgctatatcataaagccgcctcactttagctgcataaaagtaatcaatgtgtcaacaaacacagatcgatttgtctcaaccgaggatgttaacataaaagaaaagacttttcaggtcacaagacgaagataattacttcgcattattgatgtattgtgggcatcaccaagcagtaattttgcagcgtcatcaagggagatgatcctaatagcctaaacagttgaacacataaaaaacaaatctttagtaacttagtgaataactctttagttcaaaaaacgaatctttgaacttctcacttacttcagagcaaataaagagtttgataaagttctgagtaagcaatcctaaagatttctctcgtcggttatctgtcatacataaccaaccaacaaaatgttaggatatctacattgcatctcataattcatatcccacatatagagttaccaagagggtaaatcacttaactactttgcaatggcactaaacccgaacacaataagtactacacgcacaaaatgaaacagtacctattttggagggatctgaagattggggaagagaaccaggttttgaactatcagtctggctactagagtgaggctgagaagactcttcatcatcatcctcatcatcagatccctgaaagtatgaaactttaagcattagaagtatgaagacaacaaactaaagacacaagtatatcaaaagaaaccaaatccaaatgacttactttaacattctcattgacatagaaacgatgaaaagtgtccttaaccccctcttcctacatcaagaacacttcctatgagaatatgcaaatcaaatcgctacatttcttcacaattgggattgaatgggattgaatccgaatacaaaacaaatgaaaagactcacttgtagctccttcaatgctcctggaattgcggaaaaccctttccacgtatactgattctttgctcttcttgttaaaacctaaattagacaaaactcgaattaagcaaacataacacttctggattctgaaaaaaaacaaagtagtggagaaacaagtctcaccccaacactctccagaacattaacaatatcatagattcttcgtctctccactcctgaaataaaccccaaaaaccccaatcaacaaattaagatgtaaaatcagaaatgaaaataaaaatcacaaacacaaagtgggcaatacctaatttcgaggcagcatcatcaagcccaaccatttcaatcccttctcgattatacaaagctaagaaactgagtttacgaagaacactaatcagaacaaattcaacaacaaataaataaaatgggtttagtaaaaaggcactaacttggtacaaagaagtccgagagatttctgtttgcgactataggaatggtgtaattgtaaagccgaagaagattccggtatggaagaaggagaagtaacggcaagtttgaatctttctggcgatagatctgacatggttgacgcaaacgatgtctgcgattgagaatttgatattgtattttggagggatttcctaaaaagagagagggggaatttcccaagatacttgagcgccaatttgaattttttggctcctccttctccgtaacatttacacactcctctaaattttggtaaagctgaaacctttacggttttgtgctcggttcagatcgcaattttttggtttttgtctttttgttttttcggtttagaaaatttcttacaatattttcaggattctgttcaactttttcatttttcttttccaaaattagattacattaaccaaaataatacattttcaatcaatattatagtaacaagatctattttggatatctatctttttacttgaactcaaaaagtaaagttgtaaggggattttggttttgtaggatttaaaagtgatttggtctgaatttgtttttggtttggtatggtttgtttggttttggaaagattaaatcttttgatttgtaatcttgtaaagagtaatgcccttaaaatggtagattcatgatagtgtttaactacttgcataagcaaaatcagggtctatctttgactaaattatagtcttaccattaaaaatttctattgaccaaaacaaaaggttattttgtccaactaagatttttttttctataatagttttgcatacctttggtcttactcatttgagctaaaccaattaatttaaagttgttgacaaaacaaaaaaaaaaaaattgcattcttattttatttttacactttttcaataattcattgatacctaacagaaattaatacaaagtgacaaaattgatatgatattaaaattagttgtgtaaagagtttttgtgtgtgtgtgtatgttagtttcatgggcctattttgaaacccaaaagttaatcaatgggcccaatacacacgatctctctgtaaatttcaaaataattaagatggagggagcaaatgtttctgaaatctctctccacgacgaagaagagattcttcgattcttttttgaatacttaaagttaaactctcagtttctgcttctgctatg

SEQ ID NO: 6802 - DNA, 3000 bp, Unknown
  misc_feature (1)..( 3000): cDNA_ID_2175536_gDNA_ID_1621106_Annot_ID_171577 3000 nt of promoter + ATG
tatgctctcagagatggctattcagagcaggtagtggattgttcaagtgtgtctgtgtatggttatgagcataagttgctcttgtgtcagcttctttgcttcatagatttaagctactagcctactgtggtatatatttattacatgtgctccattattatatgacaattgtgttcctgggatgcagatagcagaagctttgctggaaattacacttcctagattttctggagacgtcatcccaaaaacagatgcaggaatggttttggcaataggtgataggtaaattgaaagcctaaagttttgttgtctctcccatttctttctacgccaaacggttcgtcctgtgaacacaaaaccttgtatctggattgcgcggagctaaattgtatatgcttctgatatgataatttttgttcgaatttgtgatcctatatactaacacctatgcttgtccctatgactgtagattggatagccttgttggtttatttgctgctggttgccagccaagttcaacaaatgacccttttggccttagaagaatatcatatggcttagtaagtttatagatattctgatctgaaaatgagctattatgatatgtcattttatggttgcatgaggttatggatgccaagtaatactttgtatgccacaggttcagattttggtcgagaaggataaaaatgtcaacttcaaacgtgttctagaacttgcagccagtgtacaaccgacgaaggttgaggcaaacactgtagaagatgtgagaatcaattgagtggcatcaaatcttgttatcaccatctgaaattgttcgtgacataattaactcttttatttgtttctaggtgtatcaatttgttactcgaagactggaacagctattggttcgtgcaacttttgtgatgtttatctttttcgatttcccagctcttaaaatatcttacgggtccagttcttgaaacaacgttttatccttttttacaggttgacaacggagtaagccctgaagtagttaggtctgtcctagcagagcgtggaaacaatccttgtctggcagcacggactgcatacaaggttagtgacttgtgatatgatccaatagcagttagctagggaattaggtaatagttgagaagcctttgggcatcattctcctagtgaatgttgctgtgtcatagtgatattgctccaaagaagctaacatcgctggtgcttgccttgcagacggaaaagctaagcaaaggtgagatgtttccgaagatagtggaagcatattctcgtcccacacgcattgtccgtgggaaagatgttggtgttggagttgaggtacttgaggtttctgtctgatcaaagagcatttgtgaaaacttgcagcttctaacattgaatgatgcaatcaggtggatgagaatgcatttgagactccccaagagagaacgttgtggagtacttacacctctatcaaagatcgaattcacactggtaactcactttcttccctgctgtattctctcaaacaagctcgcttccaaattcgtctcactaaccttccaaatttcaggcattgaaatcgaggacttcaccgagatatccatgcaattggtggagccactcgaggatttcttcaacaatgtatttgtaatggtggtaagttaaaactttgtccatacactgtactcgagtatcgcagacgagtgaagtttgaatataacggtttttgcaggaggaagaaagagtgaggaagaacagactcgctctgcttaataacattgccaatcttcccaaaggagtcattgacctctcatttttgcccggattttgatctttacttgtttcataatcccactccggaatcatcaattcattgacctctcattttttctttgtttcataacctcatatagttgtgttcactgagcaaaaattcaaactaaaacttgtgcaatggaatactttaaaaacagtttcataacctcaataaaaagatttcaaagatttttagatacttctgattgagatgtgttctatttcaaaattctttttttttttctcacaagtgatagaatttattaagctttcacaatatcatacataggctttaacaaaagcccaaacagcaggtttacagaaatagccaacaaagaccaaatagataaccgacttctgtagaagaatttcaatctaaactccatccatggaaacgtgtcgacaaccggttaaaccacgtcccacgcctgatgagtaatcacaagtttttccggcaacaacctccaccgttgagcgccgattccggtaagaaatcctcgccgataaggaatcgaacgaagactcttatgttttgcaccgaattgaaagcatcgaagctccaattaaagtaacagcttaagggaccatgataagcgacacaagaaaatcttctttccttcaacaaaagagtgaaatctctttgaaatcattctgtaaatccagagtacaaaagaaaaggatccgaaatttatcttgaagagataagaaactaattcggatcggagtaaaactcaaaggacagagacaaagaagaaccaccgtggatatggcagatcaacatccctaatcgtagatccgatgagattattagcaaattaaaaacataattgaaaaattaaagcaaaaacagaatccggccatggccgctaggttagccggtcgatgccgggcaaaagctagccaccgctacttaggaagccagtcggtgctagacgaaagccggccatcaccgttgagaaaaacggaagacgccggacatgtagccggataaccaccggacggcgagaagaagagcgtattctctctctaaaatattcagagagcgagaagagagagaaacactgacgaaaatatagattttatgggctaacaaaattcaaatgaaaacattggattataagatggttaacaaaaatggttgagaaaaaaccatcgagagaaccaaagggagagaaacggagctaagtt

SEQ ID NO: 6803 - DNA, 3000 bp, Unknown
  misc_feature (1)..( 3000): cDNA_ID_1988780_gDNA_ID_1621106_Annot_ID_171584 3000 nt of promoter + ATG
taacacaagctaggtaacactttttttcttttcaaggtacactttatagtatatactaaatatacaaacaatgattcattatgctgaattagttcgtggaatttccgtcactagtaaacgatgcgtgtaaacacgataaccatgatggatgtttcatgaaatgaatataaagcatatgttcatgttatatgtgtatatttacatagcgtatatatatgtagatctatatagattatagacttatagtagatcattcattccttatatacaaatgattgtgtcaattggtacagtccaaaaagttatgatgtctttgacgaagaaatgtgtacgaacataaatgcatttacaaatagtttttgcgttcgatatttgaagcaactgtaaattttttcgagacatcatttattgttctgtgtttttgtcggttttgtctctgcatcaaagcgaatataacattttttttttttttttgtccttgatctctctattaacacttacacaacatacaaaaaatgtgatgctcgaattcatatttagagcaatgcatatttaacaattgctaattagtttttgtatacaaaaaaaaaaaaaaaaaactacacacacacacaccttttgaattaacctaattttgttgtaattgtttcattgatttgtccccatttcaacaaacactacctacctaatgcatgtcattgaaaacaattcagtatatattttaacgacaaaattattccgtttatcctgtatgtaatggcaattggcaaacttgtgagctcccttgttgttttgcttgaagaatcagcttgcttcagggaaaatcaattcatcatatagacatgtttgttcttgtttaataggccataaggtttcattttgggttccgatttaagagaatcagattttgaaaaaaaaggttaggtattgactatgaagttagcatttttgaggtttggacgattaaaatgactggttatcgatcatatgtgtatataatagtaccttaaaagagtgactagaaaagttgttctagacaatagtaccttttaaaagagtgactaaaagttgttaaatgtcaataccagttaatttgacctgtctcgccaaataattaactaacaaaaatctaaaactttaacagtgaaatcttttcatattgcacaagcagtcaagcgcatgaaatgtcgtcgcataactattaaatataccatgtactttacattaacctacttatttttactcgatatatctacctaattatgtttataaactatatatacagtctatacttaagaaactttttacggtgatctatcttttaccttttaatttttattacttgaataacaataatctagatgtaacatgtgttcgcttttaattttttgtaattgaatagatttagcttcgttaaacacatattgattgatgaatgcttgaaattattgttctacaaaaatactccaacaagattttgaaccaaactagagatcaggcttgcatgattaacaaaactatccattgatgtaattataaactatcaaaatgaacggggtcaaatatgtgacaaagtcataattattgacccaatatgggctttttgataaggcccacagacagtttttacccaagttcctaagaagaaagttgggtttttgctaatcaggaaacaaattcgtagaagaaatattactgcatttggagaagaagtcaaaattaaagaggaatagactcacaaagtcaaaagatcaaaagataagcacaagatttgtattaattaaatacctaatgtatcaaaaacgactatttcgtagtgagaattaggaaaaataatgacacacaaacacgcaatccagaataaacataacacaaatatctacctaatctattttatcattaatttaccaccacaccattttatgaacgtagtcaaataatcaaaataataccttttattttgtataaattaattaaataatacataatctactctaatctaccccaccaaaccctataataagttgcgtgactttcttatattaatcacgatttgattgaattaatacattttttctcacctaatcaaatctttctcgttctcatacaatatggagagaaactcttgggccgagcagtgggacagcaatcaacaatcgtcgggaaaaacaactcacggcggagaaggtggtggtgcatcgtctaaatacaaagagaaagtgggggctggattagggaagacgaaagcggcggcgagttcggggttaaagaaggtgaagataggaacatcgttgggtcttaattgggttaaagacaagtacaacaagaccaccactaagaattgactcatcatatctttgtttttttggatttacatattcgtcttcttcttctttttgtaaacgataaaaatctgttttgattcttgctatattcataatgatcggagatattaaagacttttgaaaaagatgatttggcttggtttgatctttttattgttccgtggaaatggggtgaatcgtttggtttgtgaataattttactaatcattttatatagttcgaatcaaaagttgaaaaactcaaaaaaaagaatctggatagtttgatcttgtgcggaatattaaactgtgatgaagaattggaatcgagtctagattcttgatgactctttaagtttaaaaccggtttagctaaaaatctgcaattttgttgaatgtcccttttgattaaacaatttttacaagaaagaaaaaaaagacagcctcgtataggatgtatataaaaaaatgatgtaaaaatggttagaaatccaaataaatgtaaatatccatgaattaaatcaatcttattttttaaaaggtaaaaaactattttatatgagcagctatcagaaaaatgggtcagatatcattcttagaaccaaaacggaaagtcccaacgatcccattttactccttttcaccacctctagtagcagagagagagagagagtatg

SEQ ID NO: 6804 - DNA, 3000 bp, Unknown
  misc_feature (1)..( 3000): cDNA_ID_2175570_gDNA_ID_1621106_Annot_ID_171590 3000 nt of promoter + ATG
aaaactatttaaaaagtaccaaacttattattttacttaaacaaaatataaactacttaattttagatacactctagaccataaaattaatcatatttttaaaaattattaattactttttgataacaacctgaattttgatattttaggattaataataattttttccaaaatcatatttttaaaaataaataattttacatttagattggtgtgttgtttcaaaatacaattttttctgaaattgatgtctatatatgagatttattttcgaaatagttcttaaattataaaataaataagagaaattacttttcatagtcgtaacctacttagtgtttaatatttattcttataaagaaagttgatcttcttaaaaaagaaataaaccatatgcaatatatagtaaagaattatattccgacaaaaaaaaagtaaagaattatattttcaatttttgttgatttttgctcatttttccattttaatattttgatcgtacataacgaacataacatgatatatgtcccgctaatttataatattaattaatttaatgacgtatctatttagacaaaatcaacaaaaatttgagattaaaatgatatgtcaacaaaaattagtaaatcaataaaaactaacctataatttcatccgagtcaaagttgatgctttttcagcattttttgagtatttatgcttttttcaacattttttgaagattgaagttttatcgtcgtctcgttggccttcgtcgtcgccgttttttggcgcttctttcacggtttatccatgtcgtgctttgtcgtaccgttgatttctccgttttcagcggccatcgtcattagatgtggagctgttgctcctactttaattagcatctcatagaacattcgaggatgcttagatctggaagtgttgccttggccctgtttattctagtttaataccggtttcataccgactatgctttggtttctgttgcttgtgaaaatgatccttctcgaaggtctcaaaggcttcctctggactccccttcaattcgtatttctgtattgacgcgatgtctagatcttccgtctgtgacatagtgaatgaataaagaaagagtctgtttctttcagtagtttaaggatgcgttttgtaacttcggaattagtttggactcggccacttgtgtatttctaagttcttagtattcgatctttggcttgtttggggttacctttccttcaagctttaggattttagtagttgagactcttgcagattttaggattgactggattgcactcatggctccgctgtgtcgcgaagtgtaaaggttcctaggatggaggttaagtgagagattctatttgtcctctcttagtattttattttctgcttgaactttctgataaatctcctctatctcttagatccttcttagtttgatccatttcttttgaccttgctaagattgtttcaaggcttagtttcatattttggcaaaaaacagatggaatgcagtgttatagtgggttgaaaccggagatattgagttaatctctcttgaacaccaccggttgttgaaatgttttcaagcctatggtagattttcatgtgcccctttctcgtaagaacaacaagctgaaacactattggtatctcatgtagtgtttgaactactctcttatgtggtttgagattattaagaatttcacaatgcaaatcacagatatgtaatcgagtagctatgtgtttggctaaacaagagtttggcattccaatgtatggttcctttcaatgatatataaagcttacacttcgtgaaaaaaaaaaaattgtaacacgtgatcagagcagaaagtgtgtgagagatttagataagattcacgtgctgctcacgtgatctatttaaagctataaattacgtcgtcttcgttttacctcttatctgaaaacagagaactaggaaattttgataatgtttaacgagtgatgcaaaattcaatcaagctctgtcgattttacagcttcaattgcataaaattggggctttggtgaaggattaaggctgatttatggagtgtataaattggtaaaatcttcattaccatgtatcattgttttcgaacgatgtccttggagaaatatgcgtcaatggagtccgtcttcttgagaagcatttttgagtgagaatgattctcatgatggatatgtcttcaaggacttctttcaaacaatggtactattcttaatacttgggatgtgagaggtaaacatgatattacagattgggtctctttgttttgtaataactattatgatctttctcatctttcactgaaagtctcatcattgatacgatggtcccatgtgtattgaatgttaactaaaaggaagaaactttaatgcttcttgttggtttcttttagtaccatttagcagcacaaaacaaaactctggtattgatgtccctaaagaacttctaaatcatcgaaagacttgtctcttgtttagtcgtgtgtgttgtgttgacttgttgttccacttttagcttagcttaagaagcttttttcctgtgttcattgcaaaagggttacgagaagattaaactagatattcccaatgttgttttttgaaattttggtaaacaaatatataatagacagtcctggaataataataaattcttccagagtttgtctgtttctgggattagtctctgtctttttatctttcaatgactgtatctcccatcgctctcatgcatatactatccgttatctctcttccacagccatcacagaccacagaagctagtacccatcttgttttaatcctctgcctctccctctttttcctcttcaccaacacattatctctacaatgtcttcttctactttgtccagaataatcccagtgtagcccatcgctgtgatttgcttataactttattctctgtatgaatgattgcatcataaagagtttcatctgcattttgtttgagaaatg

SEQ ID NO: 6805 - DNA, 3000 bp, Unknown
  misc_feature (1)..( 3000): cDNA_ID_3048977_gDNA_ID_1621106_Annot_ID_171588 3000 nt of promoter + ATG
actatgaaggagtcaagcagagcatgcatagtttagtcttaatacctttcccaaaatctacatacaactcaacattgtattttgttttcttccaaattgatgttattttttttaacgtaatctatgtttgttcatatagtccaatcaccaatgtactgtgtctgtatgttatttttactaagttcatttaattttaaaagtaacgaaaaaagttaaaggatggatcaaactttttgatcgatcgggcttattctaaaagcacatggatattctttccatatgcaaaacattatgtcgaatgcccattaaccaactttttcagttcaatcttagtgctttattatccaactttgaattgattaatatccacagtattctaagttaaaggtttttctttccaccaaacttgacatgtcgatagaattgttaagttgtaattacaaatgagctaaattgctttgcctctattttggagaaaaaaatggaggcataagttggagatggtaaacaagatttagcaagttgtatatactctaatctataaaactttatcattccctattaaaagaaaatgaagaaataccacattgtagtattttactgatcctattcctaccctaactctcacgatttatatttattaaatttattttgtcttgctagtcaactgaatttactgacgaaagaaaaaggctgtttgtgactgtatttgggagagtaaataaattgctactaataaacataagctttattgggtttagttaaagaggagaattttggcagtccatgtcctgtatatatccatttttaatactaatattatcaaatttaaaatttaaagtgaagggaagagtcagaggacaataaaaaataagtaaacgacagaggaatcaaaatcatgaaactcaggaaaggcagtgccttgaaaccagagaggtagagagaatgagtttttttttccccctgtaaaagcaacctcaaatgtaaaaacataccttatacaagtatattaatcaagaaaaaaacaattgagaaggagaataaaaaggaaagaaccaacttgataaagcaaggaggcttcttgaagttgggaattttcccctcaaaagtgctaaaatgtcagcgttcttattaaacaaagtttagtgattattttataaacacttttaattttacaatttgttgtatgcgcatgataaagttctatttacaataatgaaacaagaaaattgtagtaacttttattatcggtgtaacattagtttttagtatatattttacaatttatttttcttatataaatacttgcattgtagtctgaataattgattttaaataactaatatattttttaaagttgacacaagaagaaatttgaaattttagaagtaaaaaattgtggacacattcccataatttcctgagtgactatatagtaagttataaactgtacttatgtgcaatcataaaaaaaaaaaaacaatttcaggctttaaaagaaaaacagtttcaggcttcatagtatactatgagtaaatactaaatagtaaatagagaagagtgtcttaaactctcaatgaatgaagcaaaaatgaagcaaaattgttttaaaaaaaaaaaactttttccgctctcccagagagtttcactcaccatgatgggctaaagagacttatcatgggctagggaaaatggtcaaatacagtgggcttacttagcccaacgatactcgtcggtaaagtttcgtagtgcttaaaagtttcaatgaggcaactcgactaaaaatgggccgaactgagaagtacaaaattaacaaatgacatttacaaattaatatttttaaacacttaaaataaaaattattaatttggcatattcttctagtaagaaatagtttatgtcaaaaaaaaaaattatgtgatgtgaacaaaaataatgataatgaattatgtgttacaaaaacaaaagaacataaaaatgtgagtttattacttttaaaatttaaatagaaatacatttttagtcaaacttatctttaaaaatcttaattataattgataacacttttactgatacaaaatgattttactaaaatttgacctgcaataattatgtcaccatactatatgtatattgaaaataaagtaattaatttgattagttttttgtattaattaataatatataaaaaaataaataattagactttatgctctctttctttccctttacaaccacatactattaattagaaaattatttcttaattggcaacccaatatagatgtagatataatttccaaagaaaacctcatagattcaagtttaaaattcactttagtgctatctttctcatttgatttattttaaaaagctaaaatgaattaatgaaaggaacagataccgtctttaatggaggagaactggagaagaatccaatctaaaatacatcctcgtgtttaagcggtgagactttttcggtttgctgttaaattacggttttggtatcaaaacatttccggtttaagctgtatagctctgactctgcagaaaagtactttacgccaaagagatgaacaagagtagtaagtagtaatacgtagaaaagaatctctcaccgacgacaccgaagacgaagaagaccgtacagtacatttcttacacttgtctttctttctaaacacctcacttactctcactctcacacaatatctgttgcgcttctacaggaaaatcactcacattgcgaggaaaaaagattatttgactcaaggaaacaaaagataattcggaaatttcttttgttttcctctcaggtaaattttgttgtttgttaatttcttttccttggaaaaaaatttgttttttattttttgatcaatgattcgatttttcttgaaaagatttgattttgttgatgatttggtaatcaaatatgagtaatatggagtcttgatgcagaaagatgatttcttttttggctttttttggggtgcagtg

SEQ ID NO: 6806 - DNA, 3000 bp, Unknown; identical to SEQ ID NO: 6801
  misc_feature (1)..( 3000): cDNA_ID_1815585_gDNA_ID_1621106_Annot_ID_171581 3000 nt of promoter + ATG

SEQ ID NO: 6807 - DNA, 3000 bp, Unknown
  misc_feature (1)..( 3000): cDNA_ID_3048982_gDNA_ID_1621106_Annot_ID_171576 3000 nt of promoter + ATG
tgtcacgccaagatccttgctgttttgcaagcacctaaaacacaaagtatggggattaacaagcttacgtacataccctaaaatggagctctaagaatctcgattggtttgagagcaaaagaaatgaagagagctcacaaatttttaccttttcacttagaagacttatcgcgccactgttgctttctccttcatcgtcctttacattagttatctctgtaacatcatcgccggtgttctcggtaggagtttggcctgtgggtactccaaacatggcctcatcgtgggcggctttcaactgctcttccctttttgccttacaagtttttattaaaccatataaactgtctgaagctctgatataataaaaactgtgacttgattagaggttgacaatgtaagctaatgactcagtaaacctcgatggcggaaaacctataactttgtcccatgcgcttgaccaaggcagcatcatcatcagcacctgcaatcatatgaagtttttagcatcaagagtacagagtaactgagaatgatttccggctttagctctgtccgttcatcgaaatcatggagtaaaggtagagattcacgggaaactgaccttcttctagttcctcatcatcaactggggcctctttgtcgaattcaaatctttcccatcctgcacccttactggtatctttctcagctgcaaaccaagcagatcattaatttcaagagaagaactaaacatgagattgatatcaatgttttcacaaggtatacaacccaagggatctcatttttaaggacagagttgatctttcttgtttttttattctttctcagacaccaggacttttttcttcatctaccataaacacatttacagatttgatatctccatgaaagggtttgtctcaatcctccttatatacagagctgctatgaaaatctatgaggtcaatagattttgctttgctgataaggaaaagttaggaaaagtcttctcccaacagtaacgtgcattgtatcctgaatgccacgagataaagagccaaaacacagccctccacagaactacaccataaagactttgattgatgggagaattctcagctacctgctgacccaatgcccaaccaaaaacctaacattctccgtacctccattttaacattagcacctcaactaactggcttaaggctacgaatcactacaaaactactaaactaataagaaagccttatcagcatcatcaattcaaggccaagacattaagtgccaaaacacagccccaccgttctaacattccaaagatggatcccactcaaaagaagttgtcgaaagaatgagatcttagctgctctgaagcgtggacaacagaatcaatgtaatctctcaaatgggaccgactaacatacccgtttcatcaagctgaagcttcatcttggctttcactttttcagcagctgactgttcaagaaagcaacacaaaaaccaaccttataataccacggaaatgacaatcacacacagacacacacaaaacaccagcaacaaaattacagaatctatgactatcatccataaacaaagaaggagctccacaagaatggtaaaccaaattagagatcaagggtttataatctcaaaacatctattgaatgtgggcacatgaaggcaattcctatgttgcaatatgtaaaggtaattgctaagttcttattacactcctaagtcctaactctagagggattataacattacgatgctgattctggtaaacaaaagttcctcgaagtatgataaccatacaggctgaagaatgatgagagaaatgagtattaccatctcatcgtagcctttgattaaccgcgagtaatcaggcttcttctccttaacatcttctctgctcctccgctctctcctcggcgacaaacttctgcttcggttactcctcctccggctctctctatccccgtacctattacgcctctctgcactcctgctcctgcttctccgtctctctctatccacataactactacgtctctctgaactcctgcttctccttctatggcttttatctctctcatccctctctctactccgataacgacgccgttcactcgactctctatagctcctctccggcaccctaggatcttcaggtttcttcttcaatttatctctgatggaccggatctcggaatccttgttatcagtggatttagtatggttagaagccttgacgaattggttgagaaacgaagacgacgatgcgatcgccgatcctctctccggaacagcgttggctccggtggagaagccgagaccttgcttgaagcgagcagctccttctcctttacgcgtgagctcgtcgtagtaagctgccgctttttcttcctccataacttagctccgtttctctccctttggttctctcgatggttttttctcaaccatttttgttaaccatcttataatccaatgttttcatttgaattttgttagcccataaaatctatattttcgtcagtgtttctctctcttctcgctctctgaatattttagagagagaatacgctcttcttctcgccgtccggtggttatccggctacatgtccggcgtcttccgtttttctcaacggtgatggccggctttcgtctagcaccgactggcttcctaagtagcggtggctagcttttgcccggcatcgaccggctaacctagcggccatggccggattctgtttttgctttaatttttcaattatgtttttaatttgctaataatctcatcggatctacgattagggatgttgatctgccatatccacggtggttcttctttgtctctgtcctttgagttttactccgatccgaattagtttcttatctcttcaagataaatttcggatccttttcttttgtactctggatttacagaatgatttcaaagagatttcactcttttgttgaaggaaagaagattttcttgtgtcgcttatcatg

SEQ ID NO: 6808 - DNA, 3000 bp, Unknown; identical to SEQ ID NO: 6803
  misc_feature (1)..( 3000): cDNA_ID_1988780_gDNA_ID_1621106_Annot_ID_55980 3000 nt of promoter + ATG

SEQ ID NO: 6809 - DNA, 3000 bp, Unknown
  misc_feature (1)..( 3000): cDNA_ID_1815575_gDNA_ID_1621106_Annot_ID_55982 3000 nt of promoter + ATG
aagagatatactacttaattactttacttattgtttgtttggttcactatgaaggagtcaagcagagcatgcatagtttagtcttaatacctttcccaaaatctacatacaactcaacattgtattttgttttcttccaaattgatgttattttttttaacgtaatctatgtttgttcatatagtccaatcaccaatgtactgtgtctgtatgttatttttactaagttcatttaattttaaaagtaacgaaaaaagttaaaggatggatcaaactttttgatcgatcgggcttattctaaaagcacatggatattctttccatatgcaaaacattatgtcgaatgcccattaaccaactttttcagttcaatcttagtgctttattatccaactttgaattgattaatatccacagtattctaagttaaaggtttttctttccaccaaacttgacatgtcgatagaattgttaagttgtaattacaaatgagctaaattgctttgcctctattttggagaaaaaaatggaggcataagttggagatggtaaacaagatttagcaagttgtatatactctaatctataaaactttatcattccctattaaaagaaaatgaagaaataccacattgtagtattttactgatcctattcctaccctaactctcacgatttatatttattaaatttattttgtcttgctagtcaactgaatttactgacgaaagaaaaaggctgtttgtgactgtatttgggagagtaaataaattgctactaataaacataagctttattgggtttagttaaagaggagaattttggcagtccatgtcctgtatatatccatttttaatactaatattatcaaatttaaaatttaaagtgaagggaagagtcagaggacaataaaaaataagtaaacgacagaggaatcaaaatcatgaaactcaggaaaggcagtgccttgaaaccagagaggtagagagaatgagtttttttttccccctgtaaaagcaacctcaaatgtaaaaacataccttatacaagtatattaatcaagaaaaaaacaattgagaaggagaataaaaaggaaagaaccaacttgataaagcaaggaggcttcttgaagttgggaattttcccctcaaaagtgctaaaatgtcagcgttcttattaaacaaagtttagtgattattttataaacacttttaattttacaatttgttgtatgcgcatgataaagttctatttacaataatgaaacaagaaaattgtagtaacttttattatcggtgtaacattagtttttagtatatattttacaatttatttttcttatataaatacttgcattgtagtctgaataattgattttaaataactaatatattttttaaagttgacacaagaagaaatttgaaattttagaagtaaaaaattgtggacacattcccataatttcctgagtgactatatagtaagttataaactgtacttatgtgcaatcataaaaaaaaaaaaacaatttcaggctttaaaagaaaaacagtttcaggcttcatagtatactatgagtaaatactaaatagtaaatagagaagagtgtcttaaactctcaatgaatgaagcaaaaatgaagcaaaattgttttaaaaaaaaaaaactttttccgctctcccagagagtttcactcaccatgatgggctaaagagacttatcatgggctagggaaaatggtcaaatacagtgggcttacttagcccaacgatactcgtcggtaaagtttcgtagtgcttaaaagtttcaatgaggcaactcgactaaaaatgggccgaactgagaagtacaaaattaacaaatgacatttacaaattaatatttttaaacacttaaaataaaaattattaatttggcatattcttctagtaagaaatagtttatgtcaaaaaaaaaaattatgtgatgtgaacaaaaataatgataatgaattatgtgttacaaaaacaaaagaacataaaaatgtgagtttattacttttaaaatttaaatagaaatacatttttagtcaaacttatctttaaaaatcttaattataattgataacacttttactgatacaaaatgattttactaaaatttgacctgcaataattatgtcaccatactatatgtatattgaaaataaagtaattaatttgattagttttttgtattaattaataatatataaaaaaataaataattagactttatgctctctttctttccctttacaaccacatactattaattagaaaattatttcttaattggcaacccaatatagatgtagatataatttccaaagaaaacctcatagattcaagtttaaaattcactttagtgctatctttctcatttgatttattttaaaaagctaaaatgaattaatgaaaggaacagataccgtctttaatggaggagaactggagaagaatccaatctaaaatacatcctcgtgtttaagcggtgagactttttcggtttgctgttaaattacggttttggtatcaaaacatttccggtttaagctgtatagctctgactctgcagaaaagtactttacgccaaagagatgaacaagagtagtaagtagtaatacgtagaaaagaatctctcaccgacgacaccgaagacgaagaagaccgtacagtacatttcttacacttgtctttctttctaaacacctcacttactctcactctcacacaatatctgttgcgcttctacaggaaaatcactcacattgcgaggaaaaaagattatttgactcaaggaaacaaaagataattcggaaatttcttttgttttcctctcaggtaaattttgttgtttgttaatttcttttccttggaaaaaaatttgttttttattttttgatcaatgattcgatttttcttgaaaagatttgattttgttgatgatttggtaatcaaatatgagtaatatggagtcttg

SEQ ID NO: 6810 - DNA, 3000 bp, Unknown; identical to SEQ ID NO: 6804
  misc_feature (1)..( 3000): cDNA_ID_1815571_gDNA_ID_1621106_Annot_ID_55983 3000 nt of promoter + ATG

SEQ ID NO: 6811 - DNA, 3000 bp, Unknown
  misc_feature (1)..( 3000): cDNA_ID_2173637_gDNA_ID_1621107_Annot_ID_55987 3000 nt of promoter + ATG
ggttgctgcgatcaagtcattccagtgtgtagtatactttgctccatagatgttccaagctagagcctgccaaatttctgaggcgtaaacacaagagaaaaaaaggtgattacgggttccagcatgtggttacaaagagcgcagcctgtggagagacccctgttccagctgagcatccgatctccagttgataaacgattgtgagccgccatccaaacgcagaaggagaatttgggagtccctcctgcaaaccagacactcttatgccatgtgacctctgtcgaaatagaacgtgtgtggctccaagtatcacgtgctgaaaactgtggccggaaagtatcgtttttccccttccaaagaaagacgtcctctactgccactctgttttgctttgccaaaaggagttcttgttcaatggtattaagcgtttctgctcggtgataacgtgatctcctgcgatcccatgcctctgcaagtgtcttaaacttgcttatccccatgtcgaattgaccgcgttctcccagcacgtcaatcagccggcccttggatgaccaatcatcataccaaaaagacgcagtttcaccatttctaatgtcgaccttagaaaaggcttttgcagtgtcccgatattttaacagctttttccacatccatgagccctgagatgctgaccgaaaagaccaaaaagtgttgcgcttgagaagataagtcctaatccactgcacccatagcgagtcaccttgcgagacgattcgccaaatcagtttcagacaacaaacgtcattagcctctttgattgactgcagacccaatccgccctctcgttttggcctgcaaactgtctcccatgcgatcttagccttattagtactcagttctggtcctgaccagaggaaggcggaacatagcttatcgatttccctaacacattcacggggaagcctaaaagcagagagccaaaaattgcaaatactccataggaccgaactgaccaaatttagacgacccgcgtaagacaagaaacgggctgtccaagttcctattcgtcgctttatttgctcgagtagcgggctgtagtcctgtgaagtgaatcgcttggtgacgagaggtaaacagagataccgcaccgggagacgtcctactgcaaaatggaattggtcttcaaattctttgcatacagatttcgagatacctgcaaagtaaattgtagttttcgccatgctgatcttaagacccgattgctttgcgaaactatcaaaaacctccacaataccctcaagggaacgaagcttcccgtcggtgagcaccataatgtcatcagcaaaagaaagatgtgttagaccaagatttttacattttggatgataaccgaatttcctcaaacctgctgctctgtcaagcttcttggatagaacatccattacaatgacaaagagataaggagttaaagagcatccctgacgcagcccccgcaaactattaaaatatccagctagttcccgattaacctgaaccgagaaagatgctgtggtaacgcaaagcatgatccagtgaacaaattcttgaggaaagtctagagttaaaaggacattcctgaggaaggaccattgaacagaatcaaaagccttggagatgtcgatttttatagcacaacgttctgaaactgaatctttgtgatagtccttgactaactccgttgcaagcagcagattttcaatcaaaagtcgatccttgatgaaagcggactgattccccgctatgaactgtggcaacacccgttttaacctgtttgcaataatttttgaaatgactttatagaggacattgcaacaggagattggtctgtaatctttaatctccttggcttccattttctttgggattagagctagaattgttgaatttactccattgtatatggagactttgagggcgttacaaggaaacaaacggaaacggaaacaatgaacttcaatgagcttcattgtcaaacaatgacaaagaaaaaaaaggaaaacttcattgtttgatatatcctcattacgtaaccctaaagctattcacaattctcttctctctcaatttgctctctctagtcactacgatttgcgaagtcttcttcttctcctctgtttgaatctcttctcggtttcaaaacatgaattctcgtttcatgaatcatcaaacgaaactctctccatcacaagcaaacatcaacccaatcatcaaattatcccttgccaattggttttgagttgtaaacccatattttcatacaagttatattacctattaaatttgactttaaagatttgactatcattttttttttggagatagatgtaaagtaaacatacaaaaaatagtgacttaaaatatatttttaactacatctaagaaaaaaaaataaagactagtgagactgtagtaatgtattctttctaataaagtgaggcctataatcttccttactcatgccagtctttctgtaaattcttttttaagaaaattgcaatctcttccaaacagattcaaattcagaattacttggtaatgtattaccatatttatatatatttttttcttttgcggtagtcagcacaaatttagttaggagatcgtgataatgcctttagtgagctgtttcattgcgttattttacgaaaaaacaatactaataatgtatacgggaaactcgtgtttagtattttaagtgttgttggggaagataaagacaaaacaaaaccatgactgagatgtagtgatttgtttatgctaataaaagaacacattatttaccatgtaaaatatatagtatgattctgtgagagatgtggtggttaaatcttaaacgcttataaatttagagtagatggttttgttttcataacataaaacgggttgagagatcagaaagcatcgatggagcaaattaggggtttgtatcacttggtagtgacggtgacgtgcttggtgtgtttaggatttaatgttagcatg

SEQ ID NO: 6812 - DNA, 3000 bp, Unknown
  misc_feature (1)..( 3000): cDNA_ID_1815595_gDNA_ID_1621107_Annot_ID_171649 3000 nt of promoter + ATG
aaataagaaacttggaattttttttaataatggtacacacatatctttataaaaaaatttcatgttattcgatcgatgtggtagattgatgaatttggtaactaagcttgcacaatgacagtatggctggacatagctgcgttgcacaataatctgattagaaaaaacattgttattttggtatttcacgaataacattcgaggtcttaagtgttgaagtagtccgttcccactgaatatgatcaaagcttagctagcttcttcattgcgataatttatggtaacacccctgaccaaattaattaaatagctaatgtttacacaagtcttgtaaatatatctcttgtaatatatttcattttaaatatcttgaggttttttttttttttggcacttaagatttggaattttaagtcgcatgttttgaatagaaaaaaaaagttccctaaattttgaaaagatgataaatgatacgaaaatataacaaaaaatacaaaaaaaaagttgtatttggaaaactatccatcaaagtggacacatttaaaaagcacacgcacacataagagtcatagctccttgaaggctatataagaggtaacctctttccccatacccaaacagtcttcttcttcaactctataacataaaacacagagagagataccaaaaaacaaaaaccaaaattttctccaaatctatttctttcgaatcaaacccatttcttgaaactcgatttcaaacaaacccatctcattgttttcaccaaagactttttttttttttgtcggaatctgattaaaaccaagcatgaagagagtcagagggttcaaaattggacacagatttgtcaaaattttcaaatggataccaagaaacagatgcccgacccgaatcacaaacccggttaccggaatccggtcattagcacggtgtttaagccgtggagctaagagattgtgcggtggaagcaagaagaatccgggtcagaatcagatccggttgggtaaggatccgaaaaagtcgaaccgggttgttcctcgaggacatttggtggttcatgtcggcgaatcagacgatgacacgcggcgagttgtggtgccggtgatttactttaatcatccattgtttggagaattgttggagcaagcggagcgggttcatgggtttgatcaaccgggtcggatcactattccttgtcgggtttcggattttgaaaaagtccagttgaggatcgctgcatgggatcattgccgcaggaaaaattcttacaagattatataatttgaatttataaaatagtcaaaaatcaaaagaggattaaaaaaatttatatacacttatacagtacagagaaggatgatttcctttaatttgtgaatattagttttttttaccatctatgttatacgataaataccgattcataaatacaagataattatttgtatcagtttatttcatggatgatagaccacattgacatcctataatactatatggtttagatttatgtgtgtaattttataagttagaacaaaactgaaattatgttctaacttataaaattacacacataaaaactgaaattaaaaaaaaaaaacagaaaaaactgaaattgggctatcagtatttttgaatacttatatttcaatatatcaaatacagtgagtgatggtgtattgctgtatctgaaacctatcatccactataaaccccaattgaagtgaaacaatcaatatttagaatttccatataatgttaattatgaaattacttctatctaaatatatttcagaagaatttttgagataccacttttatgatttttatttttttttaataataccactgttttttttttttgttaattttcaatgtaacacaaaatgcaatcatagaatttgttttattaacttttatagagcatattataaaaacgtttataaagtttctataatgcataatatcaaacatttataagatttttcacaaaatttttaatgttttatagtgcttagaagatttttcttaagaaatgatatgaaactagaatttttgaacaacctttttctggtctttttgaaaaatggtatcataaaggtggtaattttcaaaatttcccaaatttgaatacaaattcaaatcatattgtaggaaagtgatcaaatatgttaaaatttagaagatgaggtgagaacaaatgtgcagaggagatgcacttgctaaatttgcatcttcatgtgatttgtattttgctttttagattgtagtttaccactttggttggttacaagtatttggagaaaccatgtactacttgttctttgagtattaatatatatgattatatgtggtatgtttagaaaaaaacaaaaaaaccaaatatcaaacctaaacttattaaaagtaaagacacatttgattaaaacctaaaccaaaaacgtacaaaactattcgcttatgatgatattatttatcataaccaaaactttaatcaccatacatacctccgatttggttttctctcccaaactggtcgtcttctcacctctggtttactactacttcggattgaagaattttgatcgtctcgttgctaactccacgatgtctttctgacgcttaatcttctgacagaagacaaagacatagcataaaaaagtaagcacagaacataaacggatgtttattcttttctagacggtatatttacataaataacgaatcacttatcaaaaagctggagtagctcagttggttagagcgtgtggctgttaaccacaaggtcagaggttcgacccctttctctagcgtttcttttccttttgtatttttaagatttaaaaacatttttccacggctacaaaagaacattctcgacatacacaaaaaaattcgaaatttcgagaactctcttgtgccttcttcttcatcttcctctgtttttaaaaatgcaatcaagcagattctcacgatacctaaaccaaatccaattcaatg

SEQ ID NO: 6813 - DNA, 3000 bp, Unknown
  misc_feature (1)..( 3000): cDNA_ID_1815618_gDNA_ID_1621107_Annot_ID_171638 3000 nt of promoter + ATG
ggacccgttttcaaactatggctcggcgcaaaactaaccatcgtgataacctcttccgaagcaacgcgggatattctaagaactaatgacgtcatctttgcgaacgacgacgttcccgtcgcaggctcactcagcacgtatggtggcgtagacattgtctggtcaccgtacggaccagaatggccaatgctaagaaaaatctgcattaacaaaatgttaagcaacgccacgttggattcaaattcttttagtgcacttcgccgccaggagaccaggcgaacagtccggtatttggcagaccgggctcgggccgggttggcggttaacgttggagaacaaatatttgtcacgatattaaatgtggtgactcagatgttgtggggagaaactgttgcggacgacgaggagagagagaaagttggagctgaatttttggaattgattacggaaataattgatgttgtgggaaagccaaatgtctctgattttttcccggttttgagccggtttgaccttcagggtttggctaagcgtgtgcgtagatcggctcagaggatggaccggatgttcgaccggattataagtcaacggatgggaatggataagggaagtaaagggaacggtggagattttttgatggttttgttgaatgctaaggatgaagatgaaaacatgtccatgaaccatgtcaaggccttgctaatggtaattgagcttcttattattttactaatattgctacatgatattattggactttccgagctcattccaactccctttcgtattatattgtctactttgaattaagtccgcatgattttgttattggggtgcttctcaaaagacttatactaaatagaattggatttggtttatatattataaattttttttctaattttttgatgtgggacctttggtttgtacccaacataatcattgcttatttaaattttgcataggaaatacaaaacatttatcattgcgtaacaaattattttgtgtaacatatgactcttgatcattaggatatggtgcttggtggtacagacacatctttgaacacaatagagttcgcaatggcagagcttataaacaaactggagatcatgaagagagctcaacaagagcttgacaaggttgtggggaaaaacaacatcgtcgaagaaaaacatatcactaaacttccatacattctctccattatgaaagaaaccctaaggcttcacccagctcttcctcttctaatacctcgctgcccatctgaaaccacggttataggtggctacacaattcctaatgattctaaggttttcatcaatgtgtgggcgattcatagaaatccgaacgtatgggagaatccgttggagtttaatcctgataggtttcttgataaaggttacgactttagtggtaatgactatagttatttcccgtttggatctggccggagaatttgtgcgggaatggccatggccgagaaagttgttctttacaatcttgcaacgcttttgcattcttttgattggagaattggggaaggagagaaagtggagctcgaggagaagtttgggattttattgaagttgaagaatccacttgttgcaacacccgtgctaagattgtcggatccaaacctttttctttaacagtttaagtgaaaggagaaaagtaattgctctttttgtttatgtgaacttatataatgttcaatgtgacggtgtcttatctaatgccgtattatgtattgttacatatatgatgattccacctatattttagtactatgcatgatgtaatatgtgttttagacatggtcgcatggactatatatgtccacatatccaaatccaagtgatttcatgaaaaaatcttcaatgttatatgctcttttgttgaaaactacactgattcttattttacggctaaacaagtcatacaaactttcaaatgcatatataaaggagtttgactaatttccctccacagcagcaaaccaacgtataaaggtgtggggtctgctgccaccgtccaaaccagtaaataatataatttatactattttattgtttgaggtttttatcaaatgtaattaatatctttgaagcaaaaataaagaattagaatgtatggtaaatgatttaccatagaatagttgtttttatcatttttatgtaatatcaaagtttgatatatagcatgccttcaaacaaaatttgttttagattcgaaattgtgccctcatgtatatatactacaatttaagctattgtattctactatgtacacaaaaataagttatgatgattgttttttagttccttaagctattgtattttacgatgtacacaaaaataaattacgatatttatagtccatgaatcatcttactacacaaactctcttttcttgaggtccaaaaagatttttatttttatttttttttcctttttcctgatggcttcaaaatttgcgtccacatgcagagagatattatcaatttatcattattgatgactaaaccctatttaaaagtaacatttcgataaaagaaaaaacaattaaaaagtataccatccactcaaatattatcatcttattatcttaagacccttgagtggttttccctattaatgtattactatatgtaatgggtgtacgttgtacgttgagtggatggtatactactaaatgatggtgtacgttgtaaccttaaaaattactattatagggacaacaacttcaatctcataacttctacaaaacagctgtgaataatgtctcccatatcaaatctcttcgctggcaacacaatcaatctcactccttacgcaattctcattctcattgctatcttctcgatactatggtacctcttcaaacgctcgccgcaaccgcatctaccccctggaccgcgagggctacctattgtcggaaaccttccctttcttgacccggaccttcacacctacttcacaaaacttgctgaaagttatg

SEQ ID NO: 6814 - DNA, 3000 bp, Unknown
  misc_feature (1)..( 3000): cDNA_ID_1815622_gDNA_ID_1621107_Annot_ID_171637 3000 nt of promoter + ATG
tttgcaatggccgaactaataagaaagccggagttgatgaagagagcacaacaagagctagacgaagttgtaggcaaagataacattattgaagaatcacacatcactagattgcctttcatatcagccataatgaaagaaacacttagactttatccaaccattcccctgctagtccctcaccgtccgtctgaaaccgcgctggtcggcggctacaccatcccaaaaaacactaagatcttcatcaatgtttggtctatccagagagacccaaatgtgtgggagtatccgactgagtttcgtcccgagaggtttcttgataagaagtcttgtgatttcactggaactgattatagctatcttccgtttggatctggcaggagaatttgcgcaggtatagcactcgccgagaggatgattttgtacactctcgcgacgctattgcattcgtttgattggaagataccggaaggccacattttggatttgaaagagaagtttgggattgtcttgaagctcaagtcccctcttgttgccttgcccgttccgaggttgtccaattcgaatctttatttataaacgctatactcgttacttttccttaaaaaaaggaaaaagatttttatattgaacatttttatgatagacaaaaataacgcctggttttatttagttttttcttttctgaagtttttaatcatcatataagttagtaatgagaatcatacatcggtttctataaacagcaaaattatcagttttatcgtatttcagttttgttctatctagataactcacaggaagcgtggaccgtgtcataatggaagatttcttattttttttttaattattaatattataatggataatgaataagatatggcatgtggcatatgtggtagacgtgcaagaatcttagattaatttcttctagttattttgtactatcaacaaaatatagtataagaaaattatatctttgtaaaacgtagatctgattagtaatataaagctttatgcaaatttgtaaaaaggagttatatgaaaaagctctataataaagctgaaaataaaaaaaaattataacgtttttgataaagtttttgtaaatgataattgtcaaaattgtataaattataccgctttgataatgagttatcattaaaaccgtagtttaattaccaaactcaaatttccttgcaaagctgttatgaaatatatttttcccaaatccaacagaaatctacgatggaggaagtgcaggaaaagcttatagaagtttgtgatataaacagtttttttatagcagatacctcacctttctaaacggttttcagggctaagaccaggaaccatacaatattttcttagaatctgaagtatttcttgtccaaggaattgatgatattttttacttgttggcatggttagagatttgctacacgttcactacatatatgacaagcatgggggtgaccaaaagttttgacagttgtaaatttattcctaaaaaaacggatgttcatttggagatatattaggaggatacccgtttatagctatttgttattaaaccttaatctattggggattcattgagcccaatgcccatacatgaagaagaatcccaaatataatataagtttaacgagcacattattaggagtttcatcatagagattcacgtaaagttttattgtaaaaaaaaagagattcacgtaaaatagtggaagacataaaagtcattagttatgttctatccttttgaccaaaaaaaaaaaagaaaaatgttctatccatttgaaatcttgtgtttaattattatgttttaaaaatgggtgaattaaatttatatactcagaagaagtggaaattaaaaaagtaggagagataatttaaaaattaggtaagtatgaaagagaaagaaaatataaaccaaaaatatccttcatatttggattaattacaaaattgacatagctataatatgattattatacggatatataggcgaagacgataacattattattaaaaggtaacaaaagttgacttgcgattcaataatcatgtaaaaaaatacatgcatcagaatagttagcagataacgtattatcaggataacatgataacaaatatctcggtaatactttttaggttaacatgataacaaaatatttatatcaataagtttataattatatcatgcaaagttattttgtaccgcaataagttataatttatgtgatatatttatagttaccgtcttaactcatttattatatcatataaacaaaattaacgagttactataacgtgcaaaatctgaatttcatccaataagattaatattatcactacctctagataaagttttatttaaatcggtaatttgattgttaaccaattttgagatgaaagataaaaatataaaaagacataaggataatgatgtaattttctttgctaatgtactgtgtaaatagtgacacattagttaattttctgttcttctatgtatacttcttataaataccctttaaaaattgtgaaaatttagggtttttggagtactctcaaaatctcagcaaaatggccccataataaaattagccagcgaaaatagtcttttgaaatatgtccctaatttaacgggtaaaagagtaaatgaaacttatatccaccaaaatgtggcaccgtacatttttcatttcctcttttaactgttaaattagattcacgaagtaataatatttccctatttttaagcactatccaccaaatgttcgaattatatccaatcatatttaaaaagtattttcaaaattgggaagaatcacatccgctcaaaacttatcagcttgagaccgtctcattattgaatttcacattattaatctattaatactataaatgaaagatgaaatatcaaataactaacactaaagtacactttccttttttggttctcatagttcctttccacaattggcaaaaatg

SEQ ID NO: 6815 - DNA, 3000 bp, Unknown
  misc_feature (1)..( 3000): cDNA_ID_1815626_gDNA_ID_1621107_Annot_ID_171636 3000 nt of promoter + ATG
gaagaatcacatccgctcaaaacttatcagcttgagaccgtctcattattgaatttcacattattaatctattaatactataaatgaaagatgaaatatcaaataactaacactaaagtacactttccttttttggttctcatagttcctttccacaattggcaaaaatgtctatgctttcaaatctcttccccgacaacgcaatcagtctcactccttacgcttacgcagtactcattctcacagctaccttctcgattctatggtacatcttcaaacgctcgccgcaaccgcctctaccacctggaccgcgagggctacctatagtcggaaaccttcccttccttgacccggatcttcacacctacttcacaaaactcgctcaaagtcatggtccaatcttcaaactcaatcttggctcaaaactaactgtcgtggtaaactctccatcgctggctagcgagatccttaaagatcaagatatcaatttctcaaaccatgacgtccctctcacggcccgagccgttacttatggtggtctggaccttgtatggttaccatacggtgccgaatggagaatgcttagaaaagtttgtgctgccaaactttttagccgcaaaactttggattccttttatgagcttcgacgcaaagaaatccgagaaagaacgagatgtttgtaccagaaaggtctagaaaaatcaccggtgaatgttggagagcagttgtttttgacgatgatgaatctaatgatgaatatgttatggggagggtcagtgaaagcagaggatatggagagtgttggaacagagtttaaaggagtgatttctgagataactaggcttttgggtgtgcctaatgtttctgattttttcccgatgctagctagattcgatcttcaagggcttgttaagaagatgcatttgtatgctcgagatctcgatgcgatactcgatcgagccatcgagcagatgcaacggctaagaagtagggatggtgatgatggtgaatgtaaagattttttacaacacttgatgaagttaagggaccaagaagctgactcggacgtccctattacaatgaaccatgtcaaagccgtactcatggtaatgaaattaaatggtttcaatttttatacttaagaatataattatcggagaatagcatatctgttgaaattgacaaaaagtatatatcggaaatgaaaagtttgaaatactaatagacaaacacttaaattatatgaaaagtcggaatgataatttcacaattatatttttcattagtattgcagaataatatttgaaattcatgataaggcattagtttttcgattggtaaaatcatgcaaaaataagtttttagtcatttcgccattatgtagattaccaatcagcattagtcgctttagcatttagatgttatttgtaagatgtttatttgctcatgacttaatcaatgtgtgaaggatatggtagttggtggtacagagtcatcaaccaacacgatagagtttgtgatggctgaactaataagtaacccagagttgatgagaagagcgcaacaagagctagatgaagttgtgggcaaagacaacattgttgaagaatcacatatcactagccttccttacatattagccgttttgaaagaaacacttagactttatccaaccattcctttgctagtccctcaccgtccgtctgaaaccgcgctggtcggcggctacaccatcccaaaaaacactaagatcttcatcaatgtttggtctatccagagagacccaaatgtgtgggagtatccgactgagtttcgtcccgagaggtttcttgataagaagtcttgtgatttcactggaactgattatagctatcttccgtttggatctggcaggagaatttgcgcaggtatagcactcgccgagaggatgattttgtacactctcgcgactctattgcattcattcgattggacgattccggatggacacgtgttggatttggaagagaagtttgggattgtcttgaagctcaagacccctcttgttgccttgcccattccaaggttgtccaattccaatttttatttctaatgctaaaatctttatagttttcttaaaaagcaaaaagattgttatgtttgcgatttttattatatacgtttttaactgtcatataagttttgtaatgaaatccaaacatcggtttccataaacagcaacattattgaactaggaccacttataaattttacttaattgttgttagatatcaattttgtttttcgttccagttttgtttgatgtgagatatcatttttttttattttctattttgaacaaaaccaaacaggattatagaaacttgaaaattagcaagtacttactttgtgtcgagtcctagtttgactcttttttggtgtattttttggttagaatattagagaattcaatgaggtcataaatctttttgaaaacaatatcagcttaacgagcattttttttttggagtctcattgaaattcagataaaacattggaagacacaaaaaatcatcaattatgttctatccatctggaattttgtgtttatttatgaatattaaacttgagaaaatttagattttttggaatattgctctcaaaaagtctttgcaaaatggtcccatgcattgattcatacctctgcatagtgaagtttagccatcgaaatgaattttggtcctactctttggaaaggtggcagcttactttcccctcttactcttttaccattaaaacattagctttatttatctaaatatagctaaatatgattgattgtaaaaagtatttttaaaacattgggaagtatcacagccgctcagaattcatcaacatgactacatgagaccgtcctgacccaaaaaaaaaaaaaatgaaaagataatatactatcataaaactttcctcttatcgatctcataatttcttcttccaaagtcaaaacatttatcaaaaatg

SEQ ID NO: 6816 - DNA, 3000 bp, Unknown
  misc_feature (1)..( 3000): cDNA_ID_1815630_gDNA_ID_1621107_Annot_ID_171635 3000 nt of promoter + ATG
tggttccctacaagccataaaaaaactcgtaccctttccggagccaatactctccatatcctggaaaagaaacgctccatgtcctgagtctgcgatccctcctccatgagtagagaataagccgaccccactgtaaactctccattctccgtaccagaccatgacagagtatccgctactccgggaccgcctcccaacacgaccgcagtcaatcgtaacagcagcttctccggtaagaaacacgaaattctgcccatgtcccaaccaacacgaaattcttaattagttatttataagattgagatttcaccggggcagaaaaatgattaattgtcatgatttatgaataaaagaaaaaagaaatctacttacacttaaaatggaaacagtttatactgtgagataaagagattgattaattacgatttaagtaaaagaaagaaaaataactttgaattgtgaattgaatacaacaaaaacaatatgcacgcattacaaatatttagtcttgttttttattagccgttaagggaagtgagaccaaaggtgacacttgtggtacgaatggtagcttcagtgggtaactacgattacatcattgattatgagttccaaactgatggggttatgagagcaaaggtactttcaatatttgacttttatctcattttgacaaaaacaaatcataaaaggttccgtattgaaaatattttacttttggtaatatcaacgacaggttgggcttagtggaatgttgatggtgaaagggacaacgtacgagaacaagaaccaagtgaagaaagacaaagaaggtaatgaagaagagctttatggcacgattctgtccgaaaatgtaattggagttattcacgaccactacgtcactttttaccttgacctcgatgtcgatggcccggacaattcctttgttaaagtgaacctcaagaggcaagagacggcgccaggtgagtcacctaggaaaagttacatgaaagcagttaggaacattgtgaaaaccgaaaaagacggtcagatcaagcttagcttgtacgatccatcagaataccacgtcattaatcctggtaaaacaactcgagttggtaacccgacgggttacaaggttgtccctagagccacagcagctagtctacttgaccatgatgatccaccgcagaagagaggagcttttactaataaccaaatttgggttactccctacaataagtccgagcaatgggctagtggtttattcacttaccaaagccatggtgatgatactcttgcggtttggtccgacaggtgattagttgcaaagaattaccctttttattagttatattatagttaatattgttacgattgatttagtgtctttatttggtgtgatgcagagatagagatatagagaataaggacattgtggtgtggtacacgcttgggttccatcacattccatgtcaagaagattttccgataatgcccactgtttcttcaagtttcgatttgaagcccgtaaattttttcgagcgcaatccaatccttaaggccgctccaaactttgaatatgaccttccggtttgcggagccaaatctgattctgcttgagaagaataaagaaccaacaaaagaaattatccaactttttggatcttattggcaaaactacaaatcaagttacatgatattcactttcctatgtgttattggcgaaatcccaactcctacaaaacttataagcgcaaaaatagtatataacatgtccaattcacaccggaatgttaatctcaaggaattgtattttctcctagaatcactacttttgtgatagaagactttttttttgtcaaccttgatagaagatcttgataagattttttgtttttgtttttggcattgataacacattattctttcctaaaagaaattagtactcccctatatctcagtcaatttactaatgtttgatcttatgtttgtatatcttctcaaagcttgatcgtatctttctcttaatttgtatctcagtgtcattttatcaattaatgcttgattgtatacggagtattggtatttaacataattttaatgttcactgtgtgaatctaagtaaatcaacagtccagagactcagattgataatgctactacctaattccttgacgtaacaaatgcttatatctcatctaagaaatattcagtcgaaaataaagcatttccatcactctctgctcataaaactatcacaatagatattgacaaaaaaaatgggcttctgccttctgttagatttatctatcaaaccaactctccgaagtgggcttctaacagagaaacaagacatgggccacaaaacaattaagcccactcagaagcccaagacgaaaactgtgcaacggtcgtcttcaatgtttcagcataaagacaaagggaacaaaactgcagagatgacgaaagcttgtacggaggagatagcactctccaatcaattctcagcccttgatggcttagagacatcaagatgaagacatgtgtaagggtttatctagggttttagttcacatatgtccttgtataaaaacccaaacaatagccgcttgtaatctctaagaagcagaatgaatgaaaaccaaaacttttcataaagatttataaacttcttcattatcgacatcatgagcctcttgggccttcatcattcttcaaaatcataccatagtttatagtttttactgcgtaccacaaatatggcaccgtacatatatcattataggtttctaggagttgacaaatgtttagtcctccatttttcaatcgtcaaagataagattccttataattcgtgtacataattgttttttaatatataccatagcatgtggtagatattttattttcgggattgatatttggatatctctttatactgtaagtgtaaggtgacggtacttagttaaggctcactagtttctttaaattctatataatacgataccaattcct

SEQ ID NO: 6817 - DNA, 3000 bp, Unknown
  misc_feature (1)..( 3000): cDNA_ID_1815638_gDNA_ID_1621107_Annot_ID_171631 3000 nt of promoter + ATG
catcagatgtgggtttgagtaatatgataacgttttcaaaagagatagtagaaaccaaaatgttacctttactgcctaagaatcgtttcataggttatttggactttttttattttgaaactaaaattgtaacaactcttactgtacaagaagatgcaaatggagattttcaatttcatggatggagtatgattctccaacgaaacaattacaagacagacgatattataggattttggtgggatgccaataactctagatttaatttttcaggtactcatgatcgcttagttgatggagtggatctttgcaacttcgtttctcaaatatgttaggttccttattttatttatttaattttgcaaatttgtcttctcgatattggttcataagttatttttagttctatcttaattatgttttttaggatcatcttttctttttcaattataaatggatatatttggtgttaagacagtttggagttgcttattctccagatttacctatctatgattttcgttttaacgagtataaatacttttgctatagtaaggttgttgatttgattattaaaattaacgagtttttgataatcattgagaagaatattctcaaacgaagtttttgttgaacgtgaatccattgatctccgataacaatagaactctaagatatgattctcttacttgagatctattgatattcaagattactatcgtaatttattctggtacactaactatttacaccatttttaataaattagataaaatcacacaaacatgtttatatttggaccttcactatgaataaacttggtttatttgactaatatttcaccatataattttcaaaaattcgatttcaaaaaactattagttcaaaccaaacttggttgtaggatctgaagacttgtagttaggttgtttggtttgaactattattttccaagataaaagtagatctcttttgatttgaatatgtggtttgattaaaatattatcaaaatcaaaattgactttgtccttctcacgatcattaattaatcttactagaaccgttagagcaaaactggctgggtcaaggaaacttgcttttattgcacaaaattctaaatttacttcgaagacgtgttgcttgacgcttgtcgttacttctgataaatgattttgagtaaaattcaactaacattaaggttgtgatgcttcctatataacaaaggaagtctataataaaatccaaacgaaaagccataaaattgactaatctaattcccaaaagttttatatttgactgcatattgttttggaattttatagttttttttttttttttctccttgctagttgctaccatcgaattcgaaaaaaaaaaaaaaacgaaaaaaaatactaaagtatcttatttttaaaaatatgttctcttgttgaaataaataggggaaatagcctcgccacgtttttacgcaacctttgctttgactttaaatttcatatcacaccatactcttatttctcttatggactgcaatattttagtttaaaatttaagtaaatgtataaatgagtgatggttaaagaaaataacagataaaggaacatgacttgttttttaatccaagttaaagagtatatatatatatattatttctctaacaaagttaaaagtggttaaaactcacatgaaacctaaaaagaatctaccaactcaaccatattgtcttatgattcaatccctaagattcatttccaagcaatatattagatatctcatatgtaagtgtatataatatataatatatatagatgatcaaaatcaaaatttaggcattgaagagattgtgtatcagttcatgaataaattggaacctaccattgtctctttcgccaactctaatgccaattttttttggtttgattctctggtgaacaatgcagcatatctataagtacctttataaatcatccttccagtttttatactaaaatgattacttatgtctctcctcttttgtgccttctcatcgactacctttcattatgtaaacacttaaaagctaagcctgaattttatttaaggcaggtaagttagtattgggctttaaatataattaagtgggccttggaccgtatatcgacaaatcaagtgatgtcgtgtgcttcgtaaaattcccacatcgcttgtctagaaacgtaacttaatgtatatatttagacaaatcattacggtcacagttatgtttacgtacttgtcacttgttctcatactatgatgtagttgtctagttgatctcagttatgtttcatgaattgatacgtttttaatcaaggtgacaagattaatagagattaactacctctacacaactggacattggacaattcagattcaaggttgatatccttaaaaacaccaatacactcctctataaatatttacgtacttgtcacttgttctctttttattggttataaaattttaaaaatttttaaaaaataaataaactaaagggctctctaaagtctaaactacattacaaataatatattattgtattttaagagacactctccatccattgatggagatgatgttatggtttgatcaagaagatatcaactacaagacattacgcttctagttaaaaatagttggtcaacttaaaatcacgttgcatgtcttaatcacgttggtcatatattcccaattgccctcaaacgtcaaacattgaacatcatgtccgtgattctaaaatcttgtaatgttattttggcaaatttccttcttaaaacatgaataaaaaaatcaagaaaatttacatatctcagacggttcttctcgtgtgttttagtcttctaagcaccaatgccaatcttagtggatctggatctatccaagtagatatgaataaacaatacaagtctaccacacacacaatcacacattactcagctaaaccaactgagatctagagagagtaagagtgtgagaactttc

SEQ ID NO: 6818 - DNA, 3000 bp, Unknown
  misc_feature (1)..( 3000): cDNA_ID_2173637_gDNA_ID_1621107_Annot_ID_171621 3000 nt of promoter + ATG
gatggtataaacggcagcttgaaagacatagcgagctatgaagcccgttgttcgatcatcctgccaatgtcctgaggttgctgcgatcaagtcattccagtgtgtagtatactttgctccatagatgttccaagctagagcctgccaaatttctgaggcgtaaacacaagagaaaaaaaggtgattacgggttccagcatgtggttacaaagagcgcagcctgtggagagacccctgttccagctgagcatccgatctccagttgataaacgattgtgagccgccatccaaacgcagaaggagaatttgggagtccctcctgcaaaccagacactcttatgccatgtgacctctgtcgaaatagaacgtgtgtggctccaagtatcacgtgctgaaaactgtggccggaaagtatcgtttttccccttccaaagaaagacgtcctctactgccactctgttttgctttgccaaaaggagttcttgttcaatggtattaagcgtttctgctcggtgataacgtgatctcctgcgatcccatgcctctgcaagtgtcttaaacttgcttatccccatgtcgaattgaccgcgttctcccagcacgtcaatcagccggcccttggatgaccaatcatcataccaaaaagacgcagtttcaccatttctaatgtcgaccttagaaaaggcttttgcagtgtcccgatattttaacagctttttccacatccatgagccctgagatgctgaccgaaaagaccaaaaagtgttgcgcttgagaagataagtcctaatccactgcacccatagcgagtcaccttgcgagacgattcgccaaatcagtttcagacaacaaacgtcattagcctctttgattgactgcagacccaatccgccctctcgttttggcctgcaaactgtctcccatgcgatcttagccttattagtactcagttctggtcctgaccagaggaaggcggaacatagcttatcgatttccctaacacattcacggggaagcctaaaagcagagagccaaaaattgcaaatactccataggaccgaactgaccaaatttagacgacccgcgtaagacaagaaacgggctgtccaagttcctattcgtcgctttatttgctcgagtagcgggctgtagtcctgtgaagtgaatcgcttggtgacgagaggtaaacagagataccgcaccgggagacgtcctactgcaaaatggaattggtcttcaaattctttgcatacagatttcgagatacctgcaaagtaaattgtagttttcgccatgctgatcttaagacccgattgctttgcgaaactatcaaaaacctccacaataccctcaagggaacgaagcttcccgtcggtgagcaccataatgtcatcagcaaaagaaagatgtgttagaccaagatttttacattttggatgataaccgaatttcctcaaacctgctgctctgtcaagcttcttggatagaacatccattacaatgacaaagagataaggagttaaagagcatccctgacgcagcccccgcaaactattaaaatatccagctagttcccgattaacctgaaccgagaaagatgctgtggtaacgcaaagcatgatccagtgaacaaattcttgaggaaagtctagagttaaaaggacattcctgaggaaggaccattgaacagaatcaaaagccttggagatgtcgatttttatagcacaacgttctgaaactgaatctttgtgatagtccttgactaactccgttgcaagcagcagattttcaatcaaaagtcgatccttgatgaaagcggactgattccccgctatgaactgtggcaacacccgttttaacctgtttgcaataatttttgaaatgactttatagaggacattgcaacaggagattggtctgtaatctttaatctccttggcttccattttctttgggattagagctagaattgttgaatttactccattgtatatggagactttgagggcgttacaaggaaacaaacggaaacggaaacaatgaacttcaatgagcttcattgtcaaacaatgacaaagaaaaaaaaggaaaacttcattgtttgatatatcctcattacgtaaccctaaagctattcacaattctcttctctctcaatttgctctctctagtcactacgatttgcgaagtcttcttcttctcctctgtttgaatctcttctcggtttcaaaacatgaattctcgtttcatgaatcatcaaacgaaactctctccatcacaagcaaacatcaacccaatcatcaaattatcccttgccaattggttttgagttgtaaacccatattttcatacaagttatattacctattaaatttgactttaaagatttgactatcattttttttttggagatagatgtaaagtaaacatacaaaaaatagtgacttaaaatatatttttaactacatctaagaaaaaaaaataaagactagtgagactgtagtaatgtattctttctaataaagtgaggcctataatcttccttactcatgccagtctttctgtaaattcttttttaagaaaattgcaatctcttccaaacagattcaaattcagaattacttggtaatgtattaccatatttatatatatttttttcttttgcggtagtcagcacaaatttagttaggagatcgtgataatgcctttagtgagctgtttcattgcgttattttacgaaaaaacaatactaataatgtatacgggaaactcgtgtttagtattttaagtgttgttggggaagataaagacaaaacaaaaccatgactgagatgtagtgatttgtttatgctaataaaagaacacattatttaccatgtaaaatatatagtatgattctgtgagagatgtggtggttaaatcttaaacgcttataaatttagagtagatggttttgttttcataacataaaacgggttgagagatcagaaagcatcgatg

SEQ ID NO: 6819 - DNA, 3000 bp, Unknown
  misc_feature (1)..( 3000): cDNA_ID_1815658_gDNA_ID_1621107_Annot_ID_55988 3000 nt of promoter + ATG
tgtctggtcattgatggtgtagtggattatggtgattaattaatctactgaggtgtgtgcttctgtgtaagttctacattatgcaggtgtataaaagatcaaaacttcaagtctagatccggatgtcaaaggttctacgaggcaagtcagtagaagatttcaagcttggctcaaggtggatattgtaagaatatgatccaacttgaagaagcgtcaagaggaaaaagcaatagggaagaataacaaaaagaggagaagtgttttatgctcaactgtatcaaatacactaaaaaagagccagagggttaattccttaaggaatgaagtggaagatgctgaaggagatagagtctctcaagatgtatcctaattggccacacgctcgttgacacgtgtgaagtcgttagggttttgggtaatcacgtaggttacgtactatgttttactataaaaaagaggctccgcttcttagttgaacgaagccgttttcgagcgcttcgattgttggtagagcgagagattgctatagagagataggctgttttatctttttacctttttccttttgaataaaatgtaaaatttattcgaaacaactgtttacatccagtgcagtgttttgcactgaaatggttgtaatacgatgcttatgaaaacaaaaaccaaagagccgagctcgttcttattgtgatgcaaaccaaatcgccatgcacccgtcatatctttgattgggttttaaatattaacaaaacataattgaaaaaacatcatgtatatattattgtcacaaaccccaaaacttgtagatgtttttacataaaaatagaaatttagaaagatttaaatctttgtatgagatatgaatagaatataaatagaaaccccataactattttctatttttattattttatacaaaaggtatgaaatataaatatttttgtttctcaagatgtataagaatgaaaaaaaaattaatatgtaagaaagataaaaatatgtattaaaacttaaaaacactaaagagacacaaataagaacagttaattgaagagaaattgcaagaaaaatatatatatcttttatattttataatcatcagcaagaaatatttcattaaccaattagccaaacaagtcttacattataccataccaagtcttattcataattgaaagagacaaatgacgacgctgtagtagcaaacgtttgacaaaggaaacagcaaacataaataatcggacgagccaaggaaaatcacaggtacttattggcgagctgacctaacatctgtgggtaatatccgaggactctttccttttcttctccgcctttaaagacaatagtgatcggatgatattctatgcggtaatcctttgctagctccaactcctcgtcagtgtcgactgtgtagaattttaacatatattcgtattctgagtctaggaattcgagctcgggcatcaaactaccacattcggcacagtccttggctatgaatacaactattaccgggactttagattggatcacaagtgaattccattccgatgcagatagactttgtactacatacatcaattgaatatagagatttaaaacgttatatagaaatattactcaagcgaaatacagataaatttattacaacatgtgtttttttggtaaagatgttgtgggaatagtaacaattttctacatagaaaatgaaaaattatgtcgctattcctgtgaacaaaagtcaaaaactgtaagataacctaaaaatctaagtgaaaattatcttcattacaatatttcgaaagtatagatatgatattaaaacaattcatgttttcaaaataccttctacacaaattggagtttttttaactttttataattaactttaaaacaaatctagttaagttacccaagccatcgtgagacggtagtgatgaagacacgtaagccttgatgaagggatccgaatccgatcctgaacacatgctaacattaaatcctaaacacaccaagcacgtcaccgtcactaccaagtgatacaaacccctaatttgctccatcgatgctttctgatctctcaacccgttttatgttatgaaaacaaaaccatctactctaaatttataagcgtttaagatttaaccaccacatctctcacagaatcatactatatattttacatggtaaataatgtgttcttttattagcataaacaaatcactacatctcagtcatggttttgttttgtctttatcttccccaacaacacttaaaatactaaacacgagtttcccgtatacattattagtattgttttttcgtaaaataacgcaatgaaacagctcactaaaggcattatcacgatctcctaactaaatttgtgctgactaccgcaaaagaaaaaaatatatataaatatggtaatacattaccaagtaattctgaatttgaatctgtttggaagagattgcaattttcttaaaaaagaatttacagaaagactggcatgagtaaggaagattataggcctcactttattagaaagaatacattactacagtctcactagtctttatttttttttcttagatgtagttaaaaatatattttaagtcactattttttgtatgtttactttacatctatctccaaaaaaaaaatgatagtcaaatctttaaagtcaaatttaataggtaatataacttgtatgaaaatatgggtttacaactcaaaaccaattggcaagggataatttgatgattgggttgatgtttgcttgtgatggagagagtttcgtttgatgattcatgaaacgagaattcatgttttgaaaccgagaagagattcaaacagaggagaagaagaagacttcgcaaatcgtagtgactagagagagcaaattgagagagaagagaattgtgaatagctttagggttacgtaatgaggatatatcaaacaatgaagttttccttttttttctttgtcattgtttgaca

SEQ ID NO: 6820 - DNA, 3000 bp, Unknown; identical to SEQ ID NO: 6817
  misc_feature (1)..( 3000): cDNA_ID_1815638_gDNA_ID_1621107_Annot_ID_55997 3000 nt of promoter + ATG

SEQ ID NO: 6821 - DNA, 3000 bp, Unknown; identical to SEQ ID NO: 6816
  misc_feature (1)..( 3000): cDNA_ID_1815630_gDNA_ID_1621107_Annot_ID_55999 3000 nt of promoter + ATG

SEQ ID NO: 6822 - DNA, 3000 bp, Unknown; identical to SEQ ID NO: 6815
  misc_feature (1)..( 3000): cDNA_ID_1815626_gDNA_ID_1621107_Annot_ID_56000 3000 nt of promoter + ATG

SEQ ID NO: 6823 - DNA, 3000 bp, Unknown; identical to SEQ ID NO: 6814
  misc_feature (1)..( 3000): cDNA_ID_1815622_gDNA_ID_1621107_Annot_ID_56001 3000 nt of promoter + ATG

SEQ ID NO: 6824 - DNA, 3000 bp, Unknown; identical to SEQ ID NO: 6813
  misc_feature (1)..( 3000): cDNA_ID_1815618_gDNA_ID_1621107_Annot_ID_56002 3000 nt of promoter + ATG

SEQ ID NO: 6825 - DNA, 3000 bp, Unknown; identical to SEQ ID NO: 6812
  misc_feature (1)..( 3000): cDNA_ID_1815595_gDNA_ID_1621107_Annot_ID_56010 3000 nt of promoter + ATG

SEQ ID NO: 6826 - DNA, 90 bp, Unknown
  misc_feature (1)..( 90): cDNA_ID_2993351_gDNA_ID_1621108_Annot_ID_56012 3000 nt of promoter + ATG
tctagtgaaaataaagacgcctctcagtcaactgtctcccagtcagctgcagatgcttctcagccagaagcatcaagagatgtggaaatg

SEQ ID NO: 6827 - DNA, 3000 bp, Unknown
  misc_feature (1)..( 3000): cDNA_ID_1815722_gDNA_ID_1621108_Annot_ID_56014 3000 nt of promoter + ATG
caagattgtttattattggtcttatataattatgagattctaaaagtgtgatacggttagggttaggcgtatccttttgttaccgttgtgataaaatttcctttttgtttctgctactcaaataagaaaaggaaacaatcaaaatttccttttttcattgaacaaacgtgtacttataaatacaccccttctctcttcttccttgagaaaagtctccattctctcttcttcttcctggaaacctaaaccacgtaaggatttgctctgaatctaaatattgacgtggagaagacgcgatcttactaattctccattctctgcttcaacttcaccgtaagattgaacaaacctttacttatatatacctcttctttcttgagaaatccaaattctccattctctcttcttcttccaaaccaaaacctaattctccattctctgcttcaacttcaccgtaagattgatcggttgataaagcggctctttttggtgattgatctctgttgtgactacatcttaggtcaattcagattgctttcatatcaagtctctcctaatttcacaagatcaaagatcccggccatggattcagttgtcgacggcgaaggagaacacaaacgacgactaaggatgcgaaagtgggaaagagggatataacgaagacatggacaatgaaagcaacgagcagtatagaaccaaatcaatggatcatgatctgtgtttggtactaggtgtttccttggcgtcgacgagatcttttgaaaatcttgtgtttcgtcgatatcacaagcaaaggtattttcttttttccttttctatttttaatgattcattttttactaaataaaaatttatttttagatttttttattaagtgttaaaattttcaattttgtgtaaattaatttaaatttttaacacttgtttttgtttttattaaaaactgtttttaaacctatatttttatactactattaaagttttaaggtttttcttattaaatattaaatttttaaattttgtgtaaactaattggatacatcatccaatcccctaagaggtgttctaggttcaatagatggtttacacatcatttaaatttttaacacttgttttttatatttattaaataaatgtttttaaacctaaatttttatactactattaaaatttgaagtttttttttattaagtgttgaatttttaaattttgtgtaaactaattggatacatcatccaaacccctaagaggtgttctaggttcaatatggtttacacattatttaaatttttaacacttgtttttcttatatcaaaaatatgttttaaacctttatttttatactactattaaagttttaagtttttttattaagtgttaaatatttaaatttgtgtaagctaattggatacatcatccaaacccctaaatagtgttctagtttcaatatggtttacacattatttaaagttttaacacttgttttccttatattaaaaaatgttttaaacctatatttttctattactattaagatcttaagttttttttttaattttgtgtaaactaattggataaatcttaactcctaagaggttaggttcaatatggtttacatataatttaatttttcttatattaaaaaatgtttctatttttattttactattaagattttaaatttttttttgttaagtgtaaaaaattaaaattttgtgtaaactaattgaatataacattcaaacctgtaagaggtgtttataggttcaatatgatttatatataatttaaatagtttgctattttgtttagaatcaaaatatttttaaatgacatgttgtaataattgaccaaaagaaattagtgtgtgattttgttgaaatgcagagtacaaagccttaatttataccaagttatggtatctataacgtatatgaataccaaaattttattatttttaattggtgttgtattttataattcgaaataattaggggaacgggcaaaacctctctgttctctcgcttatattttttttagagagaaagcaaatcagtttcaacgatcggatattttctggtgttagccgtcctgactttttgggctttctgtccgatatcaccggctctggtagcggtgttggttggctctagtccggcagcgtcttgttcacataaccggtggttgctggctcttggtttctctcgtcgatgtagatcgatttttaatctgtgtttttttattttcatgttttgtttttaataattctcatctgagacatgttggtgatagagtgaatgcaatctcgctttctaatgcttcttatccgatctgttcttttttaagttttgatttacagaaatttttggagaaatttgagaatgatgttgaagaaaagaagtggattctgttgttaattatcatagccttaagctgttgtatatttaacatgagcctcgattgctttttatcggtgaaaaaacaaaaagatccatgttctatgagactatcgacggtgattctttcaccgaaatcggtgctcagacggcgaaaatgaagtcggttcgctttagagtactcatctgacacgtatattaatatatcgacatgtggtttgggatagagtcaaactatagtttcttcttctatgaaagactctctgttggcctatttggtcctaaatcgtttctgtaatcgcggacttttctttaagctttgactatcttgattaatacaatatttctcttgggacaaaaaaaaaataatcttagtatttctttaatattttttgtttgggtatgggctattgggccgcttcgaaaagttcactttctctatcgatctctcacagtttctgagttctctgactcaaaaacatatagtagaagaaaacgattagagatcttcttctttctcctgttgcatctgaagataaaggaaacagaaagcgcgagatctgagtgacggagtaatttcaaagggaggttttcgagatcagaa

SEQ ID NO: 6828 - DNA, 3000 bp, Unknown
  misc_feature (1)..( 3000): cDNA_ID_1809097_gDNA_ID_1621108_Annot_ID_56018 3000 nt of promoter + ATG
tgataacatgatcggtgaaggagggtacggtgtcgtttacagagctgatttctctgacggttctgtcgccgccgtcaagaatctccttaacaacaagtaatgtctttaatgattattactaattttgattaagatcattttgagcaaaattcaagttttttgaaatttggatcttatcgggtagtatattaaatatatcattgcctcattctgacaaatgttcatttacttcgtttcacggactccgtaattcttgggtcaaggtttcattggtacttactacttggttttaaaaatgcttttaatgttgtcttcttcgttgctttcaaacccaagaaaatggcgaaacttagattttttatatttctccgacaagtgtttaattagatagtaccactttctctgcattgactttaatatatcaatgaaattcttgagttctgtattgaataagggtccaactgtaaccattttatctcctgaattagtaacttaaagacatttcagagtatatagtaaatgtttttccgaccattgaactatataattgctgtttttttaggtaggtgtagtgaagctaaaagagtaaaacaaaaggaaatagtattaattagttgtgctttgttctttattctctattaatgctttctttaatcttttccttttcttttgacctctatcatctcttttgttttagtttgtcaccttttttagatgatgagatggtcttcactagtataaaacttgctggaacatgagatatcattgaaccaaatagcttgcaaagaatcttctctgtttgctttgtgggattgtcacttctttgttctgactttgggattgattagccaaagctccatggattgattttatggttaagaaaatgaataaatcttttatctaggtacagaaatctattatattcattgttaggttgagcagagtcaggttgttggttacaggacaaccactggaagtttgatgccatttaaaaaaaaatatatataataattttttggtcctgaggcatggatgaaactttttctcttcttgtttactcttatattattgttttataaacagttttgtagattttgatataagaaatgaatctgctaaatgatggtaaaatataattctattcaggggtcaggcggagaaggagttcaaagttgaagtagaagcaattgggaaagtaagacataagaacttggttggtctgatgggatattgtgctgacagtgctcaaagtcaaaggtgctaatccaaacaaactcaaatgaattagtaaactctaatttggaattaatctaacagttagttctttctttgttccttgattaggatgcttgtgtatgaatatattgataatggaaacttggagcagtggttacacggtgatgtaggtccggtgagtcctcttacgtgggatatccgcatgaagatagccattggaacagcaaaagggtgcaacttcttttgttttctacttcttcttttcagttcgcattttagctaagattggcctttgaaactctgccttttgatgaacagattagcctatttacatgaagggcttgaacctaaggttgtgcaccgtgatgtgaaatctagtaacatcttgctcgataagaaatggaacgcgaaagtgtctgattttggtttggccaagttattaggatctgaaacaagctacgtgacaactcgtgtgatgggaacttttgggtatatatatagataccctctcttctttcagttatcaggctcatattgtttctttacattttatcttcttacacctttttaactttctgcagatatgtttcaccggaatatgcaagtactggtatgctcaatgagtgtagtgatgtctacagtttcggtgttctgctcatggagatcattacaggaaggagcccagttgattattcaagaccgcctggcgaggtaattgaaaacgtttgtaagtaacaaaacctttacctgccaagaccatacgcaaataattgtttgttgaaacatttgcagatgaacttagtggattggttcaaaggaatggttgcaagtagacgtggagaagaagttatagaccctaaaatcaagacatcacctcctccaagagctttgaaaagagctttgcttgtttgtttgcgttgcatagaccttgactctagtaaacgaccaaagatgggacaaatcattcacatgcttgaggctgaagattttccattccgtcctgtaagtgtgtcaaaagctaaaaagagatttgatcctttatgcaatttactgattttaagtttcatgttgtcacacaggaacacagatcaaaccaggaaagatcgaagtaagaaagattattgggcaaacaataatgtcttggggaagaccacacttgagcgttgatgctattcattacacagccatatattgatagatgtttccatgtttgttcttatattgagaggattgatatgcaaaagagaaaattggaaaagtgaaattagatatatgaggatgaaattcagatttatcgcttgtaatttgtaaatatatcatatattgtataataaaacagtgaactctaagaacatttcttcccttgtgaattttcccattcaatttaggcctgagaaataatatcgacccggacctaaccggaatttggtaatttggtttatagagaagaactgttcggctctgctttgaaatttgattggtatacggtttagttcgggtttaaaaacttaatccggtcttaaacctattttggatccggtttgggtcgagctcaaacacatgtgtcggaatttggatccgacaatccacgaccagaccactaacctgcgattggtaaaattatctaagaaaggccacgtgtcatcacacattctcctgacttcgccatcatcattagccccacgcaaaaagggaaaacagaatccattccttaaatcgatttcatccagatctaaactcgagcttttgttgatcgaaaaaatg

SEQ ID NO: 6829 - DNA, 3000 bp, Unknown
  misc_feature (1)..( 3000): cDNA_ID_1808243_gDNA_ID_1621108_Annot_ID_56019 3000 nt of promoter + ATG
ttatgggatcatgagtatttctcgggaatgtgtttattcgcaagtctattctctaacctcagtaaataatgagtggaagtttagttaaggccaaatagtctaaaatatattatttgtagttttgtacacagccaggattgaatcttaagagactctttaagtctaaaattacaatcagatcctagaccactttctatttgcatgaacgtaaccggatactgattttttaaatgttttctttggttcaaaatcgccactatctttgacaaaaacattctcgaataggattcaaacctaagagcctttcaaattcgttcttaattatgtcatcatctttagttctgctcccatctctcatcggtctcaagaaccactcctagtcatttaagtactacgttttatacacattacatatacatacatttacacaactaggaattgagtagggaacaaagtttcaactttcaactaatagggtaagccttctggtacatggaaaccaaccaaccaatctactagtttttatgagttcaaagatcgatcttaaccggatatctatggatgcaatgttcccaaggattgttaaccgagggctcgacattgcgaagagccacccaaaccgcgctgttacacttaaacccgctaccaaaagcaatctgccaaactctgtttcctttcctcattcttcctttagcttccgtgtaagccaattcataccatatagagctagaggaagtgtttccaaatctatgcaaagtcattctagacgcctcaacatgttttggagaaagctttaaactcttctctagctcatcaatcacggctctacctcccgcgtgaatacagaaatgatctaaagcaagcttgaaatccggtatgtaaggcttcttcttcttgtcattgaacaatctcttagcaacaaaagtcgcaaagaacagaatctgctcgcttataggaagaaccagaggacccaaagaagtgatattcgtctttaaagcttctccagctatagccataagatctttagacaaagaaactccggttttcaaacactcatcttgttcttgatacacacaattgaatgcgttctcatcagatcctttatgagtcctgaccgtatgaacaagcttatacttggatcgttttcgatccaaaggcttgttcgaaagcagaaccgcggaaccaccaactctaaacaagcaattagggatcaacattgctttcttgttaccaaaataccaattctgagtgatgttctcagtactaaccacaagagcaaaagtgttcctatggatttgtaacatatcactagctagatctaccgcgataacaccagcactacatcccattcctccaaggttaaagctcttaatgtttcctctaagcttatacttgttaacaatcatggcggataaagaaggcgtagggttaaacaaactacaattcacaacaagaacaccaatctccctaggattgatttttgtattctcgaaaagattgtcgagtgcaccgaagattacctgctccgcttcttcacgcgctgcagccatagtaggacgcggagggatagagtgaatagaatccggtaaataagtctcttcaccgagaccagagcgaatcaagatcttcctctggaactcaagagaagtttcgctgaaatcttgaatcaaactagagttgttcatgaatttctggtagctaactttttgactcgaaggcgggaggtagcaagagtaatctagaaggtagatggatctaggtcgagacatgaagaagacaatggatccgacaatggcgagagtaatgacgaagatgaatccggtggaattgtaatagagctgaagatggtttaggcttaacaatgagacattcatgaacaaaacagccattagagggaggaacatgagtttaaaaaagtgagtgatcagatagtgataaccaagcttgacgtagttttgggtccggatctgtacaggtcctccattagcatccatggacagtttctaaagcagaatctttgatatttttgttgatgatactgatgagaaactgaatctgggtttgtgtgcgtatatatagatactgtgagagagatagagaagaaatcgtaaggggatgtgtttatagacaccattttttcttctgcaggttgggtgggagtttgatataactaaaaaacagagaagagtcgccattgatgtatttggcgtcatgtgtatcggccaactaatggaagatatcaagaggaaaagtgatgaagaagcttctggtttttcagatttttatgggaaaaaaacagagagagtagatttgaatcgaatttcaaattttcaaatttcaagaaaaaaaggaatcttaatgataatggacgttgatatgggcttggggtttaggcccaattgtttttcttttgatcttgtgtaaatctatgtatatctttggagatcaatcacaactcaaagaattggcccattatgatgtaacctaagtttgactattttactattttcttcctcaatttttttaagatcccaaagaaaaaatatggtattattgtccaataaacatgtcggaagcaccaacattatatgctaaaacatttatttaactaatttcgattaccaacggcgtacgatttaatgcaaatccagctatattacagatcctcattattcttacaaaattctatttcaataaaaaccaaattttagttagactatcattaacatactatacattaatatgtactcgttcggtggcattctcgtaataaacactaatcgcatgccttaaataggaaacactctctcaagtctcacaattctacccgttgagctctctcattttatttttttgttaaagctctcatcagtcatcatcgtcttttctcttttgtttgtttgctcctaacgtttctctttcttggaacaatctccagcaaaccaaactaatccgtctgagagaagtagttttgactttctctactccgtgatcgcgatg

SEQ ID NO: 6830 - DNA, 3000 bp, Unknown
  misc_feature (1)..( 3000): cDNA_ID_1815710_gDNA_ID_1621108_Annot_ID_56022 3000 nt of promoter + ATG
gatttgggaatacttcatctagctcaatttggtatgaattagcatacatagaggcaaagggaagaatgaagaaagggaataaagcttggcagattgctttaggatcagggtttaagtgtaatagtgcggtttgggtggctctacgcaatgtcaaggcatcggcaaatagtccttggcaacattgcatcgatagatatccggttaaaattgattctgatttgtcaaagtcaaagactcatgtccaaaacggtcggtcctaatttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgattgtttgttcatccagctgaccagctctgtctgccgtctaggttatgtgaagaaagttatattcctggttgtttagatttaaatataaaaatggatactttagtttatgtatgattttgaattgtttagatttgaaagtagggaagcccataaaattcaattgatagttgaataattaaaaatgataagtgtcagagagttggagcagtccccgatgagcctacatcagccaaaaaaagacactcatattttcattcttttttttggctaaaactcaccttatatatctgtttatttcaaaagatgcgtttttcttactttttacaacatgaaatcttttattttaaggaaattatagtaactaaccgtagaatacaaaagaatgaaaaaactaactatggagcaacgggtcagagacaatttttatacatttttcatttatataacaataactcatttatcattaaatcatttttataacaataactagtaaccataaaaaatataaatacttcttggatgttaagaaaaaaaaacaattcttcttttgacgaaaaagacttcttaggaaagttgtatacctttaaaatacatgcaagttatatgaaagtttataaaattcacaactcttctttattttaaaacccaaaaaaaaaaaaaaaaaaaaagtcctcttatttatacgtctaattcccatgcatatatcgagaataacccatcatataggaattaggctcccatcatgtgatcatgattcatgagtcatgaccattggatctcccctcattattgttccatcagaaatttctacgtcgatgatatgtttctaattctaattttttttacagcaatttctaattctaattaagaactctcccatatacaaattgatatagatatcttttagtaagttagtaacaacacttaattaaacatagataaatatacgtgcacagatcaattctccagtttaaggaaagaaattggatagatgtatttaaatacttttgtataaataatataactatctccaatacaacacaccgaatcaaatgtcaacatctacatacatgtcgacatgaatttatgaacatatatgtacaaggtgatggggaacccacaaattaggtgtgtggctttactttttttagtgtatgcatgtatagtatgatagggagggaaatagctgatcatcatcttctatggacttagtccaaattcatcacatcaaaaggcaacgaccatgtctttgtttctaacaactttacaccctcccctttccttatctactaactccatgtatctgctttaaaggttaatatataactggactaagcaaaataaaagagagttgggttttcattatagaatcgagaagatttcatgtccctatatcaatcacataaagcgttttccaataacataaaaagtcggataaatgaaaatatttgagaatctaaaacaatgtcatatatactttaatggaaggtccttttcttcgaaatatttgctcaccgaaatcggtgaaagtgatctaagactaaaactaacttgtgagtaattcatgtgatgggccttctgcatcgaaaaagagcatggcgatcacgtggcagcctctcttgcgccgtctcagtattagcctatcacgatagagtaagccaatgtatacagcatggcgatcagacacatgatgatgatcgatctgaataacaagattccgaaggatgtaataaattcatgtgaacagtgcttcgtagctaaactaagaccagagctattgaaatgaggtaaagtgttttctttgtaaccccattttaattaggtgaaatatctagcgcacacaccaatctgattcatataatcataactagcttgtaaactacaaaattatttttcattgtgttacaactagaccattcccacgtgaccattcacgtgctcctataatgaaagaaacctaaagaagagacgctccaattcgcatagacatcccaagcttatcctttcttagtgaatcaagatccaatttacactataatacatgcatatattacgtaataaatgttttataagttttctgtgtcactcactatttttagttattttctcaattttcaatcatcgcaaatatcaattatcacaaaacatataaagtttccagatttgtatatgggcctaccttattagatgcgatgaatatggactaagtacagagctgatggtttttgttataaatatcgtttcctcttctaccctcacctttactctgtttctttctccactctctctctctctcgttgcaagcaacttgttttctgaatccaaagaagacgataacg

SEQ ID NO: 6831 - DNA, 3000 bp, Unknown
  misc_feature (1)..( 3000): cDNA_ID_1807445_gDNA_ID_1621108_Annot_ID_56023 3000 nt of promoter + ATG
tttcatgtccctatatcaatcacataaagcgttttccaataacataaaaagtcggataaatgaaaatatttgagaatctaaaacaatgtcatatatactttaatggaaggtccttttcttcgaaatatttgctcaccgaaatcggtgaaagtgatctaagactaaaactaacttgtgagtaattcatgtgatgggccttctgcatcgaaaaagagcatggcgatcacgtggcagcctctcttgcgccgtctcagtattagcctatcacgatagagtaagccaatgtatacagcatggcgatcagacacatgatgatgatcgatctgaataacaagattccgaaggatgtaataaattcatgtgaacagtgcttcgtagctaaactaagaccagagctattgaaatgaggtaaagtgttttctttgtaaccccattttaattaggtgaaatatctagcgcacacaccaatctgattcatataatcataactagcttgtaaactacaaaattatttttcattgtgttacaactagaccattcccacgtgaccattcacgtgctcctataatgaaagaaacctaaagaagagacgctccaattcgcatagacatcccaagcttatcctttcttagtgaatcaagatccaatttacactataatacatgcatatattacgtaataaatgttttataagttttctgtgtcactcactatttttagttattttctcaattttcaatcatcgcaaatatcaattatcacaaaacatataaagtttccagatttgtatatgggcctaccttattagatgcgatgaatatggactaagtacagagctgatggtttttgttataaatatcgtttcctcttctaccctcacctttactctgtttctttctccactctctctctctctcgttgcaagcaacttgttttctgaatccaaagaagacgataacgatgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgatgtacggtgagacgacggtggaaggtgattcaagactctcaatttcgccggaaacgacgcttgggactggaaatttcaagaaacggaagtttgatacagagactaaggttcgtgtgtaaagaaaacttaagtttaagttctataaatgaaaaagaaaacagatcttactttgagatttggcttatctgtttcttctgtgtgtgcttttaggattgtaatgagaagaagaagaagatgacgatgaacagagatgacctagtagaagaaggagaagaagagaagtcgaaaataacagagcaaaacaatgggagcacaaaaagcatcaagaagatgaaacacaaagccaagaaagaagagaacaatttctctaatgattcatctaaagtgacgaaggaattggagaaaacggattatattcatgttcgtgcacgacgaggccaagccactgatagtcacagcatagcagaacgagtaagagagcctcattaactaaaattcattaactttgttttttgtgtaatcattgagactaattattaaagtattaaatttgtgaaggttagaagagaaaagatcagtgagagaatgaagtttctacaagatttggttcctggatgcgacaagatcacaggcaaagcagggatgcttgatgaaatcattaactatgttcagtctcttcagagacaaatcgaggtctgaaaattatttccatttatagaaaatatgttttaaagactaattttgcattaccttcctaatttgttatcaaaatattgtttaaaacagttcttatcgatgaaactagcaattgtgaatccaaggccggattttgatatggatgacatttttgccaaagaggttagtcattgatttgtttatgcttatatgaaaaacaaaactttaaaggctatttatagatgagctaaaatacgccatgtggattcaaaaccaggttgcctcaactccaatgactgtggtgccatctcctgaaatggttctttccggttattctcatgagatggttcactctggttattctagtgagatggttaactccggttaccttcatgtcaatccaatgcagcaagtgaataccagttctgatccattgtcatgcttcaacgtaagtcatatttttaatactctttcattatgatctatcctttagtttaactttggatatgataattttttactaaatatgttttgattgttacagaatggcgaagctccttcgatgtgggactctcatgtgcagaatctctatggcaatttaggagtttgattaagaaaccaatccacaacataacaatgttccctaattcaaattattcatcggaagagagagcaaaccagtagctgttatttactaattccactagattattgacttgagatcccccgcccattagttgatgtatcaaagagtgtagacattattgtgtataatttgcaaaccagtccagtaatatatttcttatcggtggacttgtgtctttaattcaaggtgtgttctcatcttcttgtggtgaatgatcatccattagtatttttttttttagtatacaatgccacaagtcatgcgaccatgaaatcaagaaacaagacaccagtcgtttaacgttatgttttacatcttatcactaacaatcttctaatctatgttttggttactttgaaaaagcgggactaatcccaaatttaaagcaattgaataaacaacacctgttaagcgtggcggacaaaacgacgacaatgtaagagaactgagtcagagattaaaacctatgaccaacccattggaactaaactatcctaattctctatacggagagtatatataa

SEQ ID NO: 6832 - DNA, 3000 bp, Unknown
  misc_feature (1)..( 3000): cDNA_ID_3049060_gDNA_ID_1621108_Annot_ID_56026 3000 nt of promoter + ATG
ccgagattttaggaaaaagattcacctcaatgattgtgtcagcgccgaaatctttcctccattggatcatgtcactccacatttgcttagctttctcaatgtcaaactttcttgctctcaaaaatctgtttatgttcatcaatacgaaaatataaatcttcttgatgaaattcaatattatttgatataccaagtttttttctttttgaacagactaaggtttttcttttcattttcttcatagttaattttataaaatgttcaaattgtattaaatgatgttaggaaataaagtgttgacaaatctttcttcgcttcgattattttctttccataaatccttttggtctgaatttaaaaataagatttgatttttaaaatatttgaaaaagtttatgtatgcatatatctgtatatgagattaatcagaaaaatatgaaatatttaactttatcgctgaaaacttcttatctttaaaataatacatatggcagtttatttgttgaatatggtcagatatctataatctttgacctaattttctctcgggttatagtctagtccaaactaacaaatcaggtttcaaaatttttaatcttattgacttataagaatactacggtctcgaaataactttgtgaataaggtaagaaaataaagagattgaatagggaaaataatttttttaccgaagcatcatgtggagatcatcgagtttggatggcaaaagctcgtcaaggataagagcttgacgaaaagcatcaagagcttgaagatcttctgcgtcaatgtcgtcctcaatcggaacggacatgactctgctgctgcttctccgaccttttttcttgaaggagttcttgaatctgttggatgcatttatcgctttcttcttcagcgagcttatcttcactatcttcctctcttcctccgacatctctatttctgattaacaatttgtaatttgcattagacttaagaaatatctctgtgaataaaggcaggaaatgtatgaaaatactaaccaggtttggtctcagccatggttagatgagttttaagcactctgtttcacacggcgataatacctaccaagacaacattgtaaagatcacttaagaaaagcttagatcgaaatcgcatgagaaatgattagatgaatctaaagaatcaagatgagttaaatgaccaaaatgtgttttaggatccaaagatgagaaagctagagagaatttgagagagtttatttttttatttttacctctattggagaagattgtttggggagaggtaagggaggctgaagataatggagaggctcatttgaagcaaggtgaaaacatgtagacaactatttagttctgattctaacaatctatatattgacagggtcctcctactgttttccataatatagaaatactttttagaaaaaatccaattaatcctattaaataaatacatagagttagttttaaactaatgaacaacgaatcgtttctaagtaaataaattaaatatgagagaaatatgtctttgtattaggagaagtgcatcccactacttccaacattttgtcgatgataaaaaaacatttgatgtcaacccaagtatctcatgatattgtttttttttgtatgattgtatcgtaacattatctacaaaatttaaactttttacacatacagtgaatttagtttatagtaaacaatggaaaaaccaaataaatattatcattacagtctattaacaattaataaccaagaatcttaaggtttaatttcccttcaaactaattgtaaatgatatatcctgaaatacatcaccacatggtgatattccccatagacggtgctaagatacataagttgtttcttttgttcacatattatatatcattcacaattatacaataggttactacaggaattataacattgtacaagaagccaaaaattcgatctaataataagtgatacacatgacaaactatttcaatattaactattctttataattaactttggaatcgtttctaaaagggcctattttcggtccagttgaggcccaatataataatgggtcgatgctgatttttcttcttcttcttcttcatttaaacgactcagtgtgactcagtcgccgtcgtctcccgccgtttataccctctccgaagccccgagcggccaagacgctacgtttgatttcgtctcaaggttagggttttggaatctcagttttttttttgtaaaaaaacaatatgaatgctgaatttgtttctgtcgattttgcctctgtttgcaatcatgaatgcgtagattcactctgaatggggattgaatttggtgaactccaatgaggttagttatggagttgttgttttagtaattgataaagtatttagattcagaaatagaaagcttggcttattatatcttatatggataaatgcatgaagaacataagaatctctgtcattgttttgaggacttatccccttatttcacactttgatatgagtttggtcttgagcgttttgtctttgaaattctgtaattctcgtctgaagttttggtttttctttttaggtgtttgcaaaactccgcaaagactctacctttagcgtttaaatcggtaagtggtgaacttgactatgtttgcattttacgtgttttttgttctattgccctatgtctaccttttctggtggagttacagttaaataagtgcttatttgtgagtgtgttattaatttatcgtatgtttgcaattagtcctgttaggtgtttattagaagtgaaaaatgtacttggttctatgttgaatgaagtgtcctgaaataagtaatcttgtgattgcaattgcattgcttagtgatcttctcaacttttatttgtgttcaatcttcaggcattgctgcctttgtctcaaaggtggttctgtaaattttctcctaagccatcctcattgacaaacattttcaaggtttcaatttcaaccatg

SEQ ID NO: 6833 - DNA, 3000 bp, Unknown
  misc_feature (1)..( 3000): cDNA_ID_1815694_gDNA_ID_1621108_Annot_ID_56029 3000 nt of promoter + ATG
acagtaagcaaaaaggtgacatggcttacttaatgttgaaatatatggtattggtaggtagaagttggaaaacaaaacaaaacactttttcctctttacgattttcggattctccattttgttacatcatgatatgaataccactacttttaaactgcatatatatcgacgtatgctttattccttcaagtaaattttaataatcgtgaaagagaatgtttatagtcaatttatagtacaaatgtgtctagtattctgtatacatgtatatgccttttatattctcaagtttgtagattttctttttctatagtatggttctcatttcatgtccattgagatatatatgttcaaaatttatgaagataattgtatttttcttaacgcaattgcgctcaagaaattctttagcactagttttttcttctttttttggtcaaaattctaatctttcattattcaattttttctttaattttgtttttgggcactggccaactaagagaaaaaggtcattatgtataatcatctccttgttagtaaagtaaacaaatcaaatcataattaaaagacgagtatgacaaaactttaaactttaaagtaatgttttttgataaacagagaattcagacatatatttcacatttcctttagatccgtgacttaattatatttttattttgacttatgtatgttaggttccaaacctgaatccaagcgtagcttaggcttcgaacctcaaatgtctgcataaaatttagttaccattattgtagctggatagttagattctccacatttatataattgtttttttaaaaactattggtttggaagccaccgattttcaaggcctaatttagaaacaacattttctccatgaactcttttgatgcgtagtcttaatagaaatctttcagtattattgacaagaaaaaataagataaaaataaataaataaaaaataatgactaacatagatgtgaaaagtccttattaatattcaaaacgctccaaaggaattgcacgacgagacaagaaaagcaggggcggctaagagagtcctttagaaaccaatctcattcgaatagtattatggtttattgagaaaatttataatttatgtactaggaagtaaaaagtcatagccgacgatactcaaaacagaattttccttcgagttcaagtattttcttgttaattagttcggaatcgaaatttcaattctaaggtttaaactctttattgtgaaagtcacacactcgtgtatttagactctaacatagagtcgagaaaccatacatgtataatgtattagttgaatggtttcgtctaaactctatgttacaagtaacaagtccatataaatgagtagaaccctacaccaaactctaattcctacttcttcgaaaggatacctaaaagcccgtgaagtctagaaatctttgattttatctacatgtattaactttgtcagcaacacacgttcataccggatttaaagttttggtgcaagtttctatcgagagagctttgcccaacatcttaatataagcccaaccttttataaataagcacaaaacaattataaagcctcacaagtaagttaaaacataggcccgaggcaaatgttaatggtacagtatgttgttgattctaatgtctattacgtgtactaactaactacgaagcccattcaagagtttaaccggcccaacaggtttactatgattgttttgtattaatatacagcttgactctcattttgtaatagaaaaatatatagcggtgtttaacaagataaattatgctatctataacattctaatccagaatttggttccatttaaaaaattaattaggccggttttcttctaaatgagttgtggtttcttgttaggacgtgcactcataccagccttaaaaaaattagtgacaaaacaaaactgaaatttttaacaaaaataaataaataaaacaaacaaaactgaaattaagaatcgtgagggtacggtcatcatccactacatcatctttactcctttttatgtgcaaccataaaataatacgtcgaacattaattatagtgacgaatcagttcattaaagcaaagttcaaacaactttgttctctttccataatctcaattaatcagtaatccatttaatttatcattgtgtgacgaatcagtgcatcgaagcaaagtttaaacaactttgttctcttttttccataatctcaatcagcaattcatttaagtttaacactttttagcaaaaaattatgagaaaaatttatgactctatctttcagtaagtatgttatgatcgattaatttgagttaaacgaagtagtgtatcatatatagtatatcactatcagatttatagaggcctaatcgtacattattcagttggttatagctagcgatatctcttgattggagaataggaatggaactttgaccgatattgaatacctagtcttcaaggattctacaatataattatgatgatttggtaaatttaattgggttatgataatgaaggcactcatattaaataatcaggtcactaacctctttagacttattgtggccaacaataggaaagtagtctcctttcaactttttctccaatcccaccatttccatgaacaatttttttaattaaaagcattaagagatatttgcattaattaaatgatggataaatcaattgttgttatggtattttactatttttatttatttgtaattgatacaatctaattttgaaactcaagctaatctctatttaaaccggtttttattgttgctttttatttaaagcattcacgttggctaaacaaattagttaacttttaatcgtgttatttctttagagattatatatagtgatataccaaacgcattggcttctcttttttttgataaggtacgtgtatctaaatacacaagatacagcttaaggcacatcaaaaattgaaaggagaaagaag

SEQ ID NO: 6834 - DNA, 3000 bp, Unknown
  misc_feature (1)..( 3000): cDNA_ID_4257557_gDNA_ID_1621108_Annot_ID_171696 3000 nt of promoter + ATG
attttgaccatgtcattacaaacggaagcagagcaactggtttatgggggcttgtgcttgtggcgagttctacgaaatttttgcttggaaaggtagtgatacgtttaggagatgtgtgtgttgtgttgtgaatttgcttgtagtttgagtaagattgtgctagtggcatatttttcattctgtttcgagcattatgttaatacatgactaggtttgacttttatagatttgtgttactttacaaggcttgttttgttgatgttccatctctttcaacaaacactctaaattgtgatttgtgaacatcaaataaattacgtaggtagtaagaaacatatttgttcttgtaacggtaacttaatttgactttttgttacattgatcaatttccttttcttcgcaaaacatagaaaaaagagacaatttccttttttcaatggagcgtttgcttataaatactccaactctcgtatcttcttcttcgttgagaaatcaaaataccatcttttatcttcttcttcttcttcttcttctttctttttcatacctgcaatttccctgagagactgatcactgatgtgctttcgttctctcgtgacaacaatcttcaatcaatcgagttcactttttagttcgtgactccctaatttcacacgatcaaagatctcgccaccgaaacgctttcaccgaaggattctttcaacggcggcgaaggagatgattacacgacggagaaggatgcgcggaagactatggccaagagagggatagtgaaattaacgaccagttggcagattcgtaggctttaaaactacaattcgactgcggaggaagaagacaaatttgtgtttcatcgatcgatcgataatcatcaccagcgagaaccaaggtttgcgctttcctaattttctttttctttaataaaagattttaaattttataagattttttttcttgtgtttctttttttagattttttttttgttttgatactaaatctatgtaaaaaatgtatatggaaaactaaccggattttggaaccaggttcggtcgttagcgatttcaaaaattcaacttgttttcatatctttatatagatttggtatcgaaggtttttgttcggacttttaagagtttttttttttttttttttttgttttgtttgatactaaatttacataaagatatatgaaactaaccggattttggatccagcttcggtcgttatcgattccaaacattcaacttgttttcatatcatttttatatagatttggtatcgaagttttttattctgatttttaaaaaaatttatgacttttttttttgttttgatactaaatttacgtcaagaaatgtatatggaaaactaaccggattttggatccagcatcggttgttagcgattccaaacattcaacttgttttcatatcatctttatatagatttggtatcgaagttttttgttggaattttaaaaagtttttttttgttttttttttgtttcgtttgatactaaatttacataaaatatatgaaactaaccggatttttgatccagcttcggtcgttagcgattccaaatattcaacttgttttcatatcatctttatatagatttggtatcgaagttttttgttgggattttttaaaaaaatttttgttctttttttgttttgtttgatactaaatttacataaagatatatgaaactaaccggattttggatccagcttcggttgttagcgattccaaacattcaacttgttttcatatcatttttagataactttggtatcaaagttttttattcggacttttaaagttttttctgatttattgttttgttttgtttgatactaaatttacaaaaatatatatgaaaaactaaccggattttggatccagctacggtcgttagcgattccaaacattcaatttgttttcatatcataaaaacttgaatttttaaaatagcttttcaaattttgttatttttgattcgaatttttcaaaggtttttaaggtttttgtttttgtcttgatactaaatttatataaaaatatatatgaaaactaatctgattttagatccagcttcggtcgttaacaatttcaaacatttatgtagattttagtatccaagtttttaaaataggttttcaaattttgatattttttatttagatttataaaagtttttaaggctttttttttgttttatactaaatttaaatatatatatatatatatgataactaatcgaaatttggatacgttttgggtcgttagcataccaaacattcaacttatttttatattatttttatgtaaattttattatccatgttttttatttagattataaaaaaagcttttcaaatctttaaaaactagctgtgttttgcatccatcattagtctctagagttcttaatattcaacttgttcttttatcattgttgcatagattttagtattcgaattttcacttttagaatttttaaaacaatatttatcatttcaatagtttctatttgttggtatggataatgtggtgttctggtctgattttttgaaatattttgtttaattttgtctcatttagaattcaaatctctgttttatgcaatttacttgatcagaatttctgaatcgaaaatgtattggctgatactaaaaattaattcggttctcgttttagttacttcggtttaatttgaaactcggaccggttttcgtggattgaactcttccacgtcacctagattttgtgaaacgactactatacccttagaacactggataatttgttcttgtttcgttacttgctcagagaccttttcaaatccaaaacagaggaatataagagattaaggaaccattgtgacgatgcctaacttgctccacaccaatcaatctcacttcttcttcctccatcatccgccaatctacaccgtcagttcaaagacgcaggctttccacttcccgcaatcaatg

SEQ ID NO: 6835 - DNA, 3000 bp, Unknown
  misc_feature (1)..( 3000): cDNA_ID_1815684_gDNA_ID_1621108_Annot_ID_171691 3000 nt of promoter + ATG
tgatgaatgattacgtattcaaatggattatgcttttgttaaaacgcaatgattatgttctgtgttaactttttttttcgtctctcgttttcgttttgtcttatttttatgtgaaagaaaaaatcatttggatacatatcttttttttcctcatttattttacttagtgataatatagcaactaaatttctaatatgcgatttgatgtcattgattcgaacaatacatttgcatcacaatgatagattggattttaggtaaatctattgaagtttttaatgttttattaggtaaaactttataataggttagatattattctacatttttttgcctagagatattgcgaatacaagaatcattaactcaaaaaccacttgcattgattacaggacttgaaactctctcccattttcttgacgtcaaaaatgataaaaactactccatgttttataaaagataagaaaagggaaagagtgatgatgatgatgcgtcgtgaatcgacgaataagaggaaaatgtgacacgttctcttttcccccattacgctctcgtcactcctcaccagcctgctcccttttcaaacttttctgttttccccctaattttacgaaaatcaaaataagttaaaatggaatatataccaactttcaaaataaaaaatcttcaaaacatatcaatgtgtatatagcgacacgagtataaagtcccacacacacaataaactaaggttggcagaaaaaaatataccaccaaactaagtgatcgtaactactctttcgaaaaaaccaaaccctaatcttgttttaagactaagaccaattatactaaaaaggaaagatttcataattggaaggaaagtagtatactttgatagttattaaaaataaaaataaaatgttcaaaagatttggctatagtggttgctttggtgaactccactccaacggtggtttgcaccatctccattcccatcactaccaaaaacccacacttctttttttttttctttctttgcgtaatgtgggttaaaaggaactttatttatgctcttgtttttgggtgtttgaatcgaatttgaaatcaacatttgtttttattttattttatttataaaaaatttgtgtgtttggaaagttgtaaaaggttcaaggggtttcggtagagataatcttaatttggtttttaacacatcgacttaatccaaattgacatctctaataggattcagatattattatatctatcctgtaattttccataaaatgtaatcaatatgagatttggtattagggtatgaacttaatgtatcttatcggaaaaatgttttctcctttgggttacctaatctcatatctaatgccaaaaatagcataacatagaagattggctagatcatatgtggacatcaccgactgcatggcaatgtttgttttataatcgcgtaatacttgtttgtcatttgccagttctcataacaaatgcgaaaataatcttatatatccttggtaatgcatgtaaaaattaattttgcttcatgaattattttatattcttaaattcatgactgaatgaaatttcttatctatattcagacgcagtatatgggacatctaactcaattttaagattctagattggatgattttatgttgtttgacaaaaaaaataaaaaaattggatgctttctataaatttcatgctttgtattttattaaattttgagctattattgtattagtatagaattgagctattattggattgttcttatcactttgttaatttcatttggtcctttagttagatatcaaaatttttaaaattttcaaaaaagatcacaggtttaatcggtgactttcaataatactagttttaacacgacaagcaaaatattgtgcatgtatactattaaattgttaatgttagtactatgaaataacaaattcatcaccattgtaaaacttaatgtttcaacatttcctaagaagaaatggtcaacccttttgacaagacaagctaaattggcatggacaaggaacacagcatcatgatataacccttcacaataattataataaaaacaatcaaatttgtattgaataatgcgaaacagacctgacttatcaatatgtgacgaaggataagcccacgccaaaaacatccacgtaaagaactcattgattaggtccaaagaaatttggagaaaataaaacaaatcctgacgtgaaaataaaaagaaatcatcacttttttttatctcttttattttcttctaaatacaaaaattgaataatcaattaatttttcatgtatgcaaacaatttcttaacaagtcttgtgagctttaaatgaaatatagaggcgagtggattagacttgatcctgatcttttattaagctgatccatattttacattgaaataaaggacacaccgtttaacacgaaaatgaagagacaaataaagaagaggaaaagcattgattctgaaataccaatatagtatcattcgtgaaagaagattttgtaatattccacaaacttagaaattaggggaaaagaaaacaaaaaaaaaagataggaaaaaagagctttaacttttggaattggaagaagcacaaacacacacaaaaaaaaagtctctgttttaccttttaaccccttcaagaatcctcctttaagttcagtgccctcttacttttctcttatcggaatatctctcttcctctgtttcttcgccattctctcagcttttctccttcttcttcgtctttgtcaggtaaagagatacgatgagcatatcccacatacctctctcctcttctcatctttttagtttctcgaaagtttgcatgcgccgactttgttataggttataaactttagttttaagcctattttcgtatgtttatggttgttgtaatagttgagaattcagagtatgtcaagtgaaacttaaaaagaattctatatgtatgtgtgtatgtgttaaagagtga

SEQ ID NO: 6836 - DNA, 3000 bp, Unknown
  misc_feature (1)..( 3000): cDNA_ID_1809022_gDNA_ID_1621108_Annot_ID_171690 3000 nt of promoter + ATG
aatagagaagtggtatatcaaacaaacactactgaataaccgtattggttaatatgaattaaaggagactttgttggtttttctcatgtgggagttggtttactatcgaacctttctaacaacaacgtattcaccagttgataagctgagctcgacatctgtcacaccgtgatatgggaacaagacctgaaaacgtttttaaaaagggaaataatatgttataatggcacatcaatgaggaccaaaaggaatctagatgtagcctgtctttttggttctctaatcaaaaacagtttatgtacatccagttcatacgtggagaacttataatccaattatctctttgatacttttactaccaatataaaccaaagttttaactctaaaaggaaggtattaaagactgaaaagcatacctctcctaagaagtaacccatgctatctgttgacgtgtcatgcatctgagatgcaaacactccattagcttcctcatatgatggaggtggcggcatactgtctgcgcttgagggagtagagggagcttctatacgttgcctctcagataccatctgtaggttcaagaatgttccattttgtccttagttgactcatataatgatgaactgattgttcgacaagaatactattatcacaggaaactgaaagctgtaaaactaatgcacaccaacctctccttcgagctgatcaagtatttggaggactctttgatggtaggcgcgttcagattcaacctgtgatcaggaatgaaaaatacagttgttacatatgggtaagtaaatcaaagttgacctagaaatggatcttgtaaccaatcgcactaccattgaaagaagtcgttcaagagtcaatttctgttgttgatcttcaacggaagctaaagcagaagcagcttctttccccaatattgtcatatttgattttaggtcgtgaagttttgcttcagcagattccagtttcatcaagatgtcaggattaccttgagactctctcgcctttgcttggcgtctggcaacttctgtagcctgtttggattaaagcaggcgcataagtaaagttctatcatgcgaataataaaatgactagttcttggaagaggaaaaaacccatattctactaacggtaattaaatagcttcatggtattatctttcaccgtacctgagcttcagcttcttggcgcattctgtcatagcgttgagcaagatgtctagcatcctccaatggagctcccaaaaccattgcccgtaatggctcagcaacctaacaaattcaggattgacatatgattgtagtagccaaaccgcaataaagaaagaaccaagtgaacaccatgacattaattgacttttaaagagtatgtaacaaattattccagataaaagaaatagatcttcccacaaatggcagtcattccactaacaatggcaggaaagtaattatttgtgtagttatattgcatgcaacagatatgtgctattgcttaacactttgatggaagatgaaaaagacaaacctgtgtaccaagagccttcaacatatttccacgttccttctccatttgtgctcgagcacgcccatagttcagtgcagcccgtgttaatacgttaccattcgtacatgtattctctgaaccatatttcctgctatcctcagacaatttcgtacctgatgaaaaatgagtgcaaaatgaaagacaggcctgtgagccaattcaagtctataacagacataaaaaaatacaataagttaaaactcaaagggtcaaaaaaatcacctatttcaacttgttttgaccctgtaactatataaccttccacaccacgaacaatatctctttggtaatgctgaaaacgaagaacgaatgagtccaaaatcaatagtaatcaaaacttcaaactagtcaaaagcttaagaaaaacaaccttagcagcacgagtggatatgtaaagcttttctagcttctgatgctgattgagttctgcttcatcagctaaaccagagccatatccccctcctccaaattgcttaaagacagccttaaccattccacaaaaactaagtcagtgtactaattaacctcaaactcaagaacacaaacacccaatctcatggtaacttggaacatgtagcaccaatatgttaatctatcactacaacatctttcaaatcccagctcacaaaactgaaacggattctcacataaaagtatcctaaattaccctttgacaaaaacttctccaattctacagaattttacccaatctcacatcgaatcaacgtattaatcacactcagatccaattactcattaagtcaaaaaccatcgatccgaaaaaaagctagcccctttatcatcatcacattattgattcattcaccagaaaccaacgactcaacggaatcacaagagaagataaaaacaaaatctagaaaaaaagatacagaatcgggatctaagcaaatgggcaaaccaaaagttaagaactttaacctgctgctgtctcgcaacttgttctctcaacctgctagcttgttttctaattgcatccattcttcaccagatcaagagctattcacaaatcttcttccttctctctttctcctattcttccactttacgagttccctccgattacttggaacaactcagagaagacagagattcgaaatcgtcaaaaatggcgttgagctcagaacaaatttctctgctttcgaacacgaagaaatcaaagatagacaaagtctctgtttcaccaagaaggttaatattgggctctctataatagcccattgggcttgaaaataaaatccagtaagctataaatttatatcatctcaaaataactaaaaagacgcaaaaccctagacatatataaatgaaaagccagtgaattagggctttctctcacttgttgaagccgcttcttcttcttcctcactgtagctcgtcgtcgctacaccatctagaagacccttaacc

SEQ ID NO: 6837 - DNA, 3000 bp, Unknown
  misc_feature (1)..( 3000): cDNA_ID_2999318_gDNA_ID_1621108_Annot_ID_171685 3000 nt of promoter + ATG
ctaaccaacagtatcaagagctcggagaaccaagtagaacacacacacctacaaaatgaaaaaaaaaaaaaaattgaataagaaaatgctgcaagactgaacacagctacactgatagcatgtgatcgaacacacacaccattttatatgtggaaacatatcgaatcatagttcactaaaatacaatctgcatttactgcagctcagaagaaactgcagaatcaattaataagaatctgcataactcatattgaactaagtggaacacaaactctcaaagccatcggattctacagaagaaaccaatcatcgccgacgtcaacaataaatgagtgtcagatatctggattcctccaaaaattgaagacgttgaccaacacagaggccgagagcgagaagaacttacggcgttacggagctcggtgttgagttgctgaataacgagagaaaagcttcgagaaaccttgtggagcatcgaatagcagaaaccccagtgtggctcaggagggatctgcttctccgctttctcaatcgctcgtttcatcttcaggagcggatatatgtcatccggatatctcagcatcgtccccaagctccccattgtttccagaaaattttgattcagaaaatggaggattcgttgacgacgatctgagattcagagaccacgagggataaattgcaggaaccctcacctgcgatgtggatcgacgcgattcggccagcgaatatcctattttttagttttgtttgttaatttattcatcgatgaaaacaaaggcttctgaattttttttctttcttttttgccagtgagccaactcacaaggattcacattttgtttgtttcttcctttttaattaaaaacaaaatgtcagagccaatgaaattgaaaaagagccacgaaacttaaagaatatcatcaaatggaaatggagagtacatttattctttttaactccctttttcttatgtgttaattagattaaaaaaacagaaaacagagaaaatgtgtttaatataatcagaaattaacaaaattagaaagaaatgatcaaattatagatgttgaaaggaaaaaaaggtatattctaaaaaaatggaagaaaaggtatctttttagtttttattatcataaatgtacgacatcaaatttacatgtccacttatttatttactggcaaactttctggcgacgctgaggtggcaaaataatccttacgtggcaacatataactggttgtaaatacgtatcttcaacagtgtaactaccaattagcacaagataacactcggtggtttgcctctattaatagggtaacttcctctggttatcaaaaacaaacagtcttgaaaaatcaaagaagcaacctctaaacaacacacaatttcgaaaatggcgcagcgatctagggttatcaccatgtctcctctcattctcgatcaagaagttgatctcgatctctgggaagttgttaatccttctgatggcgagttctccgacgattctttctccgtcgatagtctttccgacgatgacgtcatatctcttgacgacgcttcctttgtcgcaccctctgtcatttctccgccgcatgagataattcctattgctgacggtggtgatctcgccgtggatctggatggtgatgatgatgttggcgatgatgtcgttcgcgatgaagttgatgagaatgatcttggatggtctcagcagcggatgatgtttctcggtggaggttctggttattctgttggaattacgtacggagatagtgttaatgacgacggcgaagaagatcgcgagtacgacgattcgtatgatcttgacgaagagttggttccgcgtagcgtgagtaagaaggtggggagacaaaggatgaggaaactggggaaaagagcaatcgccaaggtctatgcctcgaagatatctccgtttttgaagcctggtatcgttcgtggtaagcatggtctcggcatgaaattcaagtgctgattgtgttgggatttcgaagtttcacaaggcgatgggatggtttcttcaagaactctcggtagaatttctcagtttctgggtttaattgatgtgtaaatttgttagttcaatttcaattcctctttagtagtaagtaattcggatgcttctgaagatctcattgtacatgatggaaattaaataactcgcattttaggattcattgttcattaactgatcgctttctttgatggctctttaatttggttgatcagattgtgattgtgaatcttgggttagcaaattgtagtgttgaaatggagaagatgatgaatggatcataataactcttgatagatgagctcgtttaatcttgtgtgaaccttagaattgaaaacgacagctaaactgtagcaatgatttaacaggaagaaggtttgtgtttggtggtggttaatttggttatctttgtagaagcttttgcaatttttgtgaatgttggtggttgtttgaaaagtcatactcgtaggatgtacgcatcactctgaatttcgacatctgagtggttgagactggagataactttattttattttattatatctaacttgttgcatgcactatggacttcgtatatctctctactaacagtcaaacacctatacgataacaagatgctggtgttctcaaattgaacattttgaagcaatttcttttaggaagatccttaaagacaggaagctgattgaatattttggaatttctggataatccgagattttagataagtgacttctgtatagcaaatcacgaaaagaaacgtatagcagatctaatgggcttaatgtgaataaagagataaaatgtaaactggcccaacatggcccatcttatcaataacgatcgtaacagaagaaagagaacacagataaggggaaaaagccaaaacccaccagcttaaataaaaacctttacttatcttctttcttctcacttctcagacctcaatttccaagcagagatg

SEQ ID NO: 6838 - DNA, 3000 bp, Unknown
  misc_feature (1)..( 3000): cDNA_ID_1815690_gDNA_ID_1621108_Annot_ID_171683 3000 nt of promoter + ATG
cgaataatgcaggtactggttatctgttggagctcaaccaacagacacagtggaaagcatgcttttcagggccggtttgataccaccaaagcctatggtagtggtcggttcgaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgttggttaagacttttctgcaacagagtttggtgaatttttattctttaatatgagcatgcctttttacatttaacaattctcactttagactaaataggctttggtaagaggcccatattttcaaaaataagattcattctcaatatctggattgtatgctaaaaaaaggaattaggcccatatttgctcaaaaaaaaaaaaaaaaaaagttatctgcctgaatatgatcttggacattagaacctcgttcttaccttttatgtatatctttacttctacatggtagtagttatataatctcgttgatcttgaaattagttcttattctcatataggtctgaaactcttatattgcttctcttcaaaattttgttccgtctttttggtttcaatatctgccaaaatgtatttgtatcgtctatatgtgttaaaaacacatgcaagagactagtaactagacaataatctatttcaaactaaattggtcttctaataaaaatgttatagttatggaaaaaaggatgtgtctttgggacattacagctctattgggccaacaaaatctctcgcttcgtatcccattagattctctctttctctctctctctctctcttccttcagagatgttcattgttcgtattattacggcatctctggctctgaccctctcgctgcaacatctgtccctattcagacagctatacctctattttcattctacacctaatactttatatttcttcaaaaatccaccctgatcaacttcctatcactatctaagtcattctcattatctttgtgttgttgctctcaagtctcgcccatggaactaacgattctctcagcctctaatcagtattggaccctagtcttaaagattatagtagttaccaagttaggacttaggacttaggatatagacttctgtcaaacaagaaagtgaatgctaagtttagaagcatttgaaagaaaaagtactaatccataaatatctacaagttgtttccaggaaaagaaaaaactcagtggggaaaacgagcacttatggtgtttacaaaatgaaaataaaaaagaagaaaaagttgtgtttgttattttttgggacccttatttctttaatagttgcatagcctctggacgaccagagtccacgaatgtataatcagataccaaaaaagtatgaaagaaatatataaagaaaaggaagaagaaacaatcatggcttggcttacttaaaaagtaaagtagctaatactcttaatcaaaactcacataataaacattagttatgtgtttataatgataagttaatgacctattcatcagaaaaacaagttgtgatatatatacttaatcaaaattcaccacgatctactaatctgctaaatttttattgtttacttgcaaaataaactatataactcaacacttccgaatttaaatttaaatttaagatgactttatgtcaagaagctagtagcatctttgattctttgtacttttcaacttaagtaaagaaaatagaaatgtgattatatggaggatattgatttaatcaatgtgtaattaagagacagagagtgataaggattgggattaagattaggtttaggattgggagaaagatgaagagagaggggtttaggtcgaccaactggttgttaaagatagaaactccttaaccatacatttatataacattttcacaataattttcttctctttaccaaagacttgactccaggaatcaataagcaagaagcaggaggttcaagcaccaaccagattatggctttctgaagcaatatcttcagaaaacaaaataaagtttttatttgattttcttattaccatattatatactattaaataagaaattcaaagttttttttttccattctttctttcttccggaggagggagagtatgatatgggtctttcacgtgtgacattgatgagatgatgaattcaaattatatctcataccaaaaaaaaaacacaaccaagagaaagaggcgtaaccttctgatttctttcttttaagatatcaataaaatctttcacattttctaatttttaattcttttcaagattttgttgtctccttcaacaatccatcagaagtagcagtttggtttccaggtaatttactaatctttttatttctatacaattcttcttttttttttgttgtctatggatttggcttgcatctccataattgcatgcataaccatatattcaagacatgttgaaatcttacatgtttcttagcaatacactgattatatggatcctgctctgtttcaattgtttttgaatctgtctttaatgtcaagcatttcctccataaggttaagttcttacgacctgatcagaaaacaagggactatggaactcaagtgagccaaaaagaacactccatttcgatggagaattatccagaaacacagtttattcccggagattcaatgatccagaatgctatagtttcttactctgaggaatcagccggtagagaaagaagaactgaagctaacaatgtctcagcctcacaagagaggcaagcattgtccagatttgggggagttccacaaatgcagaacattggtcaagatttcggttcttggagagatcaagcgagtgacaggaacggtttccagctaatg

SEQ ID NO: 6839 - DNA, 3000 bp, Unknown; identical to SEQ ID NO: 6833
  misc_feature (1)..( 3000): cDNA_ID_1815694_gDNA_ID_1621108_Annot_ID_171682 3000 nt of promoter + ATG

SEQ ID NO: 6840 - DNA, 3000 bp, Unknown
  misc_feature (1)..( 3000): cDNA_ID_3049060_gDNA_ID_1621108_Annot_ID_171675 3000 nt of promoter + ATG
gctccacaagagccggaatccagaaccagcattgatgataaacatccggttcaaagtctacaagataaaccggtaatcaacaacttacgcgcttataagaaaacatatttattctaattagctacatatatacctcagggtaattttcattgtcaatcttgcaaagcctttgaagaagctctcttgcagatttgctgaagttcttaagaccctaatcactcagaaaacacgcacagttttgaatttacccacttttgaactgaaagagatcataaagaaatgaatttattaaatacgtaccacgccttgcacgtcaagaattgttgtgctctgatcaatgtgtttatttgctgctacagaacaagaagggaacttgaccttgaaagtcttctcgaactctttgacatgatatttcacgtaccggtccattgttgtcacttggagtagcttgttagcatcgatttgacctagtctctcaatgtaaactggtctgccttccttgtcaactccatgatagccttgagggtagtgcttcatcacttcatcaatttcttcgaaatcaaaatcctacatcacatttagaaacatacattatagaactttttaaacccacaagagatgcaaagttggatccaattaaatgctccgagattttaggaaaaagattcacctcaatgattgtgtcagcgccgaaatctttcctccattggatcatgtcactccacatttgcttagctttctcaatgtcaaactttcttgctctcaaaaatctgtttatgttcatcaatacgaaaatataaatcttcttgatgaaattcaatattatttgatataccaagtttttttctttttgaacagactaaggtttttcttttcattttcttcatagttaattttataaaatgttcaaattgtattaaatgatgttaggaaataaagtgttgacaaatctttcttcgcttcgattattttctttccataaatccttttggtctgaatttaaaaataagatttgatttttaaaatatttgaaaaagtttatgtatgcatatatctgtatatgagattaatcagaaaaatatgaaatatttaactttatcgctgaaaacttcttatctttaaaataatacatatggcagtttatttgttgaatatggtcagatatctataatctttgacctaattttctctcgggttatagtctagtccaaactaacaaatcaggtttcaaaatttttaatcttattgacttataagaatactacggtctcgaaataactttgtgaataaggtaagaaaataaagagattgaatagggaaaataatttttttaccgaagcatcatgtggagatcatcgagtttggatggcaaaagctcgtcaaggataagagcttgacgaaaagcatcaagagcttgaagatcttctgcgtcaatgtcgtcctcaatcggaacggacatgactctgctgctgcttctccgaccttttttcttgaaggagttcttgaatctgttggatgcatttatcgctttcttcttcagcgagcttatcttcactatcttcctctcttcctccgacatctctatttctgattaacaatttgtaatttgcattagacttaagaaatatctctgtgaataaaggcaggaaatgtatgaaaatactaaccaggtttggtctcagccatggttagatgagttttaagcactctgtttcacacggcgataatacctaccaagacaacattgtaaagatcacttaagaaaagcttagatcgaaatcgcatgagaaatgattagatgaatctaaagaatcaagatgagttaaatgaccaaaatgtgttttaggatccaaagatgagaaagctagagagaatttgagagagtttatttttttatttttacctctattggagaagattgtttggggagaggtaagggaggctgaagataatggagaggctcatttgaagcaaggtgaaaacatgtagacaactatttagttctgattctaacaatctatatattgacagggtcctcctactgttttccataatatagaaatactttttagaaaaaatccaattaatcctattaaataaatacatagagttagttttaaactaatgaacaacgaatcgtttctaagtaaataaattaaatatgagagaaatatgtctttgtattaggagaagtgcatcccactacttccaacattttgtcgatgataaaaaaacatttgatgtcaacccaagtatctcatgatattgtttttttttgtatgattgtatcgtaacattatctacaaaatttaaactttttacacatacagtgaatttagtttatagtaaacaatggaaaaaccaaataaatattatcattacagtctattaacaattaataaccaagaatcttaaggtttaatttcccttcaaactaattgtaaatgatatatcctgaaatacatcaccacatggtgatattccccatagacggtgctaagatacataagttgtttcttttgttcacatattatatatcattcacaattatacaataggttactacaggaattataacattgtacaagaagccaaaaattcgatctaataataagtgatacacatgacaaactatttcaatattaactattctttataattaactttggaatcgtttctaaaagggcctattttcggtccagttgaggcccaatataataatgggtcgatgctgatttttcttcttcttcttcttcatttaaacgactcagtgtgactcagtcgccgtcgtctcccgccgtttataccctctccgaagccccgagcggccaagacgctacgtttgatttcgtctcaaggttagggttttggaatctcagttttttttttgtaaaaaaacaatatgaatgctgaatttgtttctgtcgattttgcctctgtttgcaatcatgaatgcgtagattcactctgaatggggattgaatttggtgaactccaatg

SEQ ID NO: 6841 - DNA, 3000 bp, Unknown; identical to SEQ ID NO: 6831
  misc_feature (1)..( 3000): cDNA_ID_1807445_gDNA_ID_1621108_Annot_ID_171668 3000 nt of promoter + ATG

SEQ ID NO: 6842 - DNA, 3000 bp, Unknown; identical to SEQ ID NO: 6829
  misc_feature (1)..( 3000): cDNA_ID_1808243_gDNA_ID_1621108_Annot_ID_171663 3000 nt of promoter + ATG

SEQ ID NO: 6843 - DNA, 3000 bp, Unknown; identical to SEQ ID NO: 6828
  misc_feature (1)..( 3000): cDNA_ID_1809097_gDNA_ID_1621108_Annot_ID_171662 3000 nt of promoter + ATG

SEQ ID NO: 6844 - DNA, 3 bp, Unknown
  misc_feature (1)..( 3): cDNA_ID_3093183_gDNA_ID_1621108_Annot_ID_171656 3000 nt of promoter + ATG
tct

SEQ ID NO: 6845 - DNA, 3000 bp, Unknown
  misc_feature (1)..( 3000): cDNA_ID_1815690_gDNA_ID_1621108_Annot_ID_56030 3000 nt of promoter + ATG
tatttgcataaggctacaatccttaattcatttgcttctctcagtcatgtttggttgtttctacacctaatgcatttcatctggtgcaagttttctgtgaggcttggttttgcttgtatgattgatttgattagactggtttaaaagtctaaatccacacagttcttggtgtctaactaaacttcttttttattttgtgcaactgttgaaagaaattgattttcactctatggtactcgaataatgcaggtactggttatctgttggagctcaaccaacagacacagtggaaagcatgcttttcagggccggtttgataccaccaaagcctatggtagtggtcggttcgaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgttggttaagacttttctgcaacagagtttggtgaatttttattctttaatatgagcatgcctttttacatttaacaattctcactttagactaaataggctttggtaagaggcccatattttcaaaaataagattcattctcaatatctggattgtatgctaaaaaaaggaattaggcccatatttgctcaaaaaaaaaaaaaaaaaaagttatctgcctgaatatgatcttggacattagaacctcgttcttaccttttatgtatatctttacttctacatggtagtagttatataatctcgttgatcttgaaattagttcttattctcatataggtctgaaactcttatattgcttctcttcaaaattttgttccgtctttttggtttcaatatctgccaaaatgtatttgtatcgtctatatgtgttaaaaacacatgcaagagactagtaactagacaataatctatttcaaactaaattggtcttctaataaaaatgttatagttatggaaaaaaggatgtgtctttgggacattacagctctattgggccaacaaaatctctcgcttcgtatcccattagattctctctttctctctctctctctctcttccttcagagatgttcattgttcgtattattacggcatctctggctctgaccctctcgctgcaacatctgtccctattcagacagctatacctctattttcattctacacctaatactttatatttcttcaaaaatccaccctgatcaacttcctatcactatctaagtcattctcattatctttgtgttgttgctctcaagtctcgcccatggaactaacgattctctcagcctctaatcagtattggaccctagtcttaaagattatagtagttaccaagttaggacttaggacttaggatatagacttctgtcaaacaagaaagtgaatgctaagtttagaagcatttgaaagaaaaagtactaatccataaatatctacaagttgtttccaggaaaagaaaaaactcagtggggaaaacgagcacttatggtgtttacaaaatgaaaataaaaaagaagaaaaagttgtgtttgttattttttgggacccttatttctttaatagttgcatagcctctggacgaccagagtccacgaatgtataatcagataccaaaaaagtatgaaagaaatatataaagaaaaggaagaagaaacaatcatggcttggcttacttaaaaagtaaagtagctaatactcttaatcaaaactcacataataaacattagttatgtgtttataatgataagttaatgacctattcatcagaaaaacaagttgtgatatatatacttaatcaaaattcaccacgatctactaatctgctaaatttttattgtttacttgcaaaataaactatataactcaacacttccgaatttaaatttaaatttaagatgactttatgtcaagaagctagtagcatctttgattctttgtacttttcaacttaagtaaagaaaatagaaatgtgattatatggaggatattgatttaatcaatgtgtaattaagagacagagagtgataaggattgggattaagattaggtttaggattgggagaaagatgaagagagaggggtttaggtcgaccaactggttgttaaagatagaaactccttaaccatacatttatataacattttcacaataattttcttctctttaccaaagacttgactccaggaatcaataagcaagaagcaggaggttcaagcaccaaccagattatggctttctgaagcaatatcttcagaaaacaaaataaagtttttatttgattttcttattaccatattatatactattaaataagaaattcaaagttttttttttccattctttctttcttccggaggagggagagtatgatatgggtctttcacgtgtgacattgatgagatgatgaattcaaattatatctcataccaaaaaaaaaacacaaccaagagaaagaggcgtaaccttctgatttctttcttttaagatatcaataaaatctttcacattttctaatttttaattcttttcaagattttgttgtctccttcaacaatccatcagaagtagcagtttggtttccaggtaatttactaatctttttatttctatacaattcttcttttttttttgttgtctatggatttggcttgcatctccataattgcatgcataaccatatattcaagacatgttgaaatcttacatgtttcttagcaatacactgattatatggatcctgctctgtttcaattgtttttgaatctgtctttaatgtcaagcatttcctccataaggttaagttcttacgacctgatcagaaaacaagggactatggaactcaagtgagccaaaaagaacactccatttcgatg

SEQ ID NO: 6846 - DNA, 3000 bp, Unknown; identical to SEQ ID NO: 6837
  misc_feature (1)..( 3000): cDNA_ID_2999318_gDNA_ID_1621108_Annot_ID_56031 3000 nt of promoter + ATG

SEQ ID NO: 6847 - DNA, 3000 bp, Unknown
  misc_feature (1)..( 3000): cDNA_ID_1815686_gDNA_ID_1621108_Annot_ID_56035 3000 nt of promoter + ATG
agaaaagtttgaaaagggagcaggctggtgaggagtgacgagagcgtaatgggggaaaagagaacgtgtcacattttcctcttattcgtcgattcacgacgcatcatcatcatcactctttcccttttcttatcttttataaaacatggagtagtttttatcatttttgacgtcaagaaaatgggagagagtttcaagtcctgtaatcaatgcaagtggtttttgagttaatgattcttgtattcgcaatatctctaggcaaaaaaatgtagaataatatctaacctattataaagttttacctaataaaacattaaaaacttcaatagatttacctaaaatccaatctatcattgtgatgcaaatgtattgttcgaatcaatgacatcaaatcgcatattagaaatttagttgctatattatcactaagtaaaataaatgaggaaaaaaaagatatgtatccaaatgattttttctttcacataaaaataagacaaaacgaaaacgagagacgaaaaaaaaagttaacacagaacataatcattgcgttttaacaaaagcataatccatttgaatacgtaatcattcatcacggaccatagtcagaataaaatgtaacaaaatctcaatgtcttaccaggacctaataagtaacaactgatcattattcgaatcaacaaattatataactcaaattatacaaaaagaattgtgtaagagatgcggaaattgctagtttgtcgaataattgaagaggtaaatcggggtagtgcaaattattttattttatttcgattacttcttctcaaaagttttaacctttttacagtttgactttgatgtaaatcctaatcttgtccatttaaatatttgaagagagagcaaatccagattccaaaaatgaaaagaagaagtgaagaactaagacatataataaaaaaggtaaaacatgataaacaataaagatcatccatcaaaaacgagtccaaaaccagtcacaccaatggcgacataacattaggttcttttttttttttgccagcgaaaaaacaaacaaatctataatcccctaagctccgatgatttctgttggctcctcaaccattgtctcatcagctggcctgtctaccttcacaccaacatcctctgctgtgtaatctccatgcacctaaagataaaccaaaacaaaaagagttagatttcattacatccttggaaccaagactagtgcatcaatgatgaaattaatgtgacttcaatctacctccatgagctttccaaggtcaaacttgggagcctttaggatcttcactttacggatgaacacattctgcaacgggtagatgccctgtgttgccttctcaatctctcttccaatggcctctgggatgaacttggccactagctccttgaggtcacaagatgaagcctccttcaccataatctcactcatctttctgcggatctacaagaatcaagaaacatttacaaggaaaatgttaatcttctgtttacagaaagccaaatagtaagcacatggtatgataatgttgtaacctgacggatttggctggattgagcgtaacaggtacgcttcacttggttagcacgtctctttgtgaaggcgatgcagaacatcctcaaggtgtagccgtctgtggttttcacatcgacatgggcttcaatcaaagtctgccacttcttcaccaatgaccttagcttgtcggttgtgaaatccataccctacagagatcacagattaaaaaccgcactctgtatcaatatgccagtaaaggagtggtctttatcttacccagaactgggtcaacacattccttccctgaacatcttcagctctaagacggatcttcctgtaggcattatcctcatcattttgtagatcagcaagagaaacctcaaacaccctgtgtttcagtccctcagaggcaatctgtttaaattaagagatagcccagataacaaagtcagatttgtcgaagaggaacacgctcttttctatcacaaatgcaattcctattacttcaataatgaaagccaccaagagcaaatgcccatctctacacctcacattcagcaaatgacctatgccatgagataactatagactcaaaacctagaaagctctaacctttctccagtatagtaatagaaagacataagacattaccttggtaccctgagtcctggaaacaagagtcttcccaacattcctgttcgtgaaagaaccaggagccttcacgtcataccaatccttcttggagaagggatcaacactgcaccatccataacaattcaatcacgaacactatatacagattacaattagaaatctgagaattttattcaggacataggttacttacgccttcttctttcctcctttcctaccctttgaaatcctcttgttcttcctatatgatcaaacaaaaaccttaaatcagaacatgatatactcgaagctatgatcaaatgagagattccaatacagagactggagaaacaagcaaggaatatagagatgcgaagagagatttacccgacagccatggttaagggtcttctagatggtgtagcgacgacgagctacagtgaggaagaagaagaagcggcttcaacaagtgagagaaagccctaattcactggcttttcatttatatatgtctagggttttgcgtctttttagttattttgagatgatataaatttatagcttactggattttattttcaagcccaatgggctattatagagagcccaatattaaccttcttggtgaaacagagactttgtctatctttgatttcttcgtgttcgaaagcagagaaatttgttctgagctcaacgccatttttgacgatttcgaatctctgtcttctctgagttgttccaagtaatcggagggaactcgtaaagtggaagaataggagaaagagagaaggaagaagatttgtgaatagctcttgatctggtgaagaatg

SEQ ID NO: 6848 - DNA, 3000 bp, Unknown; identical to SEQ ID NO: 6836
  misc_feature (1)..( 3000): cDNA_ID_1809022_gDNA_ID_1621108_Annot_ID_56036 3000 nt of promoter + ATG

SEQ ID NO: 6849 - DNA, 3000 bp, Unknown; identical to SEQ ID NO: 6835
  misc_feature (1)..( 3000): cDNA_ID_1815684_gDNA_ID_1621108_Annot_ID_56037 3000 nt of promoter + ATG

SEQ ID NO: 6850 - DNA, 3000 bp, Unknown
  misc_feature (1)..( 3000): cDNA_ID_1815803_gDNA_ID_1621109_Annot_ID_56049 3000 nt of promoter + ATG
ttgaacttttatcggaacatctcttactatctcattgacaaaaggttcagtagtctcgacctgagcagtggcaagattggcgttatgtaaagtatctctttcttgatgatttgaatgattgaggaagctttgttgacccgtaaacttatccgtttgttggattctcatgatatcatctggacgagaagcatagaaagctgagctcacatatggcacatacattgtagaaccatcatttccctcccgcataatcggatcagaatgcatatgaggaaaagatgtctggcacatatgacaatcatttaccctttgaaaactttcagccatagttacttgttgatagaaacttccatcggggagaacaacatggttagatggtggaacttgagacccgccataaccatcaaatggtataccaggagaaatcgtaccttgatatgcagtgtttcttggctctgtaggaagcggtactaacttttgagcagcatgatagttccccaacagattttcttgggtttgcattaccgggttaatcaaaactggtgtggaactaatctgagaattcaagggagccattgacatgtgagcagcaggaaggaactggtgggatgagacacttaaaggactatcttgaaaaggttgttgggagaacaaagaagtactacttggcaaaagctggataggtgaatgaacaatatctggttgtcttaaagcttcttggcgagattcaacataggccggtggatgatgttcagatggtgtagtatacccctgttgttgctgctgcatcttaccaactattggtttctctgaaacagtctcaagctgaaaagaatgaggcggatcggcgtggacagtcattggcacaacataagcagaagagcgtggatcaggaggaacaagtcttgatacattactatgataagtctgaggtgaaaaattactcgaggtccaagtagttgcgacaaaatcactctgaccaacgcccaagctatcaacaacatccacgccactaaaatcagaattcggattagaactaccactagctacactttccttactcacaacaacaccattcacagcctctacatatctctgcccaatatcaactccatcaccatactccaatattccgaaagaatcatccacctcagacgaagaagcatcaaacaaaaaaactctcaacttccctgacccatcagaagatctctctaccaacttctcaaactcctccatcatattatcaatatcttcactagatgaaacagaaaccaaagcatcaagatcctcatcaggaagctgatacttaacaacaacagggtgaccataaacctgaatcatcttttgctcaaattcatcaaatctcacattctttttaacactaacgatccttgtttgaccaccaacgtaacgtaacatgccatcacttggtctagggattatctttccattgtagctacataaaaacttcaccttttccaattcttcatcatccatatcacttcttttattgcctaaatttggattgtttctattcgtagcatcaatacttacctgctcactcccaaacccagaaataattccatcagagacacgcttattactcaaatcagagctataatctaacccagaagctgaaagattggccggattagaaacaagattcgaacttgggctactgggttcatgtgccattgtttggagcagggagagggatagggtttatgattactcacctggtcagtatcgtggtcgtcgtattcgaggaagaaacgaagaatcctattttgtagagagaagaagaaaggagaggcaaagcgagtcgttggaactgatacaacgacgacgtttcattgggagtatcaaaacctcaatttggattttctctgtagtctttttagaatttttctaaaagggaaacacgtgagagatgggaagaggcacgtggtcgagcctcatgcaaaagaatggttgcgtttgttttccaaactgcgagagaatcgtgtgtgtaaatgctcccagttccaacactcgacatgttttttttgttttaggttattactgattattcttgaacttttagcaaaataatgaaacaattttgacttttataacacacaaaaaaagcaatacaatttcaaataataaatcgattaagagataaaaattgtgataatttggatattttaattagtttgtgcaatattcttttctcgttgatctctataaattagagaggcaaatgcgactgctaggagtagaaccttaccattggactacaaacgcttttgtgtttaagttgactattaaatttagatatctgattgtttaggatagtttaaaacgctaccgttttggaatctttatacgctaccgtgttattcttctttgaccaaaattctggagaatttgtcttcccttcgtatttctggcaacttttttaatactaaaattctctctaaagccgtcaaagaccaaaaaaaaaaaaaaaatacgaactcgaaatctctctcgtcttgttgttgcttaccattgaagctatcaatttctccgtttgatttctctcttctcaaaacctatttcgacggattattccgattcctgtttccccgaccttcacgcttcgtacttttgttttttgaaaaattcgtgtttcaggtacgttctcgatttctatttcgtttttttctgattcatcaatgaaacaaaatcgtttcttaatatacttgttgttctttgattcgattgatttttgttaggaagagcgcatgtgtagagttggtggtgtaattcagaaaactttccggagattttttggtgatgtgttgttcgtaggtaaattttgaaattttggatttaatggttgaggaagatagatggtgtttcttcaatggatctgtgaagacgagattgttggagattgatacttatcttattcgtctttatggctttgcttgattaagaaattgtgtgattgttttggggaggggtttaaacatg

SEQ ID NO: 6851 - DNA, 3000 bp, Unknown
  misc_feature (1)..( 3000): cDNA_ID_1815799_gDNA_ID_1621109_Annot_ID_56050 3000 nt of promoter + ATG
aaatgttccaacactttgacaatctgccagaattccggtctcttgtctgtttgcgatgaccaacatcgctcgatcagctctttcatggccgctggacaatccgtcggtataactggcctaattttctggccaatatcgaaacaatgaaatgtttaataacaactgaacaataatgatctaactcagtcagatctatgcaagatcacaatcatgaaataaggaggagatgcagaatgatttaccttgtatataactagatcacaatcatgaaataaggaggagatgcagaatgatttaccttgtatataactgcgtaggcaatttgttcagcaaatttcatctcctcatatggaagtgctccagctaccatttcccataaaagaagtccaaaactataaacatcgcacttccgtccatgtggtatccgttttaaaacttcaggtgccatccacctataagttcctatgttatcccccaaaacatcacagtactcctcctcgcacgctatgccaaagtcagcaatcttcaagtgaaagtcattgtcgatcaacacgttttctggcttcagatcctgatgaactatctctcttgagtgaatatattccattcctttagcaatatccagaccaaaatcgattagctgttccaaaggaagggatttctgctcgagcttgtgcagatatgatcttaaagaccctcgaggtacatactctgtgatgatacagtttccagtattcactccaacaaactgtttcaggacacatcaatcagaggaaaaaagtcaaacaaaccataatcataattttcaaacagagttgaaagatgtaatgttaattttcaaaggcatcattcatatttgatacaacctaaccaacataatataacatgatataaactcaccttaacgacatttggatggcttagtcgagataaaagagtggcttccacgataaactctttttctaaacgagctcccaagaatatgtcgtcactatcctcaggcgctgtgataatcttcagagcaacagctttgccttcatattcaccatgataaatctggctatatttcccgtgagcaaacctatccccataagacaacttagacacatcaatgaggcattcttcaagcactcctgcagaacttactttagaacctctatagtcaacagactttgaagacttcttatctatcttgctctttcccctctctttaactttctgcgtactaagatccctaataggacccgagtgagacagggaccgtagattaactgattttttctcagaagaatctttgcgggacgacgacttggccttcattcccttctctggttccactcttctaggatgtggagtagaaaacctcttaatatcagactttgcttcgataaaagcatcagaaagagccatatgaggcaacggagaaacagatctcttcttattagtaactggattcctctgcacttcagtaccaacaacactaccacaactcaaaccagtcagctgctgcgtactctgacaaattcctacaagtgatttcaaatcagatggtgaactcaaagtcattcttttcaatccagaactcttctcttggtttacagtaaaaggcatagattctaaactcggcgtaatcatacgataacaaacagtatgagagaaatttgctctcctaatccaagaagtaacctctccatccatgtttaaacccctccccaaaacaatcacacaatttcttaatcaagcaaagccataaagacgaataagataagtatcaatctccaacaatctcgtcttcacagatccattgaagaaacaccatctatcttcctcaaccattaaatccaaaatttcaaaatttacctacgaacaacacatcaccaaaaaatctccggaaagttttctgaattacaccaccaactctacacatgcgctcttcctaacaaaaatcaatcgaatcaaagaacaacaagtatattaagaaacgattttgtttcattgatgaatcagaaaaaaacgaaatagaaatcgagaacgtacctgaaacacgaatttttcaaaaaacaaaagtacgaagcgtgaaggtcggggaaacaggaatcggaataatccgtcgaaataggttttgagaagagagaaatcaaacggagaaattgatagcttcaatggtaagcaacaacaagacgagagagatttcgagttcgtattttttttttttttttggtctttgacggctttagagagaattttagtattaaaaaagttgccagaaatacgaagggaagacaaattctccagaattttggtcaaagaagaataacacggtagcgtataaagattccaaaacggtagcgttttaaactatcctaaacaatcagatatctaaatttaatagtcaacttaaacacaaaagcgtttgtagtccaatggtaaggttctactcctagcagtcgcatttgcctctctaatttatagagatcaacgagaaaagaatattgcacaaactaattaaaatatccaaattatcacaatttttatctcttaatcgatttattatttgaaattgtattgctttttttgtgtgttataaaagtcaaaattgtttcattattttgctaaaagttcaagaataatcagtaataacctaaaacaaaaaaaacatgtcgagtgttggaactgggagcatttacacacacgattctctcgcagtttggaaaacaaacgcaaccattcttttgcatgaggctcgaccacgtgcctcttcccatctctcacgtgtttcccttttagaaaaattctaaaaagactacagagaaaatccaaattgaggttttgatactcccaatgaaacgtcgtcgttgtatcagttccaacgactcgctttgcctctcctttcttcttctctctacaaaataggattcttcgtttcttcctcgaatacgacgaccacgatactgaccaggtgagtaatcataaaccctatccctctccctgctccaaaca

SEQ ID NO: 6852 - DNA, 3000 bp, Unknown
  misc_feature (1)..( 3000): cDNA_ID_1815780_gDNA_ID_1621109_Annot_ID_56057 3000 nt of promoter + ATG
ttgataccggaacttcaatgtcttgtccgcatgttgctggtgtagctgcctacttaaaatcgtttcacccacgctggtctccctccatgatccaatcagccatcatgactaccggtatgcaaaatcatatccactctgttttctgaatattctcatcattttttttactcacaacataactttcttgtattgcaagaaaacttataatactctgttttttggtgttttttgtagcttggccaatgaatgcatctacttctccatttaacgagttggccgagtttgcttacggagctggccatgtcgatcccataactgcaattcatcctggactagtctatgaagctaataaatccgaccacatcgcctttctctgcggcttgaactacactgcaaagaacttaagactcatctccggtgatagcagcagttgcacaaaagaacagactaaatcgctaccccgaaacttaaactatccttcgatgactgctcaagtatcggcggcaaaaccattcaaagtgattttccgtagaacagtcactaacgtcggtaggcctaacgctacatacaaagcaaaggtagtcggttctaaactcaaagtcaaggttgttccggcagtcttgtctttaaagtcattgtacgagaagaagtccttcacggtaacagcttccggcgccggtcccaaagctgaaaatcttgtctccgcacagctgatctggtctgatggtgtccactttgtgagaagccccattgttgtttatgctacgaactgatgagtctgaaccagttaatgtttctatctgttcatgctatatgtttgttgttgtttttattttttcctccatcactttagttctaaacatcaaatctagttatttttgctgttcttgtagaaaaccttgttgttttaaatttcgaaatggtcatgagagttttgatttaatttggagaatgatcgatgtacttgttttcttaaataaaagatattgattagaatcacattctactcttaaaattaggtatatgtaacgctaattaaggttttgagttttgtagcatatctattgttttttataccactttagatcagaaccttacaagagttgaaatacaaagggtaaatacatatgttggcaaggaaaacaatccttccaagaactaagccggcgagcacaagacatctcccggggactaagacagatctaatggggaaaaaacccaaattaaagaacaacaatgatactaaacctaaactttcaagattcattactaaaaaaactcaaaactgaaaagcaaagtctaaatccaaattttttaaattaaaacagatctgaaactatagatctatccaaaggaaataaaaccaagactctccttaccataaacggcgctgagacatcaatcaacatcccgggacccaaaagacaaagtctcaagaagaaaggaaggagatctagatcttcaatggagagagatctgcatctgaggcgttgaaggatagaaaaaaacctgcctctgccatagttggaacggccagaattgaaactgcagacgaaggagacaaacaagcaacaaaaccggaagaggaaaagatttagactttacagatttagatctgagaatttagaaaagaaaccgttagaagaaaataggattcagatcacattaaacccacaagaaatcgaaactagagacactaaaacaaagaaatccggttccggtgctgaaaaagccaccggaaccggtaaccctaggcggcggcggagctttgtagagagaaaaaaaaaatttgttttaagagagagaaggagttgtcgtcagtatgttttcatttctattgcagtcaaaaaaaataaaaaaaaattcatttctattcatccatataaataaaaaccggtggtgttggtttaggtgatctatagttttattaatcaatgtgaacatatattttaattatttcatgaaaataaaaatgaatacaaattctaccttatggagtctgaaacatacgttggacccatagtagaattcgttttctaccttacacattccactagatcaaccggtactaagaatcttccaaacatggccattggaatctaaagcgacaacgaccttgttgcagaaaaagtcgtcaatctaagtacaatcgctaatacattttgactttttcttttgatggtcattttcgcaatttcttcattttcccaaccagttctggccacctacacttatttcttggaaaattatttgtttttcaatcggtatgtatatagaagctaatataatatcatcaaaaatgaaacgacattaaaaattgttataggagttatttgatacagttcttagttactttgctctgtagaaagtatagatacatcgcctgtaaaatcaactaaaacaaatataatcgcgtggagaatatttcgttcatgtaaggtcaaatgataaacctctgccataattaaccaaatttcagaatatacattcccatagtttttcaattgcccaagtaatactcatttctctagtcataataaagttaaactataaataaatccatttctggtgaagttagtcgattttagtggtttattaagaagaataaaccgtttttaatttatttataaacgagaattaatatcaagtcaaagaaggttatttatttatcaagttttttctttgtcaacgataataaatatcaagtcaaaagaggttctttctatttaatgttttttttgtaaatattttaatatgtttgctgtattcatgaacaacaatacaacaaaaaaagataatgcaaatattagcaggaaagaaaaacggtagtaaattaaatggtatattcaaaaccattaatataactagaggaacaaatcttaaaggactttgatgcgtttttagatcatgtacataatcttaaaggactataaataatcgtttcatcctcattcttataaaatttgataataactaaataaagtaaaccaataaaaaatg

SEQ ID NO: 6853 - DNA, 3000 bp, Unknown
  misc_feature (1)..( 3000): cDNA_ID_1017117_gDNA_ID_1621109_Annot_ID_56059 3000 nt of promoter + ATG
atatacaaataatcacattaacactaaacaataaaattgaataaattcagtgcacctctctccggtgacatcttgaagaatactagtgtgatgggacataggcatgtagtcaacacgagcaggaagtgcacccatgtatactatatactcctacaagtatcatcatcatagttatggttagtcattagtaatataattagaaccatgatatgattataataatcaaataacgaagaaggatttgtgcaattacctgtttgtcttgatcatctttgtctgctgaagcgaaactcacaacaagcaaggcaaagatacatgagaggagacaataggagacagcaggttttgtcatttttttgattgatttggttataatcaaattttacaagattgtgagaatgaaaggattattatagggagagatactgtatgtacatagaacgtaatcaaagtcctcatcaaactcctttaagatttgtttctcaaattattcttatatattaatgacagtataatgtactttccatattaataggtttttgaatgcaccgtttaatttgctaccgtttcttgttctactaatccttgcatcatcttttatttttcttttacttgtattgtttgttcatgaatatagagaaaaatattaaatagaaagaattttctttgacttgatatttattctcttgacaaaagaaaagattgactaaccactagaagttaattttttttttattatgactagaaatgagtataatttgggcaattcagaatgatgggaagtaaggaatgtatattctgaattcggtttattaattatggcagcctaatcatgggtaagaggttcatcatttgaccttacatgaacgaacgaaatattctccacgcgaatattttttcttaaaagtacttttgcaggcgatgtatctaattaattaacctttctagagaggtaacaaaaaatgtaccaaagaaattaagaactgtatcaaatattatccttaaaatatgaccacttgtgaaaactctatgtgcatattcacatttatagatttaatttagatattgtgactaaatgtactcttaatagttagggtgaattatccaatagaaagcaaatatagtatacaaatagatgtatgcaattgtatgtatcggctcctctttcgtccacgcgattgccttcttttgtgctgtattcgtttaaaatcaatagcaacgtacaattgcgtcaagactaatcagcaagaattgcgtcaggattattcataacctaaagtaataaatgtttaaataggtcaaatatatactttttgaaaatacgttacgggagtacataacaccatatattctagcgcatgtaatttctgagtcgaaaagttggagagttgcccaagaactagaacatgacattgatgcggaggaagaacctgaagtagttgaagcttgtgagtatgcgcacgttcaaagaggagaagctatgtgccaaattgacgcttcgtggactggtattaaccagaatgttagtttggggttcatgttgactagctcaacgaccaagctgtttggtcaaagtagccagaattgttatcgcaatgccctctacgcagaactcggagctcttctttggacaatggagtgcactttacaacaaagtatccaatctatacattttgaaaccgattgcttaagcttacttaagatccttgatgaaagtaaagattggccggtggaaaagattttgctagatttaaagctagttttggtcggttttctttatctcatattccacgcactatgaatgtccgtgttgtctgcctcgcaaagagtgcaagagtacgaggtgtacttttttcccatataaaccctctcgtttcggagtagttggcccacgaaactaactttttcgaacaaatttaattatttgatgtttttgcgataaaaaaaaacaaaaaaaaaacttggtttattagagggcacaaaatcaaatttataacaaaatgaagttattacgttaggttgaaaaaaagtatgacgtttcagggattaataatttagcgttaatgacttaatggtcctcatcttcatcagattagaatgtaacattctatatgtgtcgcaccaaaagactagtctcgtcctctatagctattagcctattaccatcgcaatctccgacgtattttccactagacttgtagcatgttgccttctaaagccgccacatgatccactaccatcttcatttgcccatcggccatcgccaccagaaccaccacattgtttaattatattatatggatcagaactatattcttacaaatattatgggaagttgggaatgtagtggtcaattcatcacatcctcatttcattattttcttcttctattaaagttgttaattcgacattttcaaattgacgttgcttattatcattaccacactcacaaatacaatcattgctctttaacgcaattataaagctcaaaactacatttccaataataccccttggaacatgctcttactttttgccagcctgctaacgaatcattagttgccacatcagcacgataactgaagtctttgtctttttctcaaacgcgacgtcgtttctattccctgacacagagatacgtatagatacaccgtatattcactttattgctcctctcctctttctcacgaagaagaagacgaagcccatcaaattaaacaagaaaaattccattttcctccattgattgtgagtgagaacaaacatttaaagcttcttactcaaagtttctttctttatagatctcaaaaaattcgatatttttctcgattcatccgccattaaggtacacgaatcgtttttcgtcttctgaattacttgtgggttcgtcttaatttcgttggatctgggtttgattttggagaaaagtaataaagtttctgtcttttttttctttcgaatttgtaggttttattgcgagatcgaagagagaaggagaaa

SEQ ID NO: 6854 - DNA, 3000 bp, Unknown
  misc_feature (1)..( 3000): cDNA_ID_1019253_gDNA_ID_1621109_Annot_ID_56060 3000 nt of promoter + ATG
atgatggctgggaacaaatccgatctgaaccacttgagatccgttgctgaggaagatggtcaaagtttggctgagaaggaaggtctctctttcctggagacatctgctcttgaagcaacaaacgtcgagaaagcgtttcagaccatcttaggtgagatctaccatatcataagcaaaaaggcactggctgcacaagaagcagcagcagctaattctgcaatccctgggcaaggaactacgattaacgtcgatgacacatctggaggcgcgaaacgagcatgttgctcttcttaaactaaaggtaaactgtttatttcggttgctccttgttcagagattcaaacttttgttttcactggcttctcttcttttcaagttttggctgatgaaacgtaactatgcaagactatgtagaatactctgtttttattctcttcggtttggggtttgtgttcagtttaaagcttgttagtagtatacttagaatcttctggtgcttgcttgctttcccttcttcttcccttggtgtgtttctattgatttctggtttataaagtattttttctatctccggtttagtccggttcgtcttggctttgtttaatcaaatcattgattcctctcttatcaatgtattgtatccggttccaaaatcctctcttcatgttacacactgacaagcttctaccaaagaaaataaattttagtattacgaaagaaaaaattgttgacaaactaattttgctccatctattatcacaaataaaaatgcaattgaactgcagttactatcaaataatggctatggttttttattttgttttgaaccgaccaaattaaaagatgttttgaattaatggtattattttcaagtaaaatagaggaaagtgacgacgatacatggagacagaaaaggagtgattgagaaaccgataacaaaaacgtcattgtagcccaacttgcaaaaactaaccaattgcatgcatgaaagagtttataataaatcatggaattttacattgtcaacgtgtgaggtttttctttttggacacaacccaaaaggccttttagttctaaattgtttcatattagaaaattctaagttcggaaatgctatacatgaaaattcttggtgatttctaatgagcaaaataacatgaaaattcttggtgatccattatatatatttatgcgccgagaaaccattcagagaaacaataaggaagatagtaaaacctcatctttctaatcgataacttccatatccttcgattaaaagcttttgatcaatgcatagtccaaactttatactcacatatactcacatacccataatttagaatttagatctcatttaaattgataagctatttttgtagttataaaatacataaacccatccaaaatattatcattaagacaaaatattagaataggtatattaaaatagaataatgagagataacatttttaagaaataaacaataaagaatcaatgcatagtaaaaatgaatttgttatcttgtaaatacaatataattttatcgcctgttttgagccttcttgcttctatattattccaccctgagcacataaaatatttatcatggtctatttttattgttacccagtaactcttgttattctctaaaacttccacttgaagaccacttggaggcattacaaaattttctatagtgcgtagtatcttctctatctgcaattttggttaatataacctacccatgtgggaaagatcggtgtttgtaagaactttctctaacattttattttgatccatatcaagccaaatcactattttactaaactcttaacaaatttagaaattttaaaaaatgtttgtagaaaataaaatgtttgaagactggagctctacacatatgtttatatatagttctcggccaaaccaatgtgctttgtcttcaaaccctttaacaaaaaaaaaattgtgctttgtcttcaacttttaaaaaaaaaatgaaaaaattaatttgtccaaaaaaaaactctaaatgtagtcaattatatggatatatattctaatttttgtaatattaaatgaaaatattttctaatatgttatgtttctaaatttttacacttgttaccaacttgaagattaaactaattatagtttttttctaacatcaaattaattattaagcaaaaaatttcttataacaatcttacttttttagtcatttttattttaaatttcttccaaaatttaataaaaatcgattacattctttagaaaaataaattcagttaatactatcaaattgtattatttcaaaaacacttaaaaattgcacacttggcagcttatagttttcgattgatgtactttttacaataactcttttttaaaaaaagtttataacatcaacaagaaatttagtaattaatgtttaatgagattttcttttatagatttttttcattaaactttacaagtcgaccatggcattgtccctatgggatccactaatattataaagaaaatctatacaaattaaccatgaattctatataaacctttttttgtgaatatatttatgaagtttgtgaatatttaatatttttttgtttgacctaataataacagcagaaatcgacgtcgatacgaaaatatatatatatatatatatatatatatatatatatatatatgaaaaaaatgaaaatgtgtcatttatctaaaacgaaaaaaaagaaaagaagagaagcttttttagttctctctgcccaatggagaaaagaagaaccagagattgccaaatcatcttctgcaaaagcacccatcaaagaaattacttgtaaatagaaaacaaatcatcaaatctggaagacaaatcattaaaaaaggcgacaactttttttggttcagattttgaaaatttgattttttatttttcttatcttggcgatcgaatcctatccgaaagattgaaacttgggaggtgggtaagtgagtga

SEQ ID NO: 6855 - DNA, 3000 bp, Unknown
  misc_feature (1)..( 3000): cDNA_ID_2030742_gDNA_ID_1621109_Annot_ID_56064 3000 nt of promoter + ATG
aaattaaaattttataacacaaaataatggtctcgaagaaacagattacaaatttagaaccaaatattttgctcttaccaatttacaaattaaggtaaaaacacacaacaagagttcaagacaataaatcatgaaagtgtgtacacaaaataaactttaaaactgaactttcgtcccttccaagtttcagccgaagatgcacatattcatgacaaaagaaaatctttcatctttcttttgttaatggagattgatatgatcaaattaccctaatgactactctctcaaataaagaggttgttgtagcacttagggatagaattccataaagttctcggatcacacaatagattaatagttttgaataaagctaaacagaaaatattataaatgtaaaagacaagaaaacaataaatgagattggttgtagattcaaatgattaaaacgttgggtttaggaaaattctcaggaaatatcataataatagatctagcagtaaactaggattattaacgaaccattctagaactcaaatcactaatatacaataagcggtggtgttccgcgaaactcactatgcttaatagtattgatcccaactctcttgtaaatccctagagttaagcaagcattataatcaggtttgataaattcacctaagtaatcgacgctagcacgcatctaaatagtaggctcatctaagatagtttcagtaatagatacatatggtgcgtatacctattatcctaaaatcaagttctagttagttactctaaaactaacattaagaacaatcaaagatgaaaaattctaaatatattatcctaacagggttatcgatctactagttcatccaaatcctaaatgagaatccctaaacccaacaaagaactactcaagcatgatcatagaagaacaaaacatgattgaataagaaatcaatgatgaaattaagaagagaaaagagtttagaagaatcttctctaaagggagtctctaccgggttttgctcccaagaataaaagagataataagagttaggtctaaacaatgaccataaaattcaatatataagttcctaaaacgtgacgggccttcttgaaaataaggaaacgttctaggccgaattttataatcttcaaaacttcaataaattgcgcaattgaattgccgtcaagtattagtgtcgctcgacaccaggggttgtgtcgattgacacctacgtcaattttcgtctcaggattgcttctacagcctaagttgtatgttttgttcaagaatgctccataatctccaaatgcatcccaaacatgtaaagacttgaaaaagactagaaaagactctacaaataacaaaagaactctaaaaactatacctagatcatagctaaaagcagtgaaaatcgaggtatatcagagatgaagttgagaaaattatggaaagatgaacagtcttagagctaaaacacatcatccactcataacctaaaatagtgacacatcaattatttctttaaattttagattagggcagttaaaattttccagttatcttacaactatacacaaacttgtgaataatttttgacaaaaatcacataatgtaatatatttatagtatataatccaattatgatattaattcattaaaagttaatacatacatatattattcatttgcaaaatactttaatctgatttcataacaattcatcatatgaaagtcaaacttgactattgatgatcatatttataaataagggtttacatggtgagtttttaaagaaaaaatctataccatgaaccaaacattagatttcttattcatctaatcatttaaggatcacaagatttggtgatagttaatttttggaatcattttaactttcgttgatgatatttggcccactattgatgggtttatattaggatttattacgttgtgaatctattttatataccgaacttgaaatttatatcatctacagaaaatctgctaggacgttgcaaaaatataagagtagttttgatattttgaaaatattgtattcaaattaatattgaaaaacagcacattttagatcatttatattttaattaatacgtatatctaagattatataagtgtcaacttttaattttaagtgttttttctttttatgcatgacggtcaatcacatcaaattttttaacgagacacatacatattttacattattattgcaaataactactaaccgaataaaaatctattgaattttctgagattctctccggcttgtttttgctacgatgatacaaaaccactgcaaattgcagcatctgagtctggttagtgcaaaaaccgataaaagaaggtttttagaggaagacgaggagaaaaaaccaatacaatagatttctctaactgaatgtcccagtttttattaaaccgtttcttcagatttccgatttagattaatcagcgcgtgtcttccggttcctgttcgaattggaaatgtcagtttcttcattcagttgaaaagttcattagcaaaacacaattgcttaggaatatttatttgtatagaaaaatataataaatataaacagtctcaaattcgatgattttctctattaacttgatcgctgttctctgatttaactgatccctcaaaaccgatatcaaattctgatttaactttaatttcattttggatacaaatgatattacgtgaaaatattgtagcaaagctgaaagtattttaatatctgggcccgcaggatcaagattctgtggcgaaaagttcagaccaagccacatcaagatatgttaatgacgtggcattctattattggctatgaatctgttctggataacaaaagcatcatccgtaaaaaacacaaacaacgaaagtcttttttgcactcgccatggtgtctcatcttcaatgtatggcatccacattgtttacttgaggtacaagcaaaacgtctaagctcgtcgacctcctcttaatg

SEQ ID NO: 6856 - DNA, 3000 bp, Unknown
  misc_feature (1)..( 3000): cDNA_ID_1839107_gDNA_ID_1621109_Annot_ID_56068 3000 nt of promoter + ATG
gtgtttggtatcttgttctgcatctaaagaaactctctttacagcaatctgtgcattagaagagagctttcctttgtagactgtcccgttagcctctgtaccgaataactcgctctctttgaaccctttggttgctttgtagagagctttgtaagaaaacctctgaggactgtaatcttcctcccattcttctcgtacttcttcatacttgctgttcacatacattgatcttaatgctgctcccattcttagaaatatacctgcaaacatgtcagattttttgcagattctcaaggcagcttttagtcctctattgtcatcgttgtttctgtttggtgatttgtgtgttgtgggaaattagtagcagaccactttcttttcaggagaaggtcaactgttgtaccaggaccgtccattcttgttatttaatggtatttcatctctgataatggtattttattatactagtggcatttaaagtctccaatgaagattttcattatgagttatatgtaatttatattgcaacattgaacaggttcatctctttgatcacctggatgaattaaatactcaaatttttatgaagatgcaatattttcttcttattacagaagtcaactacaagaaggaaggaaacaaaaaccaaaaaatgagtaaaagaacaaaagaagatgtattagaatttcttatgtatgtatacaacagacttcagacaaaatgaatcttggttttggtatgataacataactaatagggggaaaaagaggattgaaatagaaagcctctttcttacatagaggctttgtaaacaatgaaaaacactctctgttctttagtttggttgaagtatctttccatgattttctgcttcaacaactgcagcagaatcaaatgcatcagaatacaattgcaggtgtgtcaaattgttaatagttgaggaataaaagaggaactcactttcatttgtgttggctacaagaggagctttgttgtctgctgaatttgaagcaggtgccatgtttgtggctgcaccaaaactagaagtctgagaagaacctttacgaggactgatagctttagatatcactcgagaaagttctctatcgtcttcgctaggctcaaacttctgcgatatgtattccttcattgatacgcctttgtcccatacctggttacaaacacaagatgattgactgatgtatttacctaaatgcacaaacagatagagaactttgtcgtaccttggtattgaagccagtgggctggttagttccggcagtgttgatttctgcaacatcatttacctcttcttctcgctctgttggttctggaaaagccatatcttgaatcttcttagttatagcttgagttgcgtcagagactttagcataaccaggtgctagcttctctgtcacagtttctgttactgtcttgcttggactaataggttcctgctggctcgtgcactctttccttgtcttctcagacgattctgttactattgttgttgtgtcagaatcagcaggcttctcttgcttgacatcagataaaacattcttctcagagatcacaggatgttctgttttggaaccattacaatctttttgttcttgttcagcgtcctgtttggctgggagaacagacaagacatttgtctcagtgatcacaggattctctcggggatgctgccttgctgtctcctttaactcttcaggtgccttctttgattcatacactgaaaataacacaagaagatcgatcagttttaagcaaattcctaaaagggtggttgttacttatgaagctttgttcaatttcatttacttggggctccaagatattcaggatcttcttcttcttcttctcctccttcttctctgactttacggtcttttgacttgtcacgtggtgacaatgacgcataaccaacttctctaacttcatgatcttcggatctgcaaaacggtgacatggttgcatcaccttcttcatcatgtctcttcttggtgctgagactgtgctgcagttttttcgccttatccttcattttagagaacaaagatttcttatggtgagaatgttctccatcattttcttttcttggtgaaccagaaggtgaccgctttgaagcttcaccagctgaaaaaaagtatgacaaacagatttcaaaccaagagtttgcgtccaaaatcatcaaatcactgagagtaaacaaaatggatattatcatttcttggagagacttacattggtgacgctggctaagtgttgagaagctaggatttccagaatgatcaacatgtgtttttaagctttcgagctcagcgacggggtctagttgacgcgacatttcagaaacacaaagttcttgtagatgttctgtttaggaactctgatcctctgagaacaacataagatagatataagacaagaaaaactgtgcatgtcgtcttgtttctccgaggttcttggacaaaccataagaaaaaaaaatgcttaaaatagtcatggtctcttattggagaagcatgaagggaagacaaagtcttggcctgagaaattgacgtttgaagctgaattataggactcacatttgtagagttttctagagaaaaactggaaccataaataacaaatacactgtttaaagaacttaagcaaaacttgtctctgaactttaatgaccaaaatattaagactatgtgagaaaaatgtaagaacacatttgtctggataaaatgcataagttacagaattatcacagactaaacatttttcaagaacctagtcagaagtttactcatttgtctcactgaaactgcgtgctgtttctaactaaagtaaacgtcacgcagttctatgttaaataaacaaaacgtaatgtagtctaaaaggaaagtctctctacctgcttaaaacccaaaagtacattttttcgccgaagccaaaaatcttcacttgcttcttcttctctctgaaaccttatcttctccgccc

SEQ ID NO: 6857 - DNA, 3000 bp, Unknown
  misc_feature (1)..( 3000): cDNA_ID_1815748_gDNA_ID_1621109_Annot_ID_56070 3000 nt of promoter + ATG
agacgaggcttgttgagattgaccaacaaaataggcaaaaagagagatgcttacaacatagttgaagatattagaaccctgaagagaagaatcttggatataactcgcaagcgggagacttttggtataggaagcttcaatgagcctcgaggagagaatattacaaatgttagagtgaggcagcttcgacgtgctccacctgttgatcaagaagagctagtggttggtttggaagatgatgttaagattcttttggtaaagcttcttagtgataatgagaaagacaagagttatattatctccatattcggtatgggaggtctaggaaaaactgcacttgccaggaagctttacaactcgggggatgtgaagagaagatttgattgccgtgcgtggacctatgtttctcaagagtataaaacaagagatatacttatcagaattataagatcgctgggaatagtttctgcagaagaaatggaaaagatcaaaatgtttgaagaggatgaggagttagaagtttacctttacggtcttctagagggaaaaaattatatggtggtagtagacgatgtatgggatccagacgcgtgggagagcttgaagagagcattaccatgcgatcacagaggaagtaaagtcatcatcacaacgcgtattagagcaatagctgaaggtgtggaggggacagtctacgctcataagttaaggttcttgacgtttgaagaaagctggacgttgtttgaacggaaagcattcagcaatattgaaaaggttgatgaggatctgcagagaactggaaaagaaatggttaaaaaatgcggtggattaccgcttgctatagtcgtgctttctgggcttttgtctaggaaaaggacaaacgagtggcatgaggtgtgtgctagtttatggcgacgcctaaaggataactccattcacatttccactgtgtttgatctaagctttaaggagatgcgacatgagttgaaactttgctttctttactttagcgtcttccctgaggactacgagatcaaggtagagaaattgatacacttacttgtagcagaagggtttatacaagaagatgaagagatgatgatggaagacgtggctcgatgttatattgacgagctggtagatagaagtttagtgaaagctgaaagaattgaaagaggaaaggtgatgtcttgtagaatccatgatctactgagagacttggctatcaagaaagctaaagagcttaactttgtaaatgtttacaacgagaagcagcattcttctgatatttgcagaagagaagtggttcaccatcttatgaacgactattacttgtgtgacagacgtgtaaacaaacgaatgcgatccttcttattcatcggagaacggaggggttttggttatgtcaataccacaaacttgaaactgaagctacttcgagtgctaaatatggaagggcttttgtttgttagtaaaaatatcagcaatactttaccagatgtgatcggggaattaatccatttgaggtatctagggattgctgatacttacgttagcattttaccagcttccatctccaatttacggtttctacaaacactagatgcgtcaggcaatgatcccttccagtacacaaccgatcttagtaagctcacatcactaaggcatgtcatcggaaaatttgtgggagaatgtctaataggcgaaggagtaaaccttcagaccttgaggtctatctcttcctacagctggagcaaactgaaccatgagttactcagaaatcttcaggacttggagatctacgatcactctaagtgggtagaccagagaagagttcctttaaactttgtttctttctctaaaccgaaaaatctccgtgtcctaaagcttgaaatgagaaacttcaagttatcatcggaatcaaggacaacaattgggttagtggatgtgaactttcccagtcttgagtctctgacacttgtcggaacaactcttgaggaaaactcaatgcctgctttgcagaagttacctagactggaagatctggtcttgaaagattgtaattactcgggagtgaagatcatgagcatcagtgcacaaggttttggtcggttgaagaatcttgaaatgtccatggaaagaagaggccatggattagatgagttgcgaattgaagaagaggccatgcctagtttaataaagctgactgtgaagggccgattagaactaactaagctgatgattcctgatcgattgaaagcgtttgttcgacgcaactaaaatatatgctgatgactgctgaaaggaaaaagctaaaaatgcttttataaagtgtttatttggtatttgtatatttcccttcttggttatacatatgtattattcttatcagcaaaaatgatgatgaagaaacgagttcactagcaggagacgaaaggaaaatattttaggtcgtcacaagactaaaaatcatgtttatcattacaataactttgctgatacataacgaaaaatgtgaatccttcacagattaaacttgggacatttagaggtcaataacttatctggctatactaactatacaataataacaaacctagcttttgttggaatgtcactttcataattcggtaaaatgttcgttagcgtgtggctatccaacacaaaggaaggttaacttatatgttaaagaatgcaagaatataatacgttagttgtatatattgtcaatcatatacgccagaaaaaagaatacttaatggtatactaatatcatcttcacagcctgtaaccatgccgggtcaatagatctgagactaaaacttttccattaattaatttcactagttgcaccgtgatttgaggattaatgatgtagcatgtggtaagatcttctttaccaaacaagtgacgtgtcaacctttatgtagaaatctttttcatggagatacaaagagagatagaaagatagaggacagagaaatatataggggttaagga

SEQ ID NO: 6858 - DNA, 3000 bp, Unknown
  misc_feature (1)..( 3000): cDNA_ID_1815740_gDNA_ID_1621109_Annot_ID_56072 3000 nt of promoter + ATG
aaacaaaacaaacagaatgaacacgcttttattggaatatataatgtcattttcttctttctattatatgtcacgttagcgtgtggaaatgttattattgcattaagacaaagtcgtagtatgcgtcacacgaggaacacgagagagttgttgtcacacgaggaacacgagagatagaatgagacgacaaaaaatgtagtttgcatcgcttaaattgaatattagcatcattagaaaaataaaattaacatcaattataattgatgtaaatgaattttacatcacttatataagtgactctaaattggtgacataaatattttgcattagttaaactaaatatttgtattattaattataattgatatgaatatacatcagttgttaaaaatgatgttattttctgcatcacgtaatataaatgtattatattagctacagttatgacaaatgaatgattagctacagttatatatttacatcagttggtcaatgtcccgtacacagctttctcaaaattgaatgatttattttgataataattcctacacgatggaaggtcatttgccttgaggaagttagtggaaaacaagttattggttaaagaaataaaatgaggaatgcgttaattcttataaaaaacataaaatacatttggtttgagagttattgatgtagcatgtgaccatgtgtcaagatttatttgctatgtaagtatgtgtcaacctttatctccacagctaagtagttgacttgctggcatttaataaaacacaatgttgaatagtcagtggcgtgtgtttctacaacacaatgtaaggctattgttgctttaaaaagtagacacttgactatataaaattgtctcctttgaaagattatggaattttagtaattttgtttttagcggaattaccggttataggggtgtcaaaatgggtaacccaactcaactcaactcataatcaaatgagtttaaaattaaatgagttatgggttgacccaacttatttaacaaaataagttgggtcaacccataactcatttaatttgatgggttgagttgttaaatgggttaacccatttaagtaataatttaattaattattattataaaaaaataataaataattatcattattaattcattatcatcaaacttaagatatttacagattccacttttcacaggtttacgtttttggtaccgaaaatcacggatttacgtttttggtgggaaaattataggtttttacgttttcggccggaaaatgatgggtttacgtttttgacggaaaaatcatgggtttacgttttggacgaaaaaataacggatttacgtttttggcgggaaaatctcgggtttacgtttttggcgggaaaatcacgggtttacgtttttggcgggaaaatcacgggtttacgtttttggcgggaaaatcacggggttacatttttggtgggaaaatcacggggttacatttttggcgggaaaatcacgggtttacgtttttggtgagaaaattacgggtttacgtttttggcgggaaaattacgggtttacgtttttggcgggaaaattatggatttacgtttttggcaagaaaatcacgggtttacgtttttggcgagaaaatcacgggtttatgttttttggtggaaaaattacgagtttattttttctcaattgcatcgcttgtatatttaagaattttggaaaaatattaattttattaaattggtttagatgtgtttgttaaacttaaattggcattggtttagagattttagttggtttaattcaaatttacaaaatttgatgggttaattgggtaaaccattgaaaccattaaccattacaacccaactcattttactcatcaaaccaattgactcatcaacccatttgacccatcaactcatttgagtaaaaaaatttaagggttcatgggttgagttgagttgagttgacccatgaattttgacccattttgacacccctaaccggtcattatataataatttttattatttaatatggtagtttattttattaaaaaaaaaattatatgaagatcttttacacaaaacttttatgtttttaatagagttatcgactatcacatcatcgatatacgaaaaagttatattgcagtgacttttaaaattttagtattaatctgcatttatttaagatatagattttttttacaaaaaaaaaggttacataaaaggttcttttacacaaaatcctaaatgtaaagtatcctttaattattttgtcatcaattctaaaaaaagatattattgtactaaattttaaaagagaaagacaacacatgtcataaaaatagaatgcaaatatcggtgtctgagaggtcgttttgaaaaaattttacttcattatataagattaaatacgttcataatactattatgggaggaaaaagttagaaacacagtgactttttcattggaatcagaagaaagatccaaagctcttgacatgccctattatctttggatttccttgtgtagagaggcacaacacaagcttcccagttcttgaaatcatttttgacaaactcttaagaaaccttctgaaccacttaaatacaatttcaacagaattataaggtcatattgaccataacaagccaattgctttaaaatgacagcatatgaaaaagaagaaccccatgatttgagagttattggtgattcatgtgttaaaaacttctctcccacgaaaatgatgtgtcaacctcatatttcctgctgatattcatgtgatttctcacgcaacacaacgtattaatcatagccgtgactagttggcatttaagaattatatcctttggaagatcttcgaatctacacgaaatgggattttaataattctacatatggatcacattcacctatatatatatagatatgctatgcattgagataaaacatgagatagggagagagtgtagtagagagaggggttaagaa

SEQ ID NO: 6859 - DNA, 3000 bp, Unknown
  misc_feature (1)..( 3000): cDNA_ID_2687434_gDNA_ID_1621109_Annot_ID_56073 3000 nt of promoter + ATG
aacaagccaattgctttaaaatgacagcatatgaaaaagaagaaccccatgatttgagagttattggtgattcatgtgttaaaaacttctctcccacgaaaatgatgtgtcaacctcatatttcctgctgatattcatgtgatttctcacgcaacacaacgtattaatcatagccgtgactagttggcatttaagaattatatcctttggaagatcttcgaatctacacgaaatgggattttaataattctacatatggatcacattcacctatatatatatagatatgctatgcattgagataaaacatgagatagggagagagtgtagtagagagaggggttaagaaatggagaaaagagtagagaagagaaggatagtgttggttccacttccattactaggacatttcactccgatgatgcaactcggccaagcccttatcttgaagggattctcaattatagttcctcagggagaattcaatcgagtaaactcttcgcagaagttccctggttttcaatttatcaccataccagattctgaactcgaggcaaatggaccagtcgggtctctaacacagctcaacaaaattatggaggcaagcttcaaggactgtataaggcagttgttgaaacaacaaggcaatgatattgcatgtatcatctacgacgagttcatgtatttttgtggagccgtagctgaggagttgaagcttcccaatttcatcttcagtactcaaactgctacacataaagtttgctgcaatgttttaagcaaacttaatgccaagaagtacttgatcgacatggaaggtatacaaaaactagcttattacccattatgcttactctccttatgttcaacataattttgttttgactttgcagagcatgacgtgcaaaacaaggtagtggaaaatatgcatccattaagatacaaagacttaccaactgcaacatttggagaactagaaccttttttggagctctgtagagatgtagtcaacaaaagaacagcctctgctgttatcatcaacaccgtgacctgtctagagagctcgtctctcacaaggctgcaacaagaactccaaattccggtgtatccattaggccctcttcacattacagattcatcgacaggatttactgtgctgcaagaggataggagctgcgttgaatggctgaacaagcagaaaccaaggtctgtcatatacataagtttaggaagcatggttctcatggaaaccaaggagatgttagagatggcttggggaatgttgaatagcaaccaacctttcttatgggtcatccgacctggatctgtctcaggctccgaggggatagagtcattgccagaggaagtcagtaagatggttttagagaaaggatacattgtgaaatgggcaccacaaatagaagtactaggacatccctcagtgggaggcttttggagccactgtggatggaactcaacactcgagagcattgtggaaggagttccaatgatttgcaggccttatcaaggcgagcagatgttaaatgcaatatatctagagagtgtatggagaatagggattcaggtaggaggtgaactggaaagaggagccgtcgagagagctgtgaagaggttgattgtggataaagaaggtgcaagcatgagggagagaacccttgttttaaaagagaagctcaaagcctctattagaggtggaggctcctcatgcaatgcattagatgagcttgtcaagcacttgaagacagagtgaagaattagaatgcaatgatttttttgttaaatggtttttttaaagagttaatgatgcatatttttcaaagtagatgattttctatgcgcaaataaaaaagttattggaaccagaggaaagatccaagcttttcaaattcaaggaacgtcattgttctaattcgtatttaacattcccaattatgtatagatcatcacaaaaattctatattgaccaaaatatgcgtttactctttcgaaaatgttagcttcttccttcgttgaaagttattgctttcaaaagatatatgaagaatacttaaaatggtatagcaaccctttgatgcaataattgaaaccaagattggagaaccatgcatttagccacttttgagaaaattttattatatttggagactagaaagtaaaacctcttagcatttttgttattattatctaaatctcaagacaaaacctacccaatggtgctcaaaaccaccaactcctatatctatctatatgagacaaaacaaaataaaacaagtttttcttggaattaatgtcatactctcagtaaatataaatgggattttaaccaaaaaaatactttttagtcaacagatttttaataataatttagatcacttatttagagttgttcagcaatgatgttatactaaccaataatcatggatgatgaagatgcaggtatgacttatgagtgataggtaaattttgtcaaagagaaattgaaagcctccgtaagaagtggagtctgagtgaaaacacggtgctaaactttgctaaagacagaataaatcaaatgaacttcatgtaacatataaaaacataagtaatagaccagctttgatttttatagatcaagcttgttcttgcaaaaattacaaaagtagatgctttgctatgcaaataaaaagctttcactttaattctcatacaaagagaaaatacgtaatggtttgagagttgttgatgtagcttgtgactttatcttcattaccacgtaattgatgtgtcaacctttatcttaacagctaaagtagttgacttgttggcatttaaaatctcttttagaagattatgttgaatagtcattggcgtgcgattattcttgctttgaaaaatgaacagttgactatagaaaatggtctcatttggaagattgtgggattttagttattacttggatcacgtataggattcagagacaagagaagagaaaagaggagagaa

SEQ ID NO: 6860 - DNA, 3000 bp, Unknown; identical to SEQ ID NO: 6859
  misc_feature (1)..( 3000): cDNA_ID_2687434_gDNA_ID_1621109_Annot_ID_171758 3000 nt of promoter + ATG

SEQ ID NO: 6861 - DNA, 3000 bp, Unknown; identical to SEQ ID NO: 6857
  misc_feature (1)..( 3000): cDNA_ID_1815748_gDNA_ID_1621109_Annot_ID_171752 3000 nt of promoter + ATG

SEQ ID NO: 6862 - DNA, 3000 bp, Unknown; identical to SEQ ID NO: 6856
  misc_feature (1)..( 3000): cDNA_ID_3049089_gDNA_ID_1621109_Annot_ID_171750 3000 nt of promoter + ATG

SEQ ID NO: 6863 - DNA, 3000 bp, Unknown; identical to SEQ ID NO: 6855
  misc_feature (1)..( 3000): cDNA_ID_2030742_gDNA_ID_1621109_Annot_ID_171746 3000 nt of promoter + ATG

SEQ ID NO: 6864 - DNA, 3000 bp, Unknown
  misc_feature (1)..( 3000): cDNA_ID_3049093_gDNA_ID_1621109_Annot_ID_171745 3000 nt of promoter + ATG
ggggcttattcctgctcgaaatgttctagttacgttgttcattcattatgtgcaactagaaaagatgtatgggacatggtagaactagaaggaacaccggaagaagaagaaattgcgccattcgaggtggttgatgagaacacaataaagcacatgagtcatgatcatgatttaatattcaacaatgatggtataaatctccatgaaagcaagctttgtgaagcatgcgtctcccagatcaatactgatccgttctatagttgtgagctatgcggttttattttacatcaaacatgtgctaatatgcctaggaagaaaaggcatgttttgtgcaacatacccttctctctacaaacagacgatagcaaggattcttcacgcctaagaagaaaatgtagtctttgtctccaacatttcactggatttgcgtataatctgcatattgcgtataactcgcgtaccgaagttatggatatacgatgtggttcgatatttgaaccatttgttcatgaaaggcatccacatcctttatactacaagttcttcaccttttcggcggttgcgaagtgcgacatctgtcacataacaagaaggcatttgttatgttgtgaagagtgtgactttaggttggatttcaggtgcgcaactttaccaaaaaaagtaatgaagcaaaggtacgatgaccatccacttttcttgtcttatggtgaaaataatgtggatggtgaatactggtgtgacgtatgtgaaaaaagggtagatgcaaagacatggttctatacatgtgatgcttgtggggtcactttacatgtttcttgcgttgtgggtgacttctcctatcatatgccaggaccattatcaaccgtagttagcgaatacaaaatggtaccgcccgcggtagtaagcttatacaaagtggtgccaaacacttcgatttgtagaccactttgctccaggtgtcacactagatgcaaactcccttgcattcttgaaacctccgaggatggtgttaatgtttacttttgttctaatgattgtcataaaaatccttgggagtcgtcgtattattagtagcgcacttggtttatttatttctttctattttcttatttacttttcaaagagtattttactttacgtttattattaataatgataggttttgtttgtgaaacctatctaaacaattgagagcgttgaaggattttatcgggttaggccaagggatagttctcttgggagagtttttctcttgttatattatcgttttgtttatctactatcataataaaagttttggttttgaattgcattctatcttgtacagttatcatctttcttttacccaaaatttgctttgctttcttttcattctctacattttcacatgtcgatatatgaatcccctagtgttatatgtacaatttatacatatatgtatccgacatgcactaaagggtacttccattcatggattcttatctaagaacactaacacttaaaacatagtgttctttactagtagatgttgattgtatatggagaaagcaccgaatatatgctctggtttctccgctgtttcacctctggtagcccaatatttaaaattataaaaatggcatctatgttttgatttcccgagtgaagaaattttttaggtgttcttcaggatgcaagcttccttatattcttcaaatacaggaaacttttgttgtaataagtgttgtgggaacactcacaactattgtggtcataatttgttctcaatagttgtagtgtatgatgatagtaatgttgtgggaacacttaatgtacagtttctatcgttgtttttctcttttgccaacctccgtgaataaaagaatgttttacataaattatagtttttttaaatacttgcatttaatttgatcaaatcagtatagtgctttttatataattaactagtgatcaaactaatttattcaacaattttagttatactgtcttccaaaagcagtgataaatttaatcttatggtactttctttttttgttgctatcggaggtttcttgcttaacaagcaagtagcgttcttctcttaaactatttcccctacgtaagccgccaaacatgtaccgccaaagcagcttcatcataacaatagattcatggtttttccgttttcaaggagtttgctctaggctctagcaaattgtattaatattctacaatttaataaaaggcaaaataacacattcgtcacaaacataggatccgcacaagtggaagttaatataattaagattagagttgtaattgggcagactataagtctataacgtactattaggatccagtgatttaataacagtattattgtgtatttttaatgaattaaaatcggcagaattagctgtctctagtgggatctgcaaccacggaaacagcagagaaactagtggcatcgacaagtaaaaccccgttgctcttgtgttgcttgtatctcaagaaagcacagttcttcgctatttcgcctccgggaacccaatactcacaccaaaacctatatatgtgcaagatgacgatcgttttgttctcccggattaaattggtagccaactagctagctcgtacgttgaaaataaaagtcatgaaagggccaaaaaaaatcttatcactaatcttggatctactcaagtggatgattgattatacataataacataaactataaagtagttgtatggaatttctataattctatgagtacgatcaaaatatttaataacacagataactattatagagacgacttttatttggagtattaaaaatgaataattcccggaaagtatggatgtatgtctataaattattttcttcgatcgagttgagagattgaatcgttacagcaattaaaaatctcattccatttaagaaaaaaaagaaaaaaaaaaaaaaaagtcaccttttccttcaaatcacaagagattaggttgatttggatatcattccgcg

SEQ ID NO: 6865 - DNA, 3000 bp, Unknown; identical to SEQ ID NO: 6854
  misc_feature (1)..( 3000): cDNA_ID_1019253_gDNA_ID_1621109_Annot_ID_171743 3000 nt of promoter + ATG

SEQ ID NO: 6866 - DNA, 3000 bp, Unknown; identical to SEQ ID NO: 6853
  misc_feature (1)..( 3000): cDNA_ID_1017117_gDNA_ID_1621109_Annot_ID_171741 3000 nt of promoter + ATG

SEQ ID NO: 6867 - DNA, 3000 bp, Unknown; identical to SEQ ID NO: 6852
  misc_feature (1)..( 3000): cDNA_ID_1815780_gDNA_ID_1621109_Annot_ID_171737 3000 nt of promoter + ATG

SEQ ID NO: 6868 - DNA, 3000 bp, Unknown
  misc_feature (1)..( 3000): cDNA_ID_2186844_gDNA_ID_1621109_Annot_ID_171759 3000 nt of promoter + ATG
atgagtgataggtaaattttgtcaaagagaaattgaaagcctccgtaagaagtggagtctgagtgaaaacacggtgctaaactttgctaaagacagaataaatcaaatgaacttcatgtaacatataaaaacataagtaatagaccagctttgatttttatagatcaagcttgttcttgcaaaaattacaaaagtagatgctttgctatgcaaataaaaagctttcactttaattctcatacaaagagaaaatacgtaatggtttgagagttgttgatgtagcttgtgactttatcttcattaccacgtaattgatgtgtcaacctttatcttaacagctaaagtagttgacttgttggcatttaaaatctcttttagaagattatgttgaatagtcattggcgtgcgattattcttgctttgaaaaatgaacagttgactatagaaaatggtctcatttggaagattgtgggattttagttattacttggatcacgtataggattcagagacaagagaagagaaaagaggagagaaatggagaaaagggtagagaagagaaggattgtgttagttccggttgctgcacaaggacatgtaaccccaatgatgcagcttgggaaagcccttcaatcaaagggcttcttaattactgttgctcagagacagttcaatcaaataggctcatcattgcaacactttcctggttttgactttgtcaccataccagaaagcttacctcagtctgaatctaagaaactaggaccagctgagtatcttatgaatctcaacaaaacaagcgaggcaagcttcaaggagtgtataagtcagttatcgatgcaacaaggcaatgatatagcatgtatcatctatgacaagcttatgtacttctgtgaagcagcagctaaggagtttaagattcctagtgttatcttcagcactagcagtgctacaattcaagtttgctactgtgttttaagtgaactcagtgccgagaagttcttgatcgacatgaaaggttcccaaaatagcttaatgacccatttcgaaagcagtcggttcactcattacataatttttgttttcttactttgcagatcctgaaaagcaagataaggtgttggaaggtttgcatcctttaaggtacaaagacctaccaacttcaggatttggaccattagagccacttttggagatgtgtagggaagtagttaacaaaagaacagcttccgctgttatcatcaacacggcgagctgtctagagagcttgtctctgtcatggctgcaacaagaacttggaattccagtgtatccattaggccctcttcacattacagcttcatcgccgggacctagtttactgcaagaggacatgagctgcattgaatggctgaacaagcagaaaccaaggtcagtcatatacataagcttgggaaccaaagctcacatggagaccaaggagatgttagagatggcctggggattgttgaatagcaaccaacctttcttatgggtcatccgacctggctctgttgcaggcttcgagtggatagagttattaccagaggaagtcattaagatggtaacagaaagaggatacatagcgaaatgggcaccgcagatagaagtacttggacatcctgcagtgggaggattctggagccactgtggatggaactcaacactcgagagtattgtggaaggagtcccaatgatttgcaggcctttacaaggcgaacaaaagttaaatgcgatgtatatagaaagtgtttggaaaatagggattcaacttgaaggtgaagtggaaagggaaggtgtagagagagctgtgaagaggttgatcatagatgaagaaggtgcagccatgagggagagggctcttgatttaaaagagaagctcaatgcctcggtaagaagtggaggctcctcatacaacgcactggatgagcttgtcaagttcttgaatacagagtgaagatgcttaacttcatatattacaaaagaacttcgattataagaaaactccaatagaaatgtttacattctttggaatattaatttttgtcttccgttaaagttcataattatcaaaatttaaaacttgaacaatttttgtgttttatgaaaactagaaaacagtctttccacattaaattcacaatattctaatttgtgtgattcaaactagagatgaattttgtatggatatatgtctttgaatttgttgttttgaagaaggacacgaaattgaatacttcctctgtttcatattagttgtaatttaagatttttacacacatattaagaaatcataaaaatctcatttaatctacctcttttatataaaaacatcatttattataaccaattcaaccaataaaaaaatatataattaaatataattagttaaatggtattaaataaataaaaacccttaaactacatttatatagaaacagagggagtatcaatttttttttttaaatgtcgattcaaaatctttagtagactacaaaattgtttagtagactacaatttttagataactttgtctatcattttcccacttgtttagtataggagcatttttgtcagttcaaaccacattaattcaaaattatgacagtttggaaaaaaataaaaatttatggcattattggtaagtttattggtcaaagtggcaaccaaaacttttggtcaagtgacatttttggtaagttttttggtcaaagtggcaaccaaaaatattattcaacatgcaacccaaacttttgaagaaaatttattatatatggagactacaagtaaaaagcctcaagacaaaacctacccaacgtggttaaaaccaccaactcttatatgagacaaaagagaaacacacttttcttggagtgtttccactttattacttcattcagaaagactagttgtcacacaaggaacacgagagtcgagagagtaatatatatatagagagatagagcttaagcaatggagaaa

SEQ ID NO: 6869 - DNA, 3000 bp, Unknown; identical to SEQ ID NO: 6850
  misc_feature (1)..( 3000): cDNA_ID_1815803_gDNA_ID_1621109_Annot_ID_171726 3000 nt of promoter + ATG

SEQ ID NO: 6870 - DNA, 3000 bp, Unknown
  misc_feature (1)..( 3000): cDNA_ID_2186844_gDNA_ID_1621109_Annot_ID_56074 3000 nt of promoter + ATG
gtatgacttatgagtgataggtaaattttgtcaaagagaaattgaaagcctccgtaagaagtggagtctgagtgaaaacacggtgctaaactttgctaaagacagaataaatcaaatgaacttcatgtaacatataaaaacataagtaatagaccagctttgatttttatagatcaagcttgttcttgcaaaaattacaaaagtagatgctttgctatgcaaataaaaagctttcactttaattctcatacaaagagaaaatacgtaatggtttgagagttgttgatgtagcttgtgactttatcttcattaccacgtaattgatgtgtcaacctttatcttaacagctaaagtagttgacttgttggcatttaaaatctcttttagaagattatgttgaatagtcattggcgtgcgattattcttgctttgaaaaatgaacagttgactatagaaaatggtctcatttggaagattgtgggattttagttattacttggatcacgtataggattcagagacaagagaagagaaaagaggagagaaatggagaaaagggtagagaagagaaggattgtgttagttccggttgctgcacaaggacatgtaaccccaatgatgcagcttgggaaagcccttcaatcaaagggcttcttaattactgttgctcagagacagttcaatcaaataggctcatcattgcaacactttcctggttttgactttgtcaccataccagaaagcttacctcagtctgaatctaagaaactaggaccagctgagtatcttatgaatctcaacaaaacaagcgaggcaagcttcaaggagtgtataagtcagttatcgatgcaacaaggcaatgatatagcatgtatcatctatgacaagcttatgtacttctgtgaagcagcagctaaggagtttaagattcctagtgttatcttcagcactagcagtgctacaattcaagtttgctactgtgttttaagtgaactcagtgccgagaagttcttgatcgacatgaaaggttcccaaaatagcttaatgacccatttcgaaagcagtcggttcactcattacataatttttgttttcttactttgcagatcctgaaaagcaagataaggtgttggaaggtttgcatcctttaaggtacaaagacctaccaacttcaggatttggaccattagagccacttttggagatgtgtagggaagtagttaacaaaagaacagcttccgctgttatcatcaacacggcgagctgtctagagagcttgtctctgtcatggctgcaacaagaacttggaattccagtgtatccattaggccctcttcacattacagcttcatcgccgggacctagtttactgcaagaggacatgagctgcattgaatggctgaacaagcagaaaccaaggtcagtcatatacataagcttgggaaccaaagctcacatggagaccaaggagatgttagagatggcctggggattgttgaatagcaaccaacctttcttatgggtcatccgacctggctctgttgcaggcttcgagtggatagagttattaccagaggaagtcattaagatggtaacagaaagaggatacatagcgaaatgggcaccgcagatagaagtacttggacatcctgcagtgggaggattctggagccactgtggatggaactcaacactcgagagtattgtggaaggagtcccaatgatttgcaggcctttacaaggcgaacaaaagttaaatgcgatgtatatagaaagtgtttggaaaatagggattcaacttgaaggtgaagtggaaagggaaggtgtagagagagctgtgaagaggttgatcatagatgaagaaggtgcagccatgagggagagggctcttgatttaaaagagaagctcaatgcctcggtaagaagtggaggctcctcatacaacgcactggatgagcttgtcaagttcttgaatacagagtgaagatgcttaacttcatatattacaaaagaacttcgattataagaaaactccaatagaaatgtttacattctttggaatattaatttttgtcttccgttaaagttcataattatcaaaatttaaaacttgaacaatttttgtgttttatgaaaactagaaaacagtctttccacattaaattcacaatattctaatttgtgtgattcaaactagagatgaattttgtatggatatatgtctttgaatttgttgttttgaagaaggacacgaaattgaatacttcctctgtttcatattagttgtaatttaagatttttacacacatattaagaaatcataaaaatctcatttaatctacctcttttatataaaaacatcatttattataaccaattcaaccaataaaaaaatatataattaaatataattagttaaatggtattaaataaataaaaacccttaaactacatttatatagaaacagagggagtatcaatttttttttttaaatgtcgattcaaaatctttagtagactacaaaattgtttagtagactacaatttttagataactttgtctatcattttcccacttgtttagtataggagcatttttgtcagttcaaaccacattaattcaaaattatgacagtttggaaaaaaataaaaatttatggcattattggtaagtttattggtcaaagtggcaaccaaaacttttggtcaagtgacatttttggtaagttttttggtcaaagtggcaaccaaaaatattattcaacatgcaacccaaacttttgaagaaaatttattatatatggagactacaagtaaaaagcctcaagacaaaacctacccaacgtggttaaaaccaccaactcttatatgagacaaaagagaaacacacttttcttggagtgtttccactttattacttcattcagaaagactagttgtcacacaaggaacacgagagtcgagagagtaatatatatatagagagatagagcttaagca

SEQ ID NO: 6871 - DNA, 3000 bp, Unknown
  misc_feature (1)..( 3000): cDNA_ID_1815818_gDNA_ID_1621110_Annot_ID_56079 3000 nt of promoter + ATG
atgtgataagcaagcaaaaatgtggcccttgttgtctggtggtcaacctgtaactgttgctatgcatgagggtcctatcgcagctatggcttggatcccgggaatgaatctccttgcaactggaagttgggataaaactttgaagtaagaatgattgttcattatttcctatgactgaatgtagcaaattatagaatgttgactgattcatttatttgctgccatgaatttaatgatgtatgttggttttccttccagatattgggacacaagacagcaaaatcctgtacatacccaacagcttccagacaaatgttatacattgtctgtgaaacatcctctgatggttgtcgggactgccgatagaaatctgatagtcttcaacttgcaaaatcctcaggttagaatttttccttgttgttccatgttataacttgcgcatgagagttctaagtgctaacaatgctgtcagcatcacatggttttgggaattcgtgatcaatttagcccatgtgctatcttacaaagaatagatgaacaggctttcaccattagattaacagtttctcttgtgtaaactgtagactgagtttaagagaatccaatccccactgaagtaccagacgaggtgtgttactgccttccctgatcagcaaggttttttggtatgtcttcttatttatgttctgttgtgttttggttaattcagttttacaggaattagcttgttcgttagatgcttacattttaggttagacattgcaatgtttttatttgcaatctcgagaagattttatgtatgtcattctagcaaaaaatagagtaattttatatgggagattgttttgctagtcacatctccagatcctatctaaatcacaatggtgttgaatatgaaaaattaaccagatccaatgatctctataggttggttcaattgaggggcgggttggtgttcatcatctggatgattctcaacagagcaaaaacttcacattcaaatgccacagagatggaaatgatatatattctgtcaactctctgaatttccacccggtaagctctatctatagttatactcttatactcgtatgtattctttgaagccttcagcatatgttgagcgatgaaaatgattgtttgagttgttgtggatttaaggtacatggcacttttgcaactgctgggtcagatggtgctttcaatttctgggacaaagatagtaaacaaagactcaaggtattttcctcctgcattgattttttattttgttaaccaagtaattatctaacagttttgtattctgtgtccccacaggccatgtcgaggtgcaatcagccaattccatgcagctcgttcaaccacgatggatcgatatatgcatatgcggtatgatataaatcttatttggtttcactttatttgtacatgctcatgttatatgttgcaaaatcgagatggtcttttacttggaatctaaaaccatcattgtgttgaaaaacctttgagagcatacatgaatgctttctaacatgtattattatataggcttgctatgactggagcaaaggtgcagaaaatcacaacccggcgactgcaaaaagcagcattttcttgcacctgccacaggtgtgtgcgcgtcacagacaatagtaatatcatcatgtttcctaaacattagtgtctgtatctaacggacggaatttgttttaaatgaaattgcaggaaagcgaggttaaggccaagccaagagttggagcaaccggcagaaaatgagcgttgcttagtctgatttcttcgctagtgattttttttttttttttagcttgtggacttcgttgggctttgttatctactttagttcatgacattttgaatatacattaggagtcttgtctaaaagactaaaagtaaatctctaatgtttctagttgggcctaatttggaaccatctcgtctcatacctctttcgtttcatcatactaaggaaatctttttttcttatcaagaatttattttagtacatctgattccatagttaaactttagttattttaataactcaaatcaataaaatcaaccaagaaatgtttatctaaaactagtataattaaaacgactaatgttttcttctctcattgttactgtcggagcaaattttcctaaatttggttattagttaattttttttttggttgtgtgattaaatatggtcattagttagttagtgaagaaagagagagagataacgtggcagtagattagtggaagcaggagaagaaagcgggaatgagcaaaggacctggactttgtccatagccaagaaactcgcgtcctcttcttcttcctcttcacctatataaacactttgtcttcgaccccaattttccttcaattttatataaaaaataatttgttttcgttttttgtgtttctgtttttctcccttttgttcttctgtttcgttagaataacaacagaaaagaaaaaaagatcgtgagaaaatttcactttgaaaaagaaaaaagtgcagagagagatactttggaaaaattttgtcaacaaagaaagaaagaaagaaagaaagagtgaaaaagaaaacaaagaaacacaccaccctgtttctgtaaaacaagatggcggggaataaagattctagctgggacgatatcaaaaacgaaggcatcgatctcgtaagtatccttctccattaatattcccctcttttacttttgagttagctgctcattcttggttttgaaaacaggagaaaataccgatcgaggaggttcttacacagctccgatgtacaagggaaggacttaccagcgacgaaggccaaactcgcctcgagatcttcggttctaacaagctcgaagagaaaaaggcacacatccttaaatatctttctctttttgtttcttcactctcaagaaactccatctaaaaccaatttgaatcatcccacaggaaaacaaggttttgaagttcttagggttt

SEQ ID NO: 6872 - DNA, 3000 bp, Unknown
  misc_feature (1)..( 3000): cDNA_ID_1024765_gDNA_ID_1621110_Annot_ID_171771 3000 nt of promoter + ATG
attattcttttggaactgatacactagttgatgcagttctctcattttacttttgtttgttgaatcacctttataattaatatagattacaaggatttgcaagctataagagctacagtttttttttttttaaacttgcttccatttctttgtacaacataacaaaacaacacaacatctcatgctaattcaaataggtcaagtatgctactttgttgtccaaacatagacttgtcctccagctgtggatcctgcaagcgttccaacattataaggatggcaatggattctgcatggtatagctctctgcagagggttatgcagttccatcactgttcgctttagttttggattgatcacatcaatcttctttgacaaattgcccacatagatgtatgaatcatcccacccccatactgccctgcaatcaaaatcattaccaacttcagtttttcgacaaatagacgaaatcaattcctacttcttttcatttctcataacaaaaaagagtggaaaaagagtgtattggtcagagaaatagtgaaagactcataacaattacttgtggattcttttgtcagaacacagtacattaagcaagaagtgtattggaactgagaggcttattaaggtacaagatactggaacatacttgaatttggagatccatctgctggtgttattgtgatatatcatgcaagtgttctcaaaattggcgccgcttagaacaccaatgtagttgtcaaggctacaaggaaaacaaaacaaaacaagagttcagcaaaccccagagatgcacatagggacctacattatacatcagtttcactctctctacacatgtttactcttgtctacgttgctaaaagtttatgagatgtatttatttcccgtctcaaaaccatcaaggcacaaagttttctagctaagtaaagttcccagacataattgcttcaaggcagtggtgttttttcaaatatgtgcaacttttaaaccgaaatgcacagactttatgacctcaacaaaactagaacatatattacttaatctctccaatataatgacaaacaacatttgatgtgacttaaatcaaggagattatacttgtagttcttaatgaagtgtattgaataggctgtggaaaaaatgacaagataccttgtagttgcaagtgaaaggccagaaggtgagaaataagcagagtgcacagccctagaatgattaacagtagacaatgttttcggttttttggctcccatgcttctcaagtcccaaaggcaagcagttccatctgtggaacttgtcgccatgacatgcggattctgcgggttgaagtctatagagttaatcctccgttcatgtaactcccaatggaaaactgactttcctgctcggaggtcccatacattgaacactccataatcctgaccaaagtacaagctttgctcatcatttggtctctgcgagagtgaaaatatagcttcgtccgtggaataaaccagatcaaaaaccgacttctcgacatccatcaaccggatgagaccatcatagctgctgctaataacctgccatgaatgcaccaacgaacttgatgacttaaagaaagagataacgtttctccaatttcaatagacaactaaataaagacaagtcgtttaacaaaaaacttacccttgataaagagttttgctgaaacacaatagatgaaactggtgctgagtgaggagtgaatagatatatcccatcattatcttcctcattcccacaatccaaattccaaaacccaacattcccaagtttgtcccctgcagcaaccatcttaacattctcgcaaggtaagaactggacaacaaaaatcctcccaggcacaacacgagctacattctgcggttctaaagtcaacaaatccagatcaaactcaattttctcaggcttaaccggaatactaaattccttgttcacataatcactgaaggaatcatcttcaggctcttcctttttaacagaaactttagatacacgagaactactcctagtcctcaccataggagactcgttctcatccttaaccactccaatttctcccttaaccaatttgcctctacaagacttactctcaatacccaaaagagtatcaaccaattgcgtataagaaccgtatccttcatacgcggattcgaagggaataggagccaaaagacgcggcgattgcttctgaggagatggttggttgtgtgtgatctgagaacccatccggaaatctgaaaagccatcaggtaagccagcggaatctggattcaaacctctggtgcgtagagacattcggataacagtgggcgttgaagcaggtttgggcttcttcttcttaaaagatttagaatcatctcgagagcgtttggcggcggagagaagagaagaagctttggcgcggacattgagagcagccaacatctcatcgttccgtcttatgttctccaatctcttccgctcgtactccgtcgccattgattgattgatgcttgagaaaattgagattttttctctttacacacaaacaaaaaaggagagatttttttcttcacaccaaaactgaaagaagacctagaagaaaaagaaaaaagctaacaacatttgatgggtcggaaataggcggcagaataacaactgccgccaaaaaaataaaaaaacgaaaatatataattacacatttacaccaaagtgtgatctaaattgaacggtgcagattagtttaacatttatcccaaattttaagaaccgtacgatggagcatcttaatgacttaaaccctaaaagaagaaaaaccccaatcgagctctgtcaatggctcgcttcgtcagatgtctgagaagaacactcttttctaattcgtctccttctattgctcaccggagccctaggattggtttgcccacgaatctaaatcctaaaattttaatcagccgcagatgtctgagctccgggagttacgtctcagaaatg

SEQ ID NO: 6873 - DNA, 3000 bp, Unknown
  misc_feature (1)..( 3000): cDNA_ID_3041331_gDNA_ID_1621110_Annot_ID_171776 3000 nt of promoter + ATG
ttgtaacgcatcatggatattaccagcaagcaattcgtaaagcttaattctctccttctcaatgaaattaaaatccagcccattccttctccaaaggtgaagctgctgcaagatatcattgcggtttacagttgatccaccagcctggctcaacaaacaagcaagtctaacatctcccttagatatggcaagttccacagctgaatcaagctctcgtccagttagaagaaagaataagtgctcaaggtagctagaaccatttagatcactcacatcttcttgtacacggtgactgacactttcttggagccaacaactgaattctgctcttcggataagcggaagagcttctgtatcaatttttgcagaatcttccttcacatcctgcatcacgtcttcctcgttatcagaagctgcatacatcaaacgttcagtactctgtctctcagaaaagagaacttttatgagttcccagaccatgacttggtgcattaaaaacagcttcgcagatgtggacaacccagcaacttccagctgtttctcgattataccaatataacttcggcagatatctgaaagaactacacgatcggtgacaacattctgaagtttaagactgaaagagccaaacctaacttcttcttctacatgattcaattccttgtggagacttaagggagcctcaaacgcagaatcaataagttctttctgaacttttccctttctatcccaaaccactttgtcaattgctatcttttctttattgatcacagaagacaataccatctgggaactggagctacatattggcttaccagtgtgaaaaagaacgccatttgggccccaacctgctcggaacgatcttcccatgaataatgctgcatcaacaacattgcgggaatagttatcagttaacggtgtgacatggctgatgtccagctcgaaacctcccgttttcgactttctcactgccaaattcttattttgttgtaccatcaggatactacctggggagcttttatcattaccagggttatactccagcaaagcaagcggagttttgcgcacgaccggtggagggtcttgatgactatttctttgagcaattttctgcgaaggtcttacatttcgtttagtcaaggatgtcataagatgggaagtttgctctctaaagtcctcactttcgtcttcatcttcattaggaaacatcagcattctcatttctttcatcttttcaggatcaagtcctaaatgagctgggagagaatgagaaagctctagctccgaagtttccatctgatcttcttcatcaatgtcagctacctttttaccatccagtcctacgggatctcccaaacctggcgcatcatccattgcaatatcttctgcctcatcatcactcaacccaaatctgctgaaatgaggaacgaagaacttccataaaccattatcgggatcaaatgagatgaaagttgctccttgtctttccgtgctctgtttcaatttataagcaatatggttaacttgctgttttccccaagttagatctggtatgtttacgaccagagtcacctcagcagccttgttaagtccctcaccaacaaccggcttggagctctcatcatcataaacaataacctcgtgcctatgaaacttaactatgtgatccaggtccaaccttctaacatccgtgtttccaagaaacctaatataaccgtaaccaatcctgccaatagtaaaatcaggaacccggctgcaataatcagggctttcaatttctcgctcaaccagctcgtttatacatggcttcaagaagtagtcaggagaattcaacataggcaatgaatcaatgatctctttggaatgctcacacaaggcagcaattccatctaaagagatccttcttttctttcgcgagtccaaatctctagccatccttgaaatctctgtcgacatagaatttttgaaaatttcaaaatcagatgataaaagttacaacctaagtagcacacgattctgaatcaaatgaacttagaacaggacttgagcgggtaaggtcagataaaaacatagcagagactcaaacatcagaaaaaaacaaaaagcaaatcaatgtactctaagcatcagtgttacaaactcgaattttataagagttgaatgatgaacatgattctgaagctaacatgatatgtaaaacattaatagcccaagttcaggcgcacgacttgagtagctaaggataaaaacatagcagagactcaaacatcaatagcaacacaaagaagatttacctggaaatggttgaatagaaagagacgtcatgattgaaggaaacagaaacaaacaccgagagggtaaagaaagcgacaagctagggttttctttcttataatcactgactctaccgcgacctttccgatttctcttacaaatccattactgagacgacgctaacttacggcggtgacgatgatcggataaaaatctaaaaccgtcctgattcccctaaattccagagttcttcacactgaagtggtcggagttagccgccgcaggggaaaagagagggaaagctctcatagtgtgtgagatctgccgggtttgtttaggatccgtttaaccacccgacccgaaccgaattcctttccaattaaagtcaacattgggccataataaggcccaaatattaggcccgataatgtttttccttttttcggtatgaaaatgttttaatcccagcgtctgataaacgctgcgccggacgtcaatgtgacgcagagagacctttataagtacttcgtcgcattctctctcttccgactcaattcgttttccctcctcttctgcttaccggaaaagtctatatctccgacggaccttcttctctctaggtttgtctcttttattctgataaaagcttttagagaaggattacttatgtgattctgtctcttgaattgaacttttaacagttaatcagacctcgcgctcgtgata

SEQ ID NO: 6874 - DNA, 2273 bp, Unknown
  misc_feature (1)..( 2273): cDNA_ID_2123533_gDNA_ID_1621110_Annot_ID_171779 3000 nt of promoter + ATG
tacctttgaggttcaagtgaactagtgattggtacttgtccagcagatacaagatcccatcaaaagtaaaaccgtggcaatcggagagaagaagcttctttagaggtaacttagcactagcaatcaaacagagcaagtcatcagacaaaaacgaatccgaaagatcaagctcagtcaaacaacgagcaaacaagaacgcatcggttaacaaagactccctcggtctcaatccgattccgttgatcgcaagagactccaagttacgggaattgcgaagaacgaatttgatgcaatccgacgaaatgaaatcacagtcacggaagattatctctctcaagagaagacaattctgcgagagagcaatcaaagatttatctgtgatgaaactattaccagaaatgttaatcttcaacaaacctttgagattcgaggaaagctcgataacaccagaatcagagactcgactcggacttgaattaggatagctaatgtccagcttctctagcaacggaaaattcactccgatggaaaccagatcgctatcactaaaacctccaactccataacatttcaattccttgacattcttcatctcaaaatctgggaaatagcgcgtttgcgagacatctaccgattcgaaatccaaaccggaacgagaaacctggagaagaatcgaattgagatcctgagtgaaatcagagaacctgattcgcttcaagttgcggaatcgaaggagatgacgattgagtaaaggaacagctcgatcggtgacgacgaaagtagagcgaacgcgattggtgattgagaggaacaaggttgatacgagtgaaacagattccaggaatcgataatcgtcttcatcgatagctttgcagattaattcccaacattcttcaggtaaatccatggatgatggatttgatgaagattagctcaaatcaaactaacaacaaacacagtatgtaactaactatatatcatccttcaatttcgctggcagctggcttttaaccttatccaattttaaaatttcgaaactgggcttgttgtggctttttattccttaatggcccaataactatatttgtttttccaacagatattgggcctaacgactgattcatttcaaaatttcaaaactgggcttgtattgacccaataagatataaaaggctcattattcttgtaaggccctcaataagtctagttgttattcaactgtacagttgtgactagtcagtgaccacttgtgtcggtaattaaagtttgaagaggacagacatagagagttcacatgaataatgctcaaacttttggacctttgtcgtctgtatttttttaaaataaaaagaataaaattcttggatgcactctattaaaccatgacttgtcgttttgttcactaaatccgcatgaattgaatttggggagtgacccaatcgaatcatttggattactgtgcctcgatgcaaacaactctatcgagagattacacaatccattctcaatccatattctttccatatatcacaccattttattaatctgattaaaaataataatttcttttacgacaagatgtattttttttttcttggaaattaaaagactaaacttatgaatatgaaggaacattaaaaacaccatttatgtaattggattgtactttgattgctttatgtactttctttgtattcttgatttttctaatttaataaagatatagtataactatacgttaaagaaaaaggaacaaggctttaattaatagataaaaatctgttagctttacgtataaaaggtttaattctatttgtcaactagtagtatcagcatcatctctaacattgggatgttaaattgttgtaatggtagagagaaaatcaaaattttaaagattggctaatgggaagaaactgttttgctaactacacatcctcctcctcactctctccacaactccacgtcttatcaccacgtctgggattaggcactctttgctgctttattagcctttttgtccaccttttcataactgccacatgaagaccaaacacctaaaacctttgtccttctctctctctgtttcccaactccaacagtgtctcttgtctacatctcctccagacaaagataatctctagcatttttcaccatctccataaaagaattagatagaacacgaagcagcttcgtactctttatctctctctctctctctttttgtcttttctctgcatatttgttgataccagacaacaaaattaaatatg

SEQ ID NO: 6875 - DNA, 3000 bp, Unknown
  misc_feature (1)..( 3000): cDNA_ID_1013190_gDNA_ID_1621110_Annot_ID_171774 3000 nt of promoter + ATG
aagtctatgtttggacaacaaagtagcatacttgacctatttgaattagcatgagatgttgtgttgttttgttatgttgtacaaagaaatggaagcaagtttaaaaaaaaaaaaactgtagctcttatagcttgcaaatccttgtaatctatattaattataaaggtgattcaacaaacaaaagtaaaatgagagaactgcatcaactagtgtatcagttccaaaagaataataacccacagaagggtacattcttcgtcatctaccacctaagtttcccttctaatcatctcagtgaggtccatcacctggtttctgtacattgcccttgtgttctttttctggctgtgatacttcttttggggagagtttagtagattgatcttcttgggttttggttggagcattccctgaaggtttcttggtttccaaaacaatttcttttattgtctcttcgatttttcccagtctctgtctcatctccattagctcttcgtgagacttggttgctgcctctacttgtaatgccttttgttcagcttcttctttctctttcttttcttcttctttccttttcttctctccaagttcctgagaattagtccaatatcatgaggcatatgctaacaataaccagaatgaagacagaggataaacattaagacatgactgaaacatcatcagaaactcatatcagtttgataatgaacaataaggagaactcacagcatccatgatcttcattttccggcgagcatattgagcaaccagatacacagctgttacaagaaacaatagccatttataaacaagtcacatttgacagtaaacattgaacataacaactaagataacgggagtgaatggcaatacctacagatggcaagcagacgatgatgaattgcaccacatgccaatcaaacctaacacaaagcaaaatccatatgagaacatactacaaacacaaagcagcacaagaactcaacttactatataagagatagtttcagaaagtcaaagagataatcgcagcagaaattgaaaaccagttcacttgtttcagcctaaagaagctcacattccacaattctacaatcctgaggttttgtagcctaaaattaacttcaaaatatacaaggtaagttgaaaaaatagggtctttccatgatttaaggcctatagaagcatgaatcaaacacattatagcatctgatagactaaacaaaggacaagatcagcgaagagtgtttgcacgcattcgagagtagaaccctctttaaaccccaaatctccggtagaaattacccaaatttgttcttcttgggtggttcagtgaacaagatcttcgcagcggtaacgaaatcgagcttatcgagtttcttataggtctcatcgtagcgagaaacactagattcagtgtcgctgtgatgcgcaacgctagattccgtcttctcgagtttattctctccttttgtgcagaaacgtcgggtcctgtaaagcttcaaccgggtcgataatccggaccacgagcctctgccgcgaatcatcttgatctctcccggcgtcagctccaatcactactcgcgcattttccacacaatatgagcgtttcaaaacgcggtcttgaggctaatgttggtctccacaataaccggatctgaccgtaccgtaccgggtctagggttattggttcgatcagatagcgaatttaagactctcatgtgtcaattgtgatcatctgactttgtaataaatttcaatcaaatttggtatgtttgtcaacaaatatttgttaccttttgttttcagtttgtttttcatttttttttttcagctttggattctatttgtgagctaagatattgaccttttttttttcccctttctgttcaattaattttaatgattattatattatgatagggaaacattttattttgaaggttaaccaaaggcaaattagtggcaggcctctaatatttcatatattaaagatagaaagttgaacttttcatacaacttgtaactcttaagtttatagtctttacaacatcttgtacatcatattatatagttgtaagaaaaaaatgaataaacgcaaagttatattgattatgatatttttgtggacactacctacattcaataaacaaacatagatccatgattagtgtcatttttccccccaaatttttattttccgcaatgaaaaaatggtttattgtactatatatatattcccactttgcaccataattagtcgcaccactttgacaccttaattaaaaaaaaaaaaattgtgagtgtattaaaaagaaaaagtgtggtctcgagacaaaaagttgagccaaagataggggaatattattaagctttatttatattggaccccataataaactgtgaaattattaaagcataccgccaatattaatttaagttctatgcatttataaaatcattggctataaacattctataaggtatctagatcgttcgcggtaatcggttttaagaaaaaagattcataaatagttttaaggaaattgtaaaatggattcataaatatatggaagtagatttatttattgaagattcaaaactagtaataaaagctaagcaagaagtctcatttctgttgctaaaggctttttaatcgaaaagaggaaacataattggcatcggaaatctcaaaagacaagtctcgttggcattttgtgtaattttaataatcttgaatttagagaaaaagggtaaagcttgtcatcaacttattcgacagtttatataaaaaccgagtcatctttcatcggaagtacttccctccggcccattttctgacgccggcgatactctctttcacctctttctttctttcttctctgtcttttttgctttgtttctctccagtgaggaaaatggcggagtcattacgattctccgactgaaaaaagaagttaaaacctttgaaagaagaggaagaatttgaaagaaaggaaa

SEQ ID NO: 6876 - DNA, 2273 bp, Unknown; identical to SEQ ID NO: 6874
  misc_feature (1)..( 2273): cDNA_ID_1815814_gDNA_ID_1621110_Annot_ID_56080 3000 nt of promoter + ATG

SEQ ID NO: 6877 - DNA, 3000 bp, Unknown
  misc_feature (1)..( 3000): cDNA_ID_1815855_gDNA_ID_1621111_Annot_ID_56083 3000 nt of promoter + ATG
ctctcacaatggttaagctgttctctcggaatgttctggttatgtctgagagaagaccaactcggtcttctgctgataattccagctctaaaccctgaaagtatgtttcatatgcacaatctgtcttgagtatatcagaaatcgatgcagaacagaatgtaatttgagccaagacagagaattttcacattcctaattggttacctccgatgctctcctctcaatggctgcttccagacattgtatgacacgttcttgctctgcttctgagtttatgggaagtccatccacatgacggatgtaaaattcctgcagcaaaacactcatattattgttagaagagagatcccaacagacggccgttgagtagttacctgataagcctccactggttctgtgctgaccatgccatggaacaccacatactgcatatcagtcaaagtacagactacgtcaaacacaagctttggtctatctttggacctcatggtaacaacggtataatccttctcaatgttcattagtgtgacactgggccttgacgccgatgtccttgctcttttgactccctcgtagtccctatcatcaaacatgatctgatgcaaccgtctctccctgtgtgtatcagaacaagagaagactgttttcgcagctcttgagccgctgtttgtcctcactacattgcacagcagctccttgatggtggaaaggcgaatcgggtcagtaatggcagaatgagttgaattgtccgtgacatgaataaccgctgcagctctggtgttgtgagtccatatctcagcgttcacaacgttgcagtgaaggtctgtgagaacagcagatacttcagacaagagaccgggtctgtcagttccagcgagctcaatggatgtgtattcgtcagtgggcattacaccaactgagcttctcaaaggtggaatgaaccacccagcgttgctctctatcctctgcgcaatgaattcaacaaacgttttacacaaagaaaaaaacctgttgaaaatgaaagaaaaaaagtgatgaaatacattagaaaccttttggatatagtcaaggacttgagtgtctctgatcttattgccatcttggtcgatgactttgaaaacgtccatgaaccaacctccatcggaagagatgtaagctttcttgatcacaagattcatatcagtgagcacttgtactacttccaatagagtcccatgtttgttcacactatcaaccttttatttagcaccacaaacaaacagggaactctgttttctcaaaatctctttgtttggtacagaaccacttgaacaatttgaagagacagatttatttacctgaataacagtggcatcgtcgcttgcgttgttgtctattacaactctgtatccaccatgaaacatacataaataaagatgaatgttttagcagctggaatctttacaagggtatagaggctcacaaacggagcatggagaaacagaggacctagaaaacaataaaagagtatggagagaaagagaaaaacctgggaggattcattctcctgatgagcttggcatattcatcatcatccatggttgtagtatgtatctccttggtgatttggctgcagcagaaacccagaagagtgtgagtcctccaatttctgaggaaaattcctaaaagagagagggagagggaagttgaaggaggataaaaatggtaggccaccggaaccgaaccttgttttcattagttgatcgagcacgtgccactaaagattcttagagatgacgtggcacgggcacagcaacttttagattctgttataattgttcgaatactaccaaaagtcgggtgaagatttggggtcaatttgatgatcataaaggggattatattctccttctcaagcaagatgtggtatttactagtataatagatcattcgttatcttgaggtagacctctccgtaacgttcacaggtgcatgaccaagtaacaatttgattcctttccagcataacgtcatgttggttgcaaaaagaaggcaaagtagagcaagcaagcaagcaaagcatttttcttattttatattttgttgcggattccaccacccacttgaaaaattgacatgtcacaatgatttcgtatcctagtcttttattatttaacactctcacaatcccattactctacacctctttcattaagtcaacacacggttttcaaaaatccactaccctcccaccacctagaatcttttgttacctaccaacaccctcctttgttctctttatatattggtccaactaaatcaataagggaaagcatccttttggttggaggaattgctttcattctcactctttgtgtgttgatcaatggactagctaataacaagttcctcctctatatatttcaaaagaatggaacagaaacataaacgaaagacagagtacctgatgttgatgattcattgtctgtctggagctcccaaatgccttttatgcttacatattcataaccaacaacggctattaattataaaccaaaaacacgaaataagtttgtagcaaagtgaaattaggaatcttggagatggatccattagtagtaggataataggatatgatggaatttggttggggaacagtgataacttacgcttgcttccggcgccgggaaagttggaaaacctacaaagtacagaaatggatctgggccttgaagtgggctttttattaaagaaaaaaatacatctccgttatcaatcaccatcttcttctatctacaaattaaagaaggtaacaacagaacgtggtggatcatgtggttaggcattaattatttgctttgtttcgccgttttggtaacacacagacacagttccggtaagagcttttgcagccactctttatagttatttagaattggcgatcgaatcaatctcactccctccctcccttaagtcttgttgaatctgctgaattgttttataaagagttactttggcaaa

SEQ ID NO: 6878 - DNA, 3000 bp, Unknown
  misc_feature (1)..( 3000): cDNA_ID_1815844_gDNA_ID_1621111_Annot_ID_56087 3000 nt of promoter + ATG
tagtgggaattaaagcttttatttggggtctgtaataagtaggcgagataagttactcttactctttgaaatctcaaaaccaaaataaaaagtgggaacttaattatgacaatatacatggttcataaaaatgattattcttgataaatgaaccaaccataaaagaaggaactaacagtattccacaagaaaatcagaaatcaagaaatgaagaaaaggagccatgacgtgaaggggaaggtagggttaattaggcggcgtagatgtggatgtgaagggcgatgagggagatggtgatgaaggcgaagaagaggagagtgtggatgacaatggaggggccgcttgtctgaaacccaccgaactcaaccgctttgctctttccgggcagctgaaacaaaactccagggctcaacacgatgaagaaaattaccgacattagcaccggtccccagtccaaccccatctttgttttctgtttcttctctagctataatatacgtctctctataaacatctaccactttattatgtgcttatatttataatgtacgcgtaaatgtgagaatgaacttgatgtcaatacgattaattaataatatatatgtggcttgggctggacaaaagtggagggttcttctcaagtttgtgggatgaaggaaagaactattctctgatatagtattttaaattatctgtacacaaaaataattaaatatctagatcgatagtattttgcttgttttgaaggccaagcatatgattctcctcctcttcaggcatttcaattcataagcaagcatatgattctcctcttaaggcatttcaattcataagccaacatataacaccttacgttcttgctccggttctgagtttaagggaagtccatccgcttctgacggatgtaataatattcatgcaacatatataagtcatatatatactgaagtaattttaaaacgtcaatcgcaaaaataatacacaatacactaattaacgccataatttttatttttttaacaccataattttattatgcactaacgcggttattaatcaaatcacgtagtattagtaatgaaatagggataagatccacatgaggaaagcaaaagaatcgaaaccaaaccaataaacgcaatcaagtatcaaacactttaactttatatacatagccactaaatgtatatatccatccaacaagaaagaaagatactggtcaagtctcaatctgccttcttttgtcatccttaaataatctcaatagtttctgaatttcaaaaaagtacacaaaacacacctattatcacacgtacaatatatatataccaagtgcattaatacacttgtgtgtgtatatgtaatattgttccaagtagtgctttgacacctaataagacgatcaaatctttttggagctctaattgaggtagatatgggaggagcggactgggggccggtggcggttgcggtggtgctgttcgtagtgttatcgccggggcttctgtttcagttgccggcgaggaggagagtgttggagtgcggcaacatgaccacaagcgggatctcaatattggttcatgccattctcttctttgctattatcacgattttggtcatcgccattcaaattcacattcacatctaacatctttattttaatcaccggcttatgtttgtagtataaacctagcttggtataatattgttatctattcatctctcatgtgcttgtttttcttttcatttttaagataaaagtgtacaagttagcttgtgaaactttactgaagaaaatcaaaaatagagtaagagtagtataaaatacttgagaataaataaatgtttggtttgcctcgttatcacttcttgatgttcccacgatcgatcccttcaagagaaaataattaaaacgaaagattgcattcgtatcagcatttatggcggatgattgcgattattaatgcctcctgtaaaacgtgttttattctgtttcttttgaaaattctttcgtcgaaatgaatcattgccgtaaataatcagacattaatatctgattctatctctttaattacatcagataaaacataaaaatgacaaagatttattataaaataatatagaaaatgaaccgtcggaataatgatctgatctcgctatcgataatgaagccaaaatatatatacagtagaaactaatgacataaacgaggttaaaaaatactatcaaatgcatacatcacccaatcaattatatgtggctgcatatggtaatttctttgtatcctcgattaaacgcaacctgtattgtaaaaaaaaaagggtacacatacagaaaaagactcccccaggcccagtagacattttgaatatagatattttctgaatcaaatgttgattgttttttatttttttttgggtaggcaaatgttgattgttgtatatagaggaataagctattgttagaaaatagtttctatttaaaagctaccagtaaacattggtggtgtgtgtgatctatcaactgagtgagattttttttataaaaaaatttaaagaataagagagatcatcatatattcagtcaatcttttttttgtcggctagtattatactaatcaatttgttttttttttctttgtcggctagtatactaaatttgttagttatcagatttaagttaaactttgaatggtaagttactaaatgagacctggaaaaatgattttgaatgtggtcccaaaatgtaagtatgacagggcatgcatcgccgccgaataaaatactagtaacataatgggaaatatttcgtttaatgttttgtctaattattactctaagttcgactaatacatttttttattaaaaaacaacaactgattaacaacagtcctagttaatttcttgtgaaagaaagattaaagggatctaaagatcatcatcaattcatcaagagaccaagaaagaaatacaaggttgatcgtacaaagaaatcgaaaaa

SEQ ID NO: 6879 - DNA, 3000 bp, Unknown
  misc_feature (1)..( 3000): cDNA_ID_1663391_gDNA_ID_1621111_Annot_ID_56088 3000 nt of promoter + ATG
ggcacactattgattggacttggctatggtgctcactgggccatcgtcccagccactgcctctgagctctttggtctaaagaagtttggagctttatacaatttcctgacgctggccaacccagcgggatccttagtcttttcggggctgatcgcaagttccatttatgaccgcgaagcagagaggcaagcacaaggatccttgttcaatcctgacgatgtcctgagatgccgaggttccatctgttacttcttgacgtcactcataatgtctggattctgcctcattgcggccgccttgagtatgatccttgtgcaacgtacgaagccggtttacacaaatctctacggcaaaacccgcaactgattttaagataccatattacgaaaatatcccaccaagaaaagaagctgggttctttgagtttcatacctatatatatgattgtgttcatcatcttattctttggcttggtcttccacttccccatacatgtgtatttggttatgtaacgattttttgtgtccggtgttgtgtatggattttgaattcgcatttgtaataattgtattcacattattcatattctccagctacaaggtgtctttgtgtgtagatgtcaaacaaagacctaatctgtgtctgtctctgttttaagtgccagacgccataagatcttggcgcagggaagactcgtcgtcctcaaccaccatccacggcaatataggtccctatacaaaccaaccacacggtcaagttaaggtccttggatggatgaagcacagaatgtttagataatatattaccttcccttcccttatgaccttgggatatggtcctgtcatatccacgatggtggatggttcagccactcgtatacctccgtctaccacaaaatccagaccctgtaaaaggaaaccgaaacagagaatagagcaaccaaagatgttctttagtcgctgagaaagagtgagagctataaatacctctggtccatatatgtcacctattgcggttgggtcgatcaataggtccctaggaaccaatagtaagtaaaaagcaaagtggtaaacatacaaaagcgagattattctcaagtctcatttcaatgtcaaaactctctcttgtgtgctaagtaaacagaacctgtgtgaaagtaaaacacctctgaactcattttcactatctcacaaacctgcattatcgatccaattctcccatcttatatcttcttacatattaaggatcagagaaggtgatcaaacctgataattatgtagatgtagctgaagctaagatataaggctcaggaaccacaaaaacatatcactgaatatttcaaattagcttcagcattttatgagtcaaaatactaagaaacaatgcaaattctctcatgaaaaggctctcacattgcttttgcattctccgcaattatgatccaaaccttaaccaaaaacaactaccctataagagtataagaccatgtctgcagaaatcagtagtaacacaagaatttcatgagatattaaagaagaagaaaagtaggccacacaatagaattgaggaatcaagaaaacagatacatacacttgggaaggaccagcacagcagacgtctgttactactaactaactcagacttgtcattgaactatattatatacggctcacttgttttgctgcagtaactggcttatcttcttttctggcttgcgttaataacatgagtagagagaaaacacgacttccgtcgagtagattcctatcaaacaacaccggttctcgaatctttcgacaagccaagcaaaagtaggtgggcatgaaaatttgttccccatgaaacagaggacattcgttgttacctattctaataaccgattcaaaattccgaatcgcagacttaataaatgtggacaattaaccaaaccgtgcattgctaggtctaaaccgcattggtttatgacccaccaatcaaggagcgatgggtgagaaacctaataacactgctgctgtgactttatcatatccttagtccaattgggatcttcgtctgcgtgagacgcgttcacacctgcgacagatgaaatcacggaaataccactgcccaacgtgttcgcaataaaagtcctctgatgcctaatttcgtcaatttactgaagaaaattcaacatcaacgccctttttgataatttccccaaagttagtgggccctccacacgaagcatgtatcctccaattgcatattgccaattatttcctaataatattgaaggattattcttttcccatctatataccaccaaccctaagatccgaacgtccattttaaagccgtgcgtttaatcatgatcgtcaattatattggcaaatttgaccacacgatatccgtcatctaacggcatctacagatctaccagaacgttctcattcatgactctatatatttcgcatttcttctcctcaacgctctcataaaaagtagtactcgtgtcttactcgtgccagccactcgcatttctccagattttattatccttcctcgaaacaaggtatgacggaaactctctctctccctctctgatccgtcgttgctgcttccattttcatcttgactcgatcggatcattgttatgcttggcttgatctgtgcttaatgatgtgtttttcgtagtagatccacgattcgttgctgcgatcggcgttattatcgtcagctctctcgtttctgttctgtggttcgatattgctgagtttctaggctaatcttacgaatctgtgaaagtttttgagagatttggcttctgtagctcactcctgcttgatttaggttttttttttttccactcgtatgaagctgttttagaggctgttgttgtttatgattctcagcttgttatgtatagttggatttcgtgagttttggatttgatctgtgcgtttatttagtagtgaggctcatgtatatatatctgtgtatttgttccagagcttagctaag

SEQ ID NO: 6880 - DNA, 3000 bp, Unknown
  misc_feature (1)..( 3000): cDNA_ID_1840643_gDNA_ID_1621111_Annot_ID_56090 3000 nt of promoter + ATG
cctcttatacacagttcaacttcaactgcatcatccaactttcatcacaaccctacatctttaacaaactatcttttcttcatgtgcaataaatatttagggaaagctcgacaaggaatcttcaaatgcaggttatgtgctattgatgttttatcacctttatgagggaaaggtattatcacatactccacaacttattcttttaagtaaatctatgattggatctaactgaactttctttaaattttagaaccgtaatgaatttgagagtgaattgattgagcgctttggctccctcatcaagatgccactattgaaatcagacaggtatacagttgacatcacatgcgagctaacaaactcgaacttagcacagctacaaattgcaacttcatatttaattggttcataagcaatttaattgtcttctctttgtgcatatacaggactcctttacctgatcctgttaaatcagttcttgaggagggcattgatttgttcaatctccatagtagaagacatgggaggtgggtaccaacactaccattttaaatgacttgaaaagttgaattttatgtcaaaccgaagtattttgagcatcgtatgccaaaacttgttcatcgtgttatatattaaacaacaccttctgttctgacgataaaaaatgaaaggcaatagtaataattttagcaaaaactaacaagacatcggatttatttatcctgtgactagatgtacttggatcatgtaactggagaaatcctacacatgagtgtgctcacaggcgtttttatttcttgttctggctgttctctacttcattcttttagctctagctcctgggttccttctgacctgttttccttctgatttttcttgttgtagactcgagtcaacaaaaggaacatatgcagcggaatggaccaaatgggagaaacaactacgagatactctagttgcaaattctgagtatctcagttctattcaggtaaaaaattcctttgtcattgatggctcatgaaaagcaagaaatctgcgattgaattttaaactgcttcaatgttccttcagtacatggtaaaagagtataagaagaaggatgtacatatgatgtctttgttttctggtttgcaactttcaggttccatttgagtctatggttcatcaagtgcgagaagagctaaaaacaatagcgaagggtgattacaagccaccttcggagaaaagaaaacacgggtctattgttttcgctgccatcaacttgcctgctactcaagttcacagtcttcttgaaaaggtaaccaaccaatttcttatactatcatataaaaaaacaaaaggaatattgagacaagaactcttcaactgccgaaaactaaaggttaagtatgggctttgttattaattaatagatgttattctcatcagttggctgcagcaaacccaacaatgagatcttttctagagggaaagaaaaagagcatacaggaaaaacttgaacggtctcacgtgacgctcgcccacaagagaagccatggcgtagcaactgtagccagctatagtcagcacttgaacagagaggtacccgtagagctcaccgagctcatctacaacgacaagatggctgctctaacagcccatgttggatctgtggacggagagaccgtagtctccaagaacgaatggccacatgttacattgtggacagcggaaggcgttactgcgaaagaggccaacacgttacctcagctttacttagaaggaaaggcgagccgcttggtgatagatcctccggtgtcaatctcaggtcctctggagtttttctgaatacttgattaaacatggaagtttctctcttgagggaggttgctcgtggaatgggacacatatggttgttataataaaccattccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagcgcgcttagctcagatgatagagcaccacaatttttgtggtgagaaatcggtttgactccgatagcggctttttactatgattgttttgtgttaaagatgattttcataatggttatatatgtctactgttttttattgattcaatatttgattgttcttttttttgcagatttgttgacagtctctaacc

SEQ ID NO: 6881 - DNA, 3000 bp, Unknown; identical to SEQ ID NO: 6880
  misc_feature (1)..( 3000): cDNA_ID_4283698_gDNA_ID_1621111_Annot_ID_171804 3000 nt of promoter + ATG

SEQ ID NO: 6882 - DNA, 3000 bp, Unknown
  misc_feature (1)..( 3000): cDNA_ID_2123626_gDNA_ID_1621111_Annot_ID_171803 3000 nt of promoter + ATG
gaagccgaagctagaataagagatccagtgtatggatgtgcaggtgccatataccatttacaaagacaagtgagtgaactccaagcacaacttgcaaaagctcaagtggagatggtgaatatgcaatttcaaagatcaaatttactagagctgatttataacatggaccaacaacagaaacaagaacaagataatatgtcctttgagagcaatgatttgggattccttgaagacaagtccaacaccaactcatcaatgttgtggtgggatcctctttggacatgttgatcattactaagattttgactacttcgctttaaggccctctctagaactttactcagggttagttagcatacacaaatgtaacattgtacggtgaataaagaaaagtagaggcggcttttttaaattgtttttttgaccgggttttcaatgttttttcctgcggtttttagacacaaaccggaaagtataccggatctaaacaaccgcagagcggaaaaaaaaaatctaaaactaaacgacgtcgttcggctctttatcttgtcaccctcctcaggcgacggcgacgatgaacctccgttccaaatcttcccgtatcttttatgaaacgcgaccgactcttcaaggcccaaagaaaaagagaatagtcggcgggataggggtatgtttgtaatttggcaaacgaatccccatcatagctttattccttacttcattcaccctagccgctttactctcttgcgttatctccgaggtaagctttttcatcaccatctacgatctgcctctttctcttctgctgatctgtgttgaatctgtttcgatacttctcgtttgttgttgttatttcttggattcgattctctttgtttatagatcgtttggaatttctgatcggtggtgtaaagttttatcgatttaggagaacaaagttttacagtgcaatcgtattgttttttttcttcatgccagctgatgataaactataggatcgatctggttctgagatttttgtactgttcagtggattgttgattatatcttttgatgtatgtgatattaattatcgatttgattgggtaatccaagttgtggaaactctaggattgtttgctgtatatctcctcaattgctgatttgtttgaatttagctcgcttagctcagatgatagggcaccacaatttttgtggtagaaatcggcttgactctctttttctgccaacaaaaacaaaaaatagtctgagtcaaaccattgtagcagtacctaaaatctcgtttgtgaaccgttgtagcactacccaagtcaccggaaaggtaaaacaatgaagccgtgggattaaaccttcacagatctgtgttaccaaaccctcctcttcgtcgttcagtccgccaaaccaagccgacgagaaaggttgcgggaaaaggtacgtcgcagcttctcgtgtttgtggtggtgtgttgctaagaatattgaaccagaaattaaaccaatttaaaccaagagaccttacgtgtatttcagtattgaattgataaaacccaaacttaataatcgaagatgggattgcgttatacatttcagacaacaaagtgattttaactcaaggcattgatggtggagtgaatgtcgattacttccagaagatcgagtcttggcctttctgattcacagtattcaacattaacgtgtgaatgtattcacagggttctatgataatgattgtgaagattcttgtgaaccttgattatgtagtgtcctagtgtcttctattccatcagttgcacatgagagtttaccaaaactttgaagattatgttgtgggcagaaaataaaccaactgataaaaagccttttgtggtactttaacattaagagaattcaaagcctagttataggaaataaattataaaagcatgaaagatattgttttctttgcaagtttggtctgaaagagtgtattttaaatgggcttactgtgggtagttattgcagaaacgctgaatttaaatgggcttactgtggcccaatagatagatactgtgagtctgtgatgagcgggttatttgtgggtgggcattggtttatagaaacgacgttgtgttcaagttactaaatcgcgtgtgttttttacttttctgcaactaaatcgtgtttcttcctaagaaccctaaatctgaactgtctcatcttctccgatatcagtgagatcaataaatcatcttctcaccctagacgacagggaaactcggggattgattcggaaaaacgagttcgtttttctgcaaggtacttttcttacgaaacaaatcgtaattgattcacaggttctgaatcttctagttaagagtaatgttgtctacactcactgattgcagcaactgattcaagtttttcaaagtagtagatgatctcaatctaaatcggtttttgatagtttatgcttgtggaatttgatggttttgaatcttttgatcttgcatctaaagtagtttttcaaactttacttatttatgccaatgggtttctattttgatttcggatttttttgtgggctgggtttttggtggacaagtttatgattatctggaattgggctagttaaaatagcccagattaacagccctagatataccgtagggtattttcgtaaatttagtttatagatttttgtttgttacggtggtctttcccgcaccataacacttccactaactccgtcgtcgtcccgccggtttcacagcttgttagtgactcagcaagacgtcgaccgaacttggtcgccgccatctctctttatttttacgtggttcgcacaaaattaagccacgtgttgatgtcgttaattcctcacacaactcacttcgctttctctatcaacattcatctttctgctacttctcgaacctcctctcttctccgatcatcttctccttactttaccttagctcgctctctctgttttaactcctctatcagatttttatcctcagat

SEQ ID NO: 6883 - DNA, 3000 bp, Unknown; identical to SEQ ID NO: 6879
  misc_feature (1)..( 3000): cDNA_ID_1663391_gDNA_ID_1621111_Annot_ID_171798 3000 nt of promoter + ATG

SEQ ID NO: 6884 - DNA, 3000 bp, Unknown
  misc_feature (1)..( 3000): cDNA_ID_2123612_gDNA_ID_1621111_Annot_ID_171797 3000 nt of promoter + ATG
cgtctagatgaaatctatagcattacctctctctttttttgttttttttggttgtctttttgatattatagtatttttattcttttgaagctatagttgctttgaatttctttttaggctaaagtaagataaggattatacataaaacaaacgagacccacacggaatgaaagaggagctcagtaatgttacagccaatttcccacacacacacacaaaaagaaaaaagaaccgtttcgaactctaaatggtgtgaacgtgttcacaaaaagtcactccactcttcccttctctctactcgtcgctccaatctcatcttttctaaaacctgattacgacatagaccactcaagattcaagagggtcctaattgcagattcggttcaattcaagataaaaataagagacgtttccatcgacaacataaaaatagaaaaaaaaacggttttagagaagcgcataggcaagatccttcacctagaaaaggagtgctgaatgacaatcatttgaataacacttgacttcaagctctttactccctcggccgtgatcaaagcagcaaacactttggtaatcatagtggtgacattataagccagagccatccgtctcagctcacgccggtctttgatctaaagcatcgtctgatcaacatcgatggaatccgcctattcgggcaccacatcattacatgctgttgcatgtggtgatagaatcactttggattggtttatgggtatggaactaaaattcggtaagtgaactggtctagattggttttggaacaatgtcaggtttaccattgatctcgtagtacatagtcaaatcatgttatactaatacttctacttctgattaaagatttggctgtttatcactttatataggcaattagccactgtatcttcaaactcttaatccaagttctactgttattagagactaagcagatatgaatggatttgaggcataaatatcgagagaaattaattttattaatgtgtctaagcagcaaaagcgcaacggatgtgttcaaatcgcaacccaccgaaaaaaacagatacgtaaatccgagagtacattaagcaatcatatgacaaagttcaaatgcaatgcgacccctccagcccccaaccaaaaacagccatgactctcggggagacacacacacacacacagagcatacgtcacagcttaagcatcagcaaacctgcaaccaacagatacaaactcaaatcacaccactgaattaatatttactttctaaatgattcatagattcaggataagtacccaagctcagaaagcttcatgtgggcctcagcgtaatcagcgaaaaaggcatcttcatcctgttcacattgtcacaagaaaccatgagttctcttctctctctctctaccaagtgaaaaacagaaaaaagggaatgaaagacatacagcagcgtatttctcgaccaaaggacggaaaacagggtcgtccaatagtgctttgtcagagacaagctgaagaaggccttccttctctccgctcaagagttccctgcccatatataatttgattagtaaccatataagccactgaatcctcctacaagggaacttgggatactcacttgaagtaagagttgtcgaagattagagggtttgatgtccatgcaccttcgaagccagacctatccttgtggcatcgtccctgcgatatcatattttgctagcactcatcagaatttgtaagcttggagcaaacaaattttaaagttttaagcagttggagagaaacgaaccagagtgtgggcaccagataaagcgacaatgtctttgtcagataagcccatctgcttagcaaagacatctctcaaatggtcacaacccttggtagcatcaggaagacgaccctctggaggtggttggggcttgtcctgaaatcaagatatgcattttagaaacagaaaatcaagtcccacaattatcaatcagccatctctacaaagaaagcagaacacgttctctcgaccaaattgagtatatgataaccttagagacggcaaacaaatctacagcaatgactaacctctcttccagggtggaaaggaatgtcagggccaccagtaacttcaacggccacaacaccagcaagctgaatgatcaatttcacaccacaaggatatctagagttagaatccaaaccttacagttatcaccgttaaccaaatagtgctttttaaaatttaaaaccatgtacctgatggaaatcagcaaaagagatggtagggaattgctccctgatggggtccaacaacctaagagcaatgtggataccactgttggctccatgagcttgctcagcgtcaaacctcattgttccgaatggacctccagtccttgattgacaatcgaaagttccagcagagtgccatctgcagtttagccagacagatcagccatgagaaagttcataatcctacatacttcaaaaccacaagcaaatatggttagttacttacgcgagtcggaccatgatgggtgcacagttcttctcagcgatcaaacctctgagcttcctcctgcacttctcaacagccttcttgtaatcttcgctcacggttgggtagttcttcgtcatcttagctaagctctggaacaaatacacagatatatatacatgagcctcactactaaataaacgcacagatcaaatccaaaactcacgaaatccaactatacataacaagctgagaatcataaacaacaacagcctctaaaacagcttcatacgagtggaaaaaaaaaaaacctaaatcaagcaggagtgagctacagaagccaaatctctcaaaaactttcacagattcgtaagattagcctagaaactcagcaatatcgaaccacagaacagaaacgagagagctgacgataataacgccgatcgcagcaacgaatcgtggatctactacgaaaaacacatcattaagcacagatcaagccaagcataacaatg

SEQ ID NO: 6885 - DNA, 3000 bp, Unknown
  misc_feature (1)..( 3000): cDNA_ID_2027099_gDNA_ID_1621111_Annot_ID_171791 3000 nt of promoter + ATG
ggagagggaagttgaaggaggataaaaatggtaggccaccggaaccgaaccttgttttcattagttgatcgagcacgtgccactaaagattcttagagatgacgtggcacgggcacagcaacttttagattctgttataattgttcgaatactaccaaaagtcgggtgaagatttggggtcaatttgatgatcataaaggggattatattctccttctcaagcaagatgtggtatttactagtataatagatcattcgttatcttgaggtagacctctccgtaacgttcacaggtgcatgaccaagtaacaatttgattcctttccagcataacgtcatgttggttgcaaaaagaaggcaaagtagagcaagcaagcaagcaaagcatttttcttattttatattttgttgcggattccaccacccacttgaaaaattgacatgtcacaatgatttcgtatcctagtcttttattatttaacactctcacaatcccattactctacacctctttcattaagtcaacacacggttttcaaaaatccactaccctcccaccacctagaatcttttgttacctaccaacaccctcctttgttctctttatatattggtccaactaaatcaataagggaaagcatccttttggttggaggaattgctttcattctcactctttgtgtgttgatcaatggactagctaataacaagttcctcctctatatatttcaaaagaatggaacagaaacataaacgaaagacagagtacctgatgttgatgattcattgtctgtctggagctcccaaatgccttttatgcttacatattcataaccaacaacggctattaattataaaccaaaaacacgaaataagtttgtagcaaagtgaaattaggaatcttggagatggatccattagtagtaggataataggatatgatggaatttggttggggaacagtgataacttacgcttgcttccggcgccgggaaagttggaaaacctacaaagtacagaaatggatctgggccttgaagtgggctttttattaaagaaaaaaatacatctccgttatcaatcaccatcttcttctatctacaaattaaagaaggtaacaacagaacgtggtggatcatgtggttaggcattaattatttgctttgtttcgccgttttggtaacacacagacacagttccggtaagagcttttgcagccactctttatagttatttagaattggcgatcgaatcaatctcactccctccctcccttaagtcttgttgaatctgctgaattgttttataaagagttactttggcaaaatggaaaatccggcgaagagagtgttgatgacatccaacggcgacgaggtgtcccgaaacatcgctttccatctagccaaacacggttgcaagtgagtctctcattttgtcttctttcctcctatcctgtgtttcttcttctagccccgatttgtgttgtggttgactttggtgtctatagttaaccttcaaaaaatgcaatgtactgttgctaggttggtaatgatgggaaatgagggttccctaaggagcattgtagacaagattagagattccattgagggagccttccctgccgatgttatagcactcgacatggaatctgactctgaagttgcttttcatgccgctgtccaaaaggcatgggaactttccggccatttcgatgcttttctcaactcttatacctaccaaggtttaatttgcttcttgtttttcactaccctgcctttgatgctcttgtgtgttgatcattcctttattcaacaatctttctttcttgcaggaaaggtgcaggacattcttcaagtctctcaagatgagttccacagaatcacaaagatcaatctcaccgctccatggtttctcttgaaggctgtagccacaaggatgaaggaccatggatcaggaggctccattgtcttcatggccactatcgccagcggagagagggcgctttaccctggcgctgatgcctacgcttcaacttctgccgctattcaccagctcgtccgggtatgcatcctagctcctaattagacacatcgcgttcgtaacttgaatatgtttgttgatgattgggtttcaggcatcagccatgagtctcgggaagcacaagatacgggtcaacatgatctctagagggctgcatctggatgatgagtatacagcttctgtgggaagagaccgagcgcagaagctggtcaaggacgctgcacccctcggccagtggctcaacccggacacagacctctactccactgttatctacttgatcagcgatggctcacgcttcatgacaggcaccactgtcttggtggatggagcgcagtcccttacgcgaccccgtctcaaatcctacatgtgatcaatgcctagtattattataattctatgttgtgtgtaaaaagtgaatatgaatcaagtttgaataactatggagggatgaataatccatggaatcaatgattatatacttttgacaagtatagaagaaagcaaagagccaaaatagtcaacaatctcaacatcattcgagctcattgtttattgaattcaatcaagtttggtaggtgaacctcaaatacacgtgatattggatattatcttggaaaccttgctaatccaaattgtaaatcaaataagaaaagaatgattacctcagagatctagatgcatattgattcttgaccaagaaatatgtttgaaatttgaatccattgaaccaaaatttgaaggagttgcatatataataatataaatcagaatgatgtagccgccacacctttttgtttccacaaaactctttttctgtgatggatccgctaatgtagccatattttcaatatatatcactttctctggcatcttcgctaccgtgtacgtctctctttctctccctcccctccttggcttttttcaagttcccaccataaacgcagagggagttaagaa

SEQ ID NO: 6886 - DNA, 3000 bp, Unknown; identical to SEQ ID NO: 6877
  misc_feature (1)..( 3000): cDNA_ID_3040948_gDNA_ID_1621111_Annot_ID_171790 3000 nt of promoter + ATG

SEQ ID NO: 6887 - DNA, 3000 bp, Unknown
  misc_feature (1)..( 3000): cDNA_ID_2123597_gDNA_ID_1621111_Annot_ID_171789 3000 nt of promoter + ATG
attttacatgtatgtatatgagtctcttatttgatcaccatagcaagcatacagtatcattcattgatgattaagtacgtacctggggaatggattgttcttgactgctttttggccgtacttcctccacctgtatccatcatccagtatatcaacctggcttcttgtctggaacgcgtacctcgcttctctctctttcttcttcttcttactccttggcttctcttcggatgatgttgtcggctgagcagagttgtcgaccccatgaaactctgtcaagcgaggatcaaccgatgatgaacatggaaacaacacatcacacctcctatcctccatttcttaactccctctgcgtttatggtgggaacttgaaaaaagccaaggaggggagggagagaaagagagacgtacacggtagcgaagatgccagagaaagtgatatatattgaaaatatggctacattagcggatccatcacagaaaaagagttttgtggaaacaaaaaggtgtggcggctacatcattctgatttatattattatatatgcaactccttcaaattttggttcaatggattcaaatttcaaacatatttcttggtcaagaatcaatatgcatctagatctctgaggtaatcattcttttcttatttgatttacaatttggattagcaaggtttccaagataatatccaatatcacgtgtatttgaggttcacctaccaaacttgattgaattcaataaacaatgagctcgaatgatgttgagattgttgactattttggctctttgctttcttctatacttgtcaaaagtatataatcattgattccatggattattcatccctccatagttattcaaacttgattcatattcactttttacacacaacatagaattataataatactaggcattgatcacatgtaggatttgagacggggtcgcgtaagggactgcgctccatccaccaagacagtggtgcctgtcatgaagcgtgagccatcgctgatcaagtagataacagtggagtagaggtctgtgtccgggttgagccactggccgaggggtgcagcgtccttgaccagcttctgcgctcggtctcttcccacagaagctgtatactcatcatccagatgcagccctctagagatcatgttgacccgtatcttgtgcttcccgagactcatggctgatgcctgaaacccaatcatcaacaaacatattcaagttacgaacgcgatgtgtctaattaggagctaggatgcatacccggacgagctggtgaatagcggcagaagttgaagcgtaggcatcagcgccagggtaaagcgccctctctccgctggcgatagtggccatgaagacaatggagcctcctgatccatggtccttcatccttgtggctacagccttcaagagaaaccatggagcggtgagattgatctttgtgattctgtggaactcatcttgagagacttgaagaatgtcctgcacctttcctgcaagaaagaaagattgttgaataaaggaatgatcaacacacaagagcatcaaaggcagggtagtgaaaaacaagaagcaaattaaaccttggtaggtataagagttgagaaaagcatcgaaatggccggaaagttcccatgccttttggacagcggcatgaaaagcaacttcagagtcagattccatgtcgagtgctataacatcggcagggaaggctccctcaatggaatctctaatcttgtctacaatgctccttagggaaccctcatttcccatcattaccaacctagcaacagtacattgcattttttgaaggttaactatagacaccaaagtcaaccacaacacaaatcggggctagaagaagaaacacaggataggaggaaagaagacaaaatgagagactcacttgcaaccgtgtttggctagatggaaagcgatgtttcgggacacctcgtcgccgttggatgtcatcaacactctcttcgccggattttccattttgccaaagtaactctttataaaacaattcagcagattcaacaagacttaagggagggagggagtgagattgattcgatcgccaattctaaataactataaagagtggctgcaaaagctcttaccggaactgtgtctgtgtgttaccaaaacggcgaaacaaagcaaataattaatgcctaaccacatgatccaccacgttctgttgttaccttctttaatttgtagatagaagaagatggtgattgataacggagatgtatttttttctttaataaaaagcccacttcaaggcccagatccatttctgtactttgtaggttttccaactttcccggcgccggaagcaagcgtaagttatcactgttccccaaccaaattccatcatatcctattatcctactactaatggatccatctccaagattcctaatttcactttgctacaaacttatttcgtgtttttggtttataattaatagccgttgttggttatgaatatgtaagcataaaaggcatttgggagctccagacagacaatgaatcatcaacatcaggtactctgtctttcgtttatgtttctgttccattcttttgaaatatatagaggaggaacttgttattagctagtccattgatcaacacacaaagagtgagaatgaaagcaattcctccaaccaaaaggatgctttcccttattgatttagttggaccaatatataaagagaacaaaggagggtgttggtaggtaacaaaagattctaggtggtgggagggtagtggatttttgaaaaccgtgtgttgacttaatgaaagaggtgtagagtaatgggattgtgagagtgttaaataataaaagactaggatacgaaatcattgtgacatgtcaatttttcaagtgggtggtggaatccgcaacaaaatataaaataagaaaaatgctttgcttgcttgcttgctctactttgccttctttttgcaaccaacatg

SEQ ID NO: 6888 - DNA, 3000 bp, Unknown
  misc_feature (1)..( 3000): cDNA_ID_2034471_gDNA_ID_1621111_Annot_ID_171786 3000 nt of promoter + ATG
ctacgggttataaaacaatgtatatattatatatatacaaacagctggctcatatatatctgtaatacactgatacagaggaaggtacatatctgtgcctatgtatgcgcgtggtgtagctgtatatgctatggaacatgtatatatgttataatgtatattgaatttccaaaaagctttagttagtaaaaaaataaatggaaaacgtaaaaacaaaaaagaaggcaaaagaaaaaggaagatatcgcatgtcggtgtcgcggcgaaaaggcggtgagggtattgtgggagtgctcacgaattcccctaaaaatcctcatttataattagtatataaccctaagcccatgcaaactgcaatcccactcatctttatcactaacactaactatcttattatttcaccaaaagataaaagtatttcatcgagatatacgtcgatatgttgttctgcatgcaggtgcatggccctctattattttttgtcgaccacaagtttttgtctgtttacaacataagatttcacttattattgtttttttattttaattgtttgtttatcgcactgatagtctgatacacacattcacgaactgcgtttatccctcattgccacctaataattaacttaggcttcacaacatttgtatatcccaattcatttattatatacagttgtttaccgctacatatatgtgcatagttaatctaggaaattaatgttctaagcttttatcgtagttaatattggaacaaaaatatataaccgagtaacaaaagtcgtagtaaatagttttaaatataatatttaacaaaaaaatatagtataaatataataatgccgatcgacaccaaagttataactatatatcaatccaagcctcctcattcagaaagctttcttttataaaactgaaatattgtttagtataattagtactaaacaatggtcaaactgaatattcacaattgtgtttagtatatttcgaagtaatttatcgtgtaaataaaatattaattgtatatatcgttgtaaaatataagaggaacaaaaaaagaaatggaaatagagtaaataaatcagtgattaaggaatgggatagacacaaatgaatcatacggatttaaattagaaaaaaagaaattcaaaataagagagagggtgattgaccatcgggaggaagagagggacattggcaacaaagtggtaaatagaagtagaattaagaagacaacaacaataaaagaaaagaaaaaaaagagagagagaagaagagatgaaacagagttttgtgccccacgcgagccgcctcgcctccccctataccctgaacctttttttctctttctcgcttaaacagacctaaacccaattaatcatcccttagcttatttattagggatcatattgatacggaatttgcagtccccactgataactgaaaggcttttatgtagtactagtcgtatttacgtgaacacattattctttgagtattatcttccatacaagaggagtatattaatagacttttaccttagcactccgaatgatcctcgactattgtttattaatacacaaaacactcctctctttttttattcgtacacaaaacactcctctcttcttttattcgttattttaagaactgaattggtgttcctttaaattttttttaacacgttccacgcgtactttttgtgtgtttaccttttttaatttactaattaataatgtagtacgtactatatagttaaagaaagagggcaaaatggtaaataagagaagagcagctttaagaaaagaagagaagcaatattaactctctctatatatcttaaagatgtactgtaataaataaaaataaaagaagaagaagaaggagaaggggccgttaaaggagtaaccgacaagacggctttactttttcaggctttgctcctttgattgcctcatctcgctgctgacgttatcctcccgttgactgtctacgcactcccttttttttttttttttttttccctaaatatatttactcattattatgtcatagttttacaaggtcgaggttttgtagttttgttaatgctgcaaatactactaatgtatactaatgctgcaaatactaatacttttttttgtttgttccattttttattggtatataactataaattataagaacgtatagagatgtctagcagttttggtcaaataatttgtaatattacggagtatataatatagaaatatatggtacgttgtaaatgtaatgaagggatatatgcaaaatagtactaatatatagcttcgtgcgcgtgacaagcatgagagcatctgatatacctccttgtcttctttcactttcaaacaacagtcaacggctgctttcttctgtttcttcttcattctttggaatttgaaacgtattactattactagtattttgttatgctgcatagatattgcgtcaaaagttatatcacatcacgatattgtctgttatgtttggttgtttatcgatttcactaggttcgttatttttattttttgcaaatttcaatatacaaattattcattttagagtagtaatttacccatggtttttattttattgggtcaaacaggaactttgatcgacgcgtggcgtgggaatataacgtatcaatattttgggctttttaagtgatgattgttttgtaagctttttgagtgatgattgtttgatgggcttattaggcgactgttttatgggcttttagttaattgcaccctttgggcttatgtactctgatttttttgtttggttttttagttgtatttgtaatttctgttcgagcactaaaaaaggggaacattgtcccaattgttctttcgccattagtaccaaactaaactggagatcaatatatagtattagtatgattgattgtatattggggtttcgtaatcatcgcgaaactgcagtataaaattcgaaagtttggtttaggcgtatg

SEQ ID NO: 6889 - DNA, 3000 bp, Unknown
  misc_feature (1)..( 3000): cDNA_ID_1022008_gDNA_ID_1621111_Annot_ID_171811 3000 nt of promoter + ATG
gactccttaactaaaactccgcagatagaggagacataggattcaacatacaccatagggtttatctggttctatgaaacagataatgaggaatataagccaattataaatgattaaaaaaagcttacaagttaatgagcctgctattcaaagccttgcattcttgaataatctcttcctcatcaagaagctcttccaacgtgaaattttctttgtctaatattatctccacctgcgctcataacaaaaggaaagaacatcaatacatgaacaattcacgactcagagacaataattcaaaaaattgaaatctagcaaatccaaaaattcgacataaattatatgaaaaagcaaagcaacggatagaaactccaataatctaattctaaagcatatcagtatctgtagacaagatgaacgctaacatacaacacgacatctaaaaattcaactcacaggagatgatgcagagagagatgtgagcttccaaaacatggtggcgagggaggagtggagctagagaaagtttcgccgtagctgaagagaataaggagaacttggcgagatccgccagaaacctagaagaaaaatctaggtaatcgcttcttcgcggtggaggagtatcgatttcagctcgaaaaccctaatcgatcagtgaagaaagagattgagagatcctaaagatgatggaagcggagatgggagatcggaggtcgaaaattttgaaaattaagaggccgaattttgcataaagaaggggaaaagtaaaaaatggtcttattattatttgttattttattcctttgattgattaagaaaaagttgagcgaattattattaactaaatcgccattttcacagatttgtgtgtctaataaaagtagacttatgattttttcgtagtcgttgtctgatgatcatgattcatgacgatggtggtggtggtggtgatagtaacatacatcatctttatggatacaattgaatgatcgtgagatattgtaacagagagggggatacttgcgtcaccagcagcaggtgacttgtgaatttgttgtgataaagatcacattaatttaaataaaatcagctgttcaatttgcggaataaatagttggcgaaaattgtgcttataaattttacaacgggatgatgaagtacaataagcaaatcaattttgtggataaagaaatgcatatgattgtcttaagtttgatttaatggtgtagaataaaaacatataaagacaaaagttggttgaagtgtcaaacagagtgaactccgtaaacagcctctttttcttcacaccttaagaaaccatagacgaaaaaaagtttacatatttttagaaaattttcgatctttaaaaaatttatgaggagatttgttaaccttacataatacttgacaagagaatgatgaaatttttttagacaaaaaaaaacacgttgaaaagtctcatatatgatgtcactgatttttagatcaaaatgttgacaccccaatttgatcgggaagcaagaaaacccggagaacagatataaaattaaattgttctattctacacaaaaccttgggcatttgttaaattttaactatttacggtttattttaaccatctccactgagaatttatcgttacgtttatggaaatgactacacacatcttcgtttttctaatcatttataggtgtgtacttgtttttccttcaaattttcattgtttcacttgaaaagtgcactctgaaaaatagaaagtacactgaaaattcattgttgttttcacttaaaaagtgcatactggacaacaaaaaacctcaacaaacaaacgatcaaacaagagagtgagagacctaaagatatttttttccactagcgcttcaacaaagaaaaaagaagagaagctttcatttaaacgtggtacgttgaagtatacatgatgatgtaataaagtactacaatgactcaacaacgccagctcttggaatggatattagtgggagaagaagatccaacaactttatcaaccagcttcctcaatcccttcttcttcttcggggtcttcttttccttatccgtcttatcttctctcttcctctcttcttcaacttcttcctcaaactgtgaacacagcttaagcacttgctcctctacattattaagtctctctagcaaagttcctttccgctcagtctcctccctgacttgttccatcgaacggcagtgtaccttccctatgctcctcggtgacgacagatccattgacgatggctgagtcccactagatggagtcgatgggctcgagcttctaggcgagcttcctttcatctcctctaacttcctcaccatgaaatcaatacgatccaatcttgaaagtatcggttcttctacaacagccattattgataacaaacgacaacgtttccagaagctttggttgtgtcggaatagttgaaagacagtatcgaaagcaaaactcgtcttctcttattaatagagtaataattggagattgaaagaacacgagctaggccacgtttaaatattgcagagagagttcatggagactcacacgtgttgttgataacacgtggtggttccagcttgcggacacctcttctgtctcatactccaacattacccattcttccttatctaatccctaaaatttctttacattatgtcgggaacaagataatgtattttggatgcttgtataaaaacattatcttatcccaagtacatttaccctaatttatttatttctccataaactatacaatgttttacgaggtgtatgcgaaacagtgaaagcatgtccaataatttattttgaagtagtcgtcatgcatcttcattcctcaacatcaccatgtccattccttaaattgatcatatgataaatgggcctaaaaggctcaaacaaataagcccatgtaaatatccatcgatttattcaggcgaaagggtgaaacatactgtagttctaaaaaattaatg

SEQ ID NO: 6890 - DNA, 3000 bp, Unknown
  misc_feature (1)..( 3000): cDNA_ID_2123646_gDNA_ID_1621111_Annot_ID_171810 3000 nt of promoter + ATG
acagccattattgataacaaacgacaacgtttccagaagctttggttgtgtcggaatagttgaaagacagtatcgaaagcaaaactcgtcttctcttattaatagagtaataattggagattgaaagaacacgagctaggccacgtttaaatattgcagagagagttcatggagactcacacgtgttgttgataacacgtggtggttccagcttgcggacacctcttctgtctcatactccaacattacccattcttccttatctaatccctaaaatttctttacattatgtcgggaacaagataatgtattttggatgcttgtataaaaacattatcttatcccaagtacatttaccctaatttatttatttctccataaactatacaatgttttacgaggtgtatgcgaaacagtgaaagcatgtccaataatttattttgaagtagtcgtcatgcatcttcattcctcaacatcaccatgtccattccttaaattgatcatatgataaatgggcctaaaaggctcaaacaaataagcccatgtaaatatccatcgatttattcaggcgaaagggtgaaacatactgtagttctaaaaaattaatggtgtcgtcaaagaaacccaaggagaagaaggcgaggagcgatgtcgtcgtcaataaagcgagtggtcggagtaaacgcagctccggttccagaacgaagaagacgtcgaacaaggttaacattgtgaagaagaagccggagatttacgagatctcagaatcatcgagcagtgactctgtggaagaagcaataagaggcgatgaggcgaagaaaagtaacggcgtcgtgagcaagaggggtaacggaaagagtgtaggaattccgacgaagacgagtaaaaatcgagaagaggacgatggaggcgcggaagatgctaagatcaagtttccgatgaatcggattcggcggatcatgagaagcgataattctgctcctcagattatgcaggatgctgtatttcttgtcaacaaagccacggtatagtactaattagacatataaatttagcttgaggaacttaatttcacatggtttttgatgaatttgggagtatcaattgctagtcagtgttaattgggcgttataatctcgcaaattgctacagtaatgagattgtttctgttaattaagccgggaattaacgttattgcttcatctccatgtgtgtttgatgaaaccgtagttactgtgcttgattgtcataggtttagcttttacatccagaacttgtagacacctaacacatgagaaagtccttatatatgatttaggttcatattttcaaagcttaagtgatgagtgtttaattttcctgtattggaacttggcattgttttttctttcttttgatttcatcttgtgttcatcgaaattgatgttcattgcgtttacagtacattaactggtttttgtgattgaaggagatgttcattgagcggttttctgaagaagcttatgatagttccgtcaaggacaaaaagaaattcatccactacaaacacctctgtaagctctaatctcgtccctatttgccaatatctggttacctcaatactgaatcccatgtcgaaaatctcatgctgctgcaccaattgctgaacttaggatttctggcttctgcacaagggccagtagttagtcttaggaagagtttagataatgagttaatccgttcgtatcacttgcaagatttgttgcactcctaacataattgatgacactgtcatttctactcgttggcagcatccgtagtgagtaacgaccagagatacgagttccttgcaggtacttaataacctctgaagtattcgttttatgagttccatgtggtttacgaacagcattttaatacctgtaatatcttgaatgcagatagtgttcccgagaaacttaaagcagaggccgcgttggaggaatgggaaagaggcatgacagatgcaggctgaaataaatccggttggaatcgaactgaaccatttggattcaaatttgtgtccctgtcctggtttatacttcataggttccatccgcccgatcttcacctttcttattaaccactactgagattgcacatatttgatttctagaatgtatacattttttttcttgtttcaagttaaaatttgtaagagttgtcggaattctaatatctttctttagtatcaaaaaatacatttttgcagccattttgtgaaataaattttgtagttggacttatttacaatggctgccactggattttgatgtttgtatttgataattagaaagaaaatcttcgaattaaatatttgacatttaacaatctttccaaaatctctccacattaactaaacagagacaaaattacaaaatatttagacaatgattcataaacatatcataaataagatcaacattaataaaataaatggttttttttactggacgggtttgacaggacgttacttaataataattgtaaactataaaataaaaatattttatagttagatacaatttgtaaacttttatatatactaacattaaaaaataaattgtttccgcggtgtaccgctgagttaaaatctagttataattataggacaattggtcagaaaatatttagaaaatatttttaccataattattcttactaatcaaattataatattagtaaaacaagccaattatcaaaaaaaggtttttaaaatcattcttctagaccaatttgaaaaaactttccacattttcttttctttttacacattttataattctgttataaaataaataatccaaaataagagtttgggggtaaaactaaaaattcaaataatatgatgggtatgaataaaaattagggtgggtccaccagaagcagcgactgagagcagctctcagccgggaaaatccgacgatccctaaaacccttttccttctctttggtttgctcgagaaatcgtttcctgccatg

SEQ ID NO: 6891 - DNA, 3000 bp, Unknown
  misc_feature (1)..( 3000): cDNA_ID_3049165_gDNA_ID_1621111_Annot_ID_171806 3000 nt of promoter + ATG
gaaaaggtttctggtgtcagtgtaatgacttccgctttaactaattcaatcggtataaaaaggagaagtataatcatgggagcaacaagccgagcacctagcgtcatcgcagcaaaaccccaaattttgatacttcaccagtcctgttaacttttcttccaaatttgcaaaataattgcatttaaccacactatttccaaaataataaactacaaaggatcaatgcacagtgcactgaaagggagcataagaaacaccaaaatctaagacaaaaagattatgaaacaacacacgattaaatagattgaagttgcaaacccgagtttaactaataacattaaaagaatgaaactttcaaaacctttcaaggttttactaatcaattgctagcaaaggcaaaactccaaaccgattacaagggacgaaattaggatttggttgagaaaacatttcaaaagagaaacgatctattcatctgatctgaaactaatacgaaagaattgaagcaagattcattggagggatcagatagaagagtagggatatcaaatcttagatgtgtctgaatcgcttaccttctgcaacaccaattccgagagcagaagaaagagaggaatgtcaaagcatgtttggttttagaaagttaagtcccctaataataataacttaaaacacaaatacgtaagcccattactttaggcccaatactaacatcatgctcctttttttgttgggtggatcttcttcccatagccatcagcttcttttactttcttcgtttctttgcaaaagaccagcgataattatgaacaaaggcggtggatccggtggcggatccggtggaggaagcggtccaacggccgccgccgccgccgcggctttacagaagcaaaaggcgttgttacagagagtggagactgacatcacatctgtcgtcgataacttcacgcagatcgtcaatgtttcaagggtaagtgtggtttctttccggttttaaagttaggatttatcagaaatttcaatctcttagattggctttaagattagtgtttattgaggcgaaacatgtttggtttcggtaggtgagtgatccgccggtgaagaactcgcaggagacatacatgatggagatgcgagcttctagaatggtaaataattacttcactccattgaattcgaatgatttctttaataggttcatgcaaatcagggtttaaatcagatgtgaaacgttttgaatctctgccaaagtacacatatttggaatgtttttgagtctaccaaacattcactcatgattctccaaaatctaatttttactgttgtttcaaaactgggttgttttgttagcttatgtcctcattgtgtttgttgaatgatttcttttaggcatatggattagggaagttacataggccactcaagtgttgttgaaagattttcttatgagtctctggagtgttgttaacttacttcctcaccaatggtggcaggttcaagcagctgattctcttttgaaactcgtatcagaacttaagcaaacagcgatattttcaggatttgcatcactaaacgatcatgtagaacaaagaatagaagagtttgatcaagaggccgagaagacaaatcgattgttggctagaattgctgatgatgcatctgccaatcttaaagagctcgagtctcactattactcttctgctcagagattgactctagacatctgatattagaatgcctggagacaccagaggaaacagataaaacaattggttcataaaccagaggaaacggccatcgaaggatatgcagtttgaagtcatggacaacgttttggactatcctttcccacattgatcatatttcctctctcaattcgcatattacttagcaatcttaaatgttccagtctgatgaacaagcgtttgatgttttcatcaatcattagtgatttttttgctgttatcctcttgtatgttttgataattacgtgaaattacattctcttaacctgcaaagtgtatatcgtccaagtaaaaccttcttgatttaattcgcgttgaaccaaatttaattatattccacttttggattgaaactatcaaattcaaattagcttgacttatgaaacaagagcgacccctcgaggttagtggacttttatgaaacgcgaccgactcttcaaggcccaaagaaaaagagaatattcggcgggataggggtacgtttgtaatttggcaaacgatgttatgttaaaccctaacttattatttctttcgattcaccactataaataaactcgaatcccaaacatagctttattccttgcttcatttttcgtcaccctagccgctttactctcttgcgatatctctgaggtaagctttttcgtcaccatcttcgatctgcttctttctcttctgttgatctgtgttgaatctgtttcgatccttctcgtttgtttgttgtaatctcttggattcgattctctttgtttatagatcgtttggaatttctgatctgtggtgtaaagttttatcgatttaggagaacaaagtttttacagtgccatcgtattgttttttttcttcatgccagctgatgataaactatatgatcgatctggttctgaaatttttgtattgttcaatggattgttgattggatcttttgatgtatgtgatattaattgtcgatttgaattgtgattaggtaattctggagcagcataaacaatcaattgattcattcttcttgataccaagttgtggaaactctaggattgtttgctgtatatctccagaattgctgttttgattgaatttagggtcgcttagctcagttgatagagcaccacattttttgtggtagaaatcggtttgaatccgatagcggcttttaacaatgattgttttttgtgttcataagtctactgtttttcttgattcaatatttgattgttctttttattgcagatttgtttgacagtctctaaccatg

SEQ ID NO: 6892 - DNA, 3000 bp, Unknown
  misc_feature (1)..( 3000): cDNA_ID_3049169_gDNA_ID_1621111_Annot_ID_171805 3000 nt of promoter + ATG
atgatctgctgttgtaacaaggtaaccatatctttcatctgttatgtgactacacattgcttctctttttgtgttctgtctcattaattgcggtttgttacatgttgtttgtagatggatgccactacccccaagtactccaaggccaggtacgatgaaatcatcaaggaggtgtcttcctacttgaagaaggttggttacaaccccgacaaaatcccatttgtgcccatctctggatttgagggtgacaacatgattgagaggtccaccaaccttgactggtacaagggaccaactctccttgaggctcttgaccagatcaacgagcccaagaggccgtcagacaagccccttcgtctcccacttcaggatgtctacaagattggtggtattggaacggtgccagtgggacgtgttgagactggtatgatcaagcctggtatggttgtgacctttgctcccacaggattgaccactgaggtcaagtctgttgagatgcaccacgagtctcttcttgaggcacttccaggtgacaacgttgggttcaatgttaagaatgttgctgtcaaggatcttaagagagggtacgtcgcatccaactccaaggatgaccctgccaagggtgctgctaacttcacctcccaggtcatcatcatgaaccaccctggtcagattggtaacggttacgccccagtcctggattgccacacctctcacattgcagtcaagttctctgagatcttgaccaagattgacaggcgttctggtaaggagattgagaaggagcccaagttcttgaagaatggtgatgctggtatggtgaagatgactccaaccaagcccatggttgtggagaccttctctgagtacccaccacttggacgtttcgctgtgagggacatgaggcagactgttgcagtcggtgttatcaagagtgttgacaagaaggacccaaccggagccaaggttaccaaggctgccgtcaagaagggtgcgaagtgaaccatcctcaaaacctctatctgccgcagtgaatcaaaggacagtgttagttttattacaatagtttggtatttggtcgcgtgtctgtgttcttgtttcgttttctccccgtcagagcgttgttctcgtatggttctgatcgagtggcggatctacacacacattccttccctgtttttgctttttatttgttttctcattttgaactgttttaaaatttctgttatatgaatgaatgttttcctgcggttattatcttctttactctaattttctcttgttgcgtaaatcgtttccgaaatctttttacctctcttctctattgtgcataattaatcgctgctttcaatttaaactttttgaaagctaaaataaaagttttatggtttcaaatactcaacccgttaccgttctgtccgcaacacgtgtattcaatttgttgctgggctgtaatgatcggcccaaatcaatctaattttttatttatttttacatgtccaatataaggcttaatagataaattggacttggttaaggtccattatagatgccactgtggtaccattagccttgcattgttttttttgtttttacatgcccaatataaggcttaatagataaattgaacttggtttaaggtccattatagtccaaataataaggcttaatagataaactggaattacatgagagtagtggtatcataccaaaattcatgaattttgcatcattattttctggcattggatgatgatgaatatataaatatttcgcttatgaaatagaaagcctttgctcaaataatgaagcacatgagttgacttaagcaaaataaggcgagatgtttttttttttgttaagggtttaataacggcgagatcgttaccagtgtatttgaagcacatcaatgtaatcagttgtacacaggcaggagatatatagcgatcagtacataggctatatgtatatacgtacttttgcatgtgctctctacagcgtttcatatgcagcttattttttttttttaactgatttgttctgatttataaatcttcgtatgatcgtatctaaagagaacatgctcccgtgagtcgttgacgttaagtatggggggagacattaccggaacgaaaattagtaaaacaggcggccagacataagggtaaaattgtcattacgctaaggagattatcttaaaccctaacttttttccgcttcaccactataaatacaaacttgtttacccttccaatttatttctctacttgtccacttttctacagccgcatcatccttctcccttgtgcgatatcgtttgcgtgaggttagcttttcatacgattcttcgatttgaattcttattcttccgatcgatttggtagattcaatttcgtcccgttgtcgtttgcttcttcttaatcacttctatgcttctttacatgtaactctctgatttgttgataggatcgtttagattctttgattccatggctttgaacattatcgattgaggaaattaacgttctgtagtgcaatcgaactggctttccttttattatttcaaattcagaatcatgtaatctgtcgatctagttctttgaattttctgttgtgcgattgattgtttgttagatccatatgtgtaaggttaaattgatctattggtataatacatacgtttctagttatcaaattgatttgtgattgggtaattctggagcagcataaaaactccattgtttctttccttcttgaatctaagtcgtggaaactctaggattgtttgctgtatatctcttgaaattgcttgtttgattgaatttagctcgcttagctcagatgatagagcaccacaattttgtggtgagaaatcggtttgaatccgatagcggcttttaacaatgattgttttttgtgttcatatgtctactgtttttattgattcaatatttgattgttcttttttttgcagatttgtctgaaaagtagctaaccatg

SEQ ID NO: 6893 - DNA, 3000 bp, Unknown; identical to SEQ ID NO: 6892
  misc_feature (1)..( 3000): cDNA_ID_1988895_gDNA_ID_1621111_Annot_ID_56091 3000 nt of promoter + ATG

SEQ ID NO: 6894 - DNA, 3000 bp, Unknown; identical to SEQ ID NO: 6891
  misc_feature (1)..( 3000): cDNA_ID_2993545_gDNA_ID_1621111_Annot_ID_56092 3000 nt of promoter + ATG

SEQ ID NO: 6895 - DNA, 3000 bp, Unknown
  misc_feature (1)..( 3000): cDNA_ID_1816083_gDNA_ID_1621115_Annot_ID_56169 3000 nt of promoter + ATG
caatgatggcattccattaaattactactattgaattgtacacaaatcctccatcacatcaaccaacaaacaaagaataatacaaattaagaatatattccaaagaaattgataaatagtgattgttagttgtaactgtaaacacaaaaccagaattcttaattattaatagaaaaacaaaggtttcgaatggtaaccaaaatgcaccgtgcaatcatacatataacattagttagttatttttagaatatattgaaaagataattattgtataattactaagtatattcaatttaaagtcgtaagaaaaaaccctttattggctctaattgtttaaaaacatatattaggattcactaagatgtataattgaaatcaatttccaaaccatgtaaaagtactagttttctcaaatagtttgttgctattagtttgttactaaaactaattcacacatttttatcaccaaaagagcaaaaatggacgtgggatgaatatgatgatattttttttgaccttgttgtagggtctctcactctcttcttccattaaagaattctcagagcttttcttacttcaactgttttcttggcccatctcactgaaataagtgtgataaactctgcctgttacattatttggattttaataggtgaagtaacggaatatgtaatctacatcaaaataatattcacttctatctctctaccttatggcattagaaaaatccaattattacatgaaaggaaactatagtaattagatgaagcatagaagcgacaattaaaagacataaagagagacaagtcttggcaagttttctctgtttcacactttggagacgaaaccttaaaggcttaaaactgagaaaaacaaagccgttggcttttgtaagccgctcgttcttcgagacaaaacacactacactctttctctctcactcactcttcatctcttttcttctttctctctctcctaaaaatccgacgaaattatgattcactttaccttttaatcaggaatatccctgtttcacccttcttcttcttcttcttcttcttcttcctcgtgttttttttccataacattccctctgaatcttcgttttttattggaaagaaacaatctaatccaagttcaagggttttctcatcttcagtggctgaagttatgagctttacaagatgggaagtgttctttggtctctctgttttagccttgacaatgcctttctcagctggagttactaatctacgagatggtaataatctttctctgcaaagttttttttatttggattttgctttgactctccttcttttggtttagtgaacactctagattttttttagacttgtgtctagtgaaaatgacttacatcagttttagggtaaactaggtaagcaatatagctgtttgggaagctccagattggcaaagttctatgattttgaggctacctcaaaaaccctaaaaagtttaggtttttgacacataagctcttgttagggttttagttcaagaccaagaaatttgttcttattgttcttcattaaatggttatcataagaaagattctttaatctctagaaattttactttttgatgtgtttgtctgttgtttaataacttctgcagtttcggcgattaataacttgtatatcactttgggagcaccatctctacatcattggcttgcttttggaggagacccttgtggagaaaagtggcaaggtgtggtgtgtgactcctcaaacatcacagaaatgtatacttcctcttctgctcttgtaactctttgttatggtttgctttgagtcaccaattcaggttctaaccacgtgaattattgttgttggctgcagaaggatacctggcatgaaggtaggtggaggcttaagtgatactctggctgatttttcatctatccaagtcatgtaagcaaagcttcttgtcttgttttctttcatcttcatcttttgtatgaggcttcttgctatgtgaagaacatgcaagatgttgttaccattgactataaggtttggttataatcttgaattgctttgtgatactttttctctcttctttgtttgagtggacagggacttcagtagcaatcatatttcagggacaattccgcaggctttgccttcttccatccgaaacctgtgcgtttgagaattgactatgtgtatggcaatacttatgtttccaacagttaaaagacacttcatgtttggtttcattttcttgtttcagatctctctcaagcaatcgcttcactgggaacattccctttacattgtcctttctatccgatttgtctgaactgtaagtctttattaatgtagataccgtttcttgcatctgcggtttttcctctgtttgaagcagactctttcttttcccttcaggtcattgggaagcaatcttctatcaggagagataccagattactttcagcagctatcaaaactgacaaaactgtatatttcctcctcactaagtctcattttgtatcctcccatcagcgtctttcatttatacattaagtttctaatgcagggacttatcgtctaacatactggaggggcatttaccttcttccatgggagacttagcttctcttaagatattgtaagtgcacatatatgaaaccgtatacaaacattgttatcattgcttttatatgtgatgtggtcggactgtaggtatttgcaggacaacaagctcacaggaacacttgatgttatagaggatcttttcttaaccgatttgtaatcgtttttcaccttgcatactctttgttcttgactctccaaccattaagccaacttcagtatctcactatggcttttcatatttttgattcaggaatgtagaaaacaacttattctcgggacctataccgccaaatctattgaaaattccaaacttcaagtaagtattactaaaagaaaacttgaatgttttttttttccttttctttagccattcatg

SEQ ID NO: 6896 - DNA, 3000 bp, Unknown
  misc_feature (1)..( 3000): cDNA_ID_1816087_gDNA_ID_1621115_Annot_ID_56174 3000 nt of promoter + ATG
aatatttaatcttaatttcaaagatatgtacatcccacctaactttttttttccaaagtattttttacaatttcttcacgaagtcacccgcataagaatcaatcaatctacttatgcgatttcttatgttagttaacaacgagtcttataagtcatcaactagtaggtgacttggttgtggaatctctaattggrtggtaatatatcaactctctaatcgttttcttaatacattttccttatcagattatccatcaataacatctcaacgcgtgtcttattgtgggatgtctttgtcctagaattaaagaatacattgactgattcacaatttttctagaaacgtatccccaaaatcttttggccaataaggttattacaattccacatttaattgatattcatagttaagtgggtatccatagttctgagaatcatataagtggacatccattggccaatatggactcatggagtctggtctaacagttaagaggtccccatattgaacacaaaatttaattttataatcttctatttgcgctaagagatacaaaataatgtaaattacgtacaaaacaactaaaatagcaacacaactatttgaaggtgattagataaatcattatctcctattatagtagtacaaactacaatataacttataagtttcaagctagtggccattcaccgattcaagggatacaagtaggaaagatttactaatagatctatctaaaatttaagtttattcaaccatatttttttgttatacatcaaaataatatgaactgtcttatttttcatatagtattttagttattaaataaaatatcaatatagcaaccctttttttagaaatgaagctccaaaattaaatgtttatgtaaaatgctctatattcacgtagcaaataaacagccggaaagctatccatgaactgtttcttgacatatataaaaataaattaatgttcattgagcatgcaattcttgcactaaatgcccaattcttctattaacacttttatatacatagagacattaccttcccaagaaaaagacaaaaaaaaatgaacagttaaatgcaaaaaattaagtatatccatgatgaaacgtaacataaataatccggacatgatttccctctcattccttagcaaagaaagttgaattccatgtcataaccattcaacaaaacacttttcttttgcttcgtaagttttctctagtcttctaaacatgtatttaaactatttcgagacgtacacaacttgtccatttgaattatggaagtaaaatcgtatccacacttaccattatcaagctagcgacctatttttcttggccaaagccattattatgtgaactatataacggtcaagtgtataaatcagtttgtttaccccaaaaaaaaaggtgtataaatcagtttaaaatccgttttagttttgaccaaaatgattacacaactgatctattatacaatcatttaatatactccatgtgtagtggcatagtggatgtgtgctaataacgttcgcagactccgtggttcgattcctctcgtccaactagtttagtggtgagaaaaaaggcctatatttgatttattttctatatgatttagatattcaccattaaattaattagctattgtttgaccaaaaaaaaaaaaaaaaaaaaaattaattagctatcttgaaacaattagtacattgaattgaattcaagaatcccaacgcataaggttcgccacaaaactgcgtcattcgactttctagtttctaatgatgaggttcccttgaatttatttaactctttttttgcatatacattagaaaaaaatcactataaaataaaaattaaagggcaccatcaatttggaatatatcctccatttgcctttctctcaagtctcaacactcaacagtctgctcaaagatgttgcaacgtgacatgtctattttcttgttgttttaatgaaataaatcatcttttttcttaggaatatccgcaccatatataacctgtgagtctatgacgttagctatagttgtgagaagtattcgttagtttcatcaattttaatgatgctatattggttcgtataactttatcttatgatcttttctataatcttattgatatagttcctttataactgattacgctctgcaaaattgatggacaacatgtatttgacttcgattttagtgggcgatacattattaaagagaccatgtgcataacaattaaggagtacgagtgagctttttactaataaatataaagtacgtacatagcaaaaatcatatattcgaaagtttttaaatttatagttcaaattttttgaatacataattagcagctgatagtattgatttgtgtatccacaatacataaaataatcttcatcagtcggtaaacactaaacataccactcctaaacctggtttggtactgcaaaatctatataccctagctactttgacttcggaatcgtgcgtatttaaagtttgataaatgtttatgcattatatatctatattccaatttcccaaattatatatttcctcactagttaagcttatgctattgtggggtcgattaatccgccaattttcttaggttaataggattgtatattagttatatttatattacttttggccatgacgtggttcaaacccatataaaagaaagtgcttcatccactctatttaagtcaagtatacgaattctctcgaatttgtgcctataaatcttagtttttaagatggaattattcgaccaaatgaacaaattaaagccaccaattgccacctaggactattcttccatatccacttaattaaacttttaagaaaaaggaaaagaaattaaacaaaagcaaacaaagatctcatgatctttgcttataaatagaagtccaagtcttagatctttcttatcatctcactacaattcttgatcttcttcttaacttatacctcaaata

SEQ ID NO: 6897 - DNA, 3000 bp, Unknown
  misc_feature (1)..( 3000): cDNA_ID_1816149_gDNA_ID_1621115_Annot_ID_56175 3000 nt of promoter + ATG
gctcatgggtggatatgatccatgcttagatgattacgcgagagtattttacaacagagcagatgttcagaagtctcttcatgcgagtgatggagttaatctcaagaactggagcatttgcaagtactctccccaatatcctttatggttttttttttgtgtaatatttgaaggaatttgtctgaatgttctttggtattctaacttcagcatggagatctttaataattggactggttcaaacccgtcggttttgcctatttacgagaaactcatcgccggaggattaagaatatgggtttacaggtaaattaaattacgttcacgaaaaccaactaaattcctaattaatttcactctgacgaaaagtagttgactacaacacaaattaaaaacttcgatcactgaaactaaaaaaacagagtatacaattaggtggcttcctacgcaagtaaccactacatactttagcttcttctactttggttggttaataacaatatgaaagaaagtttattctccaatttttctaagccgttggtttttggtttctttttgtgatggatccagtggtgacacagacggaagagttccagtacttgcgactcgttatagcttaaacgcactcgaattacccatcaagacagcttggaggccatggtaccatgaaaaacaggtacccgtggacctaattcaccagttatatgaaattcttgatttgagtattgttagaccggttaaattcttgatgatgctataacaggtaagtgggtggcttcaagaatacgaaggtttaacgtttgctacgttcagaggagctggacatgcggtgccttgcttcaaaccaagcagctctctcgcctttttctcggcgtttctcagcggagttcctcctccgccatcgcggtagagaagaaattcaatgattaaaaagatgatttagtacgtaatctaattatgagtatttttgaaagatttttgggttttgtttcgttaacttgtcagacacacgagataggggaaaacaaggattgtaacttgtaagagagaatatgtgatttatgttacgttttatgtcatgatcataatgatcaaaagaaaaccttcaccgctttgagattatgatcaaatgaaaaataaatagctttttggtgcaatgtcattataatgaaatccaaattggaaccccagactagtttggcgcacacatttttttggtggtttttgttaattctcccttttatataattcattagtaaccgtagatttttgctacttaaatcgatggtcaaatataataaagttatgtatacggtatatgataatctctcttttgggtaagaatggaacattcatgcattaatcatcagaaaatctcttcccaaataagatagtaggatttcattcttaccaaccatatttacttttgtattagcattatattattattattcccatttgttatcttagagataagtttgaaccattgacccatcaaattattattttttcattcagaaatataaatatattatcttctttcttttgccatctttcccattatggattaggaacattttacattgtgaaagaaagaaagcgttacactttttttttttttttgttacagtactctgatttcaagtaaaataataataataatactacacatacttattttttatacttggagcctaaaatttacggccgcacgaacggagtgcacgtttgcttctgtcacatgtttgtttgtccgagtttttgctcttgcatactgccgttgtaaaaagttggaaagaaaataatcttaacttttcaatttcaaattagaaatgaaatcaaagaaattggagcttgacttgtctttttatagatatcctccttttacctattttactatactcaattcttctatttttaggatccttctgaaaattaaattaatttttccatttatgtttgtagtttcttatttctgacaaaacaaatgttggaaaaaatctatccttagatgccacgtgtagctattcgataagtgataagattcagtattatctggagcgttagcgttaaataacactcttaagcttcacatgttttatcgcttacactcaaattaagtctatgtaattacaaaattacaacactctctccatctctttgttttctccgcagatgatgagtgtgaaaacctgtaaagttgaggtaaagcaatttatcggtttcgcttttaaattgtttgttatcgaaaacttgttttgatatctcttatggcttttcttatttatgtgttgtttgttataaactttgttacagcctttaaaagggcaaacaccacttagaagtagcaagaccaaacaggatgctaaaccttattcgtgttcttcaccaccatccatcaaggcgtatacatctccattcgtaagccaaaagacttcaagacgtgttgctttgtctgctgaagatatcaagaatgctcatagagaagcgacaaagatctcgagttcgagctgtggatcaagcaaatggacaggaaatttcattctcatggtggagcttcgaagaaagattatcaattttagaaccatcattgatcttcctcctctgacctattatctctctatatccaatgtacgttacctcttccctacgttttctttctttcagataatcgtatctttgacctaataaactcacagactaatcacaatgagaattttcttttagtttctgaggtgaaaagtaatgtgaattttccattaacaaaatcgaaaaaatgttatttgcataatgaataaagaatgtgaagaagttgtaactagctatatctcatcgtagcaattacaaaaaaaaaagatatcccagttcataagcagtgatcaaataggtaaatccagtgaaaatcgattccttggttaaaaaaaaaaacgcaccacttgatttgtgtgttagatatgactgatttgtggcgttgttgtttgttttctggatcaatggtag

SEQ ID NO: 6898 - DNA, 3000 bp, Unknown
  misc_feature (1)..( 3000): cDNA_ID_1816145_gDNA_ID_1621115_Annot_ID_56176 3000 nt of promoter + ATG
caaaattttataatcctagtactatctattaattttgctttttcaattttcccacatttaacattaaaaacgaaagtgaaacgtagccactatggaatatgtttcattcatcgttagtgttggcagttgcaggtggggacaagctgcatttccatgttgcttccaaagtcaaacagatcaaagcagcctctttgaccaaaagaatccaacttttttcctcaactttcatggccgccaaaatcaatcactcactttccaccaccaaaaaacctcagattctccaaacccatatcttcgatttcaccataatccaacataaacatgcctaactcgattctctttcttcttctttcattcctgtatctcacaaactgcgttgctcaatctccatcacaaacttgtcctttagatttctctcatgtcctaacaatcccatggaacacaacagattgtcaaaagtccgacaaatcagccgatagcaagaacagttgttgccaatctcttttaactctaatcggaatccctctagctcatcgtctcaaacaaacttccaatttccgtctcccaaatctcgctacttcaatctcttgtctcaacaatctccaaacgaagcttagttcactctctctatcttcgaatctcacctctctctgtttcgatccgaatcagttcgtcatcaataacgaaacctgtgctggaatccaaacgactcaagattgggtatctcgtctcggtccatctacggcgcttgactccgcctgtagcagtggtctcactgatctaacgcgatgcgacgcttgcgtggcggctgggtttagggttcaaaaacagctcatcactttggacggtaatagctctcacggtgtttattgttaccattttgtggttacttacgctgctggtattgttaacaagaaaggacctgagagtgatgatgctttgtcttgtctcttctctttgagtttgagatctccattgaactcaaagaagaaaagacacacggtggctcttgctttagggataaccggagctattttcggggctctggttattgccggtttgatttgtttgtatttccggtttggtaaagctgttaaaggaggagaggttggttgggaggatcaagggtctagaccgaaatggagaccaaacactggctctatctggttcaaaatcgaggaactagagaaagctacgaataacttctcgcagaagaatttcatcggtcgaggcgggtttggttttgtttacaaaggggttttaccagatggatcggttatcgcggttaagaaggtgatagagtctgagtttcaaggggatgcagagtttcgtaatgaggttgagatcattagcaatttgaaacataggaatcttgttccgcttagaggttgtagtatggtggatgatgatagtgagagtcagagatatcttgtttatgattacatgtctaatggaaatctcgatgatcacttgtttcctcgaggtgagactacgaagatgccattgagctggcctcagagaaagagcatcattttggatgtggctaaagggttggcttatttgcattacggtgtgaaacccgctatttatcaccgggatattaaaggtacgaacatattgttagatgtcgatatgagagcgagagttgcggatttcggtttagctaaacagagtagagaaggagagtctcatctcactaccagagttgcgggaacacacggttacttggctccagagtatgccctctatggtcaattaaccgagaaaagcgatgtgtatagcttcggggttgttatattggagatcatgtgtggaaggaaagctcttgatctgtctacttctggatcaccaaacacttttctgatcacagattgggcttggtcattggtaaaagcagggaaaacagaggaagctcttgagcagtctttgttgagagaggaaggctcagggctctcgaatccgaaagggataatggagagattcttgcaagttgggatattgtgtgcccatgtattggttgctttaaggccaacaatattagatgcattgaaaatgcttgaaggagacatcgaggttcctcctattccggaccgaccagtcccgctcgcgcatccttcgtaccgtatggacggaaacggattcacaatatcgcctgcgcttagcggactacaaatacattccggagatatgctcagatgaaaaaactaggctcatgtgagattttattttgtaaatatttgaaagcaacgatcacgtcttttgattacatcatgtaaaacaatttcagaatgttgtagtatatcataagtagggaaaacatatagttcattgtaggattatattctaaatcaaagtagaggcgaaggctgagatgcgggggtgagggcggtagctggtggaagccttccggtacaagtgcaaaagttattaaggcactcacatttggtgcagtggttcacagtcctgcaccatcttgacactaatggtcctctcgcctcagccaccatgtaaaattctgcaaccattcaaatttgtgtttatttttgtccgttgcaaaatttatatgtatataaataagaagaaattacatattttttttttttgtcaacaagaaattacatagtttgatacataatgatttgtcaaagcattttcaacagaaaaaaatcagatacatattttactattaattttatatctggtaaattctatattttacagtatacagtacattacacaatttcctgaatcagttgaatataaaatgctcaaactagcataaatttaaaactttccagcattggtaatactcaaaaaaaaaaatcaataacaaataaatgtttagttgtaattcagacacaacttgaaaccccaaaaatcagactgtgaaaatttgtgtgctctttttaacttttaattgctaaagttagttagtaatttaaaacattctggttactcacttagtattagttattactgtggtaacaacaaaatttaatg

SEQ ID NO: 6899 - DNA, 3000 bp, Unknown
  misc_feature (1)..( 3000): cDNA_ID_1816127_gDNA_ID_1621115_Annot_ID_56181 3000 nt of promoter + ATG
agatacttaatgcctaggatgctttagtttccagtcatatataccctagtcttcttgactttgttcaacagcaaagaagaccaaggtgatgaagcgtcagtctacatttgttttccatcatgcctctcatccttggagtaacaatcgttttctcatttggatggtaactccccatgcttttaccttaagctgtaattttttaaaaatttcatatctctagttaagaacactgttatatttttctccagaagctatttttacggcatttgtccagcaataaaatatatgtttgcattgcagctttgtttcctgcggcaatttagaggctccatacgaaagtctgactacttcgcacttcggttaggtttcctcactgtgagtaacttttttatttcgtttctcagtctttccttcaaatttaaaatataactttctagtaatttctcaagaattctcatctaatctggtagctgacatgattagttttctgaatccggtcttcattactttaaaatttcagaaacataatttgccatttacatacaacttccatatgtatatggtacggacgatggaagatgagtttcatggcattgttggaattaggtatgcgtttctgagaattgagatcttatcaaagactctttattcaactgttttcagaagatttcgtaagggagttacagaatgggactgatgaatgtttcttgatgaatcaacagctggccactttgggtttacgctatagtatgcatctgcataaatgttcatggtaacttatcggttcaataaatacaaactacattccatttctatctccacattaaagctttgtctttactaattcagtgatttccttgcaggcctgaatatgtacttttggatatcattcgttcctgccattgtaagtaaaagcaagattaagtaaaaagcttgaaattcataaggcagtactaacactcagagcatgtgtttgtatctgttttgttgtctaagcttgtcatgttggttggaaccaaacttgagcatgttgtctccaagcttgctctcgaggttaaggagcagcagacaggcacatctaatggggctcaagtcaaaccacgtgatgggctcttctggtttgggaaaccagaaattctgctacggttgatacaatttatcatttttcaggtaagcaaaaagacttttcctttctcaattcttcaagccatgatattactctattcacacagatgatccttatatatttcctgctaatgcagaatgcatttgaaatggcaacattcatctggttcttggtaaggccaccttataaaatgcatcaatacttaaatcagctatgcaaagtttttcagtttttgagaagatcatcaatttcatgtatcagtggggaatcaaggaaagatcttgcttcatgaagaaccatgtgatgatatcaagccggctaatttctgggtgcgtttcaaatacacaacaattcgcagcaacacactgtctcttaagattttttttttctttctggtgaatgcagggttctcgttcagttctggtgtagttatggcactgtgcctctcaatgtaatcgttactcaggttcgtcaaaacctttcatatatctacaattccacaatcttaagcctatccaagtctgtgactaaacatcgttcataaaaactctatggtttcacctgaatctgaacagatgggatctcggcataagaaagctgtgatagcagagagcgtaagagactcacttcacagttggtgcaagagagtgaaagagaggtctaagcacacgagatcagtgtgttcccttgacacagcaacaatagacgagagagacgagatgacagtggggacattgtctaggagctcatcgatgacttcactgaatcagattaccataaactccatagaccaagcagagtctatattcggagcagcagcttcatccagcagtcctcaagatggatacacgtcgagggtggaagaatatctgtctgaaacatacaataacatcggttcgataccgcctttaaacgatgagattgagattgagattgaaggtgaagaagataatggagggagaggaagtgggagtgatgagaataacggtgatgctggagaaacacttcttgagttgtttaggaggacttgatcttgtttctgcttttagaagcttggttcagttgtaattacttgacatccatacaagaataacaattaacaaagtaaatcttttgttggtccagtaaaaaaaagtattcaatgatcaaagtacatcttttgttggttcagaggtaaatttaaaatataatagcatggattggaacgagatattatggcattaggaaactttttgattatggcagtataaacaaagaccacaaattatggcagctatacatatattgatttcaaaacagagataaagacttgtcacctgtcatttgattatttatgaatttacctctgcagcattttccttcttctgtgcagtcacgcctaccgatggatttgattaatttcctgtcgattattactaagttgtatttctagtaaatacaacttaaaagtagttttgtactcggtcttaaaactagttttgtacatagtttttgagtaagatactttgttttttttgggacaaagagtaagttagtaatatcaaattttatcatagtgattgttaatttatgtcaactacgaaattaagaagttatcaaatctgatttgagttatgataacaatgtcattgatagactcggtcaattatggcattaagaaaatctaaggatttaagtaaccaggtatcaattattaccgccgttggtattgacttttaaataagacttgccagttgtcacacacatgtcataaacaattgtttttttcttcttcttttcattcaaatgataaaattaaacttgcactatacagtttctatagaatcatccatcactagatctggtctggcgatccccaaaagatcaagtcaaaa

SEQ ID NO: 6900 - DNA, 3000 bp, Unknown
  misc_feature (1)..( 3000): cDNA_ID_1816123_gDNA_ID_1621115_Annot_ID_56182 3000 nt of promoter + ATG
tgaaatggcaacattcatctggttcttggtaaggccaccttataaaatgcatcaatacttaaatcagctatgcaaagtttttcagtttttgagaagatcatcaatttcatgtatcagtggggaatcaaggaaagatcttgcttcatgaagaaccatgtgatgatatcaagccggctaatttctgggtgcgtttcaaatacacaacaattcgcagcaacacactgtctcttaagattttttttttctttctggtgaatgcagggttctcgttcagttctggtgtagttatggcactgtgcctctcaatgtaatcgttactcaggttcgtcaaaacctttcatatatctacaattccacaatcttaagcctatccaagtctgtgactaaacatcgttcataaaaactctatggtttcacctgaatctgaacagatgggatctcggcataagaaagctgtgatagcagagagcgtaagagactcacttcacagttggtgcaagagagtgaaagagaggtctaagcacacgagatcagtgtgttcccttgacacagcaacaatagacgagagagacgagatgacagtggggacattgtctaggagctcatcgatgacttcactgaatcagattaccataaactccatagaccaagcagagtctatattcggagcagcagcttcatccagcagtcctcaagatggatacacgtcgagggtggaagaatatctgtctgaaacatacaataacatcggttcgataccgcctttaaacgatgagattgagattgagattgaaggtgaagaagataatggagggagaggaagtgggagtgatgagaataacggtgatgctggagaaacacttcttgagttgtttaggaggacttgatcttgtttctgcttttagaagcttggttcagttgtaattacttgacatccatacaagaataacaattaacaaagtaaatcttttgttggtccagtaaaaaaaagtattcaatgatcaaagtacatcttttgttggttcagaggtaaatttaaaatataatagcatggattggaacgagatattatggcattaggaaactttttgattatggcagtataaacaaagaccacaaattatggcagctatacatatattgatttcaaaacagagataaagacttgtcacctgtcatttgattatttatgaatttacctctgcagcattttccttcttctgtgcagtcacgcctaccgatggatttgattaatttcctgtcgattattactaagttgtatttctagtaaatacaacttaaaagtagttttgtactcggtcttaaaactagttttgtacatagtttttgagtaagatactttgttttttttgggacaaagagtaagttagtaatatcaaattttatcatagtgattgttaatttatgtcaactacgaaattaagaagttatcaaatctgatttgagttatgataacaatgtcattgatagactcggtcaattatggcattaagaaaatctaaggatttaagtaaccaggtatcaattattaccgccgttggtattgacttttaaataagacttgccagttgtcacacacatgtcataaacaattgtttttttcttcttcttttcattcaaatgataaaattaaacttgcactatacagtttctatagaatcatccatcactagatctggtctggcgatccccaaaagatcaagtcaaaaatgaataacagagaaatgaaacatggtaaaaaaaaagacgagaagatgccggttttagtgatgccaggtttcatagccggagcaacatttctggttatttggatcatacgacgtgagttccttttatcttacttttggtgtaacatagatttccttgcttctgtttatcttttgaataatccatatataggctatagaaagggctccaccaaaactaactcgccgccaccatccgcgcttccaaaggctcgagaatgtggtcctgtggcgtccactaaacctaacttaacacctgcgccgccgctaggtcagccacggctatacgctcaagaatctcaacagtacagtcttgtggcgtccaatgaacctgacttgacacctgcgctgctaggcccgccaccgctatacgctcaacagtctcaacagtttagtactattgtggtgtccagtgaaaccgacataccccagcttctggttcaatgttgtccgccagatggagaccgtggattaacaaatcaatactatgcgggacaagagttcgacttaggaggacacgacaaggacagcgattccgattaagagtagagtacttttttaaacaacttttgattatgaatttacctcatccaccatttttcttctctttatcttgtgtgcaccggcatctttagactataatatatgtcgtaagaagaagaagaagattataattggttgatttcagttattttattatcaaaaaggaaagagaggataatgtaatgttgtaatcttatatatatatatccgaatcagggcgtcatttcagtttactaaatcatttttatttatctaatttatgaaccatagatgcgttaaaacgtctacttaaccttttgtaaacttgagtgaattgatgaatggagtaaaatttcaagtttcatcgcattcgtttgtgttattaagttttgtgctgagagcaaatcttcttttagccaaacaatgggtgttgtggatttctagacttgattttattttctagcaaactaaataaagttttgggcccaatgggcctgactcattgaacaacaaactagccgttggtccgtgtttgtgcatagctcggagacgagaggttgtacgtgtacggaaagtaacagtacggagattagtcatgaaaaacaataaacatggtgcttttatgttttatatactccaaaaaggggtctgcgtgacagtgagatagacagagagagaagaaaaagaagcgagtgagcaaagtttctcaaaa

SEQ ID NO: 6901 - DNA, 3000 bp, Unknown; identical to SEQ ID NO: 6896
  misc_feature (1)..( 3000): cDNA_ID_1816087_gDNA_ID_1621115_Annot_ID_171839 3000 nt of promoter + ATG

SEQ ID NO: 6902 - DNA, 3000 bp, Unknown
  misc_feature (1)..( 3000): cDNA_ID_1807878_gDNA_ID_1621115_Annot_ID_56183 3000 nt of promoter + ATG
tttatagtgtgagcttgtagatttgggttttaccgcttcttaggtactggatttagcactttggtgtaaagtttccaaggaaattttaagagatatatgtatatgagcttatagatttgtattactgtttcttattggattttactatttgcatttctatggggatttttggtttcttatggatgttcatcttttatgtttttgtaggtttgatgatatcactttcgtaagaaccaaggaatctgctagcaagcagaattctactctggcagctgcaggcttggtggaagcgatactgtttgaggtgaagcagcgagatagagttggtggatcttttttcaaatctgaggacatgtgctgtacgccaaaacttgcggatgctggttcctgcaatcttggagaggttatgattagtgcagatcctaatgatcctgaatggcctaagcggattcccacttttttcaaaaggggtgaggaagaagtgaagatgtctccggaagctgtcattatcaagaaaactggattgtacactgtttacttcatgacatgtgatccggaattggatggcgcaacaatcagaggaagaacagtttggaagaacagaggtggctatttacagggagagaaagctcctttgaagaagttctacgcctccatgcttttggcttacgtggttcttggcctagtttggtttccacaagttgctcagtattggaaagatggaatccagttgcatagtcatatcaactttgtaattgcatttaccatgggtgaattggccttcctctaccttgacttcgtttatctcgactcagctggtacaagtcctatggaggttacagtatgggcaataaccctttcttccatgaggaaggcactctcccggcttctactgttggtcatatcttcagggtttgggatagtgagacctaccctaggtggcataacattgaagatgcttcttattggtgtcttatgctttgttataagtgaatccctcgggttggctatgcaatttgggaacatctctgaaaatggaatgaattacttaatgctctcttgggctatactggaaacttgctttatccagtggattttcagatccttgtcgaaaacgcttaagaagctcaaggtaagagaaacatacaatcctccttttcttttgattattgatataacaggttaggcacactgattgctacatgtttctaacatatcacttgtaaatatatctttcttgttaattgttgaaagttgcagaaaagccatttataaagatccatttcttcttagattattcatccctgctaatcccatatttttcttatgtagctgaataagaggaacattactaagctgcagctctacaagatgtttgcaactgtgcttgtaatcatggttgtgctcagttttgcctggatttatgtggaggtaacatctcaacagtctagtgataactctggggaatcacttgaaaaaagtcatatgattgtgtgactgaaattgttttctgaatcaggtatatctctacagctccttgagtcagttttggaaagtgaagtggattgttccaacactttggtacatcctttcttatgcaatgttggtactgatttgcctcttttggcctccatcggaaaaaccaatgaggtatggtatcaatctttctgtacttgccctttatcaatcgggtgcttatgtggcctgttttaagttccacactaagatcttgtctgttttgtactaacatgtttgaactttgtatatctgatcttctctgctgctagttacacatttttctgatgtatatatactggtttgaaattgcaggtacctatacgtagctgacatggaggaagagactgaagaagaagatgatctctccactgcagaaaccggtatgaacgcaacaaaggctgaatacgagaggagtgaaaggaagaccctgctggaagcattcatcctattgcttgggaatataccaggggagaagtgaaactccccatcttacaaagttaccgtccttttagcttaagctgcctacttctcatcctttttcagcttaagctactcctaatcatccttttaaacctacggctttaagtttttttttaactcatataatcttctgcagtagacttgacttaatcggattttctgtttcatgaacttgttggtagtgtggaacaaatgggaaaatgaatatttttggaacaaattgattttctgtttcatattaagttaaatcattctgtttccactgaaataaattgttttccaaaaatcactccgtttattatgtctttgtttttaagaaataaaagtgagaaaacagaataacgcgaaaatgtcgacatatttggctaagtatagacaagattgggaagctctgtttagttatgcgtcagtctctcatcagtgttcaactgccacggagcgaaccgattcctaattgcaacgtcccgagtccatagaatgtcgacactctttcactctttctccaagttgcctcctttgagtcctttctcatattttatagactcactttctgtttcttgatcccgaggaagaagaagaataaactcttgttcccatgatcttcgtcgatgttagtaccttgagattcgattcgtctctccgattctttataatcggaatttattggtttgtggaatctgattttgggttctcttctattgctcttataggttctttggaaattgtttcctctatactcgtttggatcaggaagagactctctctcaggtatttcatcgaacacttaccctacaatttagtgaaatttctgtgtgatgtagaattctctagattcttctaatcgagttttagctgagaaaattagtgaaatgaaatgagattttccattgattgctagattccaaaactttagcttgttgttctgaattgcacttatttgttgtgttgtatggaccatggaaacatccaaaagagtccattttgcagatcattcccgagaca

SEQ ID NO: 6903 - DNA, 3000 bp, Unknown
  misc_feature (1)..( 3000): cDNA_ID_3049188_gDNA_ID_1621115_Annot_ID_56185 3000 nt of promoter + ATG
gagctgtctctgtgagttcccttggcaaattctttaggaaccatgaatgtttcttgatttctgcaatggtgatcctctacgaaacaacaagtagctcaattgttcagaaaaatcaaaaggcatctttgaaaacatttagttcagttgattgatgtataccttgagtgaattggcgacaaatatacgggaaaggagatttttacaatcctgtgagatatggacgtagtccgggatcttgtactggacagccattattttctgtataacaagatcacacattgacgaataggatgtggcgaaagcgagatatgcagatacatggcttcaaaaaagaaacctacttgtattgttttcctgaagttcttggggtcttcctggtcttcaaatgggtatgctccaaccagcatgacataaagagtcacaccacaagaccatacatcagccatctgaaagaagaaaaaatgcttcaaatcttagcgacttccacaaagatgactttttaaattcaaaagtaaaaatgtaaagagcatgacaatatcataaatactcatgggtttatggaagttcattgcattgtgcatgatgcttgattaccttgccatcatattctcttcgagaaaggacctcaggtgcaatatatgctggagttccaactgttgatttgggcctagagtgcagcagagaggactaaaaaaaagagaataacaaatcacaaaagaggatctcgtcgacaaggggggaacttggatttttttttagtgtcagaccttggaataaccaaaatcacagattttcagacgtggagcaggacttccatccaagagcgtattctcgagcttcagatctctatggcatatttgctgcaacaaaatagtcaacacatgattaaaaaaaaacgacttcaaacagccaatggataagtaaattttgcttaagtcattgtctctacattaccatagcatggcaatagctaacacctgatataagctgctggaagaaatatctcgcctggaaaagagagaaaggattagaacgtagaccctaactgtttaatgcctgatactaaataaaaggaggttcacatgttttctcttgttcccttcctcctaatctttccaaagaccatgcagattatcctaaatactagtaatttcatattcgcaaaagcacagcacaatttttcaaatggcaagctcacctcatcctcactaaatcttccagcactgcatatacgctcgaatagttcaccaccagcagcatattccatggcaatggcaagatgggttggagtcaacaccacctataaaatccataaacccaacaaggaatgcaagatgaaagatataagagattatcaacaaactttttcatagcaagaacaccacccatgtcaagcaacaagaaattcactaacctccttgaaccggattatattcggatggcgaagtgatctgtgattaatgatctctcttgccacattctcatcaatctgtatcaaaaaaaacaaacaaagcaaatactcattgtacaaatcttttcaggaaaaatattacaactacaagataactaacgttacgttaaacacccaatcagctaacgataagaaatttacaaaaaaaaatcgactcttctgcttaatagcaattcattccaattatgcatatctgggtataggatcaccagctcatggagagcaatgaaaacacaaaaacagagaggaatataccttaggaccacgctcgatgtacttcatggcaacaagttccttagagtttttgaccttcatgagcctggcaactccaaaattcccagcacctatgtctttcaccagctcgtacttgtccattctcgctcgacaaccctaattccaaacacacaaaacagaaaggaaaaacccaaacaaaaaaaaaatctccaaaattctcgttgaaattcaagtccagttctagcagctaagaatttcacgtgaaaatgaaacaagattaaaaaaaaaaaaaacagtatcccaaaatcaaggatgcgattccgagatctcgcgattcgcaaagaaagtgggaaaaaaaaagggaaagagatgacgatggaaggttaatttgagatttggattggagagatttcaagcctaagcgaagaatcaactttctttttcttttttttttcttgttggaatttttcttttttcttttttggggtgaaattaatagagaaataatgatgagaatgaagaagaatctcccctgcctaaacaaactcccatcatgtttttttttccatttatttaattaatacgagattttttaaaagaaagagggacccacaagtttccatgcgatccatacatgtttgtttcccttgctgattcgagtgtataactacgtttttttttgtcaccaacgcgctttttttctccctaattcaacacttcaactatacactatttacacgacacgagtggtcagcagcaagcaaattcgccttagattcttttggttctatatagagagagtcattgtccataaatcacatttttctctatgaagattgtcactcaaacgtaaccttttaatgaatttatgtcatgattttcatctacttttaacatttttcaacatatatacaaaaaaagaagaagttatgttcccatgtgtgagtgtatattttaattgaaatgacatagttcgtgcgcgtatatgaaaacattaatagaccttatatgggccgctaaactaatatacacttgttagaacgaaaggcccaatcaattaatagagcaaacattaaaagaccttatatgggttttaaacttaatatacgtttcttagtactacaagcccaattaattaatagagcaaaaaagaagttgtaagccttatcgttgtttttgtattacccaaaatctctacaaagtgaaaacactgagctgaggatctcgctctctctcgattggtatctctcgctccgtccttcctcagatctgatcgtccgccggttttcacgatg

SEQ ID NO: 6904 - DNA, 3000 bp, Unknown
  misc_feature (1)..( 3000): cDNA_ID_1375255_gDNA_ID_1621115_Annot_ID_56186 3000 nt of promoter + ATG
ccacaaagcctacaacagcaatgagacagtattaaaactatataaaacaaacaaagaacataataaattttggatgtttcaagtaaatatacaaagttcataccccacaaaggtagatcatctgaagttagaaccacccgatgaaagtccacgccaatcagatgccacagaaaaaggtgagaaataaggttagcaatccaaagaagttatgtaagattatatatcctacaacatccaatgccgtaaatgatattggtaatgcagtgaagttagatatcggaataatttagatttgcatgatgtaaaaatgaaccaaaggaaaactcagcagatacaaaatgtttccaaactttacatagtaggaaattgcaacatcatagataataaatcagcattattttcatgaatttcagtggtaatatgtacaacagacgtgaaacatacccataaaaaattcgaaccagtagctagattcaatggcatctttaaaatgcttgaccttagcttcatcgagttcaagcggacagatgacacttctctcgacattctctgtggaaaaaacagaaaaggtattgtaactagagaataagtacgaatgtacgataactgttaactagtatgaaaaagaagcttgtataagaattgaaacgtactcatgaattttatcgcaatctcactgtcaatcagctcatttccacctagaacttcaccaagaccaccccatttgtgaacattgtttccagatgggcggcaaaatggaagactgtaatagttgtatgtttcttgtggattgttatatgggccaactttgtttacccatagggtgacctgctcctcggcttgatactgaaaaaggtgaaggcaaaaaaaattgacttgacagaaaagcacagaaatgtaaaagtttatgggattaactagtaagagagagtaagaaccaaaattccattagagagaacagaacaaaatgtcaaacgtagacagacagatactgataaaggctacgttcaatatcatttcaaaaatcaggagttaaagtcttcacacaaatgatggttccatagaaataatggctcttgaataatgctaccagattgctcttgaataatgcataacccgcctttatctatcatctttcacgcagaaaatatatagttggaatcgactttaaatgtcacactacttgcgagcgtaagaaggcagaggagcaaaagcattaaagctagatctcatgatctccaatatcacaaaaggcaataacaattttgagctgaaactgaccatcagcaaaagaagccatgtgtgacactttcagtatcacattttagataccaattgaaaaaaatcatcaacccgacctcggaactataagatctacatctcgaagatgctaatacattaaatgccactcaattacaacacaactcagtgttgatccaagtatttgaacatcaaacaggctaccacgtgcagaaatcaacgagaatctcaaaccaacatcaaaatttcttattaaaatcgagattgtgaaaagcctaaatcacaatgaatagacaaaatacgcctagacttgcaacgaaaagatacgcctaaatcacaatgaatagaagctcgaggatcctagcaatccgtaaacgaacagatccatgaaaaaaaattcaatcgcaaacaccatgcaaatcacggatctacggacacagtgctcgatttcgagctgcattaaaagaaaagaaaaaacgactggagatccgagtcttaccttgtgatctgaatcggatgcgaacgtaggagtgagaagggaaacgagaagaaggaacacgaggacggcggcggaggaggaagacggcatcgtgaaaaccggcggacgatcagatctgaggaaggacggagcgagagataccaatcgagagagagcgagatcctcagctcagtgttttcactttgtagagattttgggtaatacaaaaacaacgataaggcttacaacttcttttttgctctattaattaattgggcttgtagtactaagaaacgtatattaagtttaaaacccatataaggtcttttaatgtttgctctattaattgattgggcctttcgttctaacaagtgtatattagtttagcggcccatataaggtctattaatgttttcatatacgcgcacgaactatgtcatttcaattaaaatatacactcacacatgggaacataacttcttctttttttgtatatatgttgaaaaatgttaaaagtagatgaaaatcatgacataaattcattaaaaggttacgtttgagtgacaatcttcatagagaaaaatgtgatttatggacaatgactctctctatatagaaccaaaagaatctaaggcgaatttgcttgctgctgaccactcgtgtcgtgtaaatagtgtatagttgaagtgttgaattagggagaaaaaaagcgcgttggtgacaaaaaaaaacgtagttatacactcgaatcagcaagggaaacaaacatgtatggatcgcatggaaacttgtgggtccctctttcttttaaaaaatctcgtattaattaaataaatggaaaaaaaaacatgatgggagtttgtttaggcaggggagattcttcttcattctcatcattatttctctattaatttcaccccaaaaaagaaaaaagaaaaattccaacaagaaaaaaaaaagaaaaagaaagttgattcttcgcttaggcttgaaatctctccaatccaaatctcaaattaaccttccatcgtcatctctttccctttttttttcccactttctttgcgaatcgcgagatctcggaatcgcatccttgattttgggatactgttttttttttttttaatcttgtttcattttcacgtgaaattcttagctgctagaactggacttgaatttcaacgagaattttggagattttttttttgtttgggtttttcctttctgttttgtgtgtttggaattagggttgtcgagcgaga

SEQ ID NO: 6905 - DNA, 3000 bp, Unknown
  misc_feature (1)..( 3000): cDNA_ID_1816111_gDNA_ID_1621115_Annot_ID_56188 3000 nt of promoter + ATG
tcacataagctatattatttgtaatcaaggaatgcggtcgtgctggcagggatggccagcggtcatcttgtgttttatattacggttatggcgactatgtaagtgcatataaaccaacatattgtatttttcttatccgctttggtagcctggaacgatgaagttctttcatctttccgctcttgatcatgtttatgcatataaaatataatttcagatacgagttaagcatatgattagccaaggaggagttgaccaaagccccatggcaactgggtataatcgtgtagcaagttcagggaggttacttgaaacaaataccgaaaaccttctccgcatggtacttaatgtgaagaatcctacttttttgctttcaatggtatacttgctgagatatttctcctattttattgctgcaggttagatactgcgaaaatgaggtggaatgccgacgtttcctacaactagtgcatttgggggaaaaattcgattccacaaactgcaaaaaaacgtgtgataattgttgcagtagtcagagtttgattgacaaagatgtcaccttgatcacaaggcaactggtacagaaatcattagaatgctcactatgtatgtgttatttttggtcacatctcactatcttctgtgcgttgcacaggttgaactggtgaagcaaacaggagaaaggttttcttcagctcatattcttgaagtctacagaggttccttaaaccaaatggtatgcacaaataataattatccatacttccttcaagctttatgagatatttctacacatatattttgtttttcttccagattatgctaattattaaaacctgtttggcctcataaaccatagtctcttttctatacttggtaaagactaattaataatgaaagcgtaatccaaccagtgtgggtcgatctcttgaaaaaataactgttttctttgcatctaggtcaagaaacacagacatgagactttgcagttccatggagctggaaaacatttatcgaaaattgaagtctctcgtatcttgcattatctcgtaacagaggatattcttgtggaagatgttaggaaaagtgatatgtatggatctgtgtcatcgttgctccaggtacttaattgtgaattatttccatttcgcttctccctctcagtaatgattgaggatgatagtaagctaactggaaccctaattgtctctatttacctatttgtatctaggtgaataacgcaaaggctaccatactattttctggaagccagactatagtgatgaagtatgactttgcgcttatatctttctttatggtttataggaactaggtttaagcaaatcattgcaattacctgtattttatgtgttaacggcttgttaaaattactttagctaagacttccataatctgttgcaggttcccttcttctgtaaaagtattaaagccaagtaaacagggggcaaccgcagcaaaaggtccgctaacatcagagaagcaaagtactcttccacttacaacagaagatgctcctccaaaagatgtggtatagttctgtttagttcagtctctttttttcttgtcgacatgaatctaccactctgaattgctgaggttggttccttgatctttttctctagaatctctctgccaacatgtacacagccttgaggaagcttcgtacagctcttgtcaaagaagcccctgatggtgtcatggcatatcatatattcatgtatgtctgaaaaaccattccgcttttcattttccaagctttgtacttgatcatggtcaattcgattctttcctcacagtctctgtgtttgtggtggcagcaattcaacgcttcagcagataagcagacggatacccagaaccaaagaggaactccttgaaatcaatggccttgggaagtaagtagttctttatcttaaaacctctactcaaaatgaagaaaagtccaaaagtgtttgatgatggtgtgtatctttaaactctctttcagggccaaagtaagcaagtacggtgatcagttgttggaaacaatagaaacaacggtgaacgagtactatggaaccaataagaaagactccatcatcagcaacgatagtcccgattcagggaagagaagaagagacgagaacattagtccaaatgtagccgaggatgatgatttcgaagtaagcccaagccagtcctgcaaaaaaacagtgagaaacaaaagcaatgaggttcttcatggtgaatgtatagatggagatagaagaggcatggagcttgattttgatttcaaagacgaagatgggtcagagatacgaccggagggaagagtattaccgtggtgaagttgtgaccactgaaattttagttgtaaagaaattttgatgtaatattttgttaacttctatggcctactcaatgtaccttaattttcagtagattgaagaaactagttattaaatgctgacttctttgatgatctcttttttttttttaatcaatcatatattgagatttgattagaatgaagaacctacaggtggcgatggatcattaataatataagagattaataatataagagatattattgtgaagaaaccacttcagccaatggattggttagctagacaaggttgactttgggtcaaccctctcactggacttttatctgaggctcttcttgtcgtgaccacacaagctcttttttgcttcacagaaggtaaattcttgtctgcttgttttgctttgatccgtcgtttatactttgttgtggtgagtggaatttgcttcaaaataaatcctgaaattattacgagattctgaaccagttccatttgatataatataataatataaacaatacctgaatctttaagtcaatacttactacaggtttgttatctaaacaagttcttctctgttttagtaaatgtttcttctgtctcagtctcactagaacgatctgtccatgaaattttctcgtaaagggttatt

SEQ ID NO: 6906 - DNA, 3000 bp, Unknown
  misc_feature (1)..( 3000): cDNA_ID_1816107_gDNA_ID_1621115_Annot_ID_56189 3000 nt of promoter + ATG
atacacagaagtaagaatctagaggtcgaatcttcagaagatgactcttacaagtaaacaatttcaaagaagaaaacaaaatcggacctggattcgcaggagacttgcttaccgagatgatgaaacttgtgaaatcgaagaagaaaaggctgaagattgatagagcaaaagctttgctttgttgcgttgagaagctattgctgctgagaatttattctttgaatttgtgttgttgcccccattgcaccaagttccattcaaacacctttctttcttttcttttttagcgaatttatgctcacctccatttttttttatttttttccttatataatattttattacatatcgactgtctggtaataaatacggacacatactttaagaaaagaaaaaaagaaaaaacgattttattcagacgaaaataacgacagattaataatatgagaagctttggctaaatacaattttatacgaaaatataaaacatattaagtaaattcttaatttattaccaacctaatttctgttttctcgttacagtcaaccaaataatcataagttcaaaacgaaatcaataattaggatcgcatataatggtcagactgtcatatcattcaggactctcaaatccatattttattgcaacgttcattatatttgactattccacatataacacacgtctagctcatgttacaaaaaaaagggtattcacaaaatacgcgaactgttctagctaatgacctaatgttatatacaaaaaaatgtattagaatacaatattatcatcttcgatcgtgtggaaacattttcacatgtagccttaacactttacataatcttagcaaaaatgagacttattaaactttcatatttgagtactgaatcacatgtggttgatcagtggccattaacccaccagggctcttggtcgaataaaacctttattccatcgagataaaagcattttcttcagacactatattgtatatagtatgtggtggcgttgaatatgtgtgcctttgtgtagttaattagttattggatttgaatttcttaaaaagtggtgtcagttcaaccataaatttgtttccgtcaaaattcaacaaattattttcaaatgtcagaaaaattgcagaaattgtattcctcgataaagtaggtcaaccaatatcgatcatatttacatcttcgaattcttacgttgactattacatcgcacctatatactatcaaataaaccaaagtatttattgacgttgactaatcctaactccacaaagatgtgaacaataacgataacttctcgaaatcttgagggaaacccaccttctgtttatatatccgaatcggaccaacctcgaggagctcctctcaaacttttttgttggtttgatgaaatagtaaaacgtatgcatttttgtgtgataggttttagaaacacaattaaatcgcactaatgcaaaaaaatgattttaaatcggaaaaagacgttgcacaccgtccaggatcagattcagatatcgctgaataaataaaaaagcccgaccactaaaatattgttctgctgatgattttttaaataactaaatttagatgcgattaacgatgttgacgtcggaagatatatataaaagagatatggacgatgttgttaatcgcgattccaagtgatagggacttggtgaatcgtgacaacacaacaaaacaagacaaatgatattgataggacccttactatattgctagttatttttgttgcttctgcttcaatgcttattggttattattagtatggagttcaaatctttgtcttttcttctgttcaactaatatgtgtttaaatccgtatgaaaataatttaacgattggaaactatcgaatttcattgtgcttgtatgtgtattctataatccaatgactaatattatactacgagattcgattccaatgacggtgtaagttaagtattgtgatagtggtaagctactcgcatatgttaccaaaaaagaagaagataaagttactcgcatataatttgaatgtgtgattagcaaaatactggtctagatagtcctagcgtagtatgaaatagtataattttacatgttacatatatgagttaataggggtatatcaaaaagtaatatatgagttaatagttttttttttttttaaataccaactttgtaggttaagaattccataaaaaaaattgaccaaagcgagaagaaatggtgaagtggttaaaaattcaaaaaaaaacaaaaaaaaatggtgaagtgggtgtcacgaaacgtatgaagagaaggggagtggggctgtgcttgttccttgtcggtctcctgccgtacaagccgatgcaaagaatctgttttctgtttttgaattctttcttctacaatacatatgtaatttagagaaactaggttcaatagaaacgccattttgttgaaaaacatgtcagtgatgacaagttattatttttcttgtatgaaagtgcatggagcaatacataggacgcacaaagaacagtgcatgatgtgacaagtgcgtgcgcatgggaatatttgtccagaaaaactattttgttactgtacctctttttttgtttgtcaaagattttgttactgttcctctcagaattttcgtcaccaatttggatatggacaacattacaaaatttggtgttgcactttttttaacaatatggcccgttagataatcctttcaaattaatggtttgcctaaaagcccatttgtctctcccgaaaagcccatcataaaacggcgtttgtccttgcgttgttgaggatgagatttggccatttgggattagaacttttttctaatttactatactacccttcacttctcaaactagcactagattacaattaaaaacgcggggatactttggtaaaagaaacaagaacatgttcaaagatggatggatactttcgtaggctctggctcggttagctcgaaaaaacaatg

SEQ ID NO: 6907 - DNA, 3000 bp, Unknown
  misc_feature (1)..( 3000): cDNA_ID_1816103_gDNA_ID_1621115_Annot_ID_56190 3000 nt of promoter + ATG
tgtccatttgtattccattatgaggcagctctccaatgagttcaatagccttagggtatccattttttaccttaatgcaacctgcaagcaactaagacatcaaagataagatataattcagaagccaaacgaaacgagatgttgcatatgcagtcatggttctttcacctatataattctaaatgcagaaacgtatcagcaagtctcaataagctaaaggatctaaatcataagtgaaagggggaataatcgttctaagcttcaagggaagaaaatatgcgaaatattttgacactcactaaagtgacgaaaacttcagctggcataccgtgttatatgtaaccacatctggtttcagaccatcgcgcttcatctgatcaaacaatttgatgcagctgtcaagctttccattcttgaccagacaactaagaatggagttacatatatagacattgattttggtagactcgtctggaatgctttggtatatttctagagccttggagacatttttggccccaacaaactttatgcagctactgtaagttgaaacactaatctttccatgttgttgcatccattcaaagagctacaaaaagaaaaacactttgattgactatgcacatcttggaactcttgttcctcaggaaacaatgaaacatacaatagtttttatgaaaccatgttcaaagcaacagacctgtataagatcctgccatcttccagagattccaaaatcacgcaaaattacattcaaatcttgtaccttcaaaactgttgctaatctgcagaggggacagttacatcgtgagaaactacagtatccagatcctgaacactcttgacgacggagtataaagattacggcatgctcattaatcgaatcttggatacaagaattcttatgtatctctagtaatgatgtggtcaattaactttccccaatttgaatcaatttaacattctatagagtatagaccaattccattagcaggcactactacatctacttcagaactgagcattctagagatttttgtttacttctgttaagaacaaaatacgtttttaaagacaaatttttgaaatgttgactgaagtaaaatgaatcacagaatttgaagataagtgataagtaatagatagtaagacctctgcagagaagagagaaaatccgaggagcgttgaacttcagaaatggcggattttctcgccaggtatgaattggaatggcgtttggaacgaggagcttctgctacgttcgccggtaattcaataacagcggaagatgtcgttgccgccgtcggcgtgaggattcgtaaggataaggcgggaatggagagagatgaagagggacgagagtgagtgttgaagagatgaggaggacaacgtagttcgagtcccacaagaagtggcgtctccattgttttttcgagctaaccgagccagagcctacgaaagtatccatccatctttgaacatgttcttgtttcttttaccaaagtatccccgcgtttttaattgtaatctagtgctagtttgagaagtgaagggtagtatagtaaattagaaaaaagttctaatcccaaatggccaaatctcatcctcaacaacgcaaggacaaacgccgttttatgatgggcttttcgggagagacaaatgggcttttaggcaaaccattaatttgaaaggattatctaacgggccatattgttaaaaaaagtgcaacaccaaattttgtaatgttgtccatatccaaattggtgacgaaaattctgagaggaacagtaacaaaatctttgacaaacaaaaaaagaggtacagtaacaaaatagtttttctggacaaatattcccatgcgcacgcacttgtcacatcatgcactgttctttgtgcgtcctatgtattgctccatgcactttcatacaagaaaaataataacttgtcatcactgacatgtttttcaacaaaatggcgtttctattgaacctagtttctctaaattacatatgtattgtagaagaaagaattcaaaaacagaaaacagattctttgcatcggcttgtacggcaggagaccgacaaggaacaagcacagccccactccccttctcttcatacgtttcgtgacacccacttcaccatttttttttgtttttttttgaatttttaaccacttcaccatttcttctcgctttggtcaattttttttatggaattcttaacctacaaagttggtatttaaaaaaaaaaaaaactattaactcatatattactttttgatatacccctattaactcatatatgtaacatgtaaaattatactatttcatactacgctaggactatctagaccagtattttgctaatcacacattcaaattatatgcgagtaactttatcttcttcttttttggtaacatatgcgagtagcttaccactatcacaatacttaacttacaccgtcattggaatcgaatctcgtagtataatattagtcattggattatagaatacacatacaagcacaatgaaattcgatagtttccaatcgttaaattattttcatacggatttaaacacatattagttgaacagaagaaaagacaaagatttgaactccatactaataataaccaataagcattgaagcagaagcaacaaaaataactagcaatatagtaagggtcctatcaatatcatttgtcttgttttgttgtgttgtcacgattcaccaagtccctatcacttggaatcgcgattaacaacatcgtccatatctcttttatatatatcttccgacgtcaacatcgttaatcgcatctaaatttagttatttaaaaaatcatcagcagaacaatattttagtggtcgggcttttttatttattcagcgatatctgaatctgatcctggacggtgtgcaacgtctttttccgatttaaaatcatttttttgcattagtgcgatttaattgtgtttctaaaacctatcacacaaaa

SEQ ID NO: 6908 - DNA, 3000 bp, Unknown
  misc_feature (1)..( 3000): cDNA_ID_1816099_gDNA_ID_1621115_Annot_ID_56191 3000 nt of promoter + ATG
tctacgtgagatttcgaaccattggtttcctttccgccagtcagagagcgacacgtgtgggagcattttaggggtgtaacggcctcggcccatgggccttgggtcgtcgaatgagccgaggaaagagcgagtggagcgcgtgaggtaagtgtagattgtggtgaagttgaagagagggatacaagtctcggagaggaggacgaagcgtgcgttggaaggttctagtagggcatgagatataagacgcttctctgcatccatcatcgaacattttccccattcaacggcctacaatattttacaaatgtcaaagtatcgcaatgttatcttgtaaaatacaataatatgttaaccaacaaggcaacaaattaaacctaattaatgaatgtaaatatataatcatataccttgcttggtatccgtttcttgtaaaatactgaagattccggcggctcttgagtgaactccggcgaggtatgaacgtagatggaataaaacccttcatgacctttgaagaacatttcccaaagaggggacaacggcaaattccacctcgttagaaacatgaacgcaacctttggatgggtctcattcttcatggggctgcgtggggccatcgctgctcgccacatcagctcttcgtctgcaatattactaccagagctgcgaggagaaggagaaggaggaggagagagggaaggagaagtgagaggatttgaggagagagtgtgataatcttcgacgaggaagagtgatgtttggaggcgttggttaaggtaaaaagcaaggaggatgacgagagaggagacagaggagaagaagacaacggtgccaaggatgtgaatgtatcggagacttatcggttctttcttcgaattcatccgtaagttgagttctttaacaaaggttgtaatcttttgcttcttcattttcctttcttgtgtctattgattttagtctaggttctttggcttgcgtcgttgaagtcctattttgtgtgtgaataagtgtatgcatttatagtgcatattaagaacgcgtctccaaagtggtgctaaagtatattgtagaatgagattaccgttttggccacaaaataagcctataaaggaatcgaaagttcacaatcaattatgttgattctttaatatatacttataataattaatagaaaaataggatcatgtaattgatccatatactcaggattagtaaacctaggcatgatgtgtgaattgtgatgtgtatacatgatggacgtgcatggtgtgagaagaaatgtgcatgggaattgtgggtttagtgaaacgtgatttagtcaagtgaaaaagaagagaagaagagcatggaatttgcggctatgtaaaattatgggtatgctaaaaaggttaaaatgttaactgttttttctttaaccttaacaaaacttaaaaacttggaagggctcaaaacccatgtcgaatttaataagcccaaaaggcttcaatgtttaataagcccaaaaggctttcaatgttcataacgaacaagaccaattccaataatttacaaaagctggcttcatcttcttaaacgttgctctatgtatcccaaacccgacgaattttggttcgctgctgcataatttttacccatacatcttcctcatcttctctctccgtgttgactcttgaggcgatccaacaaacaacaacaacaacgccgcgattctcgagggtaagtagtcatacgatttcagctgattttccaggatggtttcaattttgggtttatgcagaagatatttaatagattgtgtgtccgcaatctgaaagttgctgctaggtttctgtttgttatacctatttagattctgataggctgtttcaattattaacatgagttgttgaatctggaatttgcaggaccaatccgttcagagagattaaagctgagctgagcttctccttataaaggaagatactgcttgttctacggaattttgagagatgcctcgggacttgtcaagatcgaggtcaccgtctccatcaccttcacgtcgtagaaagcactcgaggtctcccgtaaggcagaggcatagcaggaggagtagaagagacagaagcccttctccatactcatctcattcgtatagcaggtgatacccctagtgtttgttttttccgctattcgtttgccttagttatcattcgtttatacgaactgtaagaaacattggtggaacacggttatagatagacatgtaaagtttacagactcaagaattgcttttagtaaagttcctacttatagatatattttctacccttctctaaaagagagtgcaatgtctggatgctgctggctctgtatcgtaagcgtttttttgagtgatgctgcgtattggaaatatatcgtgtttatttggctgttgtgattaaatttgttgcaagagaatatgttttatgacctgagctttgtgatttttagaatgaaacctgtatattcggtaaagacataagttaagctgggataatagcactactgatagtctgatctagtttatattttaattgtatctgtagattattagttagaatcagttttaagagcgactatattatgttcttttaaatggagtttgttagcaatagtgatacaaaaccaccactattccttaggtaagataatatagtaatttgttgagaacatggctgagaagctaggaaaatgatacatgcgcttaccattataaaatagctcagtttcttcccgttcccacgggaggggaaatgagcagctgatggattgctcttaggtgttctttcattgatcccttgtctcgttagcttctcttcgtgtgataaaagttggagctgataattctttacagtgtatgaggtaactgcacatacttttgttttctttatgtgtaactgtgggctacctgatgcctagtcttcacgtgcgtggtacttcattagttccatctttttgcttactactttattttgggtaatg

SEQ ID NO: 6909 - DNA, 3000 bp, Unknown
  misc_feature (1)..( 3000): cDNA_ID_3049253_gDNA_ID_1621115_Annot_ID_171854 3000 nt of promoter + ATG
ctgtgcttgagagtaacattcaccagcttagttaatttgatccacaataataaatatagaatcaacgatttcataacaaacataccgttttctctctgatttctttgtcgatttgaagcatttgttgttgcatctcttttaccatattctcgttctcttctattgacttcgcatagtggtattgattcctcttggatccaacaatatcatgatgtcctacatttcgactagttttctttcttccaatctttgcgacctccatagcctcggaaaattttagattgagaaatggaaaaaaggtttttcaatcaaggtttacaaaatggaagaaagttgcttgagtttaaaatgcagagggttgagacattgatataaacttagttgtctctctatacaattttaaaattaacttatttggaatttggtttgcactccaaggaagttggccattttgccacctttttatttgcttagtttaatccaaccacactataaagtagtactattttctaagttgagaaatacctacaagttttatatatttgcacatattggagtagattgtgtattcgaatgaataaattaacagtctcatcacaagtatattagtatatgaatgaattatttgtgtgtttaaaatgaaaaattaaagtcttaattaaattccaaacaaatatggagcaatcttcatgagaggctcgagggtgctcacatgaaacttcctcccgaaaagaaaacacacattcgtcacctcaccttcgtagctacaattcgaaccgaaccggatccgatccaagaacccgacccgaatatctttcctcacaaacctcgctggatgggacccacctcttgaccaatcaacccacgtcactgtccggttcgaattcatctccggacaaatcttgttaactaacgtcggaagataatgctcgtcgatataacacggcggtcggcagtgatccttaaagacggcgtagtaccggcgatcagagacgatctcggcggcgactctacgtgagatttcgaaccattggtttcctttccgccagtcagagagcgacacgtgtgggagcattttaggggtgtaacggcctcggcccatgggccttgggtcgtcgaatgagccgaggaaagagcgagtggagcgcgtgaggtaagtgtagattgtggtgaagttgaagagagggatacaagtctcggagaggaggacgaagcgtgcgttggaaggttctagtagggcatgagatataagacgcttctctgcatccatcatcgaacattttccccattcaacggcctacaatattttacaaatgtcaaagtatcgcaatgttatcttgtaaaatacaataatatgttaaccaacaaggcaacaaattaaacctaattaatgaatgtaaatatataatcatataccttgcttggtatccgtttcttgtaaaatactgaagattccggcggctcttgagtgaactccggcgaggtatgaacgtagatggaataaaacccttcatgacctttgaagaacatttcccaaagaggggacaacggcaaattccacctcgttagaaacatgaacgcaacctttggatgggtctcattcttcatggggctgcgtggggccatcgctgctcgccacatcagctcttcgtctgcaatattactaccagagctgcgaggagaaggagaaggaggaggagagagggaaggagaagtgagaggatttgaggagagagtgtgataatcttcgacgaggaagagtgatgtttggaggcgttggttaaggtaaaaagcaaggaggatgacgagagaggagacagaggagaagaagacaacggtgccaaggatgtgaatgtatcggagacttatcggttctttcttcgaattcatccgtaagttgagttctttaacaaaggttgtaatcttttgcttcttcattttcctttcttgtgtctattgattttagtctaggttctttggcttgcgtcgttgaagtcctattttgtgtgtgaataagtgtatgcatttatagtgcatattaagaacgcgtctccaaagtggtgctaaagtatattgtagaatgagattaccgttttggccacaaaataagcctataaaggaatcgaaagttcacaatcaattatgttgattctttaatatatacttataataattaatagaaaaataggatcatgtaattgatccatatactcaggattagtaaacctaggcatgatgtgtgaattgtgatgtgtatacatgatggacgtgcatggtgtgagaagaaatgtgcatgggaattgtgggtttagtgaaacgtgatttagtcaagtgaaaaagaagagaagaagagcatggaatttgcggctatgtaaaattatgggtatgctaaaaaggttaaaatgttaactgttttttctttaaccttaacaaaacttaaaaacttggaagggctcaaaacccatgtcgaatttaataagcccaaaaggcttcaatgtttaataagcccaaaaggctttcaatgttcataacgaacaagaccaattccaataatttacaaaagctggcttcatcttcttaaacgttgctctatgtatcccaaacccgacgaattttggttcgctgctgcataatttttacccatacatcttcctcatcttctctctccgtgttgactcttgaggcgatccaacaaacaacaacaacaacgccgcgattctcgagggtaagtagtcatacgatttcagctgattttccaggatggtttcaattttgggtttatgcagaagatatttaatagattgtgtgtccgcaatctgaaagttgctgctaggtttctgtttgttatacctatttagattctgataggctgtttcaattattaacatgagttgttgaatctggaatttgcaggaccaatccgttcagagagattaaagctgagctgagcttctccttataaaggaagatactgcttgttctacggaattttgagagatg

SEQ ID NO: 6910 - DNA, 3000 bp, Unknown; identical to SEQ ID NO: 6907
  misc_feature (1)..( 3000): cDNA_ID_2125136_gDNA_ID_1621115_Annot_ID_171853 3000 nt of promoter + ATG

SEQ ID NO: 6911 - DNA, 3000 bp, Unknown; identical to SEQ ID NO: 6906
  misc_feature (1)..( 3000): cDNA_ID_1816107_gDNA_ID_1621115_Annot_ID_171852 3000 nt of promoter + ATG

SEQ ID NO: 6912 - DNA, 3000 bp, Unknown; identical to SEQ ID NO: 6904
  misc_feature (1)..( 3000): cDNA_ID_3049184_gDNA_ID_1621115_Annot_ID_171851 3000 nt of promoter + ATG

SEQ ID NO: 6913 - DNA, 3000 bp, Unknown
  misc_feature (1)..( 3000): cDNA_ID_3049188_gDNA_ID_1621115_Annot_ID_171850 3000 nt of promoter + ATG
aaaacaattatttttgaattccgaacatttcaatttgattttttgttgacatttgtattttatagatttgcattttcaaaaaaatgataaggaacgaaaaaaaataaaaataagaaatccaaaaatcaaatacatgaatcttttcggaaaataaaatctaatttacaaaaatatttattggaggtcacaatgttcatagtaccatgcgtagcaaaggactcattctcatcatcaacctctctgtttgttcatcttatactgcaaattttacaaatctccaaaaccagaaccaaaaccttagccaaagcattgtaaaggcaaacacgagaacagagacttttcagtttcaacaaaccaacgacgacttctttcttacacagaccaaaaaccaaaatatcaacttattctcacttctccacttgcgtgtacttcctttacagtcttatcgtattcatcctcatcgtcttcctcttcttccacctcctcctcttcctcctccacgtcttctgcatcttcctcttttccatctgcatccccatttcctccccagccaaaacctccgatggatcgggaaacaggaggcggtgttttggcgtcagccactatcttcatgatctcttcaacggtctgaagggagaaggttgggttctctttcttgaaatatgcagcttgagctgtctctgtgagttcccttggcaaattctttaggaaccatgaatgtttcttgatttctgcaatggtgatcctctacgaaacaacaagtagctcaattgttcagaaaaatcaaaaggcatctttgaaaacatttagttcagttgattgatgtataccttgagtgaattggcgacaaatatacgggaaaggagatttttacaatcctgtgagatatggacgtagtccgggatcttgtactggacagccattattttctgtataacaagatcacacattgacgaataggatgtggcgaaagcgagatatgcagatacatggcttcaaaaaagaaacctacttgtattgttttcctgaagttcttggggtcttcctggtcttcaaatgggtatgctccaaccagcatgacataaagagtcacaccacaagaccatacatcagccatctgaaagaagaaaaaatgcttcaaatcttagcgacttccacaaagatgactttttaaattcaaaagtaaaaatgtaaagagcatgacaatatcataaatactcatgggtttatggaagttcattgcattgtgcatgatgcttgattaccttgccatcatattctcttcgagaaaggacctcaggtgcaatatatgctggagttccaactgttgatttgggcctagagtgcagcagagaggactaaaaaaaagagaataacaaatcacaaaagaggatctcgtcgacaaggggggaacttggatttttttttagtgtcagaccttggaataaccaaaatcacagattttcagacgtggagcaggacttccatccaagagcgtattctcgagcttcagatctctatggcatatttgctgcaacaaaatagtcaacacatgattaaaaaaaaacgacttcaaacagccaatggataagtaaattttgcttaagtcattgtctctacattaccatagcatggcaatagctaacacctgatataagctgctggaagaaatatctcgcctggaaaagagagaaaggattagaacgtagaccctaactgtttaatgcctgatactaaataaaaggaggttcacatgttttctcttgttcccttcctcctaatctttccaaagaccatgcagattatcctaaatactagtaatttcatattcgcaaaagcacagcacaatttttcaaatggcaagctcacctcatcctcactaaatcttccagcactgcatatacgctcgaatagttcaccaccagcagcatattccatggcaatggcaagatgggttggagtcaacaccacctataaaatccataaacccaacaaggaatgcaagatgaaagatataagagattatcaacaaactttttcatagcaagaacaccacccatgtcaagcaacaagaaattcactaacctccttgaaccggattatattcggatggcgaagtgatctgtgattaatgatctctcttgccacattctcatcaatctgtatcaaaaaaaacaaacaaagcaaatactcattgtacaaatcttttcaggaaaaatattacaactacaagataactaacgttacgttaaacacccaatcagctaacgataagaaatttacaaaaaaaaatcgactcttctgcttaatagcaattcattccaattatgcatatctgggtataggatcaccagctcatggagagcaatgaaaacacaaaaacagagaggaatataccttaggaccacgctcgatgtacttcatggcaacaagttccttagagtttttgaccttcatgagcctggcaactccaaaattcccagcacctatgtctttcaccagctcgtacttgtccattctcgctcgacaaccctaattccaaacacacaaaacagaaaggaaaaacccaaacaaaaaaaaaatctccaaaattctcgttgaaattcaagtccagttctagcagctaagaatttcacgtgaaaatgaaacaagattaaaaaaaaaaaaaacagtatcccaaaatcaaggatgcgattccgagatctcgcgattcgcaaagaaagtgggaaaaaaaaagggaaagagatgacgatggaaggttaatttgagatttggattggagagatttcaagcctaagcgaagaatcaactttctttttcttttttttttcttgttggaatttttcttttttcttttttggggtgaaattaatagagaaataatgatgagaatgaagaagaatctcccctgcctaaacaaactcccatcatgtttttttttccatttatttaattaatacgagattttttaaaagaaagagggacccacaagtttccatg

SEQ ID NO: 6914 - DNA, 3000 bp, Unknown; identical to SEQ ID NO: 6900
  misc_feature (1)..( 3000): cDNA_ID_3049192_gDNA_ID_1621115_Annot_ID_171848 3000 nt of promoter + ATG

SEQ ID NO: 6915 - DNA, 3000 bp, Unknown
  misc_feature (1)..( 3000): cDNA_ID_1816127_gDNA_ID_1621115_Annot_ID_171847 3000 nt of promoter + ATG
ctagtcttcttgactttgttcaacagcaaagaagaccaaggtgatgaagcgtcagtctacatttgttttccatcatgcctctcatccttggagtaacaatcgttttctcatttggatggtaactccccatgcttttaccttaagctgtaattttttaaaaatttcatatctctagttaagaacactgttatatttttctccagaagctatttttacggcatttgtccagcaataaaatatatgtttgcattgcagctttgtttcctgcggcaatttagaggctccatacgaaagtctgactacttcgcacttcggttaggtttcctcactgtgagtaacttttttatttcgtttctcagtctttccttcaaatttaaaatataactttctagtaatttctcaagaattctcatctaatctggtagctgacatgattagttttctgaatccggtcttcattactttaaaatttcagaaacataatttgccatttacatacaacttccatatgtatatggtacggacgatggaagatgagtttcatggcattgttggaattaggtatgcgtttctgagaattgagatcttatcaaagactctttattcaactgttttcagaagatttcgtaagggagttacagaatgggactgatgaatgtttcttgatgaatcaacagctggccactttgggtttacgctatagtatgcatctgcataaatgttcatggtaacttatcggttcaataaatacaaactacattccatttctatctccacattaaagctttgtctttactaattcagtgatttccttgcaggcctgaatatgtacttttggatatcattcgttcctgccattgtaagtaaaagcaagattaagtaaaaagcttgaaattcataaggcagtactaacactcagagcatgtgtttgtatctgttttgttgtctaagcttgtcatgttggttggaaccaaacttgagcatgttgtctccaagcttgctctcgaggttaaggagcagcagacaggcacatctaatggggctcaagtcaaaccacgtgatgggctcttctggtttgggaaaccagaaattctgctacggttgatacaatttatcatttttcaggtaagcaaaaagacttttcctttctcaattcttcaagccatgatattactctattcacacagatgatccttatatatttcctgctaatgcagaatgcatttgaaatggcaacattcatctggttcttggtaaggccaccttataaaatgcatcaatacttaaatcagctatgcaaagtttttcagtttttgagaagatcatcaatttcatgtatcagtggggaatcaaggaaagatcttgcttcatgaagaaccatgtgatgatatcaagccggctaatttctgggtgcgtttcaaatacacaacaattcgcagcaacacactgtctcttaagattttttttttctttctggtgaatgcagggttctcgttcagttctggtgtagttatggcactgtgcctctcaatgtaatcgttactcaggttcgtcaaaacctttcatatatctacaattccacaatcttaagcctatccaagtctgtgactaaacatcgttcataaaaactctatggtttcacctgaatctgaacagatgggatctcggcataagaaagctgtgatagcagagagcgtaagagactcacttcacagttggtgcaagagagtgaaagagaggtctaagcacacgagatcagtgtgttcccttgacacagcaacaatagacgagagagacgagatgacagtggggacattgtctaggagctcatcgatgacttcactgaatcagattaccataaactccatagaccaagcagagtctatattcggagcagcagcttcatccagcagtcctcaagatggatacacgtcgagggtggaagaatatctgtctgaaacatacaataacatcggttcgataccgcctttaaacgatgagattgagattgagattgaaggtgaagaagataatggagggagaggaagtgggagtgatgagaataacggtgatgctggagaaacacttcttgagttgtttaggaggacttgatcttgtttctgcttttagaagcttggttcagttgtaattacttgacatccatacaagaataacaattaacaaagtaaatcttttgttggtccagtaaaaaaaagtattcaatgatcaaagtacatcttttgttggttcagaggtaaatttaaaatataatagcatggattggaacgagatattatggcattaggaaactttttgattatggcagtataaacaaagaccacaaattatggcagctatacatatattgatttcaaaacagagataaagacttgtcacctgtcatttgattatttatgaatttacctctgcagcattttccttcttctgtgcagtcacgcctaccgatggatttgattaatttcctgtcgattattactaagttgtatttctagtaaatacaacttaaaagtagttttgtactcggtcttaaaactagttttgtacatagtttttgagtaagatactttgttttttttgggacaaagagtaagttagtaatatcaaattttatcatagtgattgttaatttatgtcaactacgaaattaagaagttatcaaatctgatttgagttatgataacaatgtcattgatagactcggtcaattatggcattaagaaaatctaaggatttaagtaaccaggtatcaattattaccgccgttggtattgacttttaaataagacttgccagttgtcacacacatgtcataaacaattgtttttttcttcttcttttcattcaaatgataaaattaaacttgcactatacagtttctatagaatcatccatcactagatctggtctggcgatccccaaaagatcaagtcaaaaatgaataacagagaaatgaaacatggtaaaaaaaaagacgagaag

SEQ ID NO: 6916 - DNA, 3000 bp, Unknown
  misc_feature (1)..( 3000): cDNA_ID_2125109_gDNA_ID_1621115_Annot_ID_171840 3000 nt of promoter + ATG
ctatatcgcgggtgaaagttatgcaggtaacaaaataaataaaatcatttggatttagtattgcacgcccttttatttacttcaagtgtggtaacgcattttcatcgattttcgtcgcgaatttatttttctgtgaatgtaaaataaatatacttgcaggaaaatacgtacctgagctagcagaggttgtatacgataacaataacaataacaagaagaatggttcatcgtttcacatcaatcttaagggtattttggtacgtgtactaaatcttaagggtgaaattctcatcattaacccaaaaatatcatacatactttatcatgcatctactataaactttgcatgttgcatgtcatgcatgtgatcataagtataaattccgcttagaagacccggtacatttttttttttttttttttttttgctacatagttggggaatcctgagacatcagatgcagaagattggagaggttgggtggattatgcatggagccatgcagtaatatcagatgagactcataggatcataaccaggacgtgcaatttcagcagcgataatacttggagcaacgatgagtgcaatgaggccgtagcagaagttctcaagcagtatcacgagatagatatctatagcatctatacctcagtttgcataggagattctgcgcgatcgtcttactttgattcagcgcaattcaaaacaaattctcgcattagctccaagagggtatgtgcatgtgtataacataaaagcctataatttactttgaaactaacaaatatcttttattttgttgggatgccttagatgccaccgaggctcatgggtggatatgatccatgcttagatgattacgcgagagtattttacaacagagcagatgttcagaagtctcttcatgcgagtgatggagttaatctcaagaactggagcatttgcaagtactctccccaatatcctttatggttttttttttgtgtaatatttgaaggaatttgtctgaatgttctttggtattctaacttcagcatggagatctttaataattggactggttcaaacccgtcggttttgcctatttacgagaaactcatcgccggaggattaagaatatgggtttacaggtaaattaaattacgttcacgaaaaccaactaaattcctaattaatttcactctgacgaaaagtagttgactacaacacaaattaaaaacttcgatcactgaaactaaaaaaacagagtatacaattaggtggcttcctacgcaagtaaccactacatactttagcttcttctactttggttggttaataacaatatgaaagaaagtttattctccaatttttctaagccgttggtttttggtttctttttgtgatggatccagtggtgacacagacggaagagttccagtacttgcgactcgttatagcttaaacgcactcgaattacccatcaagacagcttggaggccatggtaccatgaaaaacaggtacccgtggacctaattcaccagttatatgaaattcttgatttgagtattgttagaccggttaaattcttgatgatgctataacaggtaagtgggtggcttcaagaatacgaaggtttaacgtttgctacgttcagaggagctggacatgcggtgccttgcttcaaaccaagcagctctctcgcctttttctcggcgtttctcagcggagttcctcctccgccatcgcggtagagaagaaattcaatgattaaaaagatgatttagtacgtaatctaattatgagtatttttgaaagatttttgggttttgtttcgttaacttgtcagacacacgagataggggaaaacaaggattgtaacttgtaagagagaatatgtgatttatgttacgttttatgtcatgatcataatgatcaaaagaaaaccttcaccgctttgagattatgatcaaatgaaaaataaatagctttttggtgcaatgtcattataatgaaatccaaattggaaccccagactagtttggcgcacacatttttttggtggtttttgttaattctcccttttatataattcattagtaaccgtagatttttgctacttaaatcgatggtcaaatataataaagttatgtatacggtatatgataatctctcttttgggtaagaatggaacattcatgcattaatcatcagaaaatctcttcccaaataagatagtaggatttcattcttaccaaccatatttacttttgtattagcattatattattattattcccatttgttatcttagagataagtttgaaccattgacccatcaaattattattttttcattcagaaatataaatatattatcttctttcttttgccatctttcccattatggattaggaacattttacattgtgaaagaaagaaagcgttacactttttttttttttttgttacagtactctgatttcaagtaaaataataataataatactacacatacttattttttatacttggagcctaaaatttacggccgcacgaacggagtgcacgtttgcttctgtcacatgtttgtttgtccgagtttttgctcttgcatactgccgttgtaaaaagttggaaagaaaataatcttaacttttcaatttcaaattagaaatgaaatcaaagaaattggagcttgacttgtctttttatagatatcctccttttacctattttactatactcaattcttctatttttaggatccttctgaaaattaaattaatttttccatttatgtttgtagtttcttatttctgacaaaacaaatgttggaaaaaatctatccttagatgccacgtgtagctattcgataagtgataagattcagtattatctggagcgttagcgttaaataacactcttaagcttcacatgttttatcgcttacactcaaattaagtctatgtaattacaaaattacaacactctctccatctctttgttttctccgcag

SEQ ID NO: 6917 - DNA, 3000 bp, Unknown
  misc_feature (1)..( 3000): cDNA_ID_1816095_gDNA_ID_1621115_Annot_ID_56192 3000 nt of promoter + ATG
tcaagttgagccgcgacttcttcattaagtctctttcgcccttcctccaacagcgttagaatttccattttgattttctcagactgtaagctttcttcgaccttctttcgaatagcttcttcaacccgtttcacagtttcttcctctattagcttcagttctgcttcacgctgtcgcctggtagcaaatacagtgaaaaattagaggacatccacagcaggttcagaatattgaatatcacctgaactttctcatttcctgatgtcttcaatcttgaacagcaaaagaccaaaattttattgcaaatccgtaaaaaatgttgagatcgtttccattttcactcctcccaataccaatggtaaatttcgtgaagaaatttcttttttgtcaccataacacaagcaaaccttcaccaagattattcttgtgctttggacatatttacatctctaagtcaatcatgatccatgtaatgacaaacggtaactcatcaaatcgagatagtacgaacatttgtgccagaggatcaaatataaacaaatcgaaatatagcttatcttccataagcaaagcctgtgagagaataccataaaacctgtcgcacttttgagactaacaatcaaggacttccacactacactaaaataacatttgagaacaaaaaaccttaatttcaccataacatccatcttacttcaaaattttgtattgatttacctttttcgttcttcctcttctcttttaagtttttctccattcctatttttggctgactcaagggttgcggcgggagatctttttgcaggagatggagttgaactcctactcttttgtcttttgtaacgttttggggttggagaacgtctcttaggagtaacagatcgacttcgatggcgcctaggagaaatagaacgactttttcgcctgaacattacccaaaataaagtagtaagcaaaaagatggaactaatgaagtaccacgcacgtgaagactaggcatcaggtagcccacagttacacataaagaaaacaaaagtatgtgcagttacctcatacactgtaaagaattatcagctccaacttttatcacacgaagagaagctaacgagacaagggatcaatgaaagaacacctaagagcaatccatcagctgctcatttcccctcccgtgggaacgggaagaaactgagctattttataatggtaagcgcatgtatcattttcctagcttctcagccatgttctcaacaaattactatattatcttacctaaggaatagtggtggttttgtatcactattgctaacaaactccatttaaaagaacataatatagtcgctcttaaaactgattctaactaataatctacagatacaattaaaatataaactagatcagactatcagtagtgctattatcccagcttaacttatgtctttaccgaatatacaggtttcattctaaaaatcacaaagctcaggtcataaaacatattctcttgcaacaaatttaatcacaacagccaaataaacacgatatatttccaatacgcagcatcactcaaaaaaacgcttacgatacagagccagcagcatccagacattgcactctcttttagagaagggtagaaaatatatctataagtaggaactttactaaaagcaattcttgagtctgtaaactttacatgtctatctataaccgtgttccaccaatgtttcttacagttcgtataaacgaatgataactaaggcaaacgaatagcggaaaaaacaaacactaggggtatcacctgctatacgaatgagatgagtatggagaagggcttctgtctcttctactcctcctgctatgcctctgccttacgggagacctcgagtgctttctacgacgtgaaggtgatggagacggtgacctcgatcttgacaagtcccgaggcatctctcaaaattccgtagaacaagcagtatcttcctttataaggagaagctcagctcagctttaatctctctgaacggattggtcctgcaaattccagattcaacaactcatgttaataattgaaacagcctatcagaatctaaataggtataacaaacagaaacctagcagcaactttcagattgcggacacacaatctattaaatatcttctgcataaacccaaaattgaaaccatcctggaaaatcagctgaaatcgtatgactacttaccctcgagaatcgcggcgttgttgttgttgtttgttggatcgcctcaagagtcaacacggagagagaagatgaggaagatgtatgggtaaaaattatgcagcagcgaaccaaaattcgtcgggtttgggatacatagagcaacgtttaagaagatgaagccagcttttgtaaattattggaattggtcttgttcgttatgaacattgaaagccttttgggcttattaaacattgaagccttttgggcttattaaattcgacatgggttttgagcccttccaagtttttaagttttgttaaggttaaagaaaaaacagttaacattttaacctttttagcatacccataattttacatagccgcaaattccatgctcttcttctcttctttttcacttgactaaatcacgtttcactaaacccacaattcccatgcacatttcttctcacaccatgcacgtccatcatgtatacacatcacaattcacacatcatgcctaggtttactaatcctgagtatatggatcaattacatgatcctatttttctattaattattataagtatatattaaagaatcaacataattgattgtgaactttcgattcctttataggcttattttgtggccaaaacggtaatctcattctacaatatactttagcaccactttggagacgcgttcttaatatgcactataaatgcatacacttattcacacacaaaataggacttcaacgacgcaagccaaagaacctagactaaaatcaatagacacaagaaaggaaa

SEQ ID NO: 6918 - DNA, 3000 bp, Unknown
  misc_feature (1)..( 3000): cDNA_ID_1816091_gDNA_ID_1621115_Annot_ID_56193 3000 nt of promoter + ATG
ttctatataatggttgacttattgtgaataagtgtaaaaataatttcagaaagctcccaacaaattaagaaattgaaaatttatttcattactataagttaaattttctttttgtttttgagaattaatttgaatttttagaaaatatttgactcaaaactctttatttatttatttaagttaatgacacataaaaaaagatttgtttttaaaataaagatacgaagaagggtatattggaaaatatgaattagttgtggattctagtagctatgtccagagcaatcaatcactatcatattcatcaccaaccgaaaacgcctctggatctcgccagatccaattcggaccaaatcagaacccaaaattcgactcacttgtctcactcgactcgaatctccattctttgtctgaaagtttcttcctttttgtttaaccaatggcgacctttatcaatctggaggattccccaatgtttcagaaacaggtaaaattgaaaagctatggtgtgtaattaccttctgcggatttcagattcagggtttttgttataaattgtgagactttatcaccaaaattgttgtcttgtgcctgttctaattggtttgatcaggtttgttccttggaggggacagctgacgagcttaaagatcgttgtcagaagctatacaaaggtgttaagaagtttatgtatgtctacatctgcctttttctttctactgttttactctgatctttctgttgactgaagattcttagagtatcaattgtggaatgttttctgagagtgacatatattctgaaagtggaagttggaattaccaatttgtatcttcttttacttaattagcaaatgtggattgaccattaaagctttctcgattgttttaccattctcatgtaaatcttagattatgtgataagttaacatcgtaacattgttttgttgctactgcacttttgtcattgtatctatgtggccagacatgttattggttgctgatacgaatgaaatttactttgctttctagggggactttgggagaggcatctaaaggagaaagtgcttttgcagcttgtctggaagaatttgggggtggacctgatgatcctatcagtctttcaattggaggtctgtggtcttgctcatttgttgaattatgactctatttgctatgatttaacttatttgattcttattattttgagtgacaccagggcccgttatatccaaattcataaatgcacttcgagagcttgcctcttataaggagtttctttgctcacaggtatgctcatagtatcttgtgagctattataaatgccagtaaagattcaaagatccctatcatcattaagagcatagttttgtttggtaatttaaatgaagatctgattcagagtgtcccgttttgattattttctggaaatgtccgtttgagcttctaatcaactctgtgagcaatgaaagaaatataagatagttttgagtataaaatgccaaatatgcaatttattaaagtgcatatgccttaacaatgtctcactttatataacaattgtggtattttatgtgaaattttttctaggtggagcatgtgctacttgagaggttgatgaactttattagtgttgatctacaagaagctaaggtattcattttctctgctaaatttgatcaatttgtttttttttcccagtgtactgagtttctcaacttttatagattcgactttgatcaataaactggagatttgttttttttttttttttttttttttttttgcattccagactgtcgaaatactttactctttattattgtgtgaaaattctacagtcatttggaatttggatatgaatttcaaaaggatacggctttcaaggtctttagactgaccatatttaaaaaaaaaatgtttcatatgtcatgcactgcaattatatgatcgacaactcatgcttatcattccaaccaaccctatgctgtttctacttttgcaggagtctcgccatcgatttgataaagctgctcattcgtatgatcaggtacttgcttatggagtgtataacacctttaatatcttgtatatgcagttgtacacccttattcttcgcctaaaataagtatgttttataggctggtgttaccaccacaagaatgcacagcactgaaaactttgtctgatattcttcatctgaactggtttaatgagttttcttatctgcttgtagtcgcgcgaaaagtttgtgtctttaaagaagaatacaagaggagaaattgtggcagagttggaagaggtagaacatttattcttatgtatatctttttgtttgctttctcttcgtggctacaaaggaaagtgaagcaaaattacagcgaaggaatgtgccagcccgtatgcgcatatgaatatacacatatttctagactgtctagttcaatagatgtccgtacgtcctataggtgtatgtgtacatgatgcatataagaatgtttgcgcatatgtagtctaggaaactgtccagtaggaaaagtagtaaagcaaagctactctttaatttgacaagccaagatgtagatgttgtcgttacttaatactatttgacatgctctgtgcttgtttttcccagcatggtaactaacttgtgctgtcatattttaatgacaggatctggagaattcaaagtcaacatttgagaagagccgtttcaatctagtatgcacactctactaacataagcctttgctatttactttcaatatacctacttttaagtaaatttttgcattggttgaagagtgcaggtgaattcactgatgactattgaagcgaaaaagaagtatgagtttttagaatctattagcgcaattatggatgcccatctgagatatttcaaacttgtaagggctctaatttcacatttgaagtacttaccatgtaagaccaactaagtttgagatttgtgtcatgttgtgatccttaatttggcctcttt

SEQ ID NO: 6919 - DNA, 3000 bp, Unknown
  misc_feature (1)..( 3000): cDNA_ID_1816192_gDNA_ID_1621116_Annot_ID_56195 3000 nt of promoter + ATG
gatacgcagtctggtcatcaggtacttccagcgttctatagccaatgttctctactcccgagagataacagggactgttactaattctgatatggaaatgattgctatggctcccaaaggcactctccgccaaaccaagaatggtatgtctcttcaaggtgaaaccaatgacacacctctctttgtacttcttctgatccacctatgtggatacaagatttgggctgtcagcaataaccacaagagagcacaaggcgttctttgcataggcggtgttgtgacaccgattctgatcgcttgtggagtcccaatcacatctgatggacttgagccttgggcaatggatatcgagcatctatatcattgcgaattcctggagttcgcaatggttgtttctgtgttttgttttgtcctgagtactctcttccaagtttagtcacacaatggactgtgtgatttaagtttgggggagggctcaggaagtgtgtattacattgtatatactcttgagtctgcattcatctaatgcatagaaacaccaaacaaaatttgaaaaatttcagaaaataatttcacaaaaacagactgttcatgtagttgcattacattttaggatcgagtctagagtgtttcatttaggactgttgcatatgcataggggataatgatgagatagccttgtaagcattttggttcaacggataaacttagtgccctcgttgctaattgtctgttgtgtagttaatgaaattgaagtaaaactgaaccatgcctagattgctctactcgaccacactatcatgatctgatacaattctctatcaatttgaacctgattctgatttttaattttcatgtctacatcaaatttgaacccatggatgccctaaaatacttggatttttttactcattttaaccactcttgttaatccaagtagccgactctccttattagagcagttaactcgaacccaaacctaaattttctttcaagccctataccacttgtgagtgtttatgaggtcttattccgattaagcttggtagaaagtattaggttcgtgataacactgtattttactcattttaggtgtgtgtttatcatcatttagttttgcatttgctcattatatcatatcattttgcaccattttagcttattttgcatacttaggcatctaggatcatcttgcattcgcattgcatgttttggtgtgttttcaggtgcagaaggagctaaaaaggactctactcaattcattcactcgatccaggcagctacagaagaggcatcaattcactcgacctctgtactcgatcaaggatgctacagaggaggctgcagtttactcgaccctcttactcgatcaaggcaacctcagatggagcagcaaactgatctactcgcccctcctactcgatctactactcgatccatttactcgaccaagggtgaccatctctacaagacttgttgagctatcaaagcgtcttcggatcctcctcattccccactcaaccagacatttgagcatacggatatgagaggatgaagcatctactcgaccaattgatcactccgagcatagacacaaaggcacagattttgtagcaccctctttactcgatccccaagatcgagtattcgcccaaaccgcctcaaatctcttgtcttctagtgaatctagggtttcaacattttactataaatagatcactttggggtttgtccaaaggatctatgctttatctttcagtttttctttgtgtttatgaatcttaaaaccttaattactcttaatctatttcgtttttgcatttagttctttaagtaaagttgtatagctagtttagatctacattttggtatgatttcagtaatttatgggtttgtgttcttgagaatgttgcttgagtagtgattagggttcttgaggatggattagattagggtaatttctaggttagttaggtggttagtgtttagggtaatacccttctggattcgcttggcccctatgcgattttcgctggctaatgtggagattcgatcatagacgtccagcatccaaaagaggttcaaatggatatctgatttacgaattccagagatctgtagactcgaccaagagattggcttgtatgcttattggctttggtagattgtttcttaaactctgctctgttatgtttcatcaacgagtgttgagattaggaagtggtagagttagggggtctctgtcacgagagtggattgacccgatttttgtatctatcgtcaagggtatctacctttcaccttttagccatctgatgaaccctagagttgcctttatcaatgaatccatccttaggacttctattagatttatttgtattccctgttgattgcacttttatttacctgttatttatatcccctatttgtattccttgttgattgcattttagttcttaattttgtcacttgttagttctactcgacccaatgatcgagtagggctcttaaagttcttatttttgttgtttgaatcctgacctaggattgttaccaaaaacccaccatcattataatctggctagacttagttgtttctgtacacatcttgattgctagcaatacagtggactggattgacaccccctatagctgcatcgacatatttttgttttagggaaattgaactgaatcacacattcaacataagtaggcctaaaaacctgcttattaatttggcgatgttgccaattcattgttgcattgttacattcaagatatcagaaacttttaagatcaagttcttttccatttatcaagttactaactcatcttttcgtctgcttgtttttgtggtgtaggtactaatctttgtgcatgcaaactcgatccaaaggttctgcacacctactaccattcagagacagaattgacagaataactcgtgagttacaagaaaccaaagcaaaggcagcctgtgatcagaaaagaccagctgct

SEQ ID NO: 6920 - DNA, 3000 bp, Unknown
  misc_feature (1)..( 3000): cDNA_ID_1816188_gDNA_ID_1621116_Annot_ID_56196 3000 nt of promoter + ATG
gcccaacccaaacctctcttacagaagcactaatgtagccaaccctcaggataaagtgtatccaccacaacagaatcagtccaagccttttgttcagtacaaccaaggttatgtccctaaacaacagtttaatggaggctaccaacagcagaattcaccaccagggttcactcaacaaccacaaccagccctagcagctcaagatcctgacattaagcaactcattcaacaaatcattcaaggacaagctactcgcgctatggcttttgacaagaagatagctgaattacacaacaagatagctgaattacacaacaagatcgattggtcttacaacgatctaaatgtcaagttcgaagctcagaattcaaaaatcaagtatgtggagaatcaatttgcatcaacctctgctccgaagcatcctcaacaacttccagggaaagcagtccaaaatcctaaggactatgctactgccaatgctatcaccatccaccaagaagatgagtctccaccaagtcattagactctcaatactgaggacaatatgattcaagaaggggggggggggattcaattcaaattgcaacacctgccacccagaaattcatctggaccatagagcacacacctttgtcgaatacttaacattctggaaaaaagttcaaaattaaaaaactcaagaatgatcagaatcaagagatgattagcagtgcctccactcaagaagcatacaagaagaaattcatccaagaaaagcttgatgatcccggttcattcactctgccatgctctctaggaccattgacattcaataggtgcctttgtgatttgggagaatcagttagccttatgcctctctctacagctaaaaggctagggataatggaatacaagttctgcaacctagctttacttttcgctaatggttctgttgcacatcctcatggtctaatagagaatctgcctgtcaagattcaaaatgttgagatacctatagattttgtggtattagacgtagatgaggaaggcaaggatcccctgatcctaggcagaccattcttagcttcagctggagcagtcatagatgtcaggaatggaaaaattaatctgaaccttgaaaaaggcatcaagatgaagtttgacatcagagaagcttcaggagttcagaattttgggattcaaagcatggatgttgatgaagaaacagaagttgaaacctcaccaaaagtcaactatacttctcaaaggacttttgaccacaagaagaaacaacagaaaggctagctcagactaaagatcccaaagaagatgactggtatgagatgagaaaaaaatttaaatggcaaagcagagtcatagaaggattgtcttcaagggtgatgaagatgaaagaacaactatggatgtttgaaaaaagagttcaaaaattttcaaatggtattgatccagagaagatggaaactgcactagctatcaaggaggacgaaaatttcacaacagaatggtttgcacaagaagatcagaaaggagttcacttagaggaaagaaacctagagagcaagttgttgagtgaggaggaaatcactatttcgacttattctccaggagtgcctaaacagcccaccaacccctctgctgaaaaagaacacttgattcatgattctgttgctgaagaacttctggagctctgagttggatacaaagctcaagaggataccattggggagctaacttacaagatggacgaactgaaccatgcaatcttggaacttaaagaaatggttaaaggctaccccagttttgaatttgaggattggtcaaaagagcctggttcagaagaagaagactactttgcttgtcaaaaagaagcttattttgaagaaaaatcaaatgagtactcatcctaccatatctcaagaaaggatgcaaagtatgattcaaacactaaaaattcaaccactaaagatgaagacttctctgttcctctcttcaacctcttttctgactgtaagagtcaagcttagtgacttaaaacaagctcacttggaaggaaatcccatgtctatccatgtatataattttctatttttcttgttatttttgaagtttttgtttaagtgtttcaggtttgttttagtgaccctaagggagtcaacggtcgagtaaattcaaaccaagtcaagaaaaatctcaaccgttgatcgagtagaatgaggaggagcgttttgagccgttgatttgaatgaccaaatggaaaaagcatcaccaccgtttgatcgagtgaattcctgaagtttactttggtccaattgatcgagtagacaagaaaaaggagctctcctagccgttggatcgaattttgcgcaactcaagaagatgctcgattctttactcgagctctcattattttgaaacgaaagcataattccgtgacccccttgcccccccccccaaagctattacccatacccctcaccatttccaatcaacttttctatctcttccaaagcaaaccaaagaccaatctcctctacccattgatttcgacaaaccctcattgaaactctctctttcatcatctcgttttcgcaacccctcacattgaagtcttcattccaaacccttcccctaaaacgctccctatcactctttaagaatctgttccccttcaacaatacttcaccaaagttactcgaactctccaaagtccatcctcaagcattcaatcagtttcaaactcaaaatttcatcaccaaagaaaccgattcccttctcctttgatacctctttgggagttgtttttaattgctttgttgaaactcaccaccaatcttcatggattcaacaaggaagagtttatctcgggcaagaagatcctctgttgatcatgaagaagttgaggcgtttgacatgagtggcatgactgaacgccaaattcgccaagctcgccgtgctcaaagatcaagcttgattcaaggtggaagctcaagccgctcaacc

SEQ ID NO: 6921 - DNA, 3000 bp, Unknown
  misc_feature (1)..( 3000): cDNA_ID_3049283_gDNA_ID_1621116_Annot_ID_171878 3000 nt of promoter + ATG
ttttttactattccaataaaaaaagatacaatcaaagaaaaaacccgtcaatattaacggaaaactacgataaaaagacactaataaaataatcatcaatgttttaacggaaataaacgaagaaaatatacaaacaggaaaaataactgtcaataagtaaccaaaagtaacaataaaaatatatgaacgaaaaaggtaattaagtgacaatattttaatggaaaagtgcgatgaaaagactcaataatatatcgaaaagttgcaacaaaaagacataactgaagaaaaatacccgtccataattttacaaaacaattgcaataaaaaacaaaaacgaaaaaaataacagttaatgttaacggaaagttacgatgaaaaaatatgatcgaaaataataactgtcaatattttaacagaaagttgcgataaaatgaaataatcgaaaaaataaccgtcaatattttaacggaatgttgcaataaacagacacaaccaaggaaaaataactttcaatatttttatgaaaatttgctataaaaaatactaaaggaaaaataacagtcaatattaatgaaaagttatgatgaaaagtcactaacaaaaagttgcgattaagaaaacactaacgaaaaaatgaatcgtcaatattaatggaaagctacgatgaaaagatacgaataaaaaaataaccgtcaatatttaacggaaagttgcgataaaagagacacaacaaaaaaataaccgtcactattataacagagagttgcaataaagagacacaaccaagaaaaaataaccgtcaatagttttacaaagtgacgataaaaaaaaaaaggaaaaataaccgtcaataataacaaaaagttacgataaaaagaaacaaataaaaaggtgtgataagaagaaactaaaggaaaacataaccgtcaatataaatagaaagttacgatgaaaataaactaactaaaaaagtaattgtaaatattttaacgaaatattgcgattagaaaacacaacaaaaaataaccgtcaatattaaaatgacaaagatataaacaaaaagttgcgataaaactgtagtaacggaaaaaataaccgtcattgttagcggaaagttacgatgaaaagacatgaacaaaaaaataaccgtcaacattttaaccaaatgcaaattttatgaagaatcgtagaagaaaattgttccttcccaaattttatgaagaacaaacaagaaaacaaattgttccttctcaactttcattttgcttccagtgcaatttcagagatatgttactggtgtttgtgtaaacaataataaaaaagaatagccaataagatatttcagataaactagagaccaagccatactcctcagcatcccaattacacagaataatcgtccttcgaggcttccatcctcttttctgcagcttatctagtctttgtgcaatctacaattgtttcaaaaatctctcattgcaatgaaaacattgaaaactttcaccaaatacatgttgcagataacttttactcgcctccataagtaccgcagtgccactgttcggatcaacagctctgaaagtccaagtgtctctatggtttcgaagaatcacatatctaaccaatccattcatatacaatccctagttagttactacaatcagaagtctattgccactcactattgaacatgtacctatcaggctcttcttctccctcaatcactccaataacattctgaatcttggctataacagtttgataagaatgaaactatgaatctctctttcttatccttaaaatcccaattacaatgaaacaaactctaaatcggtaagcttggagttacagttctccaatcttatctcctaagaacaaagcacataagccctaattctactcacaacatcaatatgatcacgcaggatagttctctatgtttgctctctatctctatttatactctgaattcttctcatgcttctgtttggctcttcccaagtgcctattcatctcacacgtgctctcttatcacagtttccccctgaaacaaagacccaacaaaactcaaatctaagtaagtaacacatatcatctgaaacacaaactcactcactatgtagctcaggttcaagatcccaggtccaggccccacatctccaacaattgtcttcagaatcacttcagcatcagcagctgagacaggcaacgacggtataagcggaacatcaccgctcaattcaaccgcctcgtcggataatctctcacacccatcaacacttgcccatccaggagtcgttggatcacctaacccattataaacagtaccaacttgaaacccactcggtggcatccatttactcgccggaaaccactcatctccaccgtaatctctcttgtttgtatatatcacaacaccgacagctcctgcctcgtaagcgttgttcacaatgtctactttgtatatctgaccgtacctcgcgattacaacggctccagagacattcacacccatatctttcttgagtctcacgaaatcttccactcgtccatagtttgcataaaccactagacttacctgacttagggtatccatgaaaagtatgtaagtgcggatggcagctggagaatgtgtgttgattgcagagccatcaacaatataacggttaagtattaggatgagagagggagatgaatggaaaactgcatttaaaactaaacatgggttatatgagtggctagtcatgccatttggattaactaatgcacctagtacattcatgaggttgatgaatcatgttctaagagcattcattgggatatttgttgtagtttactttgatgacatcttagtttacagcaaaagcttgagagagcatatagagcatttagattctgttttgaatgtccttagaaaagaggaactctatgccaacctaaagaaatgcaccttttgcacggataatcttgtgttttttggctttgttgtgagtgcagatg

SEQ ID NO: 6922 - DNA, 3000 bp, Unknown
  misc_feature (1)..( 3000): cDNA_ID_2165328_gDNA_ID_1621116_Annot_ID_171889 3000 nt of promoter + ATG
atgttttacttttatcctaagacaagagtttgattccaaatgatctttaaataaatctaactctttctcaatgtttcctaaatatgataaactcatagtaacagttcttgaaacaggagaaacaaatcaagttaaagagttacgtacctgagtaaggttcacagtgtgttcggtgtttggtatcatcatgacaaatggaagtggcgttggatccgggggttctttttggatcaaggcattgttggtcaccaactcctcctctctagagctatctaacaactctccaggtcgccactgataggtatggaaagtactaaatgaagaaatatccatttcaggctcctctatgcattcttccatgtgttttagccgaagttgattttgataatcttcacgaggatctcttgattgactcatatgatgagtgcttatctcccgatcactagtcttcttgattggcctcaaaagtgtacaaccttcaccaagagaaagcaaattagctttcattcgattttgggagtttagataaatacctcgagttttaaatggtggtgtagcatttggtggtttatcctaaaaaatattgcattcagctctaggtgattgtttgtggaccatgacagcctcaacttgagtgaatctttctaattgacgtggttcttctttaggtaaatctcggtttagaactggttgggatacatatggcggtcctttctttatcaagatggtgatttttgaaacatagtcagctcgacaagcttgtgaagttgataaaaacacgggagtccacccaatgattttatcaacagaagcaaaggttcgaaactttgatggtctatgagtgatgacagagatggtagatggaggggttgttgaatgaatccacaatcaacacacaaattaaacaacttgaatccacaagttattcagcccgcaaatcacccaagagaagtgaatccacactcaacttgaaatgacaaaacacaaagacaattctttgtaaaacaaacttaaagtttattgagataatttctaaaataattggtgaatagaaatgaaatcgagagttatatagaagctctagtacaacggctatatgccaaaacaaaggaaacaaatcgcaaacaataaacgaatagagccgttagaggctttatggtgtaatcagccaaataaggcaagtagagccttaatttgtatctagataacttgggaagaaatgtgcggtttcttggaagctttaggatcacttggatgctcttaaacacgcaagcttttagaaaaggaaagagtcgttgaggtgtgaactcatgcgaatccaaaataggaaagaagtgactcaacgggtcttgggtgaggtgaggtgtagcataactcgggtggggaaccttatggaaagtttggagtttcttcttgattcccttagacggatcattaataagggtaatgtccctttccttatttggcatcgaataatcttgtacgaaaagtacttcagcaagtccttcagggagtccttcagcgaaaccttcagtaagtcctttagtgagtccatcagcaagtttgtcagttccagtaagatcaatgttggtattgattcttacatcatcccctccctcttctagaggttttgtcctcaaaacttgtttacctacacatagataagtcaagttagtccattgaagtgtataggggtttagaagcttacattgagtttggccgatgggttgaacagctggtggttcttctttgatctgaatagttgcattgacactctcatctttgttcacagcaacttcgcccagtgttggttctccttggctttgacttttatccgagaacactttctccattgttgaagcttcttcttggtttgatcctatctcccagctagcaaccagttctttaaagcatcaacaccatcttcagcaactttactaacgacgatctccatcaacggctgaggaatgtgtatatccatcgttggaatctcctacatattaaataaagaaatttactcacaatcattatataaattaacattattataaaccttgctttcccgtaaatcgcccaccttatcttcagttaaacgattcatctttttataagaatgtttaaaggttttgttctatttatagactttattataccaataacttagacatcgatgggtggtatagaaccggtttggtctatgtataatattggcaactctctcgttggttttgatttttttgtataaaatttatttaatttttttacatcagtgtagtaataaaaaaattacaatccgcgtggatatttgtttcccaaaaaaaaagttgatatttgttgtgttttggcggcaattttccctctcatccgaattagatttccccatcttcccggttcaaatatttttgatgtattattttactattttaatcatttctaaacatttgttgtaatccatgtggttattgaaatgtttgacatgtcatggatcctcaaaaatagtgaattattgtttgtcattatatcttgtatgtggatttgttactatggatacaagtataaatacgtatttatccaaggtaaaacaagatgatttttgaatgtgttttggcggcaaatttcactcgcttccgaatgagagctccccatcttcccggttcaaatatttcaatttaatattcgaaaatactaaacaagctaaataaatttgttgttatccacgtggatcttcagacgtttactgatggattcacatatatatttatgtaatacatggcaataacccaaattttgtggatttgttgctatggatacacgttttaaaaataatttttgagtccataatgtaatgatacctaaacgatatccagttaattcgaatagttattactaaccggtcggtattctaaacgattgagttattggttatgtgaaatgctatttaaggaagttgcttaacccattagttgaccataaaatcactgaaacgaatgaaaaaaaatg

SEQ ID NO: 6923 - DNA, 3000 bp, Unknown
  misc_feature (1)..( 3000): cDNA_ID_2165350_gDNA_ID_1621116_Annot_ID_171893 3000 nt of promoter + ATG
aaaaaactcgaattacaggttgcagaagcaaaatggcgcagccacagtaaaaacaaagaataaaactgaagtaaaaactcaatgttgactagatgtcctaggagaaaaccctcagacacctatttatacaaaacgaaataaaatgatagtagataggtcgggaacccaatcgaccggcctatagactgataatgggccgagatgggcttcgcgattagatgaagctctggaccgcttccaaacacttcttctactcctcttctcttccttgtgttcagcttgtctggttgagtgcagattcgagtaaactctgaagatgtggtcgagtgcttggtcgagtgatggtgttgggtggtgacagctttactcaaccagggggttgagtacggtggccgagtgaacggccaagtggtggtcagttggtatgacgaagtgttactcgaccaaatggtcgagtggtgtcatcaagtggcctggagtgtggttactcgaccagggggtcgaatgattggtaagaatggctccaatgttactcgaccagggggtcgagtgtgctgctggagttactcaaccaggtggtcgagtaactcttctggttccggcttgcttcatccaatttgcttgccaacagctccaaatcacctaaaacatctcagaaatgcaatatgtatgcaaacctatcctaatcatgcaaagtatgcaagaatgttgaggaatgatataaaacagtgatgaatgatatgaaactaaactcaaatcgatgatgaatgaacactgaaatcatgcaaattgtagacatttcaaaagtaaccatatctgggagctctcatgtcacctcatcacgctaaacagttctgaaacacaaacaagtcattatagaaaactttgactgaatttgatagaaactatatggtatgcaaataataatacaaaattaccatctcttctcttctccggacatatggcattgacccacatatgtgctttgctatccctaagccaccacgatcgctcttcttatttttggagttggttttgcttctcttgatgcttttctcgttttcccataaagcaataagaccaatccaaacagagttcatcatcttttgggacttccccttgtcaacacaatcctccgataatttatactctatttttatattcatcatccgtgttgcagcagataaatgagagtgaccctctttacaaccatcataaatcggtttcttcgctgcatctaacatatcaaaatactttttcgcttctaagtttggttcttcagttccacctttagtcgtttcgtgaaaagcatctgttaccatctatattacaccggcttgagctctagttatattctcttcctcttcattactattattatctccaagttccaacccatgattttcatcatctccactgttttgatcagtactactatttgctaaagtttcaaaatcattcacatgagaaaaccatatgtattatccaggcgtaaatcttctatataaatgcttccaaatagtatctactgagagaaatttctcattaccacaagaagaacaaggacaatatatcttaccacactccaatagaatctcttgatttgcagcaaaacacataaaatcaacaagaaattctttatattcgtttgttaattattcggtaccttcatctatataattatacatccacttacgatttttgttttttgttcttgtcattgacaacaattttcaattttttcagaagtaaagtttcacagaaaaaaaaaagagaaaaggggaagactatgaatcttatataacctagatttgtctccctcttttttttttggttttttcgtttctttttttcgattttcgtttttttttccacttttccaacaaatattttgtcatcaacttgttagaaataatttcccacaaacaaatttgtttctaacaaatattttgttaataatttccaataacttaaaatgttaatttgcaacgatatcatagttgttggcaaattacaaaaattttcctacgacatttatgataaatttaccataactaacattaattggaaatttgcattaaataaaatatttgatgcaattttatagtgatatatccctatttttacctgttttagctatgatttaagtattagttttagagtttatttgttatttccagagtcttttctagttcttttcaggtctttacatgtttgagattcatttggagataatggagcattctgaaggaaaaaagagaacttatgttgcagaagaaatctgaagactaaaaatcgcgtggtagacataattttttgatagatatatcaaatatagttatgtacatagatagacttattgaatagacatatttgtagttatggtaaagatacactaatctggtatagttagactttacgatagagttgttgggtatagttacattatgtgatggtagagttagtgtcgtgacagatttaatggatagagatgatgtatttgatatagttaaactatatgtggtgatagagattcttgacagagttagtttgttgaaagagttattagtaatggtagtagatttaagcgagtatgacagatatatctgttagagttatctctagttacgatagagatattcggactgacaggcttaaggtacttaaatgtatgagacagtggtgatagacatatttacttgacagtagagttaaagtcaaatttcatgtgacgaaagacatattgttgctatgtgatggtagagttatactgtatttaattactagaatagcactcaaatttctgacttatgaatggtgtggtaatagaattacgaatttaatgattttttagacatgtcatttttctaggttaagcatatgttctaagaatggaagatactatttttattcttatccgaataagaggatcttttgtggatcaggcaagtagaggtcgtaaactgcagaaaacaattgaatcatctgctctatttggcg

SEQ ID NO: 6924 - DNA, 3000 bp, Unknown
  misc_feature (1)..( 3000): cDNA_ID_2165361_gDNA_ID_1621116_Annot_ID_171895 3000 nt of promoter + ATG
tacttctataagacaggttcggatggttgtgcttgaagttgttgaaacccttattgtaacctccttggttctacacatagctcacttcttctgattgcagagtctccccatcctggacttggaacgtctcatcatcacccagaaaatgaacgtgcttctattgcacaaggagtaacttgtctagcttgtcattcatagctttcatttccctgcgatgcttctcatcagaatcagagctggtgcggatgcttctatcgtaatcttcattgtagttaccatccgattgagccaagttctctaccagctctcatctttcttcaatgtctttgttgaggaagttctcgttggaagcggtatcaagaagcatcctgatcttgggaaggacacctatgtatagagtgccgggaagtgaagcttttttaaacccgtgatgagggcatttcgtctgatagcctttgaagcgctttcatgcttcacagaaggtttaagcattcgtctgtgtgaatccggatatctcattccggagtctagcaattctagagttagagaaaaatttagccaggaaggttttcttgtagtcatcccaggttgtgactgatccctggggtagcgtcttttcccacagatgggctttgtctccaagtgagaagggaaacaagtgaagcttgaaaccatcttcaatgactccattgattttagttaggctataaaacctttcaaactcgtcaaggtgatctagaggatcctccattggaaggccatgaaacttgttcccctgaaccatagcaatgagacctctcttgatctcaaaattattgttttgaaacggcggaggaacaatgccatgacgctcgttgtggttattggaaagtgactagcaccaatgttgttaggttgctcttgttcatctacaacgttagccattgtttctgtttctgtctgttctctcaattggcgagcaatacggtagatgttatcgttgaataggacgttctgattcccttgtgaccgtgtatgcatgcaacaagtagcaacatggctataacagacgattaaacttgtttgctaggtacctgaaatacaaagtctgaaaagacacaatgttcgtatctcttataacaaaaacaaacttgatcttaacaattctgaaatctcaaatatagcaaacaaacacccaattggcaatgacgccaaattgatattaggattttagtcaattaatcctaaaacactaatcttgtcgttgtagtattttaggtgtcaatccaattagctgtgatgcaaacagataagatgtgatctgaagtcactaagtgaagccaagcaataacggttttgaggtttctaacaatcctaagcgaacatgtagaaaacagaaattttaacagaattactaaaatcagtcgaccacaactggttgatgccagaagtaggatgtggtcgagtaatagatcgagtaaaaggcaggaaatgaaacaactatacttgactgcacagtctgttgcaagacactgggtgtggtcgagtatgttggtcgagtaatagacaggaaatgagacaactatactcgtttgcatagtctgttgtcggacactgggtgtggtcgagtaagttggttgagtaattgcaaaaactaagaaacaggcaatgagaacgattaagcgttaacgataaaacagagaaatcagatagacgagaaattcttaaggatggggtaatcgaatggagtggtatcctagcctattcgaatggttaacaagcgcaattaagctatccctagacaatatgttcaacaacagatcaattcactcccgtgatagaaatcctcaaacaaagctagcctagatatggatgagtttattttacatggtacatgttgattctgtaaaccaaacaatgaatttatactaaggggttatataaattcacttctcttttagctctaagataatcggaaactgtaagaaaagaagaacaaggttgcttaatgatgaagttagggttttgctataggaaaagtagggttattgtattgagttcaagatggattgaatagaggacaaatccctctatttatacaatactttgaccgtctaagaatatgcaaaacttctaattatctaaggcttgaatcttcattccttctattcttcgcgagatactcctctctgaaaatggaagtctcctctttcttagatttaggaagtcggctgggcgatctccaattgttgaattagatcttctgacgacctcatgacttcggcccattaaccgggataccccggtttaatcgaattccctattttattcacaattcctccggtttaagccggtattgtcggaggtgctaattcctgcaccaacaatacacatgccaacgtagagtcgagttatagagtgttcttattaaagtgcatcgaggagcggaatatgatagcaagtgttggtgtcggatcccgcaccgtggggtcgggactggtcaaagatcgccacgtaagagggaagggtctaaaagaggaaaggcccatgggcttttctgagtaaaaaagtatacgtgaggtgattgatcagcgaggtggactggacatcgatgtcagaactgcccggattggagagtcgggtgggccagaggacgaagcccagaaagttcggaatcaattcaaatttgaacattcgaatagttaatatagaataattgtgtgtaaatgggaattaaatgtattctttgagtataaattgtgggtcaaaggccatgtagagacacacacatttttgtgcaaacttactatacacattttcttacaaaactcatagttttctctataagcatcaatctattttctagtacatttgtcctcaagaataatccttctcactaaataaataaatacttgagtgtgtgaatccgacatccacattttggcgccgtctgtggggacaaagaattcttgagtcatcagattttttctatacacgacatttccgaagtgagcgacaatg

SEQ ID NO: 6925 - DNA, 3000 bp, Unknown
  misc_feature (1)..( 3000): cDNA_ID_3049271_gDNA_ID_1621116_Annot_ID_171891 3000 nt of promoter + ATG
atccaaaaagaacccccggatccaacgccacttccatttgtcatgatgataccaaacaccgaacacactgtgaaccttactcaggtacgtaactctttaacttgatttgtttctcctgtttcaagaactgttactatgagtttatcatatttaggaaacattgagaaagagttagatttatttaaagatcatttggaatcaaactcttgtcttaggataaaagtaaaacatgaacatttcaagaatggtgcattgattaaagctgagccatgtttacttatttattgtgatttcatgactatgataacgcatttgctttttgccaaaggtgttgacaaaattgcatgtataaaagaggagccactagacttaaaatttctctcgtcaaatctctttaagaggactggaattggagttgttttgaagccaaagatcgattgtccattcaatcgaacaagaagaaaaagcgacaatgcttatgaacttgagctgcaaggtaagtataatgtgatttccaatttcaatgattcttacttggttattttcattgtaggtgaattggatttgaggtcaaatccttttcaagtgggagaggatgatgtgatcatggaaagcacaaaggacttggaatttgatcaagagcgtgtagccgaggaagagcttgaagcaaatgagcagcttgaacctgaggagcatttcgaagcagaaaatgaacttataacggagaaagagtatgagaaagatgttatcttaacctcattggttttgatacatgatcatcaaatggacatgtgtctcatttgtacttggaaagaaatagaggttgcttttctcaacaacttttataatgatgcaaggtctgaggagctgagaatgaagatctctaccttctctcaagaagcagttgaagcatttaaagccgcttggatcagatttagaggatattagagagattgtccgcatcatagtttcagtgaggttcaactgttaggtatcttcttcagaggagttgattggcattatcagatggctttggatgcagctagtgataagtaggtcttttaggcctacttatgctaaatgtgtgaggttcagttcaattcccgtaaaacacaaacatgtcgatgcagctatagggggtgtcaatcaagtccactgttattgctagcaatcaagacgtgtacagaagcaattaagtcaagccagattataatgatggtgggtttctagtaacaatcataggtcaggattcaaacaagtaaaaatgagaacttaagagccctactcgatcattgggtcgagtagaaccaacaggtgtcgaaattaagtaactaaaatgcaatcaacaggggatacaaataacaggtaaataaaagtgcaatcaacaggggatacaaatatatctaataggagtcctaaggatggattcattgataagggcaactctagggttcatcagatagctaataggtgaaaggtagatacccttgacgataaattcaaaaactgggtgaatccactgtcgtgatagagacccccagaactctaccacttcctaatctcaactgtcattgatgaaacatagcagagcagggtttaagaaacaatctaccaaatccaataagcagacaagccaatgtcttggtcgagtctacaaatctctggaattcgtagatcagacatccatttgaacgtcttttggacgttggacggcaatgatcgaatctccacattagccagcgaaaaccacataggggtcaagcgaagtcagaagggttctaacctaatctttaccacttggctaacctagagattaccctaatctaatccatcctcaagaaccctaatcactactcaagcaacattctcaagaacacaaacccagaaattactgaaatcataccaaaatgtagatctaaacaagctaaacaactttacttaaacaactaaatgcaaaacaaaatagattaagagtaattaagttttgaagattcataaacacaaagaaaaactaaaggataaaagctcgatcctttggacaaactccaaagtgatctatttatagtaaaacgttaaaaccctagattcactagaagacaagagacttgaggcggtttgggtgaatgctcgatcttggggatcaagtaaggagggtgctgcaaagtctgcgcctttgtgtctatgctccgagtgatcaattggtcgagtagatgcttcttcctctcctatctgtatgctcagatgtctgtttgagtggggaatgaagaggatccgaagacgctttgatagctcaacaagtcttgtaaagttggtcacccttggtcgagtaaatgggtcgagtagaggatcgagtaggaggggcgagtagatcaatctgctgcttcatcagaggctgccttgatcgagtaagagggtcgagtgaattgcagcctcctctgtagctgcctggattgagtaaagaggtcgagtgaaatgatgcctcttctgtagctgcctggatcgagtgaatggatcgagtagagtcctttttagctccttccgcacctgaaaacacactgaaacatgcaatgcaaatgcaagatgatcctagagcctaagtatgcaaaataagctaaaatggtgcaaaatgatacgatacaatgagcatatgcacagctaaatgatgataaacatacacctaaaatgagtaaaatacaatgttatcagctagtaatgggaatttcatgtcaagatatccagaaaatgcaacaatgttgattgacagctagcttccagcattagtaccaaaagcgttgacattgcaaggaaaacgcaagttcagtatgttgcacaggttgacagtttagccacttcagagaagatgaatcaatagagatacatgagcttcaatcaacaatctacacatcagaaatttgttcagcaaactaaaagcttcattcaagattatgcttcttcaacccaagcccaccctccacccgacaccactaagacgatgaatca

SEQ ID NO: 6926 - DNA, 3000 bp, Unknown
  misc_feature (1)..( 3000): cDNA_ID_1816177_gDNA_ID_1621116_Annot_ID_171879 3000 nt of promoter + ATG
cctttggatatgcgcaccaaaagagactaaggattttgctggatatacacaccaacaagatgatcttcttaaaaaaggtttttgattaaaagaaagataagttctcaaaagagaatacaagagtatataaagagaaggagaagagaagctgaagaggcaagtcttagaacatacttcaaggctgcctagaacacaacagtaattaaaaacaaagtttgaaattcaaaataaacccttcaactactaaggccacgaaattgtctctttattttagtgggtttgggccttgaatcatcaaaattgattatatgaagtgaaaacataagcctcattaaaaaccttcctttggaaaacccagtgggacaaaaccaaaggcagggaaaaagagcactcatgaatcacttatccatcttgatgaggtccttgagcttagatcaaaacaaagaggtagtgatttggctcaagtcatttggtcggtcccaaatgtggttaagcatcccgccaatggcatggttgaataccttagctctagaacgagtcattgggacggtcgatgtgacaagaacatcctccgctacaagcttctcctcagctacaagctcatcctcagctacaagcttacctccttcctcagctacaagctcacgttcaagctccggttcatgctccatatccttaatgttgtccatgatcatatcatcccctccctcttgaaaaggatttgacctcaaatccggttcatctgcaataaaaggtaccaagtcagaaacattaaagctagaactcacattatacttaccttgcaaatcgagttgataggcattgtcgttgatccgtttgattatcttgaatggaccgtctattcttggcatgagtttggacttcctttgagctcgaaacctctcctttcttaaatgaatccacaccatatctccaacttcgaagatttgttctcgtctccctttattagcttgcttagcatagagtttggtcttttcttctatgtttctcctcgcattctcatggatatgttgcactagctcagccttctttttaccatcaatacttactctttcactcaaaggcaaagggattagatccaaaggtgagatggggttgaaccaataaacaatttgaaaaggagaatacttagaagcagaatgcacgacatgattatatgcaaattcaatatgtggtaagcattcttcccaagttttaatgttctttttaatcaatgcacgcaagagagtacctaaggttctattaaccacttcagtttgaccatcagtttgcggatgacatgtagtagagaataacagcttagttcctaacttagaccacaatgttctccaaaagtaactaagaaacttagtatctctatccgaaactatggacctaggcatcccatgcaaacgaactatctctttaaagaatagattagctacatgcaatgcatcatcagttttatgacaagcaatgaaatgagccatcttagaaaatctatcaaccacaacaaagatagaatcatttcctgttctagtcctaggcaatcccatcacaaaatccattgaaatatcattccagggatgagtaggaataggtaaaggagtatacaaaccgatgggctgaaccttagatttggcttgcttacaagtattacatctcccacaaattctttcaacatcacgtttcatgtgcggccaatggaaatgttctttcatgacttccaacgtcttagcaatgccaaagtgtcccattagtccacctccatgaacttccctgacaaatagatctcgtagagagcagttaggaacacacaaacggttctcatagaagagaaacacgtcttgtctaaaatagtgaccgaaagcaaacttttcacaagctttataaacctcgtgaaaatcatggtcagtttcataaagttcttttatttgttcaaaacccataagcttaacattaagagtagagagtagggtgtacctccgggataatgcatcagcgactacattatccttatcttttttgtacttgatgacgtagggaaatgtctcaataaactcaaaccacctcgcatgtctcttgttaagtttctgttgtcccttcaagtgttttagcgattcatgatcagtgtgaatgacgaactccttagaccataggtagtgttgccacgtttggagagctcggaccaaggcgtacagctccttgtcataggttgggtattttagcgtagctcctccaagtttctcactgaaaaaggcaataggcttttgatcttgcattagaacagctccaatacctatacctgatgcatcacactcaatctcaaacgttttaagaaagtcaggcaatatcaaaacaggtgcattggttagtttatccttgagagactgaaatgcttcttcttgtgcttcctcctatttgaatcctacatcctttttgataacctcggtgagtggtgcggcaatggtactaaagtccttgacaaatctcctataaaatccagcaaggccatgaaaactccttacttctcccacagtctttggactcggccaatctttaataaccttaactttctcttcgtcaaccttaactccatctgcactcacaacaaagccaaaaaacacaagattatccgtgcaaaaggtgcatttctttaggttggcatagagttcctcttttctaaggacattcaaaacagaatctaaatgctctatatgctctctcaagcttttgctgtaaactaagatgtcatcaaagtaaactacaacaaatatcccaatgaatgctcttagaacatgattcatcaacctcatgaatgtactaggtgcattagttaatccaaatggcatgactagccactcatataacccatgtttagttttaaatgcagttttccattcatctccctctctcatcctaatacttaaccgttatattgttgatggctctgcaatcaacacacattctccagctgccatccgcacttacatacttttc

SEQ ID NO: 6927 - DNA, 3000 bp, Unknown
  misc_feature (1)..( 3000): cDNA_ID_1816181_gDNA_ID_1621116_Annot_ID_171872 3000 nt of promoter + ATG
aagactttaggatgacctttgatgtcaaagacgcgatgaagaagcctaccatagaagggcaactcttttggatcaaagaaatggatcagttagccgatgaattactggaagagctggcggaagaagatcatcttaacagtgctttaaccaaaagtggtgaagatgggtttctgcatttggaaacatttggataccaaaagctgttagactccaataaagcgatggaagaatcagaaccctttgaggaattgaatgaaccagcaacagaggtaatggtaatgagcgaagaagggtcaactcgagttcaacctgcactctcgaggacatactcgaccagccactcgaccttgtctgccaacgaatctggggagccgatcattccaacttcagatgactggtctgaacttaaggcaccgaaggttgatctcaaaccacttcctaaaggtctaaggtacgcattccttggtccaaactctacttaccctgtgatcattaatgccgagttaaatagtgatgaagtgaacctactattatctgagcttagaaagtataggagagcgattggttattcattatccgacattaagggaatttcacctagtttatgcaaccaaaggatctctttacatgtttaggataggagcttcaagatctcaactgatcactcgaccccctggtcgagtggaggacatcactactttaccacatcactcgaccccgaggtcgagcgtcttcatcccatcacctgaccaccactcgatcgcatcactcgaccccgaggtcgagtgtcttcacattcattgccagaccactactcgacctcgtcactctacctggaagtcgagtatcaccatcaccaccactcgactgcatactcgatggcaagcttcagggccttcttcattccgcactcaaccagacactcgagcacaaggaagaaaagaagactccagctattcactcgacctcccactcgaccacatgggtcgagtacagttcttaatccgtcccaatacttcgtcgttttaagtattagggtttcgtaatatttggctataagtagcatgtacttcacattttcgcagagaagttttttatctagttttatttccgcagaccttgtgttctagaccttttgtaatccagatttctctttatctattcagtattcagtattcagcttttgttcttgatttcggttactgttgttcattctgttatcatcctgtacactgttgttatcatgttttcaacttgttcaacgtttatgctttcgtttatgatgtctgagtagtgaatagatttctgaggatgggttagagtagtgtagaattctcagtatgctaggtgattgagtattgattgatagatcccttctggattagttgttcttaatgcctattgctttctgatcaactggaatttgagcccagacatttctgcgcccaaaaagtgttcgatgaaatgtctgaaccactaattccagagattcgtgaccgtgtactaaggtattggttgcagggagcgttttggctttaacttgttgattcgtaatgcctgttaggttagctctcgtcaatggtgattgagtctaggactaggttaacttgagagtctctgttgcggtgacacttagatttggttaatgaacttgttgtctagggttaatttattgagcatgtcaatcacctgtaaactgagaaaacgaaactactcaattaccccatcctcgggaattctttatctgattgaattctttgtttactctactgttgtttactgcatcttgttatctgtcgcttaatttctacaattctttcttgttactcgacctcatactcgaccacccagttgtctggcaacagactgtgcagtcgagtatctgtgttttattttctgtgtgttactcgacctgtcactcgatcacacccagtgctctacaaagagctgtgttggtctgtgttggtcgagtgttttactatttctgtttgattttctgttttctgcatgttcacttaggactgctagaacacaccaaaacatgttattacttggcttgacttagtgacttctgatcacatcttgattgttagcatcacacccatttggattgacaacctaaaatactacaacgacatgattggtgttttgggataattgactaaaaacctattatcatatttttagagcagtttcccatacccttagcctagccttatttcaagccaaagatcatttgtgtgattgtgaggtctttttcgattgagcttggtataacttgttaggtatgagccgacaagagcagtctttcatgtagacctagcccacgctctttgggttagctaggactaggtggagacttgtatttgggattgggattgtgtatggattgaatgagaatgagaatgagaatgaaaagaaaaggaaaaaaaagagtaagagtttagagttctaagggggatacaaaagtgttaagtctagtaaagggtttggaattcaaagaagttaggcatagtgattcaaagaaaagggtaaatcgccctatgtgctaagattagaagaaaagccttaagtttgtcaaagtataaaaccaaacccgctagactcttaaattgattcaaagagaaccccttagaacttgaaccaaaaagagagaagaatgagaaaaagggtagagttaggacatctatgggactgggatcattttctgagctatcatactatatcattgggtagatgggagtctgttcttgtatgtatccattggcttttacctttagcattctactgaagctcaatcttttctctgagagtcccctgttactcgactaaaccattagagggaccatttttgtctcttagcctaagccgaaaccaagtgagttcataaccattgcattgcttgatccactattcgtgcttaatgaatgttaaagggaattggttgatgtgaatgcttgaatagattaaggcaagttgttaggttgcattgtgacgagt

SEQ ID NO: 6928 - DNA, 3000 bp, Unknown; identical to SEQ ID NO: 6927
  misc_feature (1)..( 3000): cDNA_ID_1816181_gDNA_ID_1621116_Annot_ID_56198 3000 nt of promoter + ATG

SEQ ID NO: 6929 - DNA, 3000 bp, Unknown; identical to SEQ ID NO: 6926
  misc_feature (1)..( 3000): cDNA_ID_1816177_gDNA_ID_1621116_Annot_ID_56200 3000 nt of promoter + ATG

SEQ ID NO: 6930 - DNA, 3000 bp, Unknown
  misc_feature (1)..( 3000): cDNA_ID_1816153_gDNA_ID_1621116_Annot_ID_56207 3000 nt of promoter + ATG
gatgttttgaaaatttccaaatatggcccagaactttcccttattttcaaagaaggctcaaacatttttaggacttatatattgatttttatggtcattgtttagaccaaactcttcttatctcttttattcttgggagcaaaaccatgtggagactccgtttagagaagattcttctaaactcttttctcttcttaatttcatcattgatttcttattcaatcatgttttgttcttctatgatcatgcttgagtagttctcttgttaggtttaggaattctcattagggatttggataaattagtagatcgaaaaccatattaggatattataattagaattcttcatcttagattgttcttaatgctagttttagagtaactaactagaacttgattttaggttattcggtatgcccaccataggtatctattactggaactatcttagatgagcctagtatttagatgcgtgctagcgtccattacttaggtgaacttatcaaacctgattataatgcttgcttagttttagggatttacaagagagttgggatcaatactattaagcatagtgagtttcgcgaaacaccaccggttactttatattagtgattggtgttctagaatggttcaataataatcctaatttactgctagatctactattccgatacttcctgagaatttctctaaacccgacatcttaatcatctgaatctacaaccaatctctttattgctttcttgtcttttactcttataatattttatgtttagctttattcaaaactgttaatctactgtgtgatccgagaactttgtggaattcgatccttaagtgctataacaacctctttatttgagagagtagtcattagggtaatttgactcatatcagtgattactcagacatgataatagaaacacaaatcataatctgaatagtttccattgatgaattaagaataatagcaaaggagttcagaatcctctctcaaaggattggattcttctctcaaaatgtataacaaactataaaaacaaaacttaggtctaacaatgaccaaataattaggtatattcgtgactaaaaacgtgcaaggactactttgcaaataaggaagacttcagggcttctcaaagacttggtagaaaacgagaattcccttggcagcaataagggtgtcgatcgatataggtgtggtgtcgatcgacaccagcttctgaaaaacgttattcaagatcttcattgctgaaaagcttccaaaattccttattgtgctccatagttcccagaagtgtaagtgtacctgaaatgactcaaaacatacgaaaaagagtagaaagattctaaaaaccattctgaaactatgttagaaatcagtaaaaaccaggacatatcatgcttttccatggaaattcaagaaagcatggatagaaagatacaattctcttgcagagaagcagcttgatgagatggaagcggtgatgcctctgatagaagttctcaaacttatcatggatcctcacaaagatgtgagaaattcattctggaaaggatcaagttgtatcaagattcagatgatgaatgtgatgctaatccgtctagagctactgttaagaggagcgttcaagaaaagctggaagatcccggatctttcactctaccattttccattgggcaattggctttcatcaattgtctatgtgatttaggagcttcagtaagcttaatgccactctctgtggcaaggaagctagaattcactcagtacaagccttgcgacctggcttcgatccttgctgataggtcttcaagaaaacccttcggcctgctaaaatatctgccggtaatgattaatggagtggaaatgcctacggatttcgttgtgcttgagatggaagcagaacctaaggatcctctaatcctgggaagacctttcttagcctaagtgggagcgatgatagatgtcaaagatgggagaataaatctcaaccttgggaagcacatcaagctgcagtgtgacatcaacgaaacttcgtaaaggtcaactgtagaagaaaagatcatagctcaacctcagccttcgaatttgatcacccgatcaagcaaaacctctgcacctaacttgtgagaactcagaaagaaatctgatgagcaagaagaaaccatagagaagctagcccacacggttgaagaacttaagagtaaactgaatcagatgcaagaagaagctcaaccaaacgcgggattgatactatcccaagaaaaaagtttacttcacgatggtctgaggagatagattatccaccagaagataaagaggcctatttcgaggaaagaagaattgagtattctgctgcacaactctcaagagaggatgctgaatatgatgatgagatcagagaggactacgcagatcctctctattactcattttcttcctaatgagtgtgaggagtcaagatagagattttaaacaagctcacttgggaggaagtcccatgtttatctttgtacatatttttaatattccttgttgtttttgatgcattttgttagtgttttcaggagataagtatgaagagctgagggaaatggatttaggctttgacggaacagcaatacacttgaccaccaagcaatcaaagacactcaaccttgttttggctactccatgccaggaaattactcgaccgccttgctggccgcaatagaagaagagagcagtatattcgaccacaccctacagggatcgaaaaaaatgtgatcgagtacagttgatgcaatcatgacttccacatgtcaggaattcactcgagggcggtgctggctgccacgaaggagaagagatcgagcctcctctggacatgccctcgaggagatatgacgagcctgagccaagtcagcacaggcctaagcctagtgagcaatgagtctcacaagtccctgcgaggcattcatcattcgagcctcgggagcacgggagaaagaaga

SEQ ID NO: 6931 - DNA, 3000 bp, Unknown
  misc_feature (1)..( 3000): cDNA_ID_1816248_gDNA_ID_1621117_Annot_ID_56208 3000 nt of promoter + ATG
aggtaatatattaggattatgaaattgattagaagcctcataatgttgatgacattgtaggaaaaaaagaagaagttgtaaatgggacatgcacacattttacatatttccatttattagtgtcaaatctccttcataggcttcttcttgatggccattttgatgaaacaaaccgtttctcctttttctggcagcttggatacataatttataggcgggttttacgctattattcaggagaggaagatggattaggtgaggctttgattaacttctttttatctatgattcgcgcttaactttttcttttgtttaaatcttaaatcgtttgatctaaaaaaacagatatgaggaaggcattatcaagagatgtagagaaaaagtctgtgattcctctcaagagacctatcacacctgatgaattagagtatgattaagaccctaacttggttcacaattgttatctgcattaaaaatttctccaagagcctttagatgatgttactattcctgttgtttcgtatttgaactattatgtttcgttttcttccacacaaatttataattagttttgattaaactttaatctatatatacatttttggaggagatttttgaagataatgttgaagatttgagccataattcaacaattaattcaaatggttgggttttacccggtttaactctgttcggatcctggataacatgtttaattctgttctgatattggataacattaatttttggaaaagttacctaaaaactaataattaaaaacgaaaattaatgatttaatataaacaatatctctaaactaaccatatttcttatttaccttaaccaatttcctaaaatatttctacctaatttaaacataaatatataattcttctttcatttttatttgatcttatactttatttattttgaatttatataaaatatatatagttaataaaatattatatttttttctgaatatgatgtaattcaaagttttttaaacggacatatattattcaacctatgaagaaataatatgtgtacaatgtcccacatcgcttagaaaaattggacaatggttcagacccatattataaaaggaccaaaatgattctgattacgaatgagcaggaagcttgatttatcaagcgtccaaaattaaaatagttatctgattttactcggatttattattttaaagaattgaaactttaaaatgtttcaagaaattataaatattataactttatcaaaagttaaatattataattttaaaaactttttataaagtttatctttaaattaaaatggtttgtttcctagggttatttattttaaaaaattgaaactttaaaaagtttaaaaaattataaattaaattttacaagaaatttaaacaatataaaagatattaatacgggacgatatattgcgagagaaatcttagatataacactcaaaattcaatgatgaagtttgggtcaatattaatcttttttgaagtttctaattttataaatatttgaaatttataataaaatgacaaatttgtgtttaatttcacgggacggggttatatggtgtgacaggtttgagtggataataacatgggatagtatgctatggagaaaaacatataatgacaatcataatgtaattatataatcttaaacactaaacaaaattaacaatattaaaaaaaaaaaacttaaaactttaatttttttaaaacacattttgattcttttataagaaatttaaatattataaatatttaaactttatactacgggtgaaattttagaattgactgtttgggttgataagaatttgcgatagaactaggagttaaaatgacaattaaaatataattatacaattaaatactaccacgagcgaaatcctagaattgacgagtttgaatcgatattaatatgggatggtgtactacgggtgatattttagaattgactggtttgggttgataataatttgcgatagaattaggagtgaaatcctagaatgacaattaaaatataattatacaattaaatactaccacgggtgaaatcctagaattgacgggcttgattcgatattaatatgggatggtgtactacgggtgatattttagaattgactggtttgggttgataataatttgcgatagaattaggagtgaaatcttagaatgacaattaaaatataattatacaattaaatactaccacgggtgaaattttagaattgacgggtttgattcgatattaatatgggatgatgtactacgggtgaaatccgagaaacaacaatcaaaatacaattatacaatattaaacatttaacaaaataaacaaatacaacttaaaactttaaaatttgagttataaaatttcttctcgcggtgaattatacatttaaatcaaacaatagcattaaatttattaaatcattctaaaaaatattcaattattttttatttaataaaaatatagaacccttagttgacatagttgataagtcaagtgttttactcttctaatcttaagcacttaccttaatgagacacacatattaggattggttgcacaaggccgattcttatacactgtatacccattacaacgaagcccattatcaaccctatatagcaatctgcaagacaaagatccaaacatattgaataacaagtaacttttttttttctcggtccaacttcatctggaataacaagcaacttttatctgatgtatatactttcagtgaccatctaccttagttggtttgaaaagaaaatagttgtttattcgttcatgttcttagaagttctaaattttgatcatctcttatttgaaagctcaactaaaatagctatgatatcattccctgatgctacgtactaggtttttaaattcatacacacacaaatctataattaaaacttgttaaattcatacacacaaaggacaaatcttcttcgtattaaaaaagatg

SEQ ID NO: 6932 - DNA, 3000 bp, Unknown; identical to SEQ ID NO: 6931
  misc_feature (1)..( 3000): cDNA_ID_3049347_gDNA_ID_1621117_Annot_ID_171906 3000 nt of promoter + ATG

SEQ ID NO: 6933 - DNA, 3000 bp, Unknown
  misc_feature (1)..( 3000): cDNA_ID_2992669_gDNA_ID_1621117_Annot_ID_56210 3000 nt of promoter + ATG
aaagtttcaattctttaaaataataaatccgagtaaaatcagataactattttaattttggacgcttgataaatcaagcttcctgctcattcgtaatcagaatcattttggtccttttataatatgggtctgaaccattgtccaatttttctaagcgatgtgggacattgtacacatattatttcttcataggttgaataatatatgtccgtttaaaaaactttgaattacatcatattcagaaaaaaatataatattttattaactatatatattttatataaattcaaaataaataaagtataagatcaaataaaaatgaaagaagaattatatatttatgtttaaattaggtagaaatattttaggaaattggttaaggtaaataagaaatatggttagtttagagatattgtttatattaaatcattaattttcgtttttaattattagtttttaggtaacttttccaaaaattaatgttatccaatatcagaacagaattaaacatgttatccaggatccgaacagagttaaaccgggtaaaacccaaccatttgaattaattgttgaattatggctcaaatcttcaacattatcttcaaaaatctcctccaaaaatgtatatatagattaaagtttaatcaaaactaattataaatttgtgtggaagaaaacgaaacataatagttcaaatacgaaacaacaggaatagtaacatcatctaaaggctcttggagaaatttttaatgcagataacaattgtgaaccaagttagggtcttaatcatactctaattcatcaggtgtgataggtctcttgagaggaatcacagactttttctctacatctcttgataatgccttcctcatatctgtttttttagatcaaacgatttaagatttaaacaaaagaaaaagttaagcgcgaatcatagataaaaagaagttaatcaaagcctcacctaatccatcttcctctcctgaataatagcgtaaaacccgcctataaattatgtatccaagctgccagaaaaaggagaaacggtttgtttcatcaaaatggccatcaagaagaagcctatgaaggagatttgacactaataaatggaaatatgtaaaatgtgtgcatgtcccatttacaacttcttctttttttcctacaatgtcatcaacattatgaggcttctaatcaatttcataatcctaatatattaccttttcatacatcttgatggctggtgtgttggaagctcttacaaaaagatccacaaagtaggctttatcactgcaatcaataaccacaagtataataatcattagaagaccagaaattaccagataatatataaaatcaatgaggagaaattcaagattttcttcctttgaaacaatctaaatatatcggttttcaaataaataaatggtccactcgaaagccaatatcaatatattaaggctttcatattttatatcataacgatccatatcaaagagaacactaaaacttgagatgctttgtaattgttaagtcttacatcttatcacttatatcttccagaaggttcatcagtttctttgcaagttgctgcctgcggtattctggagagacagtgacggctgtcacatgaccatgccaagattcaccctgtccttcaactttacccataactgaaaccatgtagaatcttagttagacacatgcttttaaaattatatttataagaacaagttttacatatgtcacttacgttggattctcaagaatatcaaccataacatttcaactatacaaaagaacatttcagtgacactgcttaattttcaaatgtgttaatatccaaaagcttagttttactctcagttctttcaatggtttcactatacttccaaggtctctttccaaactataccacgaaaagggagaaaaacaggtatagtaatagggcaccacgagaacagaacgtcaataatgaagcatatatcgtacttgaagaaaataaagaaagataaagccttgtataaatcacatttcgaaccaatccaataaggtatagcatcattatactacaaacactgaaagacagaaaaatttgagccttgatataactcataactcattctctggacatttagaagttagcacaaacaatcttaagccatgcttcctatgcatcttctaccccatatcaagatttctaaaaccgctaactacagagactaggactaatacaagcagaatttgtttaaacacttatacatcctggtttgtgttaatcagttttcaaacagagtcactcttcctggttttaacaacattcaagctatctccatctgataaccaaaaaaaatcaatagtggcttttacactaacagtttatcatctaagtttcaaccctaaaagtaaacataatctccacgaatttcaaattcctaaaccaacgaagacataaagaaatcaaaacgaagagaacaagaggattacttactataacccatgacacgattgccgggaccttcagcaacatgaaaatagtcaggccatctcgctaaataggtcatgtagaaggacatattgaactgtttcacgaaacaaaattcgaacaaaaatcaacaaaatcgccatagcaaaacaaagcaataatcagacgaaaccagataataagaagaagaaacacgagattactgtttcagtgaggtggtccagattcacggaagtgaatcggagaaggtcattgcagctgaatctacgtatcgtcgtcatctcttctttttctcaaatcccttcgagcttcgtcagattctctggaaaaagaaagaggagacaacaacaaagcaatatacatggcccagttagaaaattaataaagcccatttatatttgggcctataacactgatgacgtcatgtaaaagatgatcaaatttcattatctcccgtcgtcgcgaccttctcagacaacagaaccaaatcctcggcggcgattgaagaaacctttccg

SEQ ID NO: 6934 - DNA, 3000 bp, Unknown
  misc_feature (1)..( 3000): cDNA_ID_1816228_gDNA_ID_1621117_Annot_ID_56216 3000 nt of promoter + ATG
tgagaggaagaaatcccaaaagcaccttttcgtaaatcatctgggtaaacaggagctcggataggtggataactgtcaggcgtttgtggatcaaaaccatcggtggaagaaccgagaggtgactcctcaccaaacatcatagggtcttggtttgggaaggcttcagccatagtctgctgagcatgacgaataacaccggtggcatgatcgtatctttcagccaaagcacgatatgctcgataaaactcctcaaccagtttcataagctcaggccgcttcttgtaatacatttccgctcgcctagcaaaagagtcagcatcttcttcaataaccttgatcatttgcttgactttactatccatatctgtcaacaaaaatagaaacatgtaagcagatcgcatacaaagtatcttgcatgacacaaaactgaactaaaagtaaaagaaatttgtcacgatggaaatgacctttcccgtgggaaatacaagggacgttaaaacaagaaaatcacatacctgtaagattctcctgaagccatttcgagttcttggggcttatgtgactatcccaccaccaagaatagcgtttagagttaccattcacaacagcagtcatttttcccggcaaaatcacacaaaaattatgaggatattagaacactccggaaccaagtctctctcaaagccaagtacaccaaattcctctgtaaaaaaatcctaacttaagaagacgaagaagaagaagaaaatagcaagggttaagctttgataataatgaacaagttcaacagtcatataaaagacaaatacagaagaaaacaaaagaaaaaatagaaacgaattaccactaagtcaatgaaggccaaattcgagacaaaaataattaactagccaaatccagtagtaacctggtcagaaaacatatcaaacaattcattacagatgaaaaattggatcagcataaatcaattcgtctttggaaattagacgagaatcctagggaagaatagcaagtgaaaccacatgatcttacaggaattagaggttatagtaacgcacttagtcggaaactgaaattagctacacaggttaaatctacaaagcgaatctaacactagtgaaatcaggtccaaaagcaagaattctgtgaggcttaccggaaataatacttgtactacaaaaatcagaaatcttcggatcagctttcgctttcacttcttcttcttcttcttcttctcatctcattttcttcatctagatctctctctctttctctctccaggcgtttttcagctctggttcctactttttacgttgtgaagaagaagaattgtttaggtaagcttttaaatgacgatattaccctccagtacagttctcacagatgttctgtttcattattttaattcacttgttgcgtgactttgcctccttgggatcgccttcgctgccaacttaaaaaaaaacacgactttcatgtccgaaagaaaatattcttttatcgaactacaactaaatacagtatgacattttatttgatttctttatttttcaatctgatacttcccatttacccctgatttatatcaagtctgcagttcactttttctttttctatacctgtctgctcaagaactaaaatgattttgtaattttaatacattttattatccggaataacaaagtattaaatcacgaaagatgatttaaaaaaaaaaaaaaagtattaaatactagtaatgataaggaggctgacaagagataagtgacaaagacagggaggtcttggacggtgagctctcggtccactttcgtcaccctttgtttttttctccacgttcgcttttagattcgacttattgcgatcttgcgtgtcaaactttttccaatcatctaaaagttgagtcggagttagagttacgttgttcataacttttatttaaactttgcaagaaaaaagtatatacgatatatggtggcttatcgttatgtatcatttcattcagctttctaaaatttataatttaaaaaataatattataattaagattaaaaacgataaattcaaatttaattgactgagaatgtttttggtgtttggtatgcattacttgtttgacacaacttatatatcatcctttatttgttactcaaacgaagattcacgaaacggacaaataaactatccacctattgggaacaaataggttgtctgacttttaagcatcacaaacggttatatactattttacataaacgtttcgagtgtgttaagattcatttaattgtaaactaaataatcaacagcgtgacttcaaatcaaattgtcttcttataagtttattactaacatatattcttgttcagtttgttgccaatattgaattaattaaaaggattgtgtatattttccttaattgtattgttttttttgtcggttatagaaatgcaaaacaaaaagaaatgaatagaggagtcaacactcaacagccactacctaacaaacacttttaatagttccagctcgtatcgtttttcatgcctccaaagattaattatgattttcaaaatcatttataactatccctccacatgtctttaatagtcaaattgatcttatattaaaaactctatatagtaagaccaagtgaattttaaaattacatcaatgcgatttatatggatgattcaaaagtatttatatttcaaaactgaaacaaggccttgcagcctttcttaatgcttcgtgcagataggcccattaataaaacaataaagcccatacttgtaaaatcaggtaaagacgcaacgcaagcggcacatcagacacatatccattccgaccaaaccatgataaagtatatgccacgtcactattcatcgtcgattagtttttacgaaattgaccaacataccctcgttgtttggttttatctacaacgcagttgctgagtcacacttgttttcttcactcggaaaattcgaaaatcgagatcaaatg

SEQ ID NO: 6935 - DNA, 3000 bp, Unknown
  misc_feature (1)..( 3000): cDNA_ID_2026922_gDNA_ID_1621117_Annot_ID_56217 3000 nt of promoter + ATG
catgtcctcagaaactattcaagagagaataaaataacaacttgtgcaaagaagaagcaagtcgtaataggaggcctgtaatggtaccttttatcacccatgtctctaatagcagatgctggaggtccaatgaatgttagacccgaatcctcacagagttgggcaaagtcagaactttctgacaagaacccatagccagggtgtattgcctagttatataattcaaagaagacatcagctacaagaacacgattattctttttcggggatcaaaactcatacctgtgcaccagtccgagccgctgcctccatgatagtcacaccgctgaggtaactaagtctagccgagggcgggccaatccgtaccgcttcgtctgcagatttcacatggagcgaatctctatcagcgtcactgtaaaccgcaacggtctgaatccctaaacgcttcgccgttctcatgatccggcaagcaatctcgcctctgttcgccaccaaaatcttctcaatacattgctccttaggcttcatcgatgcggagccggaaatatatctcacgagcatcgagtgatttttccgacgaacattccgtcgaagtgcccacaccgtcatcatcgacatttgatctcgattttcgaattttccgagtgaagaaaacaagtgtgactcagcaactgcgttgtagataaaaccaaacaacgagggtatgttggtcaatttcgtaaaaactaatcgacgatgaatagtgacgtggcatatactttatcatggtttggtcggaatggatatgtgtctgatgtgccgcttgcgttgcgtctttacctgattttacaagtatgggctttattgttttattaatgggcctatctgcacgaagcattaagaaaggctgcaaggccttgtttcagttttgaaatataaatacttttgaatcatccatataaatcgcattgatgtaattttaaaattcacttggtcttactatatagagtttttaatataagatcaatttgactattaaagacatgtggagggatagttataaatgattttgaaaatcataattaatctttggaggcatgaaaaacgatacgagctggaactattaaaagtgtttgttaggtagtggctgttgagtgttgactcctctattcatttctttttgttttgcatttctataaccgacaaaaaaaacaatacaattaaggaaaatatacacaatccttttaattaattcaatattggcaacaaactgaacaagaatatatgttagtaataaacttataagaagacaatttgatttgaagtcacgctgttgattatttagtttacaattaaatgaatcttaacacactcgaaacgtttatgtaaaatagtatataaccgtttgtgatgcttaaaagtcagacaacctatttgttcccaataggtggatagtttatttgtccgtttcgtgaatcttcgtttgagtaacaaataaaggatgatatataagttgtgtcaaacaagtaatgcataccaaacaccaaaaacattctcagtcaattaaatttgaatttatcgtttttaatcttaattataatattattttttaaattataaattttagaaagctgaatgaaatgatacataacgataagccaccatatatcgtatatacttttttcttgcaaagtttaaataaaagttatgaacaacgtaactctaactccgactcaacttttagatgattggaaaaagtttgacacgcaagatcgcaataagtcgaatctaaaagcgaacgtggagaaaaaaacaaagggtgacgaaagtggaccgagagctcaccgtccaagacctccctgtctttgtcacttatctcttgtcagcctccttatcattactagtatttaatactttttttttttttttaaatcatctttcgtgatttaatactttgttattccggataataaaatgtattaaaattacaaaatcattttagttcttgagcagacaggtatagaaaaagaaaaagtgaactgcagacttgatataaatcaggggtaaatgggaagtatcagattgaaaaataaagaaatcaaataaaatgtcatactgtatttagttgtagttcgataaaagaatattttctttcggacatgaaagtcgtgtttttttttaagttggcagcgaaggcgatcccaaggaggcaaagtcacgcaacaagtgaattaaaataatgaaacagaacatctgtgagaactgtactggagggtaatatcgtcatttaaaagcttacctaaacaattcttcttcttcacaacgtaaaaagtaggaaccagagctgaaaaacgcctggagagagaaagagagagagatctagatgaagaaaatgagatgagaagaagaagaagaagaagaagtgaaagcgaaagctgatccgaagatttctgatttttgtagtacaagtattatttccggtaagcctcacagaattcttgcttttggacctgatttcactagtgttagattcgctttgtagatttaacctgtgtagctaatttcagtttccgactaagtgcgttactataacctctaattcctgtaagatcatgtggtttcacttgctattcttccctaggattctcgtctaatttccaaagacgaattgatttatgctgatccaatttttcatctgtaatgaattgtttgatatgttttctgaccaggttactactggatttggctagttaattatttttgtctcgaatttggccttcattgacttagtggtaattcgtttctattttttcttttgttttcttctgtatttgtcttttatatgactgttgaacttgttcattattatcaaagcttaacccttgctattttcttcttcttcttcgtcttcttaagttaggatttttttacagaggaatttggtgtacttggctttgagagagacttggttccggagtgttctaatatcctcataatttttgtgtgattttgccgggaaaa

SEQ ID NO: 6936 - DNA, 3000 bp, Unknown
  misc_feature (1)..( 3000): cDNA_ID_1816224_gDNA_ID_1621117_Annot_ID_56218 3000 nt of promoter + ATG
agtcttttttttttaagatcaaattgagctgatacaatgtgacgaattagggtttcgtagcaagaagaaagatctaagatccaaaattttcaatttgtgaacccctaaacacttgaaaaaatccccttttttccttccacgagaatgagcaaaaacccaaattttgacaaaaagggaagaaaaagagcttagcggaaaaacgcgattttgtttttgttttttttttccttaaagaaaatttaaattaaatcaaatctccttctctctcttttttcttccttctttctttgttttttttttctgttctggtgttgttgacggcgtcgtctctctccgcgccttgtttctcgctcaagtcgtctcactttctctctctaaaacacgatactgtttgtttctccttcgtaaattatttccaattttattactttattagcccttgaaattttgttttatactattttataaccactacaatatttcattaccattttgacccccaaattagtcttgcatcgcaaaccccacagctaaattttgtagaccaaaacaatggcgcatataaaattatcaactagggacacttgaatacctttgacatttcgttcgtgaaagtaacaaaggttgactctatcttctctatcattttatataattgtttgagttagtttatatacaaatggtcaaataaggatgttttagagatacacattaggatattattttgttttattatatttttaataaaataaattccatatggatagggaaaaaaaaacattgctacttttgaatttttacaatagacttaactcatacttaaaattaaagttaatttttacctttcttagtttttacttttaagcctatacatagtatatatatttacctcatgccaaaataataaataaatttatttagcatacagtttaggttctttttgtaatacgagagccaacacaacataaaaagaatttgtaaaccatatttgtgaaaagttattatctagtgagcacaatatcaacagaaattagaaaaattaacggcaatatggatctggatgaaggttttgaaacaaacgagacctaaattataattattaagaaaaacaagggccaatgtagtttctaggttcacgtctacaatcgcaagtagagcccacgggacgagaatgccacgtgttcgtataggtttgctgaacgattgcgaaacgtgatcccctctttgcaaaatttaaacactttttggaccaaaacttttatgtctttttaataataatacgaaacatatttaaattcatatttaatttatatatgaatttcttaaaaatataactatgtcattgtgagaaaattctaacatatatttatctatctatcaaaatgcagaggtcgcgtatgttaaacaaacaataaaccttatagtactggtggtaaatagtcatcaaccaaaagtagaacatctgatgataaagagacgatatattttcagaaaaaaattaaagatagaacttggtccgaattctgcttctaaaacaattttccaacaattattatagtatttcatttgtctgattcatgtcatatctaaacaccaatatttgtatgtgacgactataatcatttaggactaagttctaatataggagttgccaacaaaaaaattccaatggacctttaaaggttaaaagtctaaaaacatgtcctatgtttttgtgaaagcccacttttaagtaattcttttacaaatgaggcccacataaaccttatatatgacgacgagacagtaacacaaattttgattaactagaaatgtcatcaacacctcaaacatatggttttgtatatattaagataatttattatcacacctcaaacattattactatttaataattatcataaataaagaaatatatatatgttactttgttagtagttatgcatatttcatttaagttattatatttcttttatactgctaatacaatatatcacatatattatttcttattatcttaaaaattgtttgataatttcaaacatgtgtcacactaatgtaaaatgctaacatatattaaatttttgttacatactatatgttaagatatttaatttcaaacacctcaaaccacacattattacgctaacagttaatccataagtaacaaaaaaaaaaatgaaaggagaaaaaaagtataaatacggatagaggagctaaatttgtatgctcagaacttagaatatttaggggaaaagttgtcgcaacaaattccacaacaacataaaagcaatgatggaagtttatattattgtcgtcgtacgtgtaagcaaccgttagtttggttgttatcgttggtactgtattttgttgtagcatctgttatcgttgtctcgtgacggagaataattaaactcgaacagtcactaccggcgatgacacatggaaatagataaagactgttgctttcgtgatcatcacggtgggggttgtgatgaacatggcggaggatgcggaggatataacgattctgcttacattatgaatttatgatgctatagtttatgtccttcgttaaaaaataataatgtagtggaagctttggtatattcttataagagaatacttgaaacctttggagtcatctagagacttccggtctttacggttaacaacaaacttaacgtttcatcttcacacgcggccacgtggtgccttcaagaacgttctactttactctctccgcaactgcttttataacttgaaaaatcctaattttctctcaaccttcaaatctcaaatttctcgcattttctcgggaaaatcgtaacgaaacaaacaaaataacttctcctccggcgaaacaaattccggtacttgttaattctcgatcgtctccttctctggttcgtagtacaacctaggaatagaattttcccgcgtttttttccccattcgtctgatcagaatccattgcttcgatttacagtttttagaatg

SEQ ID NO: 6937 - DNA, 3000 bp, Unknown
  misc_feature (1)..( 3000): cDNA_ID_1816220_gDNA_ID_1621117_Annot_ID_56219 3000 nt of promoter + ATG
gagagtaaagtagaacgttcttgaaggcaccacgtggccgcgtgtgaagatgaaacgttaagtttgttgttaaccgtaaagaccggaagtctctagatgactccaaaggtttcaagtattctcttataagaatataccaaagcttccactacattattattttttaacgaaggacataaactatagcatcataaattcataatgtaagcagaatcgttatatcctccgcatcctccgccatgttcatcacaacccccaccgtgatgatcacgaaagcaacagtctttatctatttccatgtgtcatcgccggtagtgactgttcgagtttaattattctccgtcacgagacaacgataacagatgctacaacaaaatacagtaccaacgataacaaccaaactaacggttgcttacacgtacgacgacaataatataaacttccatcattgcttttatgttgttgtggaatttgttgcgacaacttttcccctaaatattctaagttctgagcatacaaatttagctcctctatccgtatttatactttttttctcctttcatttttttttttgttacttatggattaactgttagcgtaataatgtgtggtttgaggtgtttgaaattaaatatcttaacatatagtatgtaacaaaaatttaatatatgttagcattttacattagtgtgacacatgtttgaaattatcaaacaatttttaagataataagaaataatatatgtgatatattgtattagcagtataaaagaaatataataacttaaatgaaatatgcataactactaacaaagtaacatatatatatttctttatttatgataattattaaatagtaataatgtttgaggtgtgataataaattatcttaatatatacaaaaccatatgtttgaggtgttgatgacatttctagttaatcaaaatttgtgttactgtctcgtcgtcatatataaggtttatgtgggcctcatttgtaaaagaattacttaaaagtgggctttcacaaaaacataggacatgtttttagacttttaacctttaaaggtccattggaatttttttgttggcaactcctatattagaacttagtcctaaatgattatagtcgtcacatacaaatattggtgtttagatatgacatgaatcagacaaatgaaatactataataattgttggaaaattgttttagaagcagaattcggaccaagttctatctttaatttttttctgaaaatatatcgtctctttatcatcagatgttctacttttggttgatgactatttaccaccagtactataaggtttattgtttgtttaacatacgcgacctctgcattttgatagatagataaatatatgttagaattttctcacaatgacatagttatatttttaagaaattcatatataaattaaatatgaatttaaatatgtttcgtattattattaaaaagacataaaagttttggtccaaaaagtgtttaaattttgcaaagaggggatcacgtttcgcaatcgttcagcaaacctatacgaacacgtggcattctcgtcccgtgggctctacttgcgattgtagacgtgaacctagaaactacattggcccttgtttttcttaataattataatttaggtctcgtttgtttcaaaaccttcatccagatccatattgccgttaatttttctaatttctgttgatattgtgctcactagataataacttttcacaaatatggtttacaaattctttttatgttgtgttggctctcgtattacaaaaagaacctaaactgtatgctaaataaatttatttattattttggcatgaggtaaatatatatactatgtataggcttaaaagtaaaaactaagaaaggtaaaaattaactttaattttaagtatgagttaagtctattgtaaaaattcaaaagtagcaatgtttttttttccctatccatatggaatttattttattaaaaatataataaaacaaaataatatcctaatgtgtatctctaaaacatccttatttgaccatttgtatataaactaactcaaacaattatataaaatgatagagaagatagagtcaacctttgttactttcacgaacgaaatgtcaaaggtattcaagtgtccctagttgataattttatatgcgccattgttttggtctacaaaatttagctgtggggtttgcgatgcaagactaatttgggggtcaaaatggtaatgaaatattgtagtggttataaaatagtataaaacaaaatttcaagggctaataaagtaataaaattggaaataatttacgaaggagaaacaaacagtatcgtgttttagagagagaaagtgagacgacttgagcgagaaacaaggcgcggagagagacgacgccgtcaacaacaccagaacagaaaaaaaaaacaaagaaagaaggaagaaaaaagagagagaaggagatttgatttaatttaaattttctttaaggaaaaaaaaaacaaaaacaaaatcgcgtttttccgctaagctctttttcttccctttttgtcaaaatttgggtttttgctcattctcgtggaaggaaaaaaggggattttttcaagtgtttaggggttcacaaattgaaaattttggatcttagatctttcttcttgctacgaaaccctaattcgtcacattgtatcagctcaatttgatcttaaaaaaaaaagactatttttttcctttttgggtctccttcttctttctttctttaatttgaattcctcaatttaaggattgtgtgttttgtttccttcttgtgaacgaatgagagttttgggttgatcgcatttttagggttgattttatttatctgatcgacgactcggatctgaggtgggtcgtgtttggagaccgagtcagggtctggtctggtctggtgaggtcgtcgtcttcatcggatgaaagtttctgggatcgaaaagcacaacg

SEQ ID NO: 6938 - DNA, 3000 bp, Unknown
  misc_feature (1)..( 3000): cDNA_ID_1816216_gDNA_ID_1621117_Annot_ID_56220 3000 nt of promoter + ATG
gcataaaatattcttcaatgttctcattagctttattacaatagtcctcaattgtgatgattctccatgggagggaagcaagcaaaaagtgaaagacactaatgccaaaaaacacacaatcatgtactctttgattactctttattgccagattaaacaattataatcttttattaagattggaagtttggtttaagagagtaggtggtggtggggaccaaggatttacaccactaaatccttctggctgttttaaataatctttctacaaacttttaatgatagcattttcaaaaaccagagaatagaaaactgaaaatgacttgggtgtttaccttaacttggagcctgagaaactttacataatcgacaatctcgtcgatcatagcagccctatctgtctgcaaaaggaaagcaaaagaaacagatgtgaataccgcagtttctatatgccaatcacaaaacttttctctcattgacaactctagttttctccctacttttaaaatctctttcaagctctcttcgcgacatgaaaacagtagctgaagctctagagaaaaagataccaaccttgttaacggtaggtacaagttcctgcaacgacctgatccgttctgctattctttcccttcggagctgttgcaaagcaaatacattcaggttaggtcttaccgttcttagtaagtaagaactaatcgaactttctcaaccaaaagctataattaaagctttgatcaaacattatcacataaaaatcgaaaaaagagaccagaagataaaaaaagtgtatcaaacatcttaccctctcagcgatgctatgtggatcggtagcttgacctcgcctagccctaactctaggccgaatagtagactgttgatgcggcattggtggagctggctgtgacattggctgcccatggaaaatcttcaacaaaacacaaaacaatgccgtaataacattaagaaaagcttaaaaaccgcttctcacaagaacggtcgccactagagtagttatagcaacaattcaaactatgacggaattatccacatgagaaaagaaactaaagagcaaattttcttacaatataatttggacataaaagaacactcttttatactaaagtttcttgcaaaactaattttagtgttatgactttaaaacacatcaaaatcttcaacttgggtttcttcaaaaacatcaaatctcaccaatctgagccaaaaactctcggtaactatcaaatttagacctaagctgggttttctcaaaaacgacaccattttgaaaccctaaagatttgaatttcactttattttctcgagaacacaaaagaaaaagacaaagtgaagattctgaagagaaacttacaggtttcatagaggaacatcgattatcaagaacatcgtcttggaaacgtttaccagtttcatcaggtttaagaaagccatgtcctttcccttgatcgagacttaatcccaacggaaacatctgattatgaaaccctacaggtccacctcctccaatggcacccatatgattatgattcccttcgttgcctgaaccaagctgaagcatcatcggaggtggacccacgccgccgattccagagagaccagaacctgaagaaccggagaagttggaaagcccgaggatctgctcgaagaaatcgtcggtaggagatggatcggagatgctatcatgtgggatgttgttgttattagccatgaaggaaacgagtaaaggtttgaaattttcgactcagtggagctgggtgagttaaaagatagcgagttagagaagagaagtcgaagaacaactttccatgcgaagaatcttgtgtggagttgttaggtgagagaatgatgatgcttaagctaatgaggacgaagagacacagacgagaaaggatatgacaaaaagactcactttatgctctctttcattttatttttgttaaaaggaccttactttgtggtttattttcggttttgcccttgttcttatataccttccagaaacttgaagtgggctttatttgttttgaagtgggctttttgttttgactttcttcaatttattcatatcaaattaagaaaaaggtcttttaccaaactctttttagtagaatgttaaaaaccaatataactttctttttttaaaatatataaatgatatgggaaaaattctacgcattgtcggggtcgtcgtcatctcgttagtggtagaaaataagatttttttaaaaaaatctgtctttgtcgttttttccgaaatttagcactcatggagtaaagtttctaatatccaatataaaaatgacacgtttcattttgccatatggtattacaacttgcttctccttagtgctgaaccgttgtccgactcgttttccattttgagagacaagggtttttctatttttcacaaaacaaaattgtggcatttctgaatataatacgagtaaaaaatatgtcagcagaaatgggcttggatcgattttgatttgttggattccataattcaatcttgggcttccaatccataagaaaaaagcttggtgtatttttttttacaaattagaagaaagttttttcctctttaatcagtactcttctccttacccattaatggcaaatgcaaactaaatttcagttgacccgtcaaacaataagttaattttttgccacgtggccatatttctcaccggacaaagcctccaataacctcggcgactttagatggtgaataatcgacgaacaacaaagaaactacattgacgaaacaaacaaacaaaaacatagaagaagaagaagaagaaacaaaacaaaactaaacaagaaacagaggagaaaaaaggaaacgacgaggaaaaacaaaaacaaaataaaaacaagcctcgttcttcccttttctctcttcaaatcttttcttttacatattttcttttcttttttttgtctttaatacaaatttactaactaatcagaataaaaatg

SEQ ID NO: 6939 - DNA, 3000 bp, Unknown
  misc_feature (1)..( 3000): cDNA_ID_1816212_gDNA_ID_1621117_Annot_ID_56221 3000 nt of promoter + ATG
tcctgcagaaccaaatgccatactgctcgcgcttccgctggctccataagccgtcgatgttttcacggcagcgtttacagcgccgtgctgatacattccgttaagcaacaacatatcaaagcctcctccgagttctgacttttgtcctgacaagtttgtagctgtttgcaccaaagctgtttcccaatccgcagaatcatccttaaacgcttcccatcctggaccagactctgaaccagaaccgcttgcgtatggcccgtcaaataaagccaacgctaagctatctccagcttgtcctgcttcaccgccgtttgtattcccaagatcaagtaaatcacccatttcttcttgtttcttctctatgatcacttcttcctttgcttcttcctcaggttttacgtcatcttcttcttttggtggaggttcaggtaaggcctttattgcgttcatatcttcttgctcttcatttacttcctctgttctcgcttcatcatcatcttcatcggcttcagatttaacagattttgattgcttggtgtgttctaaagcagatttgtctcttataaactcatccatgagatcaagcttcttctgtgtgatcttctctatctctggatactcagaagaccgtgcgatccccatgttcttacaccaagagtagaactgatcgagctcttcgaattgtttcgagacccggcagaaaatgtcatagaccttgatcgaatcaggaatatctaactccatgaatcgttcaatcaaaatccccattatctctgttacatcgtaatatatctgaaaactctccttcactatcggatacagagccacaatcacaactctgttgttcctcgcattacctgttaacaaaataacattggtccttatataaatttttatccaagaaacaaacacacacagagaaagaaatcttgagacgcaagttattacctgttgggcgacaagccaagaaacggtcaagaagttgctgcaaatgttggattctgatgaaaatctgctctgttttcatctcggcgatcggttgtgacctgaccacgatagccgtggagagatctgccgcagcttgatcctgttcttcttcgtcagcttctcctccaacgcagtaaactccacgtttcccgtgtctcgcttgcatcctcaaaaattgcaatgaaaaaaaaaaaaaaaccgcatatcttagatatcattcaaattacataaataacttgaaatcccgaatcggaacctggatcaagcacaagaactcttacctgaaatcaagcctttcgtcaaggtacaatgcgtaagtcctgacaaacgcagagtagtcccaagaattagacctcgaaacatccctaaaatcagacatattgagaagccttgttccacggcgagtggcgaagaagatctcttgctcgtaggcttgatctccttctcctaagagcctttggatcaaaatcaaggttttgagggcaacggtccagcatttggttttattaaggcgtctcgaaagcgtgctaacgcaagcgttgatgtaactgcgtgagtaagaagttaggctaagaatctctctaatgtatttctcttctgctggaaactcttcgtgacgagtggctttgacgatggctacgtcaagttcagataaagaagcgcttcgaccattgactttggctagaccgacgctggtttggtcctttacggctcctatggctcgtttaaacttactcgaacccatttttattctgattagttagtaaatttgtattaaagacaaaaaaaagaaaagaaaatatgtaaaagaaaagatttgaagagagaaaagggaagaacgaggcttgtttttattttgtttttgtttttcctcgtcgtttccttttttctcctctgtttcttgtttagttttgttttgtttcttcttcttcttcttctatgtttttgtttgtttgtttcgtcaatgtagtttctttgttgttcgtcgattattcaccatctaaagtcgccgaggttattggaggctttgtccggtgagaaatatggccacgtggcaaaaaattaacttattgtttgacgggtcaactgaaatttagtttgcatttgccattaatgggtaaggagaagagtactgattaaagaggaaaaaactttcttctaatttgtaaaaaaaaatacaccaagcttttttcttatggattggaagcccaagattgaattatggaatccaacaaatcaaaatcgatccaagcccatttctgctgacatattttttactcgtattatattcagaaatgccacaattttgttttgtgaaaaatagaaaaacccttgtctctcaaaatggaaaacgagtcggacaacggttcagcactaaggagaagcaagttgtaataccatatggcaaaatgaaacgtgtcatttttatattggatattagaaactttactccatgagtgctaaatttcggaaaaaacgacaaagacagatttttttaaaaaaatcttattttctaccactaacgagatgacgacgaccccgacaatgcgtagaatttttcccatatcatttatatattttaaaaaaagaaagttatattggtttttaacattctactaaaaagagtttggtaaaagacctttttcttaatttgatatgaataaattgaagaaagtcaaaacaaaaagcccacttcaaaacaaataaagcccacttcaagtttctggaaggtatataagaacaagggcaaaaccgaaaataaaccacaaagtaaggtccttttaacaaaaataaaatgaaagagagcataaagtgagtctttttgtcatatcctttctcgtctgtgtctcttcgtcctcattagcttaagcatcatcattctctcacctaacaactccacacaagattcttcgcatggaaagttgttcttcgacttctcttctctaactcgctatcttttaactcacccagctccactgagtcgaaaatttcaaacctttactcgtttccttc

SEQ ID NO: 6940 - DNA, 3000 bp, Unknown
  misc_feature (1)..( 3000): cDNA_ID_1816200_gDNA_ID_1621117_Annot_ID_171929 3000 nt of promoter + ATG
aaaggacacaccaactcggtcacccagtgaaccatcctgagagcccagatttttaaaaacatcgaaatggcgaagcaaaagtatcgttggtgaatacctgtgacaatgaaaacaaggcattcaccaagttgtggataaaaatactattccagaaagaagagctcaatatttacaaaaatgtaagtaattttgcacttcattaaaacacggccatttactgaatgcagttcataatgaatacatgaaagaaaagaaaaaaagtataccattttaccttcgtgccatattaaaagtctgggccaaagcagtagatgttttcctctcagatgatgctaataaactgtggcagctaaattcaactacatgcagccccaacctcctagcaacatatttaacaacagttctcttcccacacccttaaacaagcaatagatacaaaaagctattagcacgtgattcagttatatgcatagagcataaaggtcgaattatgacttctcccaaattaccataatctgtaaacacagaaacatagtctcttactagtctttccttaacattgtttccagaaatagtttaacccttaagaacatatatgaaagtgaagtattttcttgatgaaaccgaagcaaatgtacctggtataccatgcagtaaaacagcaaccctgagttttgaggcgagtgctgatgggcagagaggtggtgaaagcaccgatgccaaaatatttactgtctcctcctgcaatggcataggaacctttgatctatacaccagtaaatctggtggaagaccagaagatacagttcctccaaggacaagggcggtttgggagtgattcactcgaagaaacctctcattagaaggttccatcgcaataacctgagcagatgaactaagttttcagtaagctctggccaaaatgagcatttttctggcaaaaatgaaaaccaatattaccttaaaatatatatagtcgtcgctttcggagcacaacctttgactacatggattacaaatgcttgaaccacaattccagtcaatgtaaatgcgaaatatatcgcctcttgatagctgtctatcagttccaaaatacttctgtaatgcagaatctattaacccttgtcgctcttcagcttcaaatgacgaattgactttcagggatgggatggtaccacactctgggattttaacaaaagaaactctcagatgtgatgcatagcctggaacttgggacacgggttccaaatccaaaccaatcttcgacccatcttctgcagattttccgataaactcctcatcacacttagcttcaaaatacttctctaagaccccgttccctcgatgtacgagggatttcaggcaagatatgtgcaagctaagattaaaagctaacattggggacaagtaagcaacctcttgatctaataactgctggcccatcaaatcataagtgggaaagacaagcatcgtatgaagagagtccgaaacaggtacttgagtgagagatgcatcttccagcgtcgtcttgggaggatcaagtacaacaacttgcgcaaccctttgaatgcctatctcaatgttcttgacaacaaccttgcattttaaaaactcaattgttaacatcaaaagcaacaaaattatccagaaaagatccagctttgttgactgaacaagatgagaaggacataccaaagaaccagagttgatagatagtctcttaagcaattgagtggagagtccaaccaatgcagagtcatctaaagaatccaattttgcatcggaaacattttctccgtccttccgccaccggagaatgcccgcagacaacctagcgttccctcgtaacaagtcaccgtctttattcagaactcggtcgccgtcggcagagctgggttgtgacgaattgagcactgaacggagagtacttcttgtggatgatagaaccagaggattccgtctctccaccattgcaacggaatcaaatcgaattcccaattactcaaaactcaaaagagtcagaaaaaaagtataaaaacaaaaaccctaattttccatcagaagattcaagttccgttgaagaaaattcacagtacgcgaaccgatgaagactgaagaggatcagatggtactggccccacttaaggattttttcgtatttatattattatattttctgattattgtttttttgtactatttgttcctcctaatcaaagttttactataatctgtttagtaaaattaacctggaatcataattagcataaatattttaaaaaaacaaattataggtttcgaggggctcgagaattttcgatcagcctaacatcattacataaacagccttaaagctaaaatataaatctcaatcggtgtaatcactactgcttttctatttttctaaccaaagcaagtaaaggccctaattttgtttggaccactaacaaatatacattttcaaaaactaaaagcatggagtgatcttaaagcttggtctcaccaaaattattcacttgacacttaatatattctttatgtatcgttatatttagaaaactttgcattagatatatattccatataaattttagtggacaaagcagtatgtagaaaaattaaatgattgatcatcttaaacttttgttaaattgaaacgaaaattgaaaaacaagagagtagacataatgatgatagaagaaacctcacttatcccataataatggatggaaatgcctcaaaggatactagctagcaacttaatgtaggtacattgcatgtattgtttgttattccttaagttaattttatctgtgataataatgatctcagctttacacgtacttagcagattaattttaaccaaatcttttttctctacctttttacatccattaactacgtacattcactgccattacaaccgcaagagctcttcttcttcttcttcttcttcttcttcttctccttcttcttctgctacgagaatagagagagatg

SEQ ID NO: 6941 - DNA, 3000 bp, Unknown
  misc_feature (1)..( 3000): cDNA_ID_2990433_gDNA_ID_1621117_Annot_ID_171926 3000 nt of promoter + ATG
taatttatatagaaatttttgtttgggaaaaattattgataggccctcttattttacatgatttgcttgttaaacccaatattattttaaattaatgctttatacttttgattttgttcagattggtacataatctaacctccatatgagatcaaattaataagacaaccctttgttaataacaaattgcaattcttgagttgattaatttggagaatttggatttttaacaagcatgtgctttatttctaagttcaataaaaaaatattcggtgtaatattctcataaaaaccattgggggttttaatatttatttttcgggttcttgggactagtttgcaaaatagattattgaaatgacagaacgagagaaaagtagaggaacattggagcctatcagaaagagaaccagaatcaacaaagattctatctcgttttcgattttgaagaaattcattttaattattataagaaaagcttctcaaaatacattagaatgacggtatataactatatatataccacgaaagagccgccattgtcgtttaagccgtacaagctggagaagatcacgaggaagatgctcccctttgtacgttcggattattcgaccgacaaataaaagagaaccaatctatatactctcccaacaatcgcaatctataatattagggtttatcttacgcacgttaatatatgctattagcatgtaattatgcgacttaactgataatggaaacttaattttgattgattctgtactcagatttgagtcgtgtatatatttccctcaatatgtactctattaaacgtaactacacataatttagttatattgacgctttcaatacgagtttgaaagattaggctctagctaattaataaagaatttcatgtgaatttcatttttaatttttcaaatatatatatgagaagtagtcaattccgacattctgtattcgttcacgtgatttttttgttcagcgctctacgtaattaactaattcacaacttcatcggtccagtttgatatcaatcacaacatatattctttagagtattacaaaaggataatgattcatacatgtacttgctgcttcaagttgatgtattttaaagattctatctttcacatatagctcccatatgaactttgccctgaaaatggtttggttcataacttcatatatctgtactttgccctaaaactggtttgatacataaccttcatatatgtacttctcaagtttttagactttatttcgcacgatcatctaacgtacgatgatttaggacttcgaatctagagattttattattagttacgagatttttatttttattttccttattaggagagttacgaaataactaaataactcgagtgtgtttcgtacacaccaatttgtagtttttttttttttcgtacacacatttgttcatagtgttcttgaaacacaatatatatattttccaacaagagacgattttggaaaccaacaatatcagcgtaactaacagatctttcattggctgaattgatacctagaagattcttttctttttttcggttaataaaaaggtaaattgcattttcattgaacaaaggtgtagaaatgcgaatgcactatgtttttcacgagacaaattatgaacaaaatatatgaacaaaaagtccaaaccagatagtgaggaacgtgtcgtcggtagaagaaggtctcgttcgatccaacacttacgagaacatattcgatatgaagaagagattacaattggacccaacttgcttttgtttttcggaaatttatttctatttttatttatctcaagtctcatgtaatgtatcaaataatatccaaagaaattatgcgtatatgaggagaaaatgaaaaagcactggtaagctgtttaatattccaataaggcaagaacatgataggccacgtatctctctctcatataaatgagtttacacatttattcatatttgaattcgatgcttttgtatggatgaataataatcttcttttttcccctagttcattcgtatatatttcaagatccttgtggtatataaagtaaattggctccatcaaaactcgaaaggccgcttatttacacgaggtcacacatgaattttgatctaattagccaattatgtttttgtgtgggtgaatgagttttatgatgaagctctatcttaatccataaatagaatcaatacatcaattctattttgtaacacaatttttatataaatcagtaagtcttttgcaggtaaattactattaaaaatcggaagacaaaaattacttaaacaatgcagttttgtagaaacacatgtatggggaaaaaaacaattcatgtcaactcgcagaaatatataagccatattgtttcgattaacaaattcacttttagatttttctcacatatatatgatttgattctgttaaattattattattcaaacattatactagcaaagcggtttggcgaatgatgttaacatctgatgcacatccatagaactagaagtgctgattatgttagaagattctactagtcagttcctattttgccttttgtcgcgtctataattgtgatggattatatatgatagtaaagtgtcgtcatgtaaagcatttggcaattgcatcaataatttattgtatacacatgcacacgggaattatatatgtagagagttaaatcaatcgagctggccagatcctggcccagtgggccgctagtaagtttttggactcattgcaggtgaaaaattcaacgcctagaagcggtagtcaacggccttttaaagcgaaggagcatgacacgtgtctttcgtcattatccggcgatgccaaactcttcttcctcgatcgagagaacacagcaccgcttcgcttaaatcggacatttgagtcggaactgttgtgatttcaaattttcatttcttgagtgataatttcagttattgatctgtgcgttcatcaatg

SEQ ID NO: 6942 - DNA, 3000 bp, Unknown; identical to SEQ ID NO: 6938
  misc_feature (1)..( 3000): cDNA_ID_1816216_gDNA_ID_1621117_Annot_ID_171924 3000 nt of promoter + ATG

SEQ ID NO: 6943 - DNA, 3000 bp, Unknown; identical to SEQ ID NO: 6937
  misc_feature (1)..( 3000): cDNA_ID_3049323_gDNA_ID_1621117_Annot_ID_171921 3000 nt of promoter + ATG

SEQ ID NO: 6944 - DNA, 3000 bp, Unknown; identical to SEQ ID NO: 6936
  misc_feature (1)..( 3000): cDNA_ID_3049328_gDNA_ID_1621117_Annot_ID_171918 3000 nt of promoter + ATG

SEQ ID NO: 6945 - DNA, 3000 bp, Unknown; identical to SEQ ID NO: 6935
  misc_feature (1)..( 3000): cDNA_ID_2026922_gDNA_ID_1621117_Annot_ID_171917 3000 nt of promoter + ATG

SEQ ID NO: 6946 - DNA, 3000 bp, Unknown; identical to SEQ ID NO: 6934
  misc_feature (1)..( 3000): cDNA_ID_3049332_gDNA_ID_1621117_Annot_ID_171916 3000 nt of promoter + ATG

SEQ ID NO: 6947 - DNA, 3000 bp, Unknown
  misc_feature (1)..( 3000): cDNA_ID_1019105_gDNA_ID_1621117_Annot_ID_171912 3000 nt of promoter + ATG
ggtggagtgaaacaggctgaagcttagttttcctcaatgaaaacattgaaagatcttatttttcttcgtcaattcgttaagaccaatttgaagctcctcggctggtatgaggatttgatgaaaactgtttcccagtttcatttagacatttcgtcgaacacttggtgcgtgaactgaaccagcaagctttgagcactaacgtgagattaggagaaaaagacaaaagctttcttgagaagacgatgggtctttgaccgttgatgatggcaggtgcgaagaaccactaaaccctaatcactattcactaatcactatagccagaagaaacttgtaaattttgcttaaccgaaaaatatcaagtgttgacaaaaagagaaaagaaaaataagtaaagtaataatattctaaggaatttgtcaaattgagtatcactatatcatatactgtcatagtaaatggtccttatctagcaaaaaatttattgttagttagaaccaaaccatgcttatttataacatttcataagattaagctttttactaatcttgggttggtttcattaaattctatgatagcatttttggtttaacaatacgcataaacataagttaatccaaaatgcaatgcatagtttcagatttatcaatagggttggtttcattaaattctatatagtaacatttttggtaacaaatacgaataaacacacaatttcatccaaaacctaatgcaaaaattcaggtttatccataatccttcttaacaaattagccccctcaaacctttctataagtatatcaccacatgactactaataatatcccatacaaaatcccaaagcttaaagataaccccaaatgattcttgcaatattagcccttgtaatagccacctttctatacggtggagccaccacggtccaagctggatgcagagacactctgaccagcctttccccttgtctttattacctcaacggtggctcatcgtcaccttcttggagttgttgtcgtcaattttccacggtggttcaatcttcaccggaatgtttgtgctcagtggttaatagcaacgaaagctcattttatgggttcaaatttaaccggactttggctctcaatctccctaccgcttgcaatgttcaaactccatcacctagcctgtgtaacagtaagaaacttaattattctaacaatatacacttcaaaaatatatgtttgttgatccaaattttttgtggtttataatataatggtatagccggtggtaacgtaccaaccacgttgccggcgaatactcctgtaggttcacctcgaagtgctccttcaccgtcaggtaccacgtctccggcgaatacaccatcaggttcaccacaaatacctcaatacacacttcataatatatttatcttcttaagaattgtgcttttggaaaatagactgttagaaaacaataaaattcatattttgtgtttaatcgatgaaacttgtaaacaggatcgaagaagtttccattgagtaatgaaagctcgtccaagagcaatgtgatcatcttgtctttcgtatccatagctctggtcctcgctataatatgaatctcagatcttctttttattttacttttttttaaccaatttatgtctccatgtaatatttgtagtgcttcctcaatgtatttgaaattcataaaattcatattgtacgttgaaagtctttcatacttgtttttttttttttttttcctctgaaactgcagttttattgaaataataatacataacatcacacccaattacataaacatcaaagacaactttcaacgaagcccaaacaagaggcccaagaaaggataaactcaagaacgtgtctcatcgatggggataagttgaggatacgtgtttatttcacatccttcaccgcatgcagagattccaaatccagtgaatcagaatacgttgccggaactacaaccgattacgaattcttctttttttctcactgataatgataataatggattacagaacaaatcaatctactaatctcaaatgattgatagattcataagaaaaccatcgtaatcatgaaataagatgtagagattgaagtaatccacccttgataatataagtgaatctctgaatatttttataagcagcaaaagggaatcgaaatttaagatggaaatgagtttttaaccaaaccttagacgcaggtaacataagctgtcgtaaatccgatggatccaacgtttttgtgtggaagtgaaaaccacacatcgttagaaaaccatcagatccaaaagcaaaatctcaatggatgaagtatattatggcaaaagagaatagatttggcgcatacgaaactctcccgattcaacaatcctagaagccatagtcttcaacatcaagcttttgtatgagcaaaaggacatggcaatagaaagccatgttaacggtaagaacacagcaacgaaaaagctgtgttgacggcaagaacacgacaacggagaagtcgtgttgacggctaactaacagcagaaccggacttcatccgagtataaactccggtaaaaacaaaccggacggagataacatataagaacctctctctctgaaaaatattagggagagaagagagagaagtcaaccaaccaatcgagtttcgaatttcctacttggttataaagattaaaacatacgaaaacagaatctttattggaataaatcgaaagcaggaaatatagtccaatgggcccataaggtttcgacttccggcccaactatggttgaaacccagtcttacgagtagtaccaaacaaacactaacacgctcaatttcttaactctaatgagaaaacgattagactaacatccaaacaatccaaatacataaaatcgattttgttgtttgtgcttttgtggcggctttttttcacgaactgctttaaaccctaaaaactccaacctttgttctctgtgtaacaacaacaacaacaatg

SEQ ID NO: 6948 - DNA, 3000 bp, Unknown; identical to SEQ ID NO: 6940
  misc_feature (1)..( 3000): cDNA_ID_1816200_gDNA_ID_1621117_Annot_ID_56224 3000 nt of promoter + ATG

SEQ ID NO: 6949 - DNA, 3000 bp, Unknown
  misc_feature (1)..( 3000): cDNA_ID_1816196_gDNA_ID_1621117_Annot_ID_56225 3000 nt of promoter + ATG
gatagagtccatcactgatgatacgagcatgatctggtaagagttctgctaaagctatgaactttgaggttgtgagattcggatccatagctatctcagctagatagttatccattagcttcgatactttcaagatagagctctgttttggagacccggggctgtcaaaatcgtagatcatctctgtttcatctctaaattgaagatgatgatgttcttcttcttcgtcgtcttcatcgaggttcaagaatatagagaagattctcaagattgaatcgatgtcgtacatggtgttgtttgttccattgagatttatcggaatcaagacatcttcgaggatggcttggtctaattgcagaccgattcttcgttctagatctgatctacatgatcctgtagaagcagatgacgatgttgcgatgaccattttgagaagacttgaaagaaacgccattggaacagagcttcttcttccttgtgtaggaagtaacctcacaattgtttccacaatcaatcgctgtttcttcttaccttctgaatcaagaaccctttctttctccagtttcggatcgcgaacaatgagcccttgaagagacttattcgtgtagcttatcagaatcttgctgatcacgtcttgtattaaccctttagacttaaccgcagagataaccctctgaaagaaatcgaggttcagaacagctagtgacttcccccaccagtctaatggagtttgtggttcgatatttgtacccgagaacgaataatcgagctttaaaagacccgatgttagctgttctttgcaggcattgttggcaacagctatgattaaccgattaaccaagttgagatcttcagagactgggattaaggtttcgcaatgatgtagaacgatgatggaattcaaaatactggggaagattgtctctttcaagaaatgttctgttttggaagcgagattctcctctgagaaatcctctgtcatctctagataatgagatgcacaacggagcttagctatattaagaaggttgatttcaatgttgattccataacagaacttagctgcgagctcaaaagcctctgatcctccaggagcatttgagagacaaacattcgatatttttggatccgcgagaagctttcggatttttccactccgagacacaagaggaaactgagaaatcaaaacaacaagtaacagttgaaaactttcaatacaactcaagaacagaggatactctgttttaatgttcttaaatttgctttttaccttatgaagacagaaactcgaagatccaacttgaactgtcagatcactagagacatcggatatcggcctgcgaaaacagataaaaaaaccatcaagattaagcgaaaggatttctgaattatgaatcaaaagatcttttgtgtacttgaattccatgactccgacgctaagattctaggataacgaaacagtgaatttatcgccaaaaatagtgttatttattcctggttttagagacatttaaagattcacaggggacatgtaaaagattatgtctacatcaagctttttcaaatgaagacagaactagaaccagatgaagtgttaatgtacggatatgttccacatatatacaaaataagatggagaaattattggtttcgatgaacagtaagactttaacaagaaatgacttttggctacagattcacatcacatacaagattgctataattcttcagaaagaacaaattttttagtctttttctgacagttttatcaaaaacaaagatgtgaatgcaaaaaaaaaaacaagaatcgttgttactaaatttggatttcatttggtgataatagttacaaaactggtttttgaaacagagtatatattaccattcagaggcatgtctgatggttgaattcagacgaaaccctctctttcctgtgaaagctggcttcaattctccgactgtaacaagtcccatctctctctattctcgtagcagaagaagaaggagaagaagaagaagaagaagaagaagaagaagagctcttgcggttgtaatggcagtgaatgtacgtagttaatggatgtaaaaaggtagagaaaaaagatttggttaaaattaatctgctaagtacgtgtaaagctgagatcattattatcacagataaaattaacttaaggaataacaaacaatacatgcaatgtacctacattaagttgctagctagtatcctttgaggcatttccatccattattatgggataagtgaggtttcttctatcatcattatgtctactctcttgtttttcaattttcgtttcaatttaacaaaagtttaagatgatcaatcatttaatttttctacatactgctttgtccactaaaatttatatggaatatatatctaatgcaaagttttctaaatataacgatacataaagaatatattaagtgtcaagtgaataattttggtgagaccaagctttaagatcactccatgcttttagtttttgaaaatgtatatttgttagtggtccaaacaaaattagggcctttacttgctttggttagaaaaatagaaaagcagtagtgattacaccgattgagatttatattttagctttaaggctgtttatgtaatgatgttaggctgatcgaaaattctcgagcccctcgaaacctataatttgtttttttaaaatatttatgctaattatgattccaggttaattttactaaacagattatagtaaaactttgattaggaggaacaaatagtacaaaaaaacaataatcagaaaatataataatataaatacgaaaaaatccttaagtggggccagtaccatctgatcctcttcagtcttcatcggttcgcgtactgtgaattttcttcaacggaacttgaatcttctgatggaaaattagggtttttgtttttatactttttttctgactcttttgagttttgagtaattgggaattcgatttgattccgttgca

SEQ ID NO: 6950 - DNA, 3000 bp, Unknown
  misc_feature (1)..( 3000): cDNA_ID_2993716_gDNA_ID_1621118_Annot_ID_56226 3000 nt of promoter + ATG
caaaaaaatattttaattgtgtatgaagtaacacgtggcagtaagaaaaattgtttgaacttcgaaccgaagtttcagtttttttttttcctttccgaaggatctttctggaatattatagccgacataattgacaacatagtaacatacatatacgtaattacgttctatactacacctaaataatcgtaattaatttttagatttgtttttgtcaatcctattacattatcattagagatgttcaggatttgaatgcttacggcggtaaaaacggtctataattgatccgcgacgattttcttttatttttcttaatctataatcttacatactctaatttataaatggtaaatcaaaaacggtctaattcgcaaacggatttatccgtctcaaccaccgtaaccattcacatcctcaaatctaatcctattattatggtgatgaactgatgatcgtaaaactattaattatgcaacataaaggtccacttaactactaaacaaaatccaatattactgctgtagattcaaatgctcgatgtcgatatataccaaaccaaacaatcataagtttaaccaactatatatagcttagtaaaaaacgagggcctatattgttgaaacaagtactcttacgattgtttcgatggctcatggctatattgaaaaaagaaatgagaagttttaaagacatacaattttggacggaggtagggaaaattcgaaaatgcaaaataaacacaaaacttggtgaaactcggaagacagcagaatttataagaagaaccttctcctgctcgtgtccatttcaggctgtaatgaaatacaaaaaaaaaacacatcagaaaataaaattaaaaatcatcaaaaactctaaagaacagcaatgaagctgctcgtgtccatttctggtgattttaccttatgaacccattcaaattctccacctttggtgtcaaaagttccatgctgtagagtaactagcttaagcgtgaatcgaggaccgcattcctaaaaatccaaagtttaatgatacaaacattgataatgttgattactttttgattcaacatggtcaaaactgacctgaagacgaggttttattgtctcttcttttcctttatcactcttgctttcctttgtctcaaatatgtaactggatagtgttgaaatttgttcaataaaaagttttattggagaatggagcaaaagcaactcgaagaagaaaaggtgaagttatgtaccggtgatgtctgaaaaatataaagtcacgctggttgtggaatgttacaactctcctaccacggaaattaggatccggagggaagagtgattgaaaaaatctgaaaaaaggaaaaatctaacatcagcaagaaattcaaagagaccataaaaccaagtcaacaacactatgaaaactatacctcccaacacgattccctaaacgcgttgtaaagttattcaaaaccagttctggttgatggcttgtaggatttccgtgattctgcagttacatttaacatccaattcagtgatcactaatctacactcgatgtagagaagagtaatggttagcttacataccttaatatccttccttagaacaagatttgacaatttgaaatgagcagtaggaccatttggcaaaccgatgataagaagcgcatctacatatgaaatagcaaaagcttgaaacaaagcatatacagtagagagcacaaaacttgaaactcagtgaaaactaaccaggttctctacgatttgtatgaacaacaataagagatgtaaaatctttcttcgttgcgtattctacaatctgcagaaccatatctaacaaggttatatagttgcaaaaagactaactttatagagaaacaaggaagctatgaaacttataacaacaccttcttcaaatcataggttcctctcttttgataatgagagtttggtatcaccgaaagcaactcagatattaaagcaggtcctctctgcaatccaacaacattacttgaatcagaaaaccacaaacaaatctgtagaatctcttatgaaacaatggtaccaaaaaaaaaagacttacagtggaattgaaacgacatgttgtgagcaagaccttaggtgcaatctcacgtctcagaactggattaaactcatcagcatcaatatccgcaaacaactacaaactcaattacactaaattagcaacacgacaatgaattgaattcaaaaattgagatgaatcaaactttaaatctaaacatacttcttcatcgtcaggtctgcaaacagtttcatcagattctcttgtattctcaatcgtcttcggaatcatcttttgtggaggctacaaacgaataacacacaccaaacttaatatctcaaattcataaacacctttaaaaaatccctaaaaaagcttctccagatcgttacctcttctccaagctctaaagctcgtttctcagcagcatcacgagctctaatcttcttctgcttctccaatttcttctcatgcttctgcttcgcatacacttttgatctcttatctttgttcttaatcatcgaaggaagtatcacattcctcttctcacccccactgaaagtagactttccacgaacatcagattccatttcctcaccatcaccatcatctttcttcctcttgaaccccatttttacgacggacggcgaacgaagcctctctctctttaatcgatgaaaacggcaaagctgagaatgaagacgacggagactaacttagggtttatcgactcaaaattgaaaaacctatacaaatgggcctatgcttgggcccatctttaagcataggcctatctatctttataatattcgttaaaccgtcgccgtatcagtctattaacgggcttaattctgggccttgaagaaacattatactatggcgtttcattataacgatattaaacgacgccgtgtatgttagctatcaatttcgtttctcagtggtcactatgcgatg

SEQ ID NO: 6951 - DNA, 3000 bp, Unknown
  misc_feature (1)..( 3000): cDNA_ID_1816288_gDNA_ID_1621118_Annot_ID_56228 3000 nt of promoter + ATG
tcagctttgccgttttcatcgattaaagagagagaggcttcgttcgccgtccgtcgtaaaaatggggttcaagaggaagaaagatgatggtgatggtgaggaaatggaatctgatgttcgtggaaagtctactttcagtgggggtgagaagaggaatgtgatacttccttcgatgattaagaacaaagataagagatcaaaagtgtatgcgaagcagaagcatgagaagaaattggagaagcagaagaagattagagctcgtgatgctgctgagaaacgagctttagagcttggagaagaggtaacgatctggagaagcttttttagggattttttaaaggtgtttatgaatttgagatattaagtttggtgtgtgttattcgtttgtagcctccacaaaagatgattccgaagacgattgagaatacaagagaatctgatgaaactgtttgcagacctgacgatgaagaagtatgtttagatttaaagtttgattcatctcaatttttgaattcaattcattgtcgtgttgctaatttagtgtaattgagtttgtagttgtttgcggatattgatgctgatgagtttaatccagttctgagacgtgagattgcacctaaggtcttgctcacaacatgtcgtttcaattccactgtaagtcttttttttttggtaccattgtttcataagagattctacagatttgtttgtggttttctgattcaagtaatgttgttggattgcagagaggacctgctttaatatctgagttgctttcggtgataccaaactctcattatcaaaagagaggaacctatgatttgaagaaggtgttgttataagtttcatagcttccttgtttctctataaagttagtctttttgcaactatataaccttgttagatatggttctgcagattgtagaatacgcaacgaagaaagattttacatctcttattgttgttcatacaaatcgtagagaacctggttagttttcactgagtttcaagttttgtgctctctactgtatatgctttgtttcaagcttttgctatttcatatgtagatgcgcttcttatcatcggtttgccaaatggtcctactgctcatttcaaattgtcaaatcttgttctaaggaaggatattaaggtatgtaagctaaccattactcttctctacatcgagtgtagattagtgatcactgaattggatgttaaatgtaactgcagaatcacggaaatcctacaagccatcaaccagaactggttttgaataactttacaacgcgtttagggaatcgtgttgggaggtatagttttcatagtgttgttgacttggttttatggtctctttgaatttcttgctgatgttagatttttccttttttcagattttttcaatcactcttccctccggatcctaatttccgtggtaggagagttgtaacattccacaaccagcgtgactttatatttttcagacatcaccggtacataacttcaccttttcttcttcgagttgcttttgctccattctccaataaaactttttattgaacaaatttcaacactatccagttacatatttgagacaaaggaaagcaagagtgataaaggaaaagaagagacaataaaacctcgtcttcaggtcagttttgaccatgttgaatcaaaaagtaatcaacattatcaatgtttgtatcattaaactttggatttttaggaatgcggtcctcgattcacgcttaagctagttactctacagcatggaacttttgacaccaaaggtggagaatttgaatgggttcataaggtaaaatcaccagaaatggacacgagcagcttcattgctgttctttagagtttttgatgatttttaattttattttctgatgtgttttttttttgtatttcattacagcctgaaatggacacgagcaggagaaggttcttcttataaattctgctgtcttccgagtttcaccaagttttgtgtttattttgcattttcgaattttccctacctccgtccaaaattgtatgtctttaaaacttctcatttcttttttcaatatagccatgagccatcgaaacaatcgtaagagtacttgtttcaacaatataggccctcgttttttactaagctatatatagttggttaaacttatgattgtttggtttggtatatatcgacatcgagcatttgaatctacagcagtaatattggattttgtttagtagttaagtggacctttatgttgcataattaatagttttacgatcatcagttcatcaccataataataggattagatttgaggatgtgaatggttacggtggttgagacggataaatccgtttgcgaattagaccgtttttgatttaccatttataaattagagtatgtaagattatagattaagaaaaataaaagaaaatcgtcgcggatcaattatagaccgtttttaccgccgtaagcattcaaatcctgaacatctctaatgataatgtaataggattgacaaaaacaaatctaaaaattaattacgattatttaggtgtagtatagaacgtaattacgtatatgtatgttactatgttgtcaattatgtcggctataatattccagaaagatccttcggaaaggaaaaaaaaaaactgaaacttcggttcgaagttcaaacaatttttcttactgccacgtgttacttcatacacaattaaaatatttttttgtccctctcatttgtcaacgtttaggggaaaaacattaatatacttttactgcattccgccacaaatatctttctttctttttttatggttcttcttcaccccaactgtattagtactgttcgtctttcagaaaaaacaataatagatagaggaaaaaagaaagaaacagagaagtgagaaaaagcccttaaaactcaaacactaaaaaattttcagtgtcgattcaaaaagttttgttatttgatctgtttctgtgtaaaaaaa

SEQ ID NO: 6952 - DNA, 3000 bp, Unknown
  misc_feature (1)..( 3000): cDNA_ID_3090164_gDNA_ID_1621118_Annot_ID_171953 3000 nt of promoter + ATG
ataacgttttgatctgttttcatttgacatttgtaattggctttttgtaatgtggctttcattacgaaagcggctttctcgatcgttgaccgttgactgattgagaggattaaaaaaacaacgaccaattggtagaatccacgcgctcgtgaggctgataaaataatgatcatatcataataattaataaatcatcatcatcagtatcatgatgaacatcattatcatatcatgccttattgttatcatcatatctctgcttcttcgcttggggtcctacgtatctcaaaaacaatgcagctttaatattatatcattaaagcgaagtaatgtttttttttgtcggcttaatattagtactcttaaagcatgatattgatttgtatataaaaccatataatagtactttgagaactgctacattcagttaatgatatttgggagtttattgcatctgacatccttgaggtaatagaacttcatgcaaataattattttccaacttatgaattttagtattaaatctatataatgttaaaatatttctaatatattttcacatttttaaattgtaggaaaagacttttgtgtgtaaaacaactattactgataatgtgtcacgtaatggttggaattatatatcattttcaacttgctcaacaaaattaagaaatacaggaccatctctcaaatgccaaaaatgtggtaaatcatcaaaatctgtaggagttctaaagtactattggttatcttttaatatatactgcctaaatatagtaagtattattaagtttaaaccattatattttgttcaatttcaaaattgaagtaattgtagatgatggagatgattctgccactttggttatatttgatcaagatggctcacaatcattggaacaactgctgaagatataagatataagtattatataattttatgtacatattatttaggtggacataaattccaatgaacaattaaatgaatgttgatcaaaataaatttgggggaagaaggcattcccaaaagttacattcaattataggagagatttatttgttcgagataaaagttaaagaaaaggattttcaaggatcttatcaaagtttcgtgctatgcttaggtcgtcccattgtactattttaacataacacatgaattttagatgtctttctatgtttaaccattttaggatgtcaagatgtgcaataagagtagtgaaggcaaacacggagaaaacgaagatcatgacgaaccacttactagtctaaagaaaaaaaacaaagattgaagtctaaactgaaacttttattatgatatgaagtttatgaaacaaaagaaaaagtttatgaaacaattttaggtttttaattttccttttaccacttaatagtctaaagaaaaaagcaaggattgaagtctggactgaaattattattatgatatgaagtttatgaaacaattttagtttttttcttttttagttttctttttgttcttcccttttcctagattttgtttcttcactattctaagtttcagatgattttttatgaatagttttcttaaaattaaaaaaaacactaaattaatgtcttctaaaataaggcacatatatatatatatatatatatatatatatatattacgagattggtcgataaatattttaattatgttatattttacgttctctttaaactattatcaacgtatttttaaccaatcaaaaaattagtcacctaccatatacaatagttttcttttacccgtactacgtacgggttgacattctagtattatcataacaattgtttttgtgaattatcatttaactcataccacatatttcaactctgttacactaatgttgtatcaggttcatgtgccgtaatttaatgacccactaagccagtgatagatacaacttttaattaattttctgagaaaactaccatttttatatgtgagaaagcgtaagaaattaaaacataagccaggaagagaagtatcaaaacttggaaatggaaaaacagtggcgttaaaacggtaatcagatcagagtagaaacaagattggagaagtcagggtcttctggttcgatgaccttgatgctcctaaagccaagggtgagagtagtcgttgggttatgcacgagtataagatcacttccttgcctcatcttaatctggtactggtactttcattcttttcttacataagtttatccgatagagttatggtctagttacaagggcccatccggcgtacaaagaattataccttaatggggtcatattttattaaatatataataatattatttgttaaactaaaataaaatttaaagtaattttatgaattaaattttataaatagagaaagagaagaagaaaaaattatacctaagtaaagaagaaaagttgaaaacctatataaaatatgatcaaaagttaaatagtatgtattataacaagaaaagattagtcaaaaaaattgattagggggtgcaaatgaaaaatatgaactaggaacatagggtcatattacatatttaagccaaataattcaaatttctaactaaataagcttgaattataaaagttatggggtcctttgaccaccttgccctccatttagctccgcccccgcccatccttgtgtctttccgaaacgtaggttatgaggagaggaacccatgaacacttatataccaacattctcttctctatcttaacgatatgcgatacctatcattatttcttgttcattatgagatttttcggtgttagatgcaaaacagttatagaaaaatattgacttttgatagagaatttgtaaaagaccgtctattgatagagaatttgttattggcaacagagctagtgaaagattaccacaaggagtcaatctcaagtcgatatgctataaaaattgatatttctaaagctttcgactcggttcaatggtcttttctcagaaacgtccttttggct

SEQ ID NO: 6953 - DNA, 3000 bp, Unknown
  misc_feature (1)..( 3000): cDNA_ID_1976558_gDNA_ID_1621118_Annot_ID_171958 3000 nt of promoter + ATG
tcataagcaaaacaaatccgatcaatatgtttaaattctgtaatacaagaacaatataaacaaaaacatattattcagaaagcaatgatacattatttgaatattgtgtgtaagagtgaacgacaagatcatacgtcagagataatcgactggtaacaactctgatcttttccaacttttggtcaaagtcaaaccatttggtcatttttacagtaaattattgagtaatatgtcatttactcatttcttttgaggaaaactctttttttatcagaaaacaaaaacaaattactcattttcgttttgggctcaagacaaaagtccttcttttaaaaatattagcccagttaatctatacaggcccattaaagcccatactaaaagagccgagcgttccaccgcgtgagattgacgtgcgtgtatttacgcgttaatgtttcgcgtggtatttgtttatttgaataaagattccttagctttattcttagtaggtcctcatgagtcatattcgtgaaattgaggtttttgaacgaactcggggctttgattcgaagtcgaaagttttgattttatattgtgatttctaagtcgaaggatgtgttactttggtgttttttttatttgattttttaaaaagaatatttgatagttgtaaagagtttttgtatatgtttaatttttaaatagagaaatggtcaacgtagcacaattaacttgtaatagagaattgctcaacgtagcacaattagtgtagatctttaaaattaaatcatcgagcgaattttagaattctcccaaatagttgttatctgcaaatgtcatgttatttacaattcttgatacataaaatagttagttttccatgtggtaaaaacaataaaacatacgaccaatcgaccattgacataactcttctaaatccacgatgagttatatatataaacttataatactaatcacaattattgttattgaggaatatacatcgtgagtatcatcaaatctcgtcatcgcactttgcttgaacgtgcaagaaacttggaaacgcgtttagagcaaacaccgggacaccgaagtaccgtttattgaattcctttttttgtgtgtgttgttcaatacttaaatcgactaaaaaatcattagcctaagattcacatatcagaacgtgcttgggccaaaaataaaataaagaacgtgcatggaccaaccaaccatatatatatcttcatagtattattgataatggcgggtcccattatgtttgatatattttcagttttcaccatggaagcataatctcaagaatatgcctccaataaaattcgtttgtacatgaattccttaagtatggcagaatactacgtataccccacataatagtttaatctaatttaaattagtgtaaattttccaccaatcaatttattaattacttaaaacaacaaaagtagtgaaaaacaattaaaaacacatatctccctcaaaatacccatagtaggctacaactgtagatttcttgtttcacaagacacaagaaaaaaaaacctaacttagaaatcattagaaggaagtggttcatgtccattactaccgataaagatagtatcataaacaatagctgcaatggctgcaccgataaaaggaccaacccaatagacccaatgattcgtccaaatccagctaaccacggccggaccaaatgaaaccgcggggttcatcgatgcaccgtcgaaagcaccaccaaccagaatgttagctccaacgattaacccaatcgccaaaggcgcaatgattccaatatcacctttcttgggatccacggcagtagcgtaaaccgtgtaaactaacccaaacgtcatcacaatctcgaaaacgactgcgttccagggcgtcactccatatgatagcgaaaacgcagccgtttccatcccgccagtgcttaccttgagcaacaagcaagctacgactgctccgagtaattgagcgatccaataaagaatagctctcaacaacgttatgtttccaccaataaaagccccaaatgtaaccgccgggttcacatgaccacctgaaacgttagctccaacggaaaccgcaacgaacaacgcaaacgcatgagacaaagacgcggccacaagaccggcaggtgtggctggaccatctccagttagttttccataagccattccagagccttgacccgcgaaaacgaatataaccatcgagaaaaactccgcgaaagctgctctaatcgcatcgggacgactagcttcccccggcgttccaatcgcaattctgttgataggcatcgttacaaaaaaatttgctttcttgcttcctcttcattttgtttttcatcagtaaaagtttaaatagttaaagcgttagtgccaagtgtgtgtatgagaatcgttcaagagactgagattagtgttttacggtgggccctaggttataagaaatcgaacggtgattataaattcatatttaattaataacttacttaccaattaattaaatcttaatccgtttttctcgctttctataaatactattatgggtagcaattgaagaacacgcgctttactgttttctcatcatcgtcacttttctttctccacactttccgcaagattgttctgttcttcaaacgattctaaggtacgacttttttttttgaaggttcttgatctcaacttttgttgcgtattgatgtttgatcctctggattttgtatccaacggaagatctatcgagaaatgaacaaattcgatacaaattgttagtgtttagctgaattatgtagattttgttaacttcgatcttgaagatgattgatgtttatcgtactagtagaatctgatgttaaatctttgagtgatggatcgtgttatcagcatcaatagtgaaaagattctatattgatttagacgtgaagtcatgaaaattgactaacaagattctaacgtttggttctgttttgctctgttttattagatg

SEQ ID NO: 6954 - DNA, 3000 bp, Unknown
  misc_feature (1)..( 3000): cDNA_ID_3049361_gDNA_ID_1621118_Annot_ID_171956 3000 nt of promoter + ATG
cagaatcagaatgagaaaatgtcaggtggtggagaacttctttttctttcttttgtcagatagttggatctgctgctcaccccaaaatgggcctggcccagtatatatcaataccagtaaattggcgcgtgtatatcaatctccttttcactaaaaaaacacttaataccagaatatattttaccaaaaatcttattagttctctagttttttttttttaaatctaaatataagcgtaatacttcatccttttttaataagtgatatttaaaaaatttatacatgtatattatctattttacacctacattctattaattttcaaaacaaaagtaataggactaagcatttattgtaaggttgattttgaaaatagttaatagttttacatgaaaaaatattgaatattatttaaagtgaagcaaaataatttggctacatgtcacttattataaataaaaaaatacacataacattagagaatcaatcttactgaaacaaaaaaaattgtgaaagagtagatggaaataacatagtatactaaatactaatgcttatttttcttcatatatccactctattacacctacatgctaccgttgcagcgaattaaatggatcaaaccaactgcatgatagatcaaacgtaatttcaatgtttttgatcaaaagatcaaatgtaattatgatgactcttttgtcaacaatctcccctggaatgcatcatgcatgatggtttgcacgagaagatcaaagtataaatttaagttcgggacacgcagaaaaaagacctacttgtaatattcttgaaagtgagttcaagctctcatcatttctatgcaaagttgatggcgtaaaggatacacaaaggtatactgagcaaaattttttaccacttttgattttctacatgacacttcttactaacaaatttcgttgaaaaacggtaaaacaacaattatttcctacgattttcctacatttttgacagtaggaaaatgaggtttttctaagataacatttgctttgctatgtaaaactaaaaacagagtgaaacggatattacagatattttgcagaaccctatattctatgcaactggactatatttgctccgccgatgataagacccattcttcatacattaagactatatattatgcacacccatacgcacacatttcaagtttaatctatcattgactatgcttacattgattattaatgtttcagttatttcttggttcctagaatgaactggaccggctactttcgtatcatagaatagctattttttcggaagtgtctgcatcttaataaatatatattatgactatatacacaatgatgtcgacaagagtgaatatacacaacataattatcgcattttcttattagacgtactacgaaatttcataaaccattgattcattgcttgtttcctaacggggaccaaattaatccctaactttttccgatgggtatagaaaaggtcgaaaaatcccccaaggaccaaaaatataccttcaagttgaagaaagtaaatagataatatattttaaaaggaaaatgtgtgaaggaaaggaggcgtgggaggttcttttgcgacaaactctacatggacgcggtgtggtccctctggtccttaccctaatcgtttgatgatatatttttaccatgttatcatttcgaaaacgttttatagtatatatatttttattttatttttgttaaagaacgttttatagtatattacataagatgtgttgacgatgattagtttataatttctaggacaattagaaaaattcaaaggtaagctagatatataatttcatagtaggggaggtgctactttaggtacttgttaacatggaaattatataatagaaaagttaaaatctaaatcatattcccgtacttattaatttctaggacatttttttagtataactcgagtaattcttgttgctagactaatttcagggcatgcaagttagtttgggtacaaagataccatgtaaagtatccggaccaaaacttataaaaacgagaatatgagtatataaaacaaataaagaaactaatttcttgttgctagactaatttcaacagttatataaaaactagattttcaatttttgaatattcttatttaactatatcatactaaaaaaaaaaatgtaaacaaagaaaacaaaattatatctgtctatttcctcgcaaaagaaaaataacatgtaaacaaatagtagtaatagtaataataacgtgtaagaagcccctcttaaggtgtacggacgtatgttttttttctttcccaggcactcttccctatgtcctaaaagaagctaaggttttttaaaaaaccagatctcagctactttctattaccaaaaacagaaagtttcccaccatttctcaaatagacggcatctccctccggccaaatccccggcgatgactgcccttaccgaccaatggtgttgacggccccttagaagtcatgtcacaaggtgtgggacaacagaggacttcgagctttcaccaacttctcctccaaaccctcctttctccccttggcttcatagtgctttaagagctcaactaccagatcccttgattgtttgaggtacaaaaagtcttgagcatttactcttgcatttatgtctaaccttgtggttctatctcttgaactttctcactatatgtgaagaaccttttcaaacttatgtcatgctcagtttctcaacaaccatgatgacaaactctctcacctagtgtgaagaaccttttcaaattgtatcgacaagactctgccctagacgccttcgttagaataaccattggattacgtgtgatcttgctgagttcccaggacctaagtatagaccaaagaatcccttactctgcaaaaggaaaagacatagctcacagtcaaaaatcttactcaaattatgccagtcaaaaccgctcaagggactctggggaaagagctatg

SEQ ID NO: 6955 - DNA, 3000 bp, Unknown
  misc_feature (1)..( 3000): cDNA_ID_1816284_gDNA_ID_1621118_Annot_ID_171943 3000 nt of promoter + ATG
tttgggtttgattcatctgtccctgtgttggttgctatctttatcccaatttgaggttaaagtcatgttcttgtaagaatagatttgggtttgacttatcttttccctatgatgcttagtacatcaagtttaggttctgtgtatcagagtttgaagtgttatatatagaagttgtggcctagaaggctagtgtatttgcttccctgtgttgaatatattactgtaatctcccctgtgttggttgctatcattagtacgttctgtgttgtcacagagttttaagcgctatgtatagaagttgtaacctagtgttcttacttctgccaaagcttgtgattgtttgagttatgtgtgtttgattttttgttttgttggcaaagaacttatgtgtgtgtgtacttttggaatttgttcagaggaactatgttatctgccaagtgatgtataagggtgaagatggagacgtcccatctggtggtaacaactcgagtgagccgagtcaatctttggtctctgattcgaatactgtcagagctacgagtcccacagcgcttgaggtgactccagtttctttatttgataatctcatgtacttgattcgtttactcaaaactctcttttacattttcagtttgagaagccaggtcaagaaaatttctttggtatgtctgtggatgatttggggactccaaagaatgaacaagaagatttctctttgtgggatgtactggatccagacatgttattcagtgacaataacaatcctactgtgcatccacaagctcctcacttaaccccgaatgatgatgagtttctcggtggattgaggcatgttaaccgagagcaggttgaatatttgtttgccaatgaagatttcatatccagaccaaccttatctatgaccgagaaccgcaacgatcacaggccaaagaaggctttgtcagggattattgttgattatagcagtgatagtaatagtgatgctgaatcgatatctgcaacggtaaagcaaatcacccgttttctttatcgttacttctgtgctgtaatctccattctcacattttgattatattatgtcagagttaccaaggaacatcaagtccaggtgatgatagtgttggtagttcgaatagacaatttctccagactggtggagatgagattctatcgtcttgcaatgatctacaaacctatggagaaccttccatcagtagtagcacccggcaatctcaactcacacgaagcatcatacgaccaaaacaagaggttttgcgttgctcttatgttgattctatatgatttcaacatatgttggatatataaagataatgattatgtaactttccttcacaggtgaaacaagatacatcaagagcggttgatagtgatacatccatagacaaggagtcatctatggtgaagacagagaagaagagctggtttattacagaggaagcaatggagagaaaccgcaacaatccacggtatatctatctcatgagaatgatcataggcttcattctcttgctggctctcattagcaacatcatatcggtgttacaaaacttgaacccggcgatgaagtttgatcgcgagagatagacaaaagctagcagattgatcaaagcactcgtttttactttgcttttatttatttctattttcttccgaaattttgatgtatatatgtgtgtgtatgtatgaccaagaggtatgtcttgtacctaaagttaaataaaatttagggtttgaaaattttataacatttagagcgggtccatagttcagtgccgtggtggagcattagactgctgataaagaaaacattcgacagagaccagtgaatggtttgaaaggtttctcaaagatttggtttgttgataattaagagaatgattacataccggacaagggactggtctaatgtgattgatacttcgatgatcaatcaatcaaatattacttcgatgatcaatcaatcaatcaatcatattacttacaactatgtaatatgattctatgaacctttttcttgttttttgtaaactttaatcccttatcttgcaagccaaatccatagacatatattttacaaaattagtagtagtactatattgaagtagagaaagtaataacgccatgtcgtcgtcgtcgatggtggcggctataatttccgaaagatccttcgactcaaaatacacaaaaaaaacaaggaaaagagaaaggttcatactttcgttcgaagctccgacaatgaaccgtcaataatttgccacgtcttcattctcattcacaataaaaataaattttgttcctctcatttgtcaaccttttttgtttttgtttaaagaatttgtcaacctattggaaaacattttgcattcaattaaaatcttatcgctaacagttttttgttttttgtttttttttcaactatcttatttattaacagtagtaaatttgttataaaatacataatattacatttcttccaatacataattgatatctaaatatccgatcgttgtaaatttggagtttcattcatcttaaaatgtgtgaaaaattacggctgatgtgtgacaaacacaaaagataaaaagttactaaacacaatttttttacaaaattaaattgaaacgaaaaaaaaaaatttaacaaaaaactaaaaagaaaaaacattttagaaatagacacaagtcatcaacacggtttcggcgcgagtagacttcacggcttttgttctttacttactgagaaattactaaaatttggtttttttttttttttcaaatagaaaaaaactataaataccatcactcgctatctcttcaccaatcacttcctacttgtatttgaaaaagaaagaaaaacagagagagagagggagaagccaaaaaaaaaaacagagaagcagaaaaaaataaattccttcacccaaaccctagaattttttttagaaagttttgttttttcgatctgtttctgtgtgaaaag

SEQ ID NO: 6956 - DNA, 3000 bp, Unknown; identical to SEQ ID NO: 6955
  misc_feature (1)..( 3000): cDNA_ID_1816284_gDNA_ID_1621118_Annot_ID_56229 3000 nt of promoter + ATG

SEQ ID NO: 6957 - DNA, 3000 bp, Unknown; identical to SEQ ID NO: 6953
  misc_feature (1)..( 3000): cDNA_ID_1976558_gDNA_ID_1621118_Annot_ID_56235 3000 nt of promoter + ATG

SEQ ID NO: 6958 - DNA, 446 bp, Unknown
  misc_feature (1)..( 446): cDNA_ID_1816252_gDNA_ID_1621118_Annot_ID_56238 3000 nt of promoter + ATG
catcacagttacatataaatatatatatatatatatatattactaatcccttccaccgagaaaaacagtatattctatacctacaatttcaaaaaacaaatgtttcatataactttacttaatagttttttttttttttctgttaaagaactttacttagtagttctataatttgtttcatagttaaaaaagaattcaatacctactcgttctttaaatattttcattgttttttgttgttttagaaagaaatgggctccaactcaacatccatgttatttataaatatatccacctctagtcttaatatttcactactcaaacaagtttctgaagaagagacagagagagaaggatagagtaaaagctaagagagagagcgagactgagagagaaagaaagagatatcattttggttattaagtaattaacttatactaatcatg

SEQ ID NO: 6959 - DNA, 3000 bp, Unknown
  misc_feature (1)..( 3000): cDNA_ID_1816383_gDNA_ID_1621119_Annot_ID_56239 3000 nt of promoter + ATG
cattttcttaatgcttagtttaattttctaaaagggaaaaactatgatttatacgcggatacgagggagtgggatgcattaaacaaaattcaaatttgacgtcaattaagcaaattaaaacaataatctgtttcacctttttgtgacaagtggacgtcttctttctcatccaagttagccatctatttctcctaaacacattgttaattagtttcattattagtgacgaaatcaagacgccgtaaccgataattctaacataatcccttttataataagaaggatacaatttcaaagaacatactaatatttacaatattatttaagattgtattattgaacaagttgtcattcctgtgtttggtcaactatggcctttgggatactcagaaggattccatacccaattatttaattcgatacccttcttctacatgattcaatcaatccttttaaaaaattgaatctgtattttttttcttccttcgtcacctgctggaatattaatatcatataattagtaataaatcattaagttttgtcaatgttacacatttagaccctacaactttatttaattttatctatcaagctaacaaaataaggtactaaccagttaatgaaattaaaattgaggatatacatatagtttagtaaaaaactttgatcgataccttatctgaattgaaactattctgatctatcctaacaatattaaaaatggtttacatgcgctatcatcattttttctactaaaggatttaacgcttattgtaaaggccttttttttttttttactctgatggtttgtcagaagattattcgttaatgaattatacgtttgttataaactgtaaatcttcattttgaatgtaaaactcaaaaattaaaattgaagcaaaaggtagtttccttgttcgtgctaactgctaatgtcgattaagattcatcctcttgaaatgaccgagtcaacgctgagggagaatctcacgtggtcctaccaactatcacgtgccaaaaatctgggccctgagatatacctataagcaaaagccagctccgcccaaaacatttgatccatccattttcatttttattttccaattttgaagttagggtttatttttataagtttccattaatttattttcttattccttttcggaggatgtgtttattaatttaatttcaatagaagataatatatttgggttcaccactcgttctctttttctttttggatgggactcttcattgtgacttttttgttctcgctcttccacaatctttggatgtgtacaaaataatcgattgttggggatattatagtaaatttagcaatatgaaactagcaacgaagaaagtgtttattgatgggttcaaaatttcatcgatctgcatatcaataactcggaaagagatggatcatgacacatagtatacaataaattttataaatttcgaaaattaactaattgaggatagaaattcatcaattacttaataaataaataaaaaactgattcaaatgtatgttttacttctgtaacatacaatttcttgcttttcttgaaaattgactcgttttttatattggatattttacatagactttgagacttattaataaaactaactaaccatctcttacaaattgttggaataaattatttttatttttctgttggctctataaaatgaaaatgacctttgttcttcttctttatactcctatatatgttttctccagagagaaagagaaccattgaagttgcgagacttccaattatatatatagttcatgaaagtcctgtgaccatgctctttatttattttatttcactatacgttaaataaatggaaagtagggtaataatcatattgcagcatgattcattttagtggcgtctaagaagcattcattttgagccattaaatctcaaggtagactttcccattaacacaaaagaagaaaaaattggtacgtaatcataccaacatctacaaatctttggtttcaattttgtaacaaagacctagattgttgacaaacaaaaagcaaatacctaaaaggacttttattgacttctataaagatgttttgattgaaatttcatataatttaatagtttcctcaaactatatgcaataaaattataatttgataattacatgtgaaagaaaacatgactctcaaattaatatgagtcgattatcaataaatttttgtgatatggctgtgctgcagaacaactgaatgggcctagaagtaaagttgatattgagcaaacaaaaaacgaaatagattttttttttcttttgggcaaactcaaaaaacgaaatagatatgcctcgacaatactacaaaatctcaaatgaacaatattgatgaaaatgcgtttgtaacacagaaatcaattattttgaattattttccatatatagtacagacgtaaaaaacatactgtattatctttcatggaagtaaaataattttccaagaaatagaacaaatgtaaaacaggtggtggctaaaactggtgcttttaatggctaatgccattgaatcactgacaaaatgaccgatgacttcaacttaaaagttcaagcccacagttccaaaggtagaggaagtggtaaaatttaggtatggtctctttctctctctctcaattttctctttctacaaatatatactacagttacagtagtagttattattattaattattctctccccaatcaaacaacactcatcagagtcacacatgtgtcacttttttcttcaatattttagttttatgaataaaaaatcaaaataaaacaataaaaacttttttaacttggctagtttcccagtataaatagatgtatcaacgaacacatttaagaccacaaaagaaaccaagagctctcaaacaaaacagccttttacataagaacaaacacccccaaaaactgcaaaaaaaagagagagatcattaatccatcttcaagatg

SEQ ID NO: 6960 - DNA, 3000 bp, Unknown; identical to SEQ ID NO: 6959
  misc_feature (1)..( 3000): cDNA_ID_1816383_gDNA_ID_1621119_Annot_ID_171971 3000 nt of promoter + ATG

SEQ ID NO: 6961 - DNA, 3000 bp, Unknown
  misc_feature (1)..( 3000): cDNA_ID_3409141_gDNA_ID_1621119_Annot_ID_56242 3000 nt of promoter + ATG
cttacgatatgaatcctctaccatgagattcaaatctttcttctaaatcaacggtgtagaaccactcgtagagaaaatataatttagagacatatccatcagtttgtccgcgctttagcgttacacatgttgaagacatggggcgtttttcataattgggacacgaaaagtgaattatttacaactttttttcagatctacctcataaattaattaaagttatatcgaggagtaaaggatatactgtatgtgtctccctcatttttttatttcccccacttttttctttataatatatctagtttttgatgaaatgtatgtttttgataaactattttcaagtatagtaacggttttttatcattattattattattattattattattattattattattattattattattattattattattattattattacgatattgaccgacgacgtcattaagctgcaatttatttatctgcgaccaaacaaaatttctggaacttggaaatagagtgatgaatgcattatgtgttagattaatattgtattgtattaacagatcaaaatgaccctctgtgttgacttatacctaagatatatctacttttttgttcccctctacctaaagtttccagttttgtaacgtttatcccttacgcattattggtgttttagttcattttcggacaaaactatatgataaataggaccaactgaatggggtcatcttagccgtccaactctttttaccggcttttctgctggccattctttacagattgtgacgagtacgtgtcttgtggcctgtatcttcttctctttttgtcgaaaaagaaatcaaccttatgcacaatttgctctacttatttcatcaactaaaagtaaagcctaaatatagattgtttataaggttataaaacctgtttaatcgaaaaaaaaaaagttttagagcctaaacattagagattggcttaaaatctaattagagaaaacatcaatcacacaattttgatttacaaaattaaaaaaccaacatcaatatgtttagataaacttaataatctatctaactaaaatatagatagtaaaaagacaataatgtcaaaattaatcgtatcatgtattttcaatgtaaagtatactaaatgtagaaatataatgtcaaatttagttttctaaataaattgggaaaaataaatattactagtgaagatagtaattttttcaattttcatattaaaatggtcattttgttaggcttaagatttccttaaatggcgttattgaccaaaaacggaaactgatgtactttagggtccacattcacgaggaatcctacctggcttatagtcacatgagcccgcaacttgtagccacgtcatcttaagtcaaatatggtacaaatttaaaatagagtagtactaatttttttcttttggacaataatatttgatgtcatggaagatacttttgatttgtatttttaagaaaattattgactacaatagtaaagattgcattctctttctcagacaataatcaatctcacatcgtttaacaggattaaaatggtgaaaagatagtcatttacacagtttcatcatgttctttagtctgttcttttcatgacatgtaatttccaatgctaattaacagatgatagtaaaataaattacaatacaaatatgttaaaatttgacaaaatggtaaatcatttgtttatatttttataaatccaataccaaaatgatttgaagttgaaacgttttgagtgtgaccctttaaattttattcaagggttcttattctccaaattaccattttcaccagaatccaggctctgtcattattattttagttgagaaaacgacttttatcctatttactcgtcactgaccggtggtgtaatttactcctttttgtaataaaaataaataaatcatctttctgatatgaaaaaccaatatttcaagtatattttttagtatataatcaagttttacaaataaatcataaaaatacgcattcaaagctacaaattctcgttctatctactttttcatagatcacttttcctagcccattatcttttgttagatatcttcacgtcaatttaaaaatcctaaaatatctatttttgttttaaatgatcataggttaacaaaaaagttcgtcaatataacatgcactaaaacgaaccactaaggtatataagtcatagttgaaaatagttaagttttaatggacaatctattccagtactgaatataaaacatgatagagcttttaaaatgttaacatccttcatttttattgtgcgaaaacatccataatctaaaatataaatcgtatattgtagaattcaaatgtcacacctagtgataagaacattgatcttttggcgcggatcaatatatagaataaagaatttaagatgtttccgcaggcatcaacgcaagtttaactgctggaatttctaaaagagttcaacgttcaaatgagaagttgtaacgttcaatttaagagtttcaacgttaattacatgaaaggtttgttgtaacgttcaatgaagtcacagaagaaggaagcaaaaagcttctcaaaaaacttctattgcatttcatttttttatttatatgtaaaatataatttaatttcctagttgaaaattgataaatctattttttacaagtaatggttaagtggtgatgttctaaatctatgtggcatgaggtgtaaaattgtacattatttttttatataagcaaaaaaggttctttcatgtgcaatactcatcatcatggttctttatagaaattaattttttttttaatttatatttagtaaaacaatttttttattgtaaaccatttgcttctactataaatacccctcctcttgatcaaatctcttcactcatcaaaacatcacatacactatttttctcctctccttattgtctatatatttttcctctttagctttttcatttcgaaatg

SEQ ID NO: 6962 - DNA, 3000 bp, Unknown
  misc_feature (1)..( 3000): cDNA_ID_1816377_gDNA_ID_1621119_Annot_ID_56243 3000 nt of promoter + ATG
tttggagaataagaacccttgaataaaatttaaagggtcacactcaaaacgtttcaacttcaaatcattttggtattggatttataaaaatataaacaaatgatttaccattttgtcaaattttaacatatttgtattgtaatttattttactatcatctgttaattagcattggaaattacatgtcatgaaaagaacagactaaagaacatgatgaaactgtgtaaatgactatcttttcaccattttaatcctgttaaacgatgtgagattgattattgtctgagaaagagaatgcaatctttactattgtagtcaataattttcttaaaaatacaaatcaaaagtatcttccatgacatcaaatattattgtccaaaagaaaaaaattagtactactctattttaaatttgtaccatatttgacttaagatgacgtggctacaagttgcgggctcatgtgactataagccaggtaggattcctcgtgaatgtggaccctaaagtacatcagtttccgtttttggtcaataacgccatttaaggaaatcttaagcctaacaaaatgaccattttaatatgaaaattgaaaaaattactatcttcactagtaatatttatttttcccaatttatttagaaaactaaatttgacattatatttctacatttagtatactttacattgaaaatacatgatacgattaattttgacattattgtctttttactatctatattttagttagatagattattaagtttatctaaacatattgatgttggttttttaattttgtaaatcaaaattgtgtgattgatgttttctctaattagattttaagccaatctctaatgtttaggctctaaaactttttttttttcgattaaacaggttttataaccttataaacaatctatatttaggctttacttttagttgatgaaataagtagagcaaattgtgcataaggttgatttctttttcgacaaaaagagaagaagatacaggccacaagacacgtactcgtcacaatctgtaaagaatggccagcagaaaagccggtaaaaagagttggacggctaagatgaccccattcagttggtcctatttatcatatagttttgtccgaaaatgaactaaaacaccaataatgcgtaagggataaacgttacaaaactggaaactttaggtagaggggaacaaaaaagtagatatatcttaggtataagtcaacacagagggtcattttgatctgttaatacaatacaatattaatctaacacataatgcattcatcactctatttccaagttccagaaattttgtttggtcgcagataaataaattgcagcttaatgacgtcgtcggtcaatatcgtaataataataataataataataataataataataataataataataataataataataataataataataatgataaaaaaccgttactatacttgaaaatagtttatcaaaaacatacatttcatcaaaaactagatatattataaagaaaaaagtgggggaaataaaaaaatgagggagacacatacagtatatcctttactcctcgatataactttaattaatttatgaggtagatctgaaaaaaagttgtaaataattcacttttcgtgtcccaattatgaaaaacgccccatgtcttcaacatgtgtaacgctaaagcgcggacaaactgatggatatgtctctaaattatattttctctacgagtggttctacaccgttgatttagaagaaagatttgaatctcatggtagaggattcatatcgtaaggttagtaattgggaattgtggtttgctatatatcgatctagaccatatccaaaataattaatattggttcgaatttggatatgaagatcatacattatgattaaataatgttttaaaaaatgagagaaaattttgatgaagagaaaaaatatttttggtttggtgatcattacaaaatctgggttgggtctgatcccaaaaatatcagagaatacaaaacaaaatggctctaatcctgtatttttttctggatggtgtatacttggacatgagaagactctagttaacaatcgctatatagttcaatcatagaaattttcgaaaaaattgtacgtgaaactctattgaattagcaaaatttcttatatttttggtaaacaaaaacttcttagattataatgattgcattggtctttacgaatagtatgtattagttgttaaaatttatttattcgattttaacgatcagatagtggaggaggtcaaatttcaaagaccactgttggacttgggactagaggcctaattcaatagcccaataaaattttcaatttgactttctttaaaacctatgaaatttctcttcctttatatattaccactgctgactcagaccaatttttctccatcgccacgacgacattcgctggtcatggtagataacggaagtaacaattttgtaaccagggctttatgcacacaattttttcggaccagacttaagaggtgaatgcgtctatttcgatttacgtgcatgcatgcatatatagctaattatattgtaccaattatttttagaaaaagaaaaaaaaacctgtgaacgggaagactacaagtcttaattaattaaggatcaccacatatgaccttttcttcgaactccatatttaaacattcctcaaacatttctctctcattatcttttatttctcttcttgttactttcttctcattcttttgacgaaaaacaaaccctttaattagactctcttttattctcccatactctttttttgctgtcttatttttgaagttttttttttttttttttttttgctgtctcctcgttgaactcagttgcataaccatctccagtaaatcatgtcgaatcaaatccaacggtagagattttctacgacaaatctgaattaaatcagagaacgaatagagatcaggaaagcaaag

SEQ ID NO: 6963 - DNA, 3000 bp, Unknown
  misc_feature (1)..( 3000): cDNA_ID_1816366_gDNA_ID_1621119_Annot_ID_56246 3000 nt of promoter + ATG
tccaagtttgaggaattcagtgacgatggttttatctccccgcaaaggtcagctctttttgtcttctctacgttatttcatcaacgtgtaaacatgtcactaattgaaaatttccgtaaaaaaaaagaaggccaaattggagagagagaaagagatacgactttggaatttctaaactgttttataaagatggagcacatagagatattagatgttcataattagtaaaattgggtttcttgacccataagcaatgttgttccctcctcttcgttccctctttctcttcaccctcttgctctcctccgtttgtttcttacaaatcaaagcagaccacgacgatgaaagcgacttgggcagtgatatcaaagtagacaaacgtctcaagttcgagaacccgaagctacgtcaagcctacattgctcttcaatcatggaaaaaagcaatcttttctgatcctttcaacttcacagctaattggaatggttcagatgtttgctcctacaatggaatctattgtgctccttctccttcatacccgaaaacccgagtcgttgctggcattgacctcaaccacgctgacatggccggttacttggcttccgagctaggtctcctctctgatctcgctctgttccacattaactcaaaccgtttctgcggtgaagtccctctcacgtttaaccgcatgaagcttctctacgagcttgatcttagcaacaaccgattcgtcggtaagttccctaaggttgtcctctctttgccttcccttaaattcttggatctccgctacaacgagtttgaaggcaagatcccatcaaagctcttcgatagagagcttgacgctatattcttgaaccataaccggttccggttcgggattcccaaaaacatgggaaattcccctgtttctgctctggttcttgcggacaacaatctcggaggatgcataccgggaagtatcggtcaaatggggaaaacactcaacgagcttatcctctccaacgacaacttaaccggttgtttacctcctcagatcggaaacctcaagaaagtgacggttttcgacatcacttcaaaccgtctacaaggtccgttaccatctagcgttggtaacatgaagagcctagaagagcttcacgtggctaacaatgccttcacaggagttattcctccaagtatctgccagctttctaaccttgagaactttacttactcttccaactacttctccggtcgtcctcctatatgcgcagctagtttgttagccgacattgtggtgaacggtaccatgaactgcatcaccggtttggctcgtcaaagatcggataaacagtgctcatctttgcttgctcgccctgtggattgcagtaagtttggatgttacaacatcttctctccaccaccaccgacgtttaagatgtcacctgaagtccggacacttcctccaccgatttacgtgtactcatcgcctcctccaccaccgtcgtcaaagatgtcccctaccgtcagagcatactctcccccaccaccaccttcgtccaagatgtcaccctctgtcagagcatattcaccaccaccgcctccttattccaagatgtcacctagcgttcgagcttaccctcctccaccaccaccatcaccatctcccccaccgccttacgtatactcatctcctccaccgccctatgtgtactcatctcctcctccaccgccgtatgtgtattcatcccctcctccaccgccttacgtatactcatctcctccaccgccttacgtgtactcatctccacccccgccttacgtatactcatctccacctccgcctcctccaagtccaccaccaccgtgtcctgaatcatctccaccaccgcctgttgtatactacgcacccgtgacacaaagccctccaccaccatcaccggtatactatccaccagtaacacaaagccctccaccaccatcgccagtatactacccaccggtgacaaacagtccaccaccaccatcaccggtatactatcccccagtaacatacagtccaccaccaccatcaccagtttactatccccaagtaacaccaagtcctccaccaccatcgccgctatactatcccccagtaacaccaagtccaccaccaccatcaccagtttactatcccccagtaacaccaagtcctccaccaccatcaccagtttactatcccccagtaacaccaagtcctccaccaccatcaccagtttactatccatcggaaacacaaagtcctccaccacctactgagtactactattcaccaagccagtctccgccaccaacaaaagcatgtaaagaaggccatccaccacaagcaacaccaagttacgaaccacctccagaatattcatactcatcatcaccaccaccaccatctcctacgtcctactttccaccgatgccaagcgtctcatatgatgcatctcctcctcctcctccgtcttactactagtttcaaccattgagtaaaaaaatgcattgccttatgattaacgagactactcacaattatattcttttggctgcgagactttaatttgtgtgttttgttgatttaaagaaaaaaagacattccagttactttttcttgtaatatttttttttcttttggatattatgttcttttttccctaacacagagctgctcattagcagcaatggagtatatagtttcagtttatttaatttgatactaaaatgttctgtataaataataaagaaaataataaatcctttcacaaaatccatttttatctcaaattaaaattgaatatttaattgaaaactgtaaagatgacgtcaacttctcagtcatcatctcaaaaacggaagcttaagaaaaatctatacctaccacttcgaactaactctcctctctcgcttactggaatttggggattagcttgggaaacttcgccggagattcatacgtcgtcgtcgtctttagtatctgtatcgtcaatg

SEQ ID NO: 6964 - DNA, 3000 bp, Unknown
  misc_feature (1)..( 3000): cDNA_ID_1816358_gDNA_ID_1621119_Annot_ID_56248 3000 nt of promoter + ATG
gcgtagatccacataaaaatgacctaaatacctcacttttaagctatgttgccgggtagttaaataagcaaagctcatgttcaagtaattttcgttttctggagattgatccaaggggatgtatatataggccctataacagagcaagaaatgtccaatattacatgttcaattgcaaagcatgttaaaacaagagagggataggccatccaattttcccgatgagaaaacctctagcgcgaagtaatagtatgaaaatcccggctcacaaacataagcataccatcatcagtgtgtcattaccacagtcatgctcgtttttggtcaattggctaagaaacgatccgtggtggaatgggtgaagcagtgccttgtcgttggtgttggcgatcttaagaggggagaacaccagtatacttgtcaacaaacaccgtgtatatcgctagcacgacttagttccatcccgctgtccttcttcatccatgtggttgccttccttcttatgtatttacataggtccaaccaagtttcttatcgaaattaccatgtgaaatatttttaaaaaatcttaaattattttttataatgaatttaataaataaaatacattttactacaacactatcgattaatacattagacaaattggaatcgttgtaaaatttaaaatataagaaaaaaggcaaaaaaatgagcaaaatataagacgaaacaagaagcaaaacataagaagaaaagcttggaatggtaagttcatatttgatacattaacatcaagaattatgagttttaattaccaactatacaaaaaaagaacaacacaacaatatgaagacctatactttaaaaaatcgaacttatcaacttatcatttcaaactttatagctaatcatattatatcagttttaaactatcctctaaacttaccatacattttggctatcataaaaatgaaaaagataaatctacattttaatatgccgatcttaaaatatgaggaaataacaatttgttttgaaagcatgcgtcaaaaaaatctctacactccgattcacgaatgtggatctacaaataagctacttaagcgtaaagttataaaaatggcagaagatggtcaatccaaccgtaacgcccagcagtattaatctgctgagaacaaaagaatgattgagaaagtgttagccagggtcgcacaataataattaagatatagcaagaaaccatttaactgaatcaacaactacaaattaccaacgaaaattaattagttggaaagactaaaattcattaacttggtgtttttatttcattttcggttcaagtattttgcctattctcgagattgatccaaggcgatgcatccctaacacataaattgctagcaatgtccaatattaattaatgaacacagacgacgacaaaagaaaaaaaaaactaattttaaagcatgtggaattgaaggagtatctcaaatactctctagaagatcatttgaagggatgatccaacaaagcaaactacaatatccacaaaaactcttattgtctctgaatcaaacagagctataacattcaaaaaatttataaagccaacgcgcttgatcatcaagatgaagatagaatcgaagtttatgttattagcaaactgggaatcaggaaggaacacatccttcgaaatagataagcgatcatgtcatagtaggtacaatacaatcaaatggatcactgtattcatcaatttcagacactctagttgtaaaagaacttaacgatccataatcaagaatcacccacaattgtcagtcaaacagatcaacataaggtttaagagttctacaaatgatttagttagttcattcgttaaggaattagtggatttgtggcagaaaattcagaactaaattcaatatatgtgattagtgatcagagtgtttcaaacacgtcactgtctaaatccaaaggagaagtgttcaaacctagaggaagctactgggttttgagagttaagaagatcagaccagtccgatatatcttatatatagaaccacatgcacgagaatcatgaaaacgtagtgattttgatttttgtttagtagaacaaatattttgagatttttttagaaatttgttagaatttgagattttttatatgactaagacagagccaaacactagtgccgtcacgtgtaatagataagtttctatccggatgaagccattagcggtgacaaggtttaatagtattcaactactaattgcaagaactttagatacattgaatctagacagcatttcagattcattgaacttggacgtgtttggtttactctactacttctggtttccgcatcagatgtttagaatgtatcagcaaatctactgatgtgaaaaaaaaaacaagacgaaagatccgaccacaacttgccacgtggtaaccacaatttaacttgttgccggtacgtgtgtccacgcgctactatgtaaccgtgaccgtgacctagcttttttagtttttactccaactggaactggttatggatactttgtcacggacgttagttaataaatgttggcgtccgttaatcagaatttttgaagtaaataaaatatacaaaggtgttattaaaaatctgaatctaaaaatgaaaattaattgactaacactaaatgcctaattattttatttttctgatataatccttttaaaagtgaatgtatctggacaatatggtggtaacaattgagaatctaaaattaatccgccagcatatcccaaagctgtaattaatttaacgggatttagggtttctccgttacacaaaacgccgttaatcctttttcaccatcatgttgtcatattttacattttgtcgtttactccgtcaaaaagtcaaagtctctgtcaacataatgaaaacatatcactaaatataattaatactcgtgtatatatatcccacaagtcaccgagaagatgagaaatcaagaaaagggcataaa

SEQ ID NO: 6965 - DNA, 3000 bp, Unknown
  misc_feature (1)..( 3000): cDNA_ID_1816352_gDNA_ID_1621119_Annot_ID_56250 3000 nt of promoter + ATG
aaacaacttcgctatctcatctacaaccacataaaccaaaacactaaattctccaaaactcttctaaataatctataaaccacagatctataagagcatccattctcaaactacacgagagcataatacacacataatcacaattaaactacttcaatttagcttaataaaatcatctagttcctcaatttttctcaccaaactaacaagatctagatcagactgataaaaaaactcaaatcgcgagtatctaacctggattcccggcggcggaactagcgggaccttcgacgattttgaaagctcctttgagaacagaaggcaaaggaagagtgttgttaatacggcttgattgaacttcactgtaaaccgaagcacgtcctttcgcaggagcattctccggagatccgacggcggtgagatctcgtgtaacggcgagagcaggggccattgctctgtgggtgttgtttcgcttttcacctaactagtttactttcgtttcgaacctaacttttttcttccctcctttcgttcactcgtcgtcaatggagttcacttcgaggtctccgcattggggttggtgtgaatatatactctgacccaagggtttaatagtcaattcctttattaatttactcatcctacaaggcaaagggtattttagggatatcttgtataatggcctgttctatgatgttcggaactttaaggcccaatttaatttttgggcttttgagccttgagattatcgtatctagctagcttcttttttgctgtctatttttacgttttgtatgcgacgagtacacatgccttgcgtagacaccaaaccaaacacaatatagcctagtctgttgcattttattataacgaaattagtgttgtattaatgaaaatgcatgcgtgtgtataactccataagtttttaaaaagacatgtaattccatagtttactttcaccaaaaaatcaatcaagacattgaacagtaagaagaagacggtatatatgaacgttttgtaagcataaatctgaatttttttaaaaaattaaaacgttaccattgaaagtaagtattttgttcataataagtctagataaatccgaatttcgatagatatatagtttgtaaattaatacttgacaaaaaaaagaacttttcaattagtgaaagaaataacaagctcgcatgggggttattgggctaagatcactaaaagaaaagtaggtagtagtagccaccgaccgaagtatttctttctgattttttgttatcaattatcaattaatttcacaagatacgagagagataaagattgatttattttcttgttacttgatacaagattttttgtggcacgaattattataacctcaactttaacccttttccgaaaaaagaaaggtattataacctcaactattacaacttggaagtaattaatcgtatattgtgttgtttttcgtacataaagagaaagtactatcattttaaacttattttattttagtttcacttcttaatgagtttgggaatattttctaactttagttaaattatatataatgtatacttttcttaccaaacatttgatttaaaggtttttattgatttgttaaactatgaggaatattttttccctattatggaagaatccaaagataacttattgtaattatattagctggccaaggccaaccggtattatcgaagaagcaacctcataatgatcaagataatttgacagaaaaatgatcaggttaatcttcttccttcccaaaattaacaaagttgatttataatccaaaaaggaccaaaatcatatacgtatctttaggttgtggttggtaatccatgaattagaacgataaactgattttgcgattctgtcaattagttattgataatttaatttatgttttgttatttcacaatttatttgacaaaagtaaaagaaaatgatcatcatatatacatcataaattttcagtccagttaagaaaaggaaagaaaaaacttcatttcattctaattttgaatattactctaagtcaaaactataagtcaaattcaaattctctcactgaaaataacatatttttacttgatatatatacatcagacctacttgccaacacccataagaacgaggaaataatcatgcaactcgaagatgcaagatgttggtgatgaaaatcatcctcttgtatatgttaccatctacaatatatataaataaattactcaacatggaatttgtctcctcatcctgctattatgcaaaataagaaaatctatctgtcaaatagtagaattacaagcacaaacgattttctatttattgcttgtacgcattttacaatgacttagtcattccctattcatagtgattcaaataaaatgatcaatcatacataactagataaccaaaaatccaaaatcagtatattgtaatattgttatttgtcgagattgatcgtatattacacatcatccctagcctttttttttgcatctaatgactccacaaagcaccagcagataaaaaaactcttcgagtctttacttgtacgaaccttataaacaattattcatgtttttttttaaaaaggcaaaagaaataaccaatagaattgtagaactagagatacaaatggaaaacaccaaattttatcccatctcaaaagcaggagagtaaggtccccccaattatattgcacacacacaaatacaacttccccaaactctttttctttctaataagaaaaataatttttatatttagcaactattatctaaatgacccaattatgtgatcttatgactctatgatacttatctatcgttttacttaaaaaattatttaaaagacttaacatttgttttattatttgcgcctataaatagctagcgaccctctctcaaccccttaactcacacatttagcatcatcaaggatcgaaaacattaagtagctagttaagagagagagagagagatg

SEQ ID NO: 6966 - DNA, 3000 bp, Unknown
  misc_feature (1)..( 3000): cDNA_ID_1816348_gDNA_ID_1621119_Annot_ID_56251 3000 nt of promoter + ATG
agaaagtgctttcccaatcgacatcttcaacttcggtctcgagggtatctaaacctttggaacgaagcatttctttgaacttttgttccatatgtttcttgtagtgttcctttgtcatcctctcaatgttgtccattagatcatatggtagtccatggttcaccagctgaaataacgaaactttgaattgtaacgtccattttcggaaaaaaaaaatgtaagggaaaataatttgattatttttcaaaataataggttttatgtatatgataccaaagaatatctaagaaagaacctaaattccctgataatcaatcagcaagagaagagagacaagaacctcgaagaagccccagttttgacaagcatcgtcgatcaaagccatggtttggtctctctcttcaccattgagcttagacaagtctataactggaaacttaatgttcatctccatctctctctctctctcttaactagctacttaatgttttcgatccttgatgatgctaaatgtgtgagttaaggggttgagagagggtcgctagctatttataggcgcaaataataaaacaaatgttaagtcttttaaataattttttaagtaaaacgatagataagtatcatagagtcataagatcacataattgggtcatttagataatagttgctaaatataaaaattatttttcttattagaaagaaaaagagtttggggaagttgtatttgtgtgtgtgcaatataattggggggaccttactctcctgcttttgagatgggataaaatttggtgttttccatttgtatctctagttctacaattctattggttatttcttttgcctttttaaaaaaaaacatgaataattgtttataaggttcgtacaagtaaagactcgaagagtttttttatctgctggtgctttgtggagtcattagatgcaaaaaaaaaggctagggatgatgtgtaatatacgatcaatctcgacaaataacaatattacaatatactgattttggatttttggttatctagttatgtatgattgatcattttatttgaatcactatgaatagggaatgactaagtcattgtaaaatgcgtacaagcaataaatagaaaatcgtttgtgcttgtaattctactatttgacagatagattttcttattttgcataatagcaggatgaggagacaaattccatgttgagtaatttatttatatatattgtagatggtaacatatacaagaggatgattttcatcaccaacatcttgcatcttcgagttgcatgattatttcctcgttcttatgggtgttggcaagtaggtctgatgtatatatatcaagtaaaaatatgttattttcagtgagagaatttgaatttgacttatagttttgacttagagtaatattcaaaattagaatgaaatgaagttttttctttccttttcttaactggactgaaaatttatgatgtatatatgatgatcattttcttttacttttgtcaaataaattgtgaaataacaaaacataaattaaattatcaataactaattgacagaatcgcaaaatcagtttatcgttctaattcatggattaccaaccacaacctaaagatacgtatatgattttggtcctttttggattataaatcaactttgttaattttgggaaggaagaagattaacctgatcatttttctgtcaaattatcttgatcattatgaggttgcttcttcgataataccggttggccttggccagctaatataattacaataagttatctttggattcttccataatagggaaaaaatattcctcatagtttaacaaatcaataaaaacctttaaatcaaatgtttggtaagaaaagtatacattatatataatttaactaaagttagaaaatattcccaaactcattaagaagtgaaactaaaataaaataagtttaaaatgatagtactttctctttatgtacgaaaaacaacacaatatacgattaattacttccaagttgtaatagttgaggttataatacctttcttttttcggaaaagggttaaagttgaggttataataattcgtgccacaaaaaatcttgtatcaagtaacaagaaaataaatcaatctttatctctctcgtatcttgtgaaattaattgataattgataacaaaaaatcagaaagaaatacttcggtcggtggctactactacctacttttcttttagtgatcttagcccaataacccccatgcgagcttgttatttctttcactaattgaaaagttcttttttttgtcaagtattaatttacaaactatatatctatcgaaattcggatttatctagacttattatgaacaaaatacttactttcaatggtaacgttttaattttttaaaaaaattcagatttatgcttacaaaacgttcatatataccgtcttcttcttactgttcaatgtcttgattgattttttggtgaaagtaaactatggaattacatgtctttttaaaaacttatggagttatacacacgcatgcattttcattaatacaacactaatttcgttataataaaatgcaacagactaggctatattgtgtttggtttggtgtctacgcaaggcatgtgtactcgtcgcatacaaaacgtaaaaatagacagcaaaaaagaagctagctagatacgataatctcaaggctcaaaagcccaaaaattaaattgggccttaaagttccgaacatcatagaacaggccattatacaagatatccctaaaataccctttgccttgtaggatgagtaaattaataaaggaattgactattaaacccttgggtcagagtatatattcacaccaaccccaatgcggagacctcgaagtgaactccattgacgacgagtgaacgaaaggagggaagaaaaaagttaggttcgaaacgaaagtaaactagttaggtgaaaagcgaaacaacacccacagagca

SEQ ID NO: 6967 - DNA, 3000 bp, Unknown
  misc_feature (1)..( 3000): cDNA_ID_1974557_gDNA_ID_1621119_Annot_ID_56252 3000 nt of promoter + ATG
actatcattgtaagtaaatgtttaacaaaatttcttgaagttgcatcatttctattgtgccctatttgtttacatgctgtatcacattttcattgcagttgtaagacttatgggtcgtgctgcttcccacattacgcttgagtgtgctttacaaactcacccaaacataaccattattggagaagaggtaacgtttttggttgacttcaattcaaattaccgtaaagatatctgaatcttaatcgtgtagatgatagaattagactgcaaatcagattcatatttgtgacacttttccattgaagcaaattattcatttcaatatggggttattggttcagagagacctcacacatgcctcattagatcagtttatatttactcaactttgatctggaaatacttttttgcaggtttctgcccagaagcagactttgaagaatgtcacagactacatggtggatgttatctgcaaacgtgctgaacttggttacaactacggtgtcatactgattccagaaggtctgatcgactttattcctgaggtgtgttgtcattgtaaaaaaatagaatctactacttttaaaccgattaatataattgttcttcttaactgatgattaattttatttcatgacttctcaggtccaagagctcattgctgaactgaatgaaattctggcaaatgaggttgtcgatgaaaatggtttgtggaagaagaagctcaccgagcaatccctgaagctgtttgatcttctgcctgaagcaattcaggaacagctgatgcttgagagagacccacacggaaatgtccaggtaattgatcatggtcctgtctcctcgtactaaatttccaccacaatgcagttagcttcatctctcacaaatcattattaataataccatgtcctcatctcaataggttgctaagattgagactgagaagatgcttattcaaatggttgaaactgaattggagaaaagaaagcaagctggtgcatacaagggacaattcatgggacagtcacatttcttcgggtaagttacgcaatttgttctttcagttaaccaaatcgttatataatacattgcttatttattgatgtgaataatacaagcttgatttatggtttgtaatcaacttgaatacaggtatgaaggaagatgcggcttgcccacaaattttgatgccacatactgttatgcacttggttatggcgctggagtactcctcaacagtgggaagaccggactaatttcttcggtttgtactccaccatttccactaaaatctgttttccatctgtgatcataatagcctttggtaaactagtatgtgcttagaatgagatgagttaacttattggcgcaggttgggaacttggctgctcctgtggaagaatggactgtaggtgggactgctctcacagccttgatggatgtcgagaggagacacggtacagaaatataaatcaataaagcttactaagacacattttgaaatctagatattaaaaaatcagagttgatttcaacttgcaggtaagttcaagcctgtgatcaagaaagcaatggtggaacttgaaggtgaccctttgattcccttcccttttcatagttttcgattggcggttagattgtcttgctgactgtctttttgagctctgcaggtgcaccatttaagaaattcgcatcactgcgtgaagaatgggcattgaagaaccgatacatcagcccaggtttgttgcatgtttcttgtctttttttgacaaaccatctgttgtgtttcagattctaatccctttgcgggaatgttatcgacttgcaggtccgatccaattcactggacctggttcagactctctcagccacactctacttcttgaactcggggctcaatagtctctcgactaaccaccattcctttgcttttctgccttccttggaatttcgcatcagtcttgttttatcttgaatattacgtgtccgtaacatttcgattaagttgattcctctcgtgtttcttcaacatataagataattataatattatttctctcgtgtttcttcaacatataagataattatactacatggtctaaatttactacaaagatctaaagtcggagtctgtctagaaaaaagtcctttgcgggtctattaggaaaatcgtaagctactttttgtcaacatatgcgttacttgaatttttatgatgtttttaaagtacaaatttagtttaaggctaattattgtttcaacacactaaaagtcctggtaggctctatatacacatcaaggtcagattctaattttaatacaaagttctaaagtcagaattcaaatttaatacaaagttcttttggtttctattaggaaaatcttaagctactaaaatcaacatatcgttacttgtgaggttaactgttaaaccaccttttgcttaccagtaaaccctattaaaagaaaatagtaaaacctaatgctggtaggttctagagatacatcaaggtcattttcatatcaaattataccggtaggttgctttgttaacgggtctattatttgcttcttgaaagcaaaacaacacataacttttacatgtatgttaactgtttatagatcctaacttagcaagtgaaatgatatttcaagtggtgccttggtggaatgttaaattgtgataaattaaagatatttataagaagaaataaaaaacactaaggttgtttctgttaatagctaaactataggactaacattaaacgttaatgatgttcgaagttttctaacgaagagaataacagacacactgaaattcaaataatctctctctctctctctctctctcactatcttcgttaaattcggcaaagctttcgctttcttatttatggaaatttctttcatcctttagtttagtctctctctctctcccttttttgtcaattcagagacagagaggagagagagaccaagaaaaggagacttttgttgatc

SEQ ID NO: 6968 - DNA, 3000 bp, Unknown
  misc_feature (1)..( 3000): cDNA_ID_2044033_gDNA_ID_1621119_Annot_ID_172014 3000 nt of promoter + ATG
ggtccaaaaccaagaaaagcattagaatacttctcctcagggatatctcttttcctcaacagcttcataccaaagacctcagtgtaaaacctggtgagacaaataaagaatatcttaaaatgtaaaataactcctgttacagaaagataaagaataaggtattaatgaaaaagaaaaagacatactcaatggtgcgatcaagatcaccaacgcggtagacaacatggagaaaacgacggttatccttcttaggccattccaacaaatcagaagcctcagccatgtttctagaaagaagaaaacttgattcagctgctctcattgaaacaaaatgtacattacaaatcgagataaaacattgacacagcctcaacatagaggcggaagcaatctcattcatttcccctataaacttgctctctcctgataaatttaacgaacaccatcaactctagatttacatttaccaggattcttataaaacatcactaatctcaacttcataagcattttcaacccaaaaaggtctcaactttaacatacccaaaatcatgatgcaccaaatatgaatcttattataagttcgccgctattatataatcgcaaaacgatcaacaagaacgaacggaattgtgatttctcaatgatcatcacaacacaaagaacaattacattctataaaaatcccactaaattatcgatccacgaatcctgtcctaaattagatccggaaaacaccggatcgctagaataaaattccactattgaatcgagaaaaaatgattaagaatcacaaaatctagaacatgatcaacgaaatgtttagaacttgatcatatctgcaacagtaaacacacctgggaagaagatgtacggtacaaaaaagctaaaccactctcgagtaggtgagtaatccagtcattgttggcacaatcgtcgtcacttaaataggagtttgtagaaactttgccgacaatgtctttgctactgcctgtgacatagttagatcatcacagacgcgttacaaccgatggatgagtgtattattgtgaaaatatggtgaacgaccgttacggttataatctaacagccgtgtcatgggatgacacgtggcggcgtgaaacaggtgttaaaaacatgcttctgtaaaccgtctgtttacagtgtgcgacacagactcgagcatagagaaagaatctcattcaagtagaatcgtgtttcatgtgattttggaaaggcattagccaaggcccacacaaaattgtgaaattagaatttagcgagggagtgaagcccatcagtccgtgaaatgggatctcagcccatttagaaaatattttatttcttttgtttatatatattttctggtgttttgtatgaaatttggacgatgtcttattcacgacacatcataagctttctttatcgacatgtttggttttgaaatggaatcattttcttcattcttctttttggcactaccataaaaagaaggctttttatgcattaaattttaaaagtaaaaacgataaaattggcttcacattgaatcttttgaagccatgcgtagtgtataccgagactacattatgaaaacgacacacctcttagcaatgcggtaacggattgtaaattttaaaatcaaaccctttgtataatttcaatatatataactgtagatttaataattcctataaacagacgaaaaagtgtcacggttcattgttattttgttttccgtaatgaaaatctgtttattttatttatataaaggagataactaaattgtttcaggagattggcatatactatagcatataattcagtgtgatttcatgattcaaagagtgtttgtttattgacatacatacatacagaaagctttcctctttttcagagtttgtttctttgtttgtttaatctgttatcttatgttacatatggatctctatgttagtatgtttgttgggttgctgtatttttttttttttgtcctctctttcttctcttgctcgactagaaagaagtctacaactttacaaaagagactatgtaaaagtgatacaaaaagagaaaatgtattcattttgtctaacataatttctttgtatataagttccctttaaacagtttagtcggtgcaaaaagattcaggctaacaatattacttgttacgttttcttgagacatctatttttattttttttcttgtattgtttgagatgagaaaaagtgttatcaacaaataaataaaatgggccattgtcttcttgctgttcagcggaagcatgggttatattgtaattctctgtttgtcaacttgtaattcaatgtgtttgatagatatatttcaatgaccggaaaataaatacatagagaaaacacctacataatataatagtataattcaactaaaggccattgttatatgctttcaattgtccacttttattacatgtggtcaacaccaacatcccatttccaacccaatatacaaaaccaaaataataataaagaataatattttttattttattttatcttaattgtttgaagaactattattttagacagagtctttttgtgtacaagcaattcaactttatttaatttggttttttacaaaatttatggatgaaagaaaatattccaaatggaccaaatctattaaagattacatagtgatgcctagctggtgcttttatcggaattcaagggcattacggtaaaatatcacatatggtctgaaaaaaaaacagtttgtgtggggaggagcgagcagagtcggttcacgtgaaagcacagagacataaatctttctttcacagcctaaaacccctaaaaatgtctaatctctcttcttcttctccgtttctctttagattatctcaaccatacagccataaatccatcggaagaggaggaagataatgcaagaatcagtcgctgagtctgaatctgaaggggaagagttgcacaataagctcaagctcctcttca

SEQ ID NO: 6969 - DNA, 3000 bp, Unknown
  misc_feature (1)..( 3000): cDNA_ID_1013977_gDNA_ID_1621119_Annot_ID_172012 3000 nt of promoter + ATG
aaaatcgaaacttggcaatgatttctaactaaggtttaagaattcactaaatgggttttgtctagatttggattcgaaacaaaagaagtaatatttagccaagtgttaactcaaaaggagaccaaaaaaacaattttttatttgaaatatgtaaaattcgtcaatttgggggaatttgaactgaaaagtggaattgtttggtgaacttaccagaaatcaaaagaagagtgaagaagaagaagagaacaggaacggtggaaaccatgctagtgaaagccattgaagaggagcttgagcttattgtgcaactcttccccttcagattcagactcagcgactgattcttgcattatcttcctcctcttccgatggatttatggctgtatggttgagataatctaaagagaaacggagaagaagaagagagattagacatttttaggggttttaggctgtgaaagaaagatttatgtctctgtgctttcacgtgaaccgactctgctcgctcctccccacacaaactgtttttttttcagaccatatgtgatattttaccgtaatgcccttgaattccgataaaagcaccagctaggcatcactatgtaatctttaatagatttggtccatttggaatattttctttcatccataaattttgtaaaaaaccaaattaaataaagttgaattgcttgtacacaaaaagactctgtctaaaataatagttcttcaaacaattaagataaaataaaataaaaaatattattctttattattattttggttttgtatattgggttggaaatgggatgttggtgttgaccacatgtaataaaagtggacaattgaaagcatataacaatggcctttagttgaattatactattatattatgtaggtgttttctctatgtatttattttccggtcattgaaatatatctatcaaacacattgaattacaagttgacaaacagagaattacaatataacccatgcttccgctgaacagcaagaagacaatggcccattttatttatttgttgataacactttttctcatctcaaacaatacaagaaaaaaaataaaaatagatgtctcaagaaaacgtaacaagtaatattgttagcctgaatctttttgcaccgactaaactgtttaaagggaacttatatacaaagaaattatgttagacaaaatgaatacattttctctttttgtatcacttttacatagtctcttttgtaaagttgtagacttctttctagtcgagcaagagaagaaagagaggacaaaaaaaaaaaaatacagcaacccaacaaacatactaacatagagatccatatgtaacataagataacagattaaacaaacaaagaaacaaactctgaaaaagaggaaagctttctgtatgtatgtatgtcaataaacaaacactctttgaatcatgaaatcacactgaattatatgctatagtatatgccaatctcctgaaacaatttagttatctcctttatataaataaaataaacagattttcattacggaaaacaaaataacaatgaaccgtgacactttttcgtctgtttataggaattattaaatctacagttatatatattgaaattatacaaagggtttgattttaaaatttacaatccgttaccgcattgctaagaggtgtgtcgttttcataatgtagtctcggtatacactacgcatggcttcaaaagattcaatgtgaagccaattttatcgtttttacttttaaaatttaatgcataaaaagccttctttttatggtagtgccaaaaagaagaatgaagaaaatgattccatttcaaaaccaaacatgtcgataaagaaagcttatgatgtgtcgtgaataagacatcgtccaaatttcatacaaaacaccagaaaatatatataaacaaaagaaataaaatattttctaaatgggctgagatcccatttcacggactgatgggcttcactccctcgctaaattctaatttcacaattttgtgtgggccttggctaatgcctttccaaaatcacatgaaacacgattctacttgaatgagattctttctctatgctcgagtctgtgtcgcacactgtaaacagacggtttacagaagcatgtttttaacacctgtttcacgccgccacgtgtcatcccatgacacggctgttagattataaccgtaacggtcgttcaccatattttcacaataatacactcatccatcggttgtaacgcgtctgtgatgatctaactatgtcacaggcagtagcaaagacattgtcggcaaagtttctacaaactcctatttaagtgacgacgattgtgccaacaatgactggattactcacctactcgagagtggtttagcttttttgtaccgtacatcttcttcccaggtgtgtttactgttgcagatatgatcaagttctaaacatttcgttgatcatgttctagattttgtgattcttaatcattttttctcgattcaatagtggaattttattctagcgatccggtgttttccggatctaatttaggacaggattcgtggatcgataatttagtgggatttttatagaatgtaattgttctttgtgttgtgatgatcattgagaaatcacaattccgttcgttcttgttgatcgttttgcgattatataatagcggcgaacttataataagattcatatttggtgcatcatgattttgggtatgttaaagttgagacctttttgggttgaaaatgcttatgaagttgagattagtgatgttttataagaatcctggtaaatgtaaatctagagttgatggtgttcgttaaatttatcaggagagagcaagtttataggggaaatgaatgagattgcttccgcctctatgttgaggctgtgtcaatgttttatctcgatttgtaatgtacattttgtttcaatgagagcagctgaatcaagttttcttctttctagaaacatg

SEQ ID NO: 6970 - DNA, 3000 bp, Unknown
  misc_feature (1)..( 3000): cDNA_ID_2044045_gDNA_ID_1621119_Annot_ID_172008 3000 nt of promoter + ATG
aatttaagaatgtataaaaccaacaaaaatatgtttaagaatgtaagttttgtgtatcacatcccatgttttaaggttgttaggaatctcacatgcacattgaaaagagactaacactaattaatgtacgagagttgattgatgctatgtttaatctctttgtatacaaatacatatcgtttgacatagaaatacaaatacatatcgtttgacattgtactctttgaaaagagactaacactaatatgttagtaagactaatttatatttagctacattgtactcaaggtcctatatccaaagttttatctgcatttattgcacacttacattacgtatgtgtgtgtatacataacagcctatatatatggtcttgtaacacagctcagggattcaccataaacaaaaagaatttgaaccaacaaagcaaaacatgaaaggcacattcactaacttgcttgtgctccttctcattgcacttgtttgtgccaatgtcggtgctaggaaacttatctccgaagatacccaattcaaggatgaaaaatctttcctcggaggcggtggcagcggtgatggcttagggcttggccttggtggaggagctggtcttggtgggcttgggattggggctgggatcggcgcgggagccggactagggttaggtggaggcggtggtggactcggaggtggtggcggtggactcctcggtggaggcggctttgggggaggagccggtggcggactcggtggccttccttgaacgtattgacaagtgtgcgtgtgagagctgattctcagcttattactaattaattaagttactttcattctcttaataaaatctagagggtttgaatttcggatttcttcagctttaatttaaacttcaatatttgaaccaaaaaggtcttgctactagaggtaatgctcgtaatcgtattatgtgtaacgccggttctgatattcttaagtgcaagtgtggaacgtttctcttttattcactatatagcattactttcttttttcttgtttatatatcgctaaacaaaatgtatttttaatttgttttgaacaagtgtagttataacgccgaaaaacgattggaagaagtagcatataacaaaacaagcttatattctatccgaagtaggaagagaaaaagaactatatatggattgtgatcatgacccctcctcatatataaacaatgctatgcttacattcttaaacatgtgattttagtccagtggtttcatctttactgtcatgacatatgatcataaatatttttgcaagaggcacacatttaaatttactatgtatatagttattcctacaactaggttagtgaatggagatgccgtgatggttaaggtaattaataagatcaaattaaccgcgactaaaacacaataccattatttttggtcccaaacccaaatcatatttttatacatccatgagacctagatatgaagatcagatccggtctagccttgtataaaaagtaccactatactaattattcttcttcctcttcctcttgtgtttgttcttgttcacgtcttccgttagtagccttttttttttctctacaaggttttagatcttattagggaaagtgggaaacgaaaccccatgattctagagattagaaatcacaacgttatcagatatataaaactgagggttcacaggaaaccatttcgacatctgcttggaacaaaaaatgcataaggggtcaaaattacccaaacaaaactacaagtgagaaagggaaactacttgtggctagaggttgttaaaagacaatgacaaaatctattgaaggggttcgttttaatgggcctggtgaaatctcaaacccatcttccccggcccggtattacccaaaagaaaaaaaacagagagggcaatgagccgttctggttttcgatagagcgagagagaagatagaaggattcagaaggaaagtgttcgaaatgccgatgatcacattcacgttattgatggttgcatagaacagaagatcacaatgaacatacaatgttaagtcacatataagcaaacaacaagttttaaagcagcttcattacccatagtagttgattttaaatatatttcttgaatacttgataacttaagaatcaaaccgtgacaaaggaaatgttattttgaatcctgtttcaaatttaagtcaatgtactgtattctttttttttggaataataaatggataaaaatgtctacaactccaacatttgatgaagcaaatgttcctttttcatttttggtgatctacaatacctaaaagtttatttagatttttataaaattttgaaaaataagaagataaagattgaacaattacttaccactcaatggggatgcggttgctttggccttttcttcgtttggctgatgatgattcctcttccatcaccaaccccatctctttcttcacttttttaattcacaaatctctatttttaaatctcattaatcctacctaaatataaatatataaagtcccttttgccattgatagcaacaaaatcatcaattaatttgcaatataacacacacttactactacatagtagtttgaggaatctgggaagaagctccagtggcaaagactcaacatttgtaagatttctacacaacccatttcagtttttatgttttctattcacagattatttcgattgcagacaacatttgttttcttcttctttctgataatacgattttcgattcgatctcattgcgattattaagttttctgattgtttcagatgctatattatgaatcttaatctgatggttgaagattcatagatttaaaaatgctatctttttgcctatagagcctttatatgaatctcctttcttcattccatagcttaagagtttatcgaatccagttgaatttgaaaagatgcatttttggttattgattttgagtgttcttgtatcaaacttgttgtgtagaagatg

SEQ ID NO: 6971 - DNA, 3000 bp, Unknown
  misc_feature (1)..( 3000): cDNA_ID_1816304_gDNA_ID_1621119_Annot_ID_172007 3000 nt of promoter + ATG
acccatagtagttgattttaaatatatttcttgaatacttgataacttaagaatcaaaccgtgacaaaggaaatgttattttgaatcctgtttcaaatttaagtcaatgtactgtattctttttttttggaataataaatggataaaaatgtctacaactccaacatttgatgaagcaaatgttcctttttcatttttggtgatctacaatacctaaaagtttatttagatttttataaaattttgaaaaataagaagataaagattgaacaattacttaccactcaatggggatgcggttgctttggccttttcttcgtttggctgatgatgattcctcttccatcaccaaccccatctctttcttcacttttttaattcacaaatctctatttttaaatctcattaatcctacctaaatataaatatataaagtcccttttgccattgatagcaacaaaatcatcaattaatttgcaatataacacacacttactactacatagtagtttgaggaatctgggaagaagctccagtggcaaagactcaacatttgtaagatttctacacaacccatttcagtttttatgttttctattcacagattatttcgattgcagacaacatttgttttcttcttctttctgataatacgattttcgattcgatctcattgcgattattaagttttctgattgtttcagatgctatattatgaatcttaatctgatggttgaagattcatagatttaaaaatgctatctttttgcctatagagcctttatatgaatctcctttcttcattccatagcttaagagtttatcgaatccagttgaatttgaaaagatgcatttttggttattgattttgagtgttcttgtatcaaacttgttgtgtagaagatgagaggtgggagtctatggcagctagggcaatcaataacccgtcgtcttgctcaatctgacaagaaggttgtgtcacgtcgctactttgcctctgaagctgacctgaaaaagactgctctttacgacttccatgttgcccatggaggaaagatggttccttttgctggttggagtatgccaattcagtacaaagattcgattatggactcaacggttaactgcagggaaaatgggagtttgtttgatgttgcacatatgtgtggtttgagccttaagggtaaagattgtgttccttttcttgagacacttgtggttgctgatgtggctggtttggctcctggaactgggagcttaactgtgttcacaaacgagaaaggaggtgccattgatgactcggtgattaccaaagtgacagatgaacatatctatttggtggtcaatgctggctgtagggataaggatttggctcacattgaagaacacatgaaggctttcaaatccaaaggaggtgatgtctcgtggcatatccacgacgagagatctcttcttgcccttcaggtttggccattataagattcttctcttggtttgttctgttattgctgaatacttgtatatacagttcatgagttatcttgaaccttgtgatgcagggtcctttggctgctccagtgcttcaacacctgactaaagaagacttgagcaagctttactttggcaatttccagattctggacattaatggttccacatgtttccttaccaggactgggtaaaatttcatgtttcactatctgcttctagtcagatttgcttggttcaagtagacaatagctcaagaggaaaagttctgaagatctcataggtaatgaatgtctctgttttggtttttcaggtataccggggaagatgggtttgagatttcggttccagatgagcatgctgtggatctagcaaaagcaatcttggagaagtccgagggtaaggtaaggcttacgggtctaggagcaagagacagtctcaggttagaagcaggactttgtctatatggaaacgacatggagcaacacatttctcctgttgaagctgggctcacatgggccatagggaagcgtagaagagccgaaggtggatttcttggcgcggatgtgattctccagcagcttaaagatggacctacaatcagaagggtcggtttcttctcctcaggaccacccgcaaggtcgcatagcgaggttcatgatgagagtgggaacaagattggagagatcacaagtggagggtttagcccgaacctgaagaagaacatagccatgggatatgtgaagtcaggtcagcacaagactgggactaaagtcaagatcttggtccgtgggaaaccatatgaaggcagcatcacgaagatgccattcgtggccaccaaatactacaaaccaacatgaaatgtgtgtctccttcgtccatgactttgtctcttgcttctgttaaatgacttgtgtttttcttctgttctgttttggcctgaaaaatgtacgatattttgccaagagggcattgcttatttcatttttattgaaataaatttaacacatgtaatagtatcagagcccatggttttaatgtgtctcgattgtggatcacccgtggatgtccagtcctgaacgtgaaggatgtgtgttagaaattagaatatgtctctcatatgtatatataagtatgtgaacaagaacaagaggaagaggaagtggaagaagaatgataagaagacgaaggcccttgacgttgttcataagttgtaataatgcagaattggattaactttcgtcttcctcttattcttcttccttgtaaaagtttcaacaacataagatagaattatcatacttcatagttcacttcatacatacgcaaaacgttgtcgtttttattgaggagagatgtcaacactgaatcataaagaaacacgtggcaagtcaaaccagttaacagatccaaacgacaacgtttaaatagcaatccgcaaaacagcagaagataaaactaaatcgtcgtcgtcgtcgtgtcttcttcgtcagcagagaagctccggcgatg

SEQ ID NO: 6972 - DNA, 3000 bp, Unknown
  misc_feature (1)..( 3000): cDNA_ID_3049419_gDNA_ID_1621119_Annot_ID_172006 3000 nt of promoter + ATG
cgaccatcggtttatgtctaccgagctttaatcgattgtctgaagaagtcaggagattttcagagtgcattgcagctttcagatgagttgaagaacacttcctcattagatttggctggtccacaagattttaagagacatttgaggtcacatagacgctaaaatagcctgtgtaaactcttcagattttgttagatatatgtatgaaatcaaacccaatccgttttactttaattgtggttctaattcaatttaaaagaagcctgagaaaatgacaatgaaggtttgaaaagagtataatggatgatactatgaccagtctcataaagtttgcatactacagaagtacaaaatgtgtcaaagtttctctttgaaagaaagaagatattttgggtgccggaatctgagacttgagtccggtaggggaggtcgacatatgtctggagaagtccgctaaattacgaaaatagccttagattcctccttttttttttaccatagcttgttcttgacccagaaaaggaggaagactacaccgaacacaattgcgactggtgcccattttcggatcaaagcctggtcaaccaaattcaatgtttcataaccatatgttaactatctaagctacaatatgtcaagctcacaaggaatgagagcatctcatagccgtgtgatcaatgttgcaatgtgtaatataaggtaatatacaatcaaactcacctgacggttcaaatctttagccttatcagcatatatacgagattcagatgttaaccggctcgacatctcgctcacctctgcattaagaaaaaacaagaagagaaaatggcaaatgataagcatattgctcagctgattataacaaacgcaaaactagtgttccatttctccttattctaaaagcttaaataatgatcataggagaagtaatggatgttgacttacggtccagcttttcaccaacacctaagacttcttgcacattccgggtcattatttgatgaacctcatagagttcatcattcaacttggcgatgtttcgttgcgtacgagtgtcttggtacagtttcttggttttctgtatgaatgtatctacaaaaaaaggcaaagtggaaaaagagtgaatccagagaggtatgtttccaagatactgaatgtacagaaaaatctacactacacataccaaatttaataaaggcataaggccgagcagctgtttcaatgttaggcccattgacacgttcaaattcattcttgagatcttccaggtattggaaagcgagtttctttgggtaagagcggtcacacattgtcaagtagcaaacacgtccttctatgatgtaactaaagttttctggtcaaggaagcatacatatctggtctttcttaaactttagctttgagatacaagcatactaatatgacaacgtagatttcaaacataatgcaagaggattgaaacgtgtactaagccaaaaactggtaaaaatgtacaaggatgtcaaaagtgtgaatcttaagtaaatcaaagtaaactttctacaatccttattatatctatcaatcaacaaacttttgcagcagaaactgaactaataaggaatgaagaaaaaaccagaggttaaggatactggaaaacataggggccagtttcaacggacattcttgaagcgtcattttgacctctggacagattcttaaacaaagctttgacctgttgtttatacatatctgaatccggtaagtcacgtccatcatcgagcccctcagctagaggtaacccatcagtaacacgagctatcaatgtcattttcaccatctttgccttattacttctccagtaataaaaattcactgcaattatcacaaatttcaaaacaagaatatgaatcctgcaactcactaaaatcacaaaaccaatatttatcatcaagacagaacatgtaagccaggtaattgaaacacagatgcttaaaacttgggttctgtaagaacacacaatactctaagaagatgaattattttgatttttcaacaatgagtgttcgaaatagcttatctctatttgcattcagatattgaacaagacgaactattcaaacgtgagattcaaatatagcagagaacatcaacctcaaagaaaattctataatcaaaagctttcgttttctacattgtgacaattcaccaccatcaaatccaaagtttataacgaatttcagcataatccacattcatcatctacggaaagaaaattaacgatctaataacaacatcaatacaagacatcaaacggaaaaattgattcaagagctacacagtaaagtaatatcttcagaacgttctcaaagttccgatcccaaacggaagcaaatctcatacaaaattgaacaaatgtaaaacgtaaaattagacttgagcatggatttagagaaacctgataggagatttaaaattgcttctgctcgattcaaagatctgagaaccagaggaagacgatgatcgaaggaaagagaagtaatttgttttttttttcaattaaagggtttatcaaacaaagggactaaatgattatttattgattttcttttctttttttgtctgttcgaaatttaatttatggcgatctacgttttgcgattaccaattaccagccctcacgtgattgggcttatgacgcgttttgttgacatgtcttgatgacgtggctcgtttaattagcttcacaaacgctacattcatcttagcgtttttaaaactggattgaaccgatcaaagcgtcttaatgacccggataataccggaacaattttctaaaaccggtgactttcccttttattgaaccgaccggttcatttattaaattgaaactctcttttacatttagagagtaacacattcttctccgacgagaagatcgaaaatcacaaatcgtcaccggactcttgcaatcgagaaccatctgtcgcctttttatactcgaatacgagctcgtgatca

SEQ ID NO: 6973 - DNA, 3000 bp, Unknown
  misc_feature (1)..( 3000): cDNA_ID_1022478_gDNA_ID_1621119_Annot_ID_172005 3000 nt of promoter + ATG
cgatatgaagagctcaggccgagacttcatgtaactcataatcgaacacacagctaaagagagaattggggatgcgagcagaaagtttgggagctgcttaaactgaaagtatttaaggaaacctactcccctgtcagaaacaagaatctctaaatcaaatataagaaagaaaatttacaagaacaagaaaaggtttgtgttcaaagtattaaccaataatgactttgaatgaagttatacagcaacggaatccttcctttgcaccaaggcctcacttcatcacgcgtatgtccatggcagatgttatagtatccgtatgcttgaaatgcgacaaaaggaagacaaatgcatatgcatctaagaaatccagcaataaaaacctgcatagctaactgggtagcgagaagaatcattaggctaccatacctttaaagagttgacagcaagttaaagagacaggctttaatcattacatgattaaccaagcagatgtgatttgagacatactaaatcaagaaactattccagtgcaaccatgaactaaagagcataccagcagaacagttaagtaggaatccatcagatagagatataaagaacaaagtaactaaaaattgttcgagttctccttttctatcttctagaaggatcttaattgtaggaaatagaatgtttcagattaagcatactaccgaaaaaatccggagtttgaattgcagcaatagttctgaaatttgaatgaaatatgtataacttacataagcacgccgtttctgatataaagcttcatatgctcgatgcattgtctggaaacagatataaccagcattaagaattccattggaccttgcacagcctgagagagcaaaccaaagaacgcctacattgctggtaccagataacaagtgatacactcctccaatagagaaaagagcatacaaactttctgaatatctgaaagtcacaaagaaacagtttggtcttcagttagttaccattctgataagactgaacatatttactttcagcaaatgaacttaagagatcattggcttaaacacattacattgacgaataaaatatggacgccggattgaaacagaagataatcgaagctctgaatgatgcttcagtatccttcaagataataactgaaaccctgttagcaacgactggtgtaagacacggtgaatagcaaacagcattagcttgtagagctcaaaagactcttgacttgacttatttctagacacaataatcgatttaggatgaatgtcaaagaagtacctaaatagatagatagcagcaaatatgaacgccaagttactaacagtgaaaccagacaacaccatcacagctcgaagaccaatcaatggaaccaaaggcgcaaaaactgaatccaaaaagaatcagttactaccggaatgatacaaccaaagtaaggaatcaagtgggtagatgtctaaattacaaaacctgtgcgagagagaagcgagatgaagaaaggaagcagaggcaagaaggcgtaagtctgctcatactcatagccacactctgtgattcggagaaaataaacactgtcccagacaacactgttctcaagggatctcgaagctgcattggctactagaaacggaaaagaatcttctttgtgatacaagcaaggaggattcagtgcagcggatgtatcgtacggttggagtaagctccgccacaaaatggttaagaagagaacgagaagtcgcgagaagatggcgtatttgatcaagatggtttctttccttgatttcgagtttgattccaaagctttcgccattgatcacgagctcgtattcgagtataaaaaggcgacagatggttctcgattgcaagagtccggtgacgatttgtgattttcgatcttctcgtcggagaagaatgtgttactctctaaatgtaaaagagagtttcaatttaataaatgaaccggtcggttcaataaaagggaaagtcaccggttttagaaaattgttccggtattatccgggtcattaagacgctttgatcggttcaatccagttttaaaaacgctaagatgaatgtagcgtttgtgaagctaattaaacgagccacgtcatcaagacatgtcaacaaaacgcgtcataagcccaatcacgtgagggctggtaattggtaatcgcaaaacgtagatcgccataaattaaatttcgaacagacaaaaaaagaaaagaaaatcaataaataatcatttagtccctttgtttgataaaccctttaattgaaaaaaaaaacaaattacttctctttccttcgatcatcgtcttcctctggttctcagatctttgaatcgagcagaagcaattttaaatctcctatcaggtttctctaaatccatgctcaagtctaattttacgttttacatttgttcaattttgtatgagatttgcttccgtttgggatcggaactttgagaacgttctgaagatattactttactgtgtagctcttgaatcaatttttccgtttgatgtcttgtattgatgttgttattagatcgttaattttctttccgtagatgatgaatgtggattatgctgaaattcgttataaactttggatttgatggtggtgaattgtcacaatgtagaaaacgaaagcttttgattatagaattttctttgaggttgatgttctctgctatatttgaatctcacgtttgaatagttcgtcttgttcaatatctgaatgcaaatagagataagctatttcgaacactcattgttgaaaaatcaaaataattcatcttcttagagtattgtgtgttcttacagaacccaagttttaagcatctgtgtttcaattacctggcttacatgttctgtcttgatgataaatattggttttgtgattttagtgagttgcaggattcatattcttgttttgaaatttgtgataattgcagtgaatttttattactggagaagtaataaggcaaagatg

SEQ ID NO: 6974 - DNA, 3000 bp, Unknown
  misc_feature (1)..( 3000): cDNA_ID_2044057_gDNA_ID_1621119_Annot_ID_172003 3000 nt of promoter + ATG
cttccttgaccagaaaactttagttacatcatagaaggacgtgtttgctacttgacaatgtgtgaccgctcttacccaaagaaactcgctttccaatacctggaagatctcaagaatgaatttgaacgtgtcaatgggcctaacattgaaacagctgctcggccttatgcctttattaaatttggtatgtgtagtgtagatttttctgtacattcagtatcttggaaacatacctctctggattcactctttttccactttgcctttttttgtagatacattcatacagaaaaccaagaaactgtaccaagacactcgtacgcaacgaaacatcgccaagttgaatgatgaactctatgaggttcatcaaataatgacccggaatgtgcaagaagtcttaggtgttggtgaaaagctggaccgtaagtcaacatccattacttctcctatgatcattatttaagcttttagaataaggagaaatggaacactagttttgcgtttgttataatcagctgagcaatatgcttatcatttgccattttctcttcttgttttttcttaatgcagaggtgagcgagatgtcgagccggttaacatctgaatctcgtatatatgctgataaggctaaagatttgaaccgtcaggtgagtttgattgtatattaccttatattacacattgcaacattgatcacacggctatgagatgctctcattccttgtgagcttgacatattgtagcttagatagttaacatatggttatgaaacattgaatttggttgaccaggctttgatccgaaaatgggcaccagtcgcaattgtgttcggtgtagtcttcctccttttctgggtcaagaacaagctatggtaaaaaaaaaaggaggaatctaaggctattttcgtaatttagcggacttctccagacatatgtcgacctcccctaccggactcaagtctcagattccggcacccaaaatatcttctttctttcaaagagaaactttgacacattttgtacttctgtagtatgcaaactttatgagactggtcatagtatcatccattatactcttttcaaaccttcattgtcattttctcaggcttcttttaaattgaattagaaccacaattaaagtaaaacggattgggtttgatttcatacatatatctaacaaaatctgaagagtttacacaggctattttagcgtctatgtgacctcaaatgtctcttaaaatcttgtggaccagccaaatctaatgaggaagtgttcttcaactcatctgaaagctgcaatgcactctgaaaatctcctgacttcttcagacaatcgattaaagctcggtagacataaaccgatggtcgaatctgtctctgcttcatctcatcgaaaagcctcaacgattccttaacgttcccagatcgacccaaactgtctatcaccgctgtataacttagcaaatctggttcaattccacattgaaccatttcattgtatatcaccaaacacatatcgaatctacaagctttcctcatcccgtttaacaccgtgttgtaagtaatgatgtttacagatacactacaatcttccttcatcgttgacaaaacccccagaatctcattcacaaggccagctcgtcccaagatatccaaaaccgagttatatgtgatcacatctggtttacattcccactctttcatctccttaagtatcataagaaccttatcgatctgtctagtttcagcaaatgcaaagatgattctgttcattactattaacctatacggaagtgaagactctgatatctctttaagcagactcgtcaaatacgtgcaatcatccgtgttaatgaatgctctagcaaggttgagataacaatctgaactcaatggttccttacccggcaagatcaagacctctctgaagactctacaagaaagcttcatatcgttcagctcacccgccgctgcaagaaggttcttgaaaaccgaaataggcaaacatatgttcttttcttgtaaagactgtaacaagtcatatgctccagagagatttccatctcttgtaaacttctcaacaagattcgtataatcgattttgctgatgatctttgaaccactttcactatggttaacgatcttcttcaagagttcttcctcgtcttcttctccagtgtttatcaaagagtgcataccagagaacgagcagctccagctcaaatcagctggaactaacatcatatgtttctgcaatgccaataaacagaaaaccaaatcatcaatttgcagaatcaccatcaatcatcaacttccacatataactatgaacaatgtaaatctataaaaatggatttctcagttttcgagatgactacaaaaaaactcacacatttaatcagaaaacttcgtaatcaaacactagctgaagcgtgaaagccccgaaactaaaaaacgatcaaactcagaagaacagcaatggttcgaaatttcgcatcttcatcgaatcaaacattgatagaagaaactcgctgagcagtaacaatcagaaaacaacaacgagagcataacatgaatcacgaaaacggttctggatttttggaattcataccatagaaatgaaggaacctccatagacggggattctcttaacgatcgaccacttcatcatcttcctcggtaatctatctcctctctgcttgtgacatttttcagatttttgatttctgagggaattagttttggttacaattaacacattagttaatatcgagccaatttgaaaccatcttaaacctcagggaccaataagataaatacacgaaaatttaaaaagcaaaatgttatttgacagcttattaatttcctcacgacttcaactttcctccttagtattttccgacgaggaaagttcttcaaattcgctgttgaattttgtttctcggagaaattatcaaaaccctagacgatcacattatcgcttctgagatcaaagacgatg

SEQ ID NO: 6975 - DNA, 3000 bp, Unknown
  misc_feature (1)..( 3000): cDNA_ID_1397832_gDNA_ID_1621119_Annot_ID_172002 3000 nt of promoter + ATG
acaaacttcatgttgtagttatagtaaacttgcttatttacctgcgatagctcctacgcgtttatggtttacgaggcttggatctgcagaatgtatcaaaatgattgaaaatacgtattagtactatctaatagtccctaccaaaaaaaaaactatctaatagtagttaaatagttctcaatagaaattgtagttaggacgaaaagatatgaacatagacattttgacctttgcaataagtagtgacattgccttgtttacaaaggcacaaaaaatctcgtgtcctcgtattaaacccacaaactccaccacctttagtcgtttcttggcaaagaaggcacttcattgtcactggaaattcgtaatcaacccttatcccgtactctggaaactgatcatacggtgcattctccacacctgtactcctccaatacacacttgtatacgtcgcacagtcctgcagcatgagcctaagagattgagtcgctttagggtaatacgaacaacaagaaaccctagatcccaaagcagagccacattcaggcaaatgtctgcatagatagctagaactatcgcaggacgagtcacatctatctggaaacctttcgcagaagagcggttttggttcgacgataactttatcggtgttgcagttgaagaacaagtagtcgttttgaggagagacagtgaagtgtgtacttgaatcgatgctaaaagatctagtgggtcgaaaattgtctcgatcttgacagttccacatgaatggatcggagacaagaaggtgaggatcagagtagcttatagatttaacagggtatttaccagatggtgttctaagttcgagcttggtatcgttgtcggagcaaatgagcatgtgtctgtaataagggctaccacaaccgtcgtcgatggaaaaagggtaatttatcggaatgttgccgcaagaagatctgcagagatttgattgggatgatgttgttgatgattgaagaaggatggtcatgagaagggagaagaagataatgtaagagtgaagtggagacattgttcaaaaattaggagtttagatttgattattgggtagtttttagttatgagattataatttggtggtgtgaagtgttgagtaagcttggaatgtcttgttaaagagtttaagaatcaatcttgtcatgtgcttgttaatattgcttattttaggtttcggtttgtttttaaaatttcacctttctttttagtataaagtattccaagaggactcgtggttttgtttcagattatttgaaatatttacatacaatatgtcaacaaacgtactattcttttttctgatattttacaacaaaatttgttctttaacatgttatctaaaaaccatttaacaaaaaaaataaaatgtatgagaaccttataaaatacaaaatagtaatttcagtatataatagttttgaattttcttttatttagaatttcgtttaaagggttgtgatttgtgaagtaatctttggaagataatctcaatgtaaacaacacattgggcttctcataggcccaatataaacaacacattgatcattatccatgtaaggtgaactctttaatcgaaaccgttcaatttcagtcatctcaatccaacggttagtattccaaggagcacgtaatccactctaaattcgtaaacacgtgatttctcactaaatataaaacttgatacgttacgccttcctatccatccgtcaacgattaaatccaatcgttcaatatagagatccaacggctaataacgaaacattagcccacacgaaatctcctttttttttttgacgggattatacagtgggcctccacctgtaattgtccatttaggagacagcgcggttaatttagcattatccctcctcacagtcatctctttcttcgcaaataaatgtaaccatctctcttctcgttttcttcaacaaaaatcctcatttctctgagaatctggtgctttagctttggtgagctctctttcttatgaaacttatcgattctcttctcgttgattgtcttatacttttagttctctgcttaatttattgtccttaatactcgtggatttgttcataaatcgttttctgagcagttaggtaagagttttgttaccgaatttcatgttcttcgattttgaatctggatgattgtatgatgtgattagtagactcgcttagattttgtgatctgtgtatggtttgtggctaattttggtttcatcggtggtatgaatttatttggggttttaggtttgtttgattacgtaatcggactgtttacttgaagatttatcgattatagttgtgatcgtttttagttgattgagaagaagaaaataaatttcatgctcttgttattgtcgcgattgtggcgattttcagtgtcttatgaatcaattatgttgcatgtgagtcttggtgcaattgagattgtttcctttttttactagattgcttgtcttattgaacaaaactttccatttatgttgaaaaggtttataggaacggatgtttagggttttgttgtaatctgggtatttgctttctgatttcggcaagcaaatgtcgatttcaaggtttatatcactttctctagcaaaagaagtctttagtcatttgcaaagtcaagagagtttttactttatttattgcttccacgctattgcttcgtggctgattgagagagaccaattaaactaataatttgtagtttgtacaatatattgcgtgtaacattgtccttcgttatctgtttgaggaggaggaccgagttagcctatttttagtcactttacaaattttcttttatgttgcatcattcaatatgaactctctgatataaatatatgtatacatactggttgacttttatgggtatggttctctgctttttttctctgtgatggtctcttgattctaactttctttgttttatgtttttggtttttgttgtcaatgaataggtaaa

SEQ ID NO: 6976 - DNA, 3000 bp, Unknown
  misc_feature (1)..( 3000): cDNA_ID_3049423_gDNA_ID_1621119_Annot_ID_171999 3000 nt of promoter + ATG
tatgcaaataaacaaaaccggtggactgtcacacgtatattcctcaagtggtttgatcacttatcaaactctcaatccatctttaatatcactacccacaaaagttcaacaatagagtccactatctggataattgtagtattcttacccaaagatcatgatgttttcgttatctaacacctcgaaagagctctagaacatttaacaaaccaatttctctttaaatatacaaaagagaaacttttaccttttcatcatcaacactttccacggtcacaaggttaggaacaccagctgatcaaaccaaagaattaagaatagaactcaagtgtggagttttacacccaatttagtaactcaatacaaaaaaactaaagatgaggactttgaaatagcaaagtcaatttacatagcaaaggcttcactttgttgctctgcaaattcccaatgaaatgccactctatatcttctggaagctgcaaatttcaatgtatcaatataaattcagaacttttctaatccaaaagattcaatttttaaaggattcgtagaaatcatagcaagcagagagaacctgaggtgccttctcaatgatctcttgcacataattctctccaaaagacctctgaccagcgtcgtatacttggcgaatcagagaaactggtttcgtcttactcaccgctacgacccgtatctgatccgacccacgacccgctttctccgccgcctggtttacccgctgaaacaccgatctcagagccgccacaccatcaatcgccgccgccgacatagtagaatccgccacgtgttctttgtctggctcctcttcgttcatcgaacaatcactgatcttctggtcacagctttgtgggagagaaagagggaggacagagagacggataatacgctgcgtttcgatgttttaattttcaatgaaaaaaaaaacattcgccacgtttcgaaacagaggaacaatgttgatttttccccaaaaaaaaaaggaacaatgttgatacccgtgagaagttaaacgaatgtactgttgcagatgtattgctaaattatggatgtagattaattatatacgtagttgtaaatactaaatagttttgaaaataaataccagtgggaaatatttttttcataaaacaaaaactatatcctaaaaaaaaactagaacctaataaccccaagcatcatgtgtaaatttgtgtttttgtatataagcaaatggcaattttgatttttttttcttgacaaatgggcaaagtctataaaccatcaaaataagttctttattcgtaattgattccacaaacctttgatattcattttgtcttcataagttaaatttgtgtttttgtacatttattgtcacacatcctatttaccactagtttcaaccatggggactttcatatatttctaaattctaagtctggattttaatgagtgcatggttgaagttgttctctaaatctttcatgctttttaaatccaacgtacatttaacgatccatatgtctctccacttagaaacttcgacactttatcatccctcaacaatcataagaatttcattaaggagtttaaccagtgtgcctatagcgtcacagtccgaactttaaattgcagcaatgtccttcaagttgaagggactttttgtacttgtttaaaatacgcaaatatattagggtcccaaatttattattcattgaatttatcccaccaagttaagtgtcaacgccttacttgagtgctctcagaactgaatttagtcaagtttgaacaaatatgtatataccgtgtattacggaaagtcttgtattgtacatttgtactcgtacctttttctctcctatatatttttcttagttctaaatgtattatttgcttcatggatatgattgatactacaaaaaaactagttgaataataaatatgaacgcttcaaaaaatgtcaatgtctaaccttttgacaaaaaaaaagaatgcaagtttcgtaaacatggcacataaaggctaaagtgtgtacaacaaaaagacttggtttggttcggatagtggagttccattccatatggatacactattgaacaatatctccctaaatcagtaaatctctatatagtatatacttcgtaaaaacattataatttagttgattgtttgtaatcaacctaacaatattacgcaaaaacattatatttttaaagatatattatcataaatcgtattacgttacgtttataattaaatccttaaaaacaattagtagataaatcatttgagctttctgagttaactgatcgtgttgtcaggatcaggaagagaaaaaaaatcactaacggatgcgatcaagacgttactatactagttgcacttttagctaaaagattatttatttttactttgtctctagatattattaaacttggatatctcatggtgttattctttgcaaaatatctagatatttccccttttacttatttaaagtaattaatttccttattttgtctctggatattttggagaaatttttatctccaaatatcgatgatatataccaaatcacaaaaacatctatatatctagagctatatagctaaaaacaatttattgccaaatgatcaaatgaatttcatgtgtcccacttttgttctgcctaaatttagaaatttattgtttttttttctacgcgagcctaactcgttttactcttctgaaatctaaactcttcgaatttaattgaccactccactaaaagagtcttaaaaagtcaaatatttttcttattacgacctaattttgaaagaacttcttcgttgacctatgcatcattctctcgtctataaataccattcacgtcgttcgttactcttcatctaaaaacattcatacacatacaaacacacgaaaatacatcccaattctaaaaaaattgttttttcaatttttctcctttgatttcttaaaagaagatccacaacaacaaga

SEQ ID NO: 6977 - DNA, 3000 bp, Unknown
  misc_feature (1)..( 3000): cDNA_ID_3049431_gDNA_ID_1621119_Annot_ID_171996 3000 nt of promoter + ATG
tatatgtttttttttcattatatgattgaagagtatatcaagattttggtgtgcacatgatatgtgagatttatatgtttcttattaattgaatcctacaaaaattcaattaaaacacaataaagaaacactcctctaaaactaggtcaaagttcagaatcttcatagaaccaaaagcaaccaatataacataagcaaatcaaacagaagaaaagaaagaaagaaaaaaattagaaaaccaaaacaattgacataaacctagctagtcttattgtaaccaaacctagattagcaacaaccacctctaagggcaagaacaagatgaagaacactaccacgttctaggttgtaatgtttggcggttaaatcatcagcaagttgtttcccagtgtagacgatcctttgatgaacaggaggaatgccttctttctcttcgattcgttctttgatccgctcaatcgtgtccgttagctcaatctcaatgtctatttgtttttccgtcagagtcttcactttgatctccatgcttactcaagttttctctctcgctctcaaccttgtcttttgtctctcaaatcaaaatatatatatcttcggatagttaaaagccttgaaggatttggagttatttccttttttttaggcattggaatttccaaaacaaatccattatttaacatattttagtagattttatcagatcaataaaaaattcattaacgtttagcaaaattaaggtaaaaactgaaataccttttatcaagtaatccattaataatctttctttgtactgaaaaaaaacccaatcaaatttcatggtttacttgatacttctagaagttttaataaaaaataaaataaaaattgaaattcacccaaaagtcctttaagaacttatccaaacttaaaaacagttcaaatatcaaattcatccctttttatattgacaattgaatattatggttgagtgtttgaaaaacaaaaaaaaattgatgaatttgttttctttcttttttgccgtccggttttggttcgatttatccttattttgtaacctttttaatcgagttgagttttctcatttctgtaatgaatatttgtttatttatttattatgtgattcaagagaatatcaagattttggtgtgacattctaatttaccagataaggttatttgcaggtttattgttctaaaaggttcatatttttgtagaatcacaacccacctagtaacattaattgacgagaataccaaaattttcggatttgtcagactaatttgcttcttatcaattaaatcctacataaattcaacataaaacatacaaacaaaacaaaaactcctctaaaactaggtctaaaagtcagaattttcatagaaccaaaagcagtgattaacattgagaaatacaacagaagaataaaagaaaaaaatagaaaaccaagacaatagaaccaaacctcgatcgattatcaaaaacgatgaataacactaccacgtagtcggttataatgttcggcggttaaatcatcagaaggaatgcctatttcctcttcgattccttctttgatctgttcaatcttgtccatgggatcaatctcaatgtcgatttttttttcactaagaaattgagatttgactttgaaacgctgtcgttcagcaatctcccgcttcccatgtgaatttaaagtattaacgtggtggcattcacgctccaacttgcgcgtgacattctccagaagctcgatcaatgcataacccacgtggcacatacgcgacttccactgttgccgccccacgtggcagctagctgattttaggatcaaatctaataccaatgcactaaattaattataataattacttaacaatctacggattatcttcttacttcataagatccttatattttcattacactttgactcattcctttcaaattctcatattcactgattgaatacagtacagcataagacatgtgtttaagtgaagtaaacgctttactaatcagtaatcaaggattcaactagaaaaagggagccacagagacaaagactatacgcagaccaacgtcaccctcaacctttttctattcacccaatgctaaagaacaaaataaaaaaaaatctttccattgtcaaacattaaaaagtaaaaaaaaaagttcttcatcttcctcgtcctcactttattcctattccgtgttttttcagcgttttccacagctaaaaaccgacatagcttctctatttttgtttcctgggtgtatgtatgtacagagaataagaccgatctctccaagatctctgttttctgaagagttggtgaatactgtttaagcttctctataagagtgtcattccaaggtatctcttacttctctaatttggtgtttttagctttgtcttcaatttcttcttcaattttaatttctatgtatttgagtaatctataagttagattgcttatacagaaattctaggaaaatggtatttctttgtcaaaaagagacgttactgcaaaaaaacacttctttttctgggttttgggtctctttgagattttgatctaggagttgaattgaattgaaatcttttcttaaaggttctagtcactgctatactagtgcataaattctgttctttttattgattactagtaatatgaaaatgagaggaacaagagacgtattaaggtatgatattaaaatgtagagatatatcttcactctttttggaatactctgaaaatcttatcttaccaattcctctttaccaatttccttttcggtaaaatgtagaattttttatatctaagaaatataaatttccataatctgtacatatatcacacgctttttgaatgaatatttttgtaggtgaagtttttgatttcaaagggttcgaattgattttgcaggtgaagaagaagcgtttgattcccaaaggagattcatttatttgataaatagatttaagctaagagttaaaaaaag

SEQ ID NO: 6978 - DNA, 3000 bp, Unknown; identical to SEQ ID NO: 6967
  misc_feature (1)..( 3000): cDNA_ID_1974557_gDNA_ID_1621119_Annot_ID_171993 3000 nt of promoter + ATG

SEQ ID NO: 6979 - DNA, 3000 bp, Unknown; identical to SEQ ID NO: 6966
  misc_feature (1)..( 3000): cDNA_ID_2044091_gDNA_ID_1621119_Annot_ID_171991 3000 nt of promoter + ATG

SEQ ID NO: 6980 - DNA, 3000 bp, Unknown; identical to SEQ ID NO: 6965
  misc_feature (1)..( 3000): cDNA_ID_1816352_gDNA_ID_1621119_Annot_ID_171989 3000 nt of promoter + ATG

SEQ ID NO: 6981 - DNA, 3000 bp, Unknown; identical to SEQ ID NO: 6964
  misc_feature (1)..( 3000): cDNA_ID_1816358_gDNA_ID_1621119_Annot_ID_171986 3000 nt of promoter + ATG

SEQ ID NO: 6982 - DNA, 3000 bp, Unknown
  misc_feature (1)..( 3000): cDNA_ID_2044102_gDNA_ID_1621119_Annot_ID_171983 3000 nt of promoter + ATG
tttggtcgtgcgtgcaggtttctctttctttgaccgcttctaattccatagatcgtgctataatgtagttttgagttatcaacatattaaactctatactttatatgatttaacgttgacggctgactattttattctttaacatcatagaacctctaggaacgtgcgtccaagtttgaggaattcagtgacgatggttttatctccccgcaaaggtcagctctttttgtcttctctacgttatttcatcaacgtgtaaacatgtcactaattgaaaatttccgtaaaaaaaaagaaggccaaattggagagagagaaagagatacgactttggaatttctaaactgttttataaagatggagcacatagagatattagatgttcataattagtaaaattgggtttcttgacccataagcaatgttgttccctcctcttcgttccctctttctcttcaccctcttgctctcctccgtttgtttcttacaaatcaaagcagaccacgacgatgaaagcgacttgggcagtgatatcaaagtagacaaacgtctcaagttcgagaacccgaagctacgtcaagcctacattgctcttcaatcatggaaaaaagcaatcttttctgatcctttcaacttcacagctaattggaatggttcagatgtttgctcctacaatggaatctattgtgctccttctccttcatacccgaaaacccgagtcgttgctggcattgacctcaaccacgctgacatggccggttacttggcttccgagctaggtctcctctctgatctcgctctgttccacattaactcaaaccgtttctgcggtgaagtccctctcacgtttaaccgcatgaagcttctctacgagcttgatcttagcaacaaccgattcgtcggtaagttccctaaggttgtcctctctttgccttcccttaaattcttggatctccgctacaacgagtttgaaggcaagatcccatcaaagctcttcgatagagagcttgacgctatattcttgaaccataaccggttccggttcgggattcccaaaaacatgggaaattcccctgtttctgctctggttcttgcggacaacaatctcggaggatgcataccgggaagtatcggtcaaatggggaaaacactcaacgagcttatcctctccaacgacaacttaaccggttgtttacctcctcagatcggaaacctcaagaaagtgacggttttcgacatcacttcaaaccgtctacaaggtccgttaccatctagcgttggtaacatgaagagcctagaagagcttcacgtggctaacaatgccttcacaggagttattcctccaagtatctgccagctttctaaccttgagaactttacttactcttccaactacttctccggtcgtcctcctatatgcgcagctagtttgttagccgacattgtggtgaacggtaccatgaactgcatcaccggtttggctcgtcaaagatcggataaacagtgctcatctttgcttgctcgccctgtggattgcagtaagtttggatgttacaacatcttctctccaccaccaccgacgtttaagatgtcacctgaagtccggacacttcctccaccgatttacgtgtactcatcgcctcctccaccaccgtcgtcaaagatgtcccctaccgtcagagcatactctcccccaccaccaccttcgtccaagatgtcaccctctgtcagagcatattcaccaccaccgcctccttattccaagatgtcacctagcgttcgagcttaccctcctccaccaccaccatcaccatctcccccaccgccttacgtatactcatctcctccaccgccctatgtgtactcatctcctcctccaccgccgtatgtgtattcatcccctcctccaccgccttacgtatactcatctcctccaccgccttacgtgtactcatctccacccccgccttacgtatactcatctccacctccgcctcctccaagtccaccaccaccgtgtcctgaatcatctccaccaccgcctgttgtatactacgcacccgtgacacaaagccctccaccaccatcaccggtatactatccaccagtaacacaaagccctccaccaccatcgccagtatactacccaccggtgacaaacagtccaccaccaccatcaccggtatactatcccccagtaacatacagtccaccaccaccatcaccagtttactatccccaagtaacaccaagtcctccaccaccatcgccgctatactatcccccagtaacaccaagtccaccaccaccatcaccagtttactatcccccagtaacaccaagtcctccaccaccatcaccagtttactatcccccagtaacaccaagtcctccaccaccatcaccagtttactatccatcggaaacacaaagtcctccaccacctactgagtactactattcaccaagccagtctccgccaccaacaaaagcatgtaaagaaggccatccaccacaagcaacaccaagttacgaaccacctccagaatattcatactcatcatcaccaccaccaccatctcctacgtcctactttccaccgatgccaagcgtctcatatgatgcatctcctcctcctcctccgtcttactactagtttcaaccattgagtaaaaaaatgcattgccttatgattaacgagactactcacaattatattcttttggctgcgagactttaatttgtgtgttttgttgatttaaagaaaaaaagacattccagttactttttcttgtaatatttttttttcttttggatattatgttcttttttccctaacacagagctgctcattagcagcaatggagtatatagtttcagtttatttaatttgatactaaaatgttctgtataaataataaagaaaataataaatcctttcacaaaatccatttttatctcaaattaaaattgaatatttaattgaaaactgtaaagatg

SEQ ID NO: 6983 - DNA, 3000 bp, Unknown; identical to SEQ ID NO: 6962
  misc_feature (1)..( 3000): cDNA_ID_1816377_gDNA_ID_1621119_Annot_ID_171980 3000 nt of promoter + ATG

SEQ ID NO: 6984 - DNA, 3000 bp, Unknown; identical to SEQ ID NO: 6977
  misc_feature (1)..( 3000): cDNA_ID_1816336_gDNA_ID_1621119_Annot_ID_56255 3000 nt of promoter + ATG

SEQ ID NO: 6985 - DNA, 3000 bp, Unknown; identical to SEQ ID NO: 6975
  misc_feature (1)..( 3000): cDNA_ID_1397832_gDNA_ID_1621119_Annot_ID_56262 3000 nt of promoter + ATG

SEQ ID NO: 6986 - DNA, 3000 bp, Unknown; identical to SEQ ID NO: 6974
  misc_feature (1)..( 3000): cDNA_ID_1807460_gDNA_ID_1621119_Annot_ID_56263 3000 nt of promoter + ATG

SEQ ID NO: 6987 - DNA, 3000 bp, Unknown; identical to SEQ ID NO: 6971
  misc_feature (1)..( 3000): cDNA_ID_1816304_gDNA_ID_1621119_Annot_ID_56267 3000 nt of promoter + ATG

SEQ ID NO: 6988 - DNA, 3000 bp, Unknown; identical to SEQ ID NO: 6970
  misc_feature (1)..( 3000): cDNA_ID_2044045_gDNA_ID_1621119_Annot_ID_56268 3000 nt of promoter + ATG

SEQ ID NO: 6989 - DNA, 3000 bp, Unknown; identical to SEQ ID NO: 6969
  misc_feature (1)..( 3000): cDNA_ID_1013977_gDNA_ID_1621119_Annot_ID_56270 3000 nt of promoter + ATG

SEQ ID NO: 6990 - DNA, 3000 bp, Unknown; identical to SEQ ID NO: 6968
  misc_feature (1)..( 3000): cDNA_ID_1816300_gDNA_ID_1621119_Annot_ID_56271 3000 nt of promoter + ATG

SEQ ID NO: 6991 - DNA, 385 bp, Unknown
  misc_feature (1)..( 385): cDNA_ID_3049465_gDNA_ID_1621120_Annot_ID_172037 3000 nt of promoter + ATG
gaattcgaaattaggttaaatattctaaatttatttaaataactggaaaaataattttaactaaattattttttatgtttgataattaaaatagaaaatatatgtttaaacatttaaaaataagattaattacatttttggtttatattaatttttgttaattatattaattgaattccttttgcagcaactgaatcatattaatttaaaatattcaatgcgtatattcctttcttaaatttaaatatatcacttctccataattatagctaatcaaatattcagttggatattcatttttgaagttaacataaagtttccggacaatttccataattaaataactacttataagataattgctaaacattctcttataattatg

SEQ ID NO: 6992 - DNA, 3000 bp, Unknown
  misc_feature (1)..( 3000): cDNA_ID_2165180_gDNA_ID_1621120_Annot_ID_172046 3000 nt of promoter + ATG
gtttttatctatcatcaaatattcttacatttcgttattagtaattatataaacggaatatctatactattatttataattgcatgccacatttgtttgttttttaggctccgtgatgaaggtgcaaggaatggcggttgaacatctacttaaaatttttttttacatgtagcctattgaactcggtctattattatttttatttctgtatgaacaagtttccatttttatttctctacgaacaagtttacatatttcgaatttagattaccttctaaaacttgatatcttacaatatcgcatcgctattatttgatgattgatttaaccaaagataccgtgcgtagcacgggtactgacctagttcacatagtaaaaaaagaaaccaaactaagatttagtattcattttggaaattttttttgtaatgcccttttcatgatggccttttttaactctaccctttttttttagccatttttatttctatcctctttaaatttttaatgaccattttacctttatttgaaaatttttttatgttaacaaaatgaaatattaataactttcgcccaaatatttcaaaataaatttccggccaaaattttttgaaaaaatattttcgcgccaaatttttttttcaaaaatatttttcccgcaaaaaatacttgagtgtgtgaatccgtcttccacattttggcgccgtctgtggggagcggaggattcttgagtcgtcagatttcttccgtgtattacatacccgaagtaagccgcaatgtctggagaggatgctaccaacgcttcaatagccgaaaccctcaagaccatgcaacaaactatggccgatatggcgcagaagttttcaaacgtggaaaaaatcgtcgaaacactgtaaacaatccaggtatcacttagccaaaatgttagtaccattcagtctcgtgtccgttctttaaatgcaggaaattctactagagttcgaagaactatcttcggatccccaaattcccttccacgaaatgcaacaagcgatcaaacgaccctggatggtacaaacgcgaatagtcaaccggaagatggagaaacgcatcctgaagatgataaccagttcgatgatcagcacgagcaagaaaactttgaccagctcgaaaccatgagagaagtaagtcgggaactgaaagaaatgaggtcgaagttccatcaagttacaagttcggagccagacatcaaccgagttatccaggaggctaggcgaacaccgttcaccccacaaattgcaagtttgagaatcagagattctcaaaaactcaacttagaaccatataattgtttggaagacccgaaaggctatctcgcagcttttctaatagccgctgggcgagttgatctgaacgaagccgatgaagacgcagggtattgcaagcttttctctgaaaatctgtgtgggcaacccctgatgtggttcattcagttggagccaggatcgattagcaatttcaacgaactatcgaaagtatttttaaaacaatactctattttgatggataagagcattttggacaccaacctctgaaatctatctcaagggccgaatgagacacttcaggcttttatcaccaaattttaaaacgtgcttttaaaactcccaaggatctcacaatagtcggctctatcggctttgtgaaaaggattatggcatgattcgaggtttaaggaagatctaatacttcacaaacctgatactattcaagatgcattatttttagcgaacagttggatggaagtcgaagatgaaaaagagagtttcgcgaaaagaaataagcaagcaaaaccagcggtcacttttccacccaagaagttcgaacctcgggaaaatcagggaccaaggaagtttggttcgcaaccattcaataacaacgtcggaaagcagtttcaggggaaaggaaggtcaaatacttgtgtccgagatgaaagctcgtattgcgatatacatagagtcacaagacatctgaccaaagactgcagtgtccttaaaaggcatctcgcaaaattatgggccagtggagacctctcaaaattcaacatggagaacttcgtcaaacaatattatgaatcaagggataactcagaggctcaaaactctaaaagaccaagagcggctggcgaagaggaaccaagaacttcaaagggtaaaatcaatgtaattcttggaggatctaaactttgccgtgattccgtcagcgcaatcaagaaacatagacgcaatgttcatctgaaatcaagcttaagtgaagaagtagactttcaaggcacttcgatattattcgaagaaaaggagacacatcatctcgaaatacctcatgatgatgcacttgtaattacgttggatgtagccaacttcgaagtatcgaggatcctcattgataccggtagttcggtagatctaatttttcttagcactttggaaaggatggggataagcagggccgacgtggtaggaccgccatcccccttagtggcttttacaagcgaatcgacaatgtctctcaaaacaatcaagctaccagttttggctggaaagatctcgaagattgtggattttgtcgtttttgataaaccagcagcctacaacatcattcttggaactccattgatctaccaaatgaaagcgctcccctctacttatcaccaatgcctcaaattcccaactccgagcggagtggaaacaattcggggagatcaagaagcttcgagaacttgttatttagctagccaccgattaaaaattcaatagcaattaacgaagcccgcaaagaaaggaataatcccgagattccctagcggacagaaagtggatgatgtcgtggtcgaagtaattctggaagcagacaaaccggatcagaaagttcgaatcagagctaccttatcaggcgaagtgaaggaagccttagttgaattgttaaaaaggaacaagaagtcattgcttggtcggcagcagat

SEQ ID NO: 6993 - DNA, 3000 bp, Unknown
  misc_feature (1)..( 3000): cDNA_ID_1816419_gDNA_ID_1621121_Annot_ID_56280 3000 nt of promoter + ATG
tgtacctcatcattcttccttctggttaactgaaaatggagtgtagttcagtgagtgtactaggaatattactggtatttcctctccttcataaccttgtcaccatctccgggcagaatcttccggcggtgggtttgttcactttcggagattccaacttcgacgctggaaataaaaagttcctcacaagtgctccacttcctcaaaacttttggccttacggtaaatctcgagatgaccctaagggcaagttttctgatggcaaaattgtcccggactttattggtaagtttgtaaatttatctctattttacacttttaattttttcaaaaggaatcagattgttttattatatctttctaatcccaagtaaacatatagaggacaacatatggtttgtggattgatgcttatttgttatccttcatgttaaaattctgtcccaatacagttgttaaatattttacttaaatcaataaatgattttataatgagttcgattaaaaataagcaattgcaacgggtacttcaatattgcaaactcttttataatgtgtgaaaagttggtaaaaacgtaacgggctagtaattgttttttcaaaggtctcaatctgaatcagcctgatttctttaatattttaacaacgtatacaagatgaacacgctctttataggtataatgctataatgcatatcatttaaccattaagaaaactagctactcgtttttataggtactctatactaaatggaaattttgattggtaattaaagatatatgaaattgatgaggggtgaataaatcacagcaaaattcatggggataccacacgatttaccgccggcgctaaaacccggcaccgatgtgtcacgaggagccagcttcgccgtcgggtccgcttccattcttggatctccaaaagattctgtaagctcacttaaaatatttgttaatcaatcgtaaagcaatgtcataataaagattcacatttttttggtagttggctctgaatcaacaagtgaggaaattcaatcagatgatatcaaattggaaagtggattacattcagaaatcagtgtttatgattagcattggtatggaagattactacaactttaccaaaaacaatcctaatgctgaagtttctgctcaacaagctttcgttacttctgtcactaaccggtttaagagtgatatcaacgtaagtattttcatccaaaactaatcaaaaattaatacgagttagtgatatagatatgttgttataatgattaattgcagttgttgtattcatctggagctagtaaattcgtcgtacacttgctagcgccattaggttgtttaccgatcgcaagacaagaatttaaaaccggtaacaattgttacgagaaactcaatgatttggccaaacaacacaacgctaaaattggaccgattttgaacgaaatggcggaaactaaaccggatttccaattcaccgttttcgatttctacaacgttattcttcgcaggacacaaagaaacatgaactaccgtgagttacaattcgccattcaaagttccacactatcattaatatcgttatatgcttttactttgaagcaaacatttaataatacttgttgttatgactaattagggttttccgtgacgaatatatcgtgttgcggtgttgggacgcattatgcatatggttgtggtttacctaacgtgcactcgaagttatgcgaatatcaaagatcctacctttacttcgacgcacgtcataacacagagaaagcacaagaagcgtttgctcatcttatctttggagctgacccaaatgttatccaacctatgaatgttcgtgagctcatggtgtatcctgttaatgagcctatgcgtgagttttgggaggatccaatggatgagaagttatcgttagtccaatactagtggatctgtctacctcgtttagttcttgagctcactattttctatctctagatcacgtacgagctcttggaatttgtaatgtattgttcttaattagttgcgaagtaaaataattaatactgtttaaatcctcaactctgcttattttcataagaaaaaaataatcaattaatgggtaatttgatagacctgagaatataaccaaagcatatatatgacctgctttgtgctcatattagacaagtttcgggccatacgcactcattagaacgaaatgattgaatttggtggaatcatttaagacttatggatttcaaattacataactcacttgagtcattttatttacttttttttttgtttttttttgcaattcttgttgtaatgaaatagtggaaatggtttcaatttttaactgttccaaaattattttataataagtgttgttttaggttttaatataaaattttggttaaagttccaaattttatttatactgttttaatgtgttaactagaatgaattaatcatagtaaaacaatttttttttagtttgtagtatttaaaaaaaacgaacacttgatctgaaatgcatggagtattttcttagttacgttttcataggtgagaggttccatttgacatgtttttttatatattttattgaaatataggaatatgcatttaaatcttcttctgccctcaatgcatgatcgatcttcttgatactagtaacaataaatgtatcttgaaaattaagaataaataaaatagaaatgggataccagttgtgcattaactaggtgtgtagaaaaaagaaaaaaatgaacctcgagcaacacgttatcatatattcatatttaaataacaatatttttcaattgctaaattgcttttttcttaaaaacaatctttttgataaaaaaaattcagttgccaaattgtgtagtatttacaatataaatataacgtatcggtctacgagctaagacacaaaagcaatcttctactcatttactgttctgtttcactttctctctctctgtatactctctaaatgatg

SEQ ID NO: 6994 - DNA, 3000 bp, Unknown
  misc_feature (1)..( 3000): cDNA_ID_1816387_gDNA_ID_1621121_Annot_ID_172095 3000 nt of promoter + ATG
gaattattcaaactcaaccaagaaaagaaatattgattcaagactcagagtcaagtctctaccaaaccatatgagtcatgctttaacatgtttttttttgttcttagctcccaaacagaaaccaacaacgaaactagaatggtcccgccattttcacttgcaaccaaaacaatccatgaaagtgactcagcagaaagattaatctacctgtgacgtcagtgatttaatcgcttgcttagtcctaggggtaccaataactccgtgttcttcatcttcttctcgagtagatccgccattgttggtgttaagctgcttcgtgcaagctatacacgtcagcatctctcaccttctcttttgacactactcgaaccctatgagatcaaaccagaaacccaaatcacatttcaagcaaaacccagaagatcaaatctagaaatgaagatactttaatacccaaaaatcacaattcttgcactgtgcagatacaaagaggcaaaaaagacgtacacttggaagagctccgagatcacagaaacgcagcgatgaagagctcaaattgaaatggggttaaatatgaccgttacgccagagacataaattagggtacacagatctgtatagatcaaacccataaattcgcatttaactctgtctctgtcagtctctctctctctcttgctgcttcaagcgacacagagaatgagtgggagataatgtctgtataaagacagaatcgatctttctctcgctgtctctctctgtaggagaagaaatacaaagctgaagaagaagaatctgcggatttgggaaaaaagtaataaaaaggctttgagatttgttgggcttttgagttcgttggacactgcaaaaagctttaagagtgtggtctactgtgtttcttattgatcctctgtgccacttgtcactttcgttttctacttttgggaaaataatttcttcacaagtctgattattatatacagtaacgccaaacacattagtcatctctaatctctatgcttaactttatggtaacaagtaagaatatgtgatcaaagtggtgaaatgattgctctaaagtctaaagtctaaacgaagaactatactaatagagcgtgcaactaagccttagcattttaatttctaaaagctttgattactataatacaaattttatagacttgctccccacctttttctctcttccttgaaagtttaagccttttgattaattatgagtttaagtacaccttccacatcatcaagcaatgcatatcatgccctctcaaaaagttaatcttgtaggggtgggcatttgggtacgcgagtcagtttttggtaaaacccgatcgggtaagtgtaggtataaatttttagacattttttagaactgatacctgaattttttggataaatacccagatttccctgatctttggataaaatttagataaaatttagttattttcgggttctagttgagctcgaatttttgggtagaagaagtttaggacccaataagatagatctaaattttcaggtttggtttcgaatccaattttttgggtcggttccgtgttgttttttaaaccctaatctagagttttttttttgtttaatatgaaaacttagtacttaactttctctacttgtattatagacttgtaagaagttaataactataaaattcaattgacaatgtttgagatataatctctttggatatatctcaattgacaaataatttgagataattctaataatgtttgagatataatctctttggatatactatatctgaagaagtagttattgagataaatatagctaattaacttttgaataactacttcttcagatataatctaataatgtttgagatataaacgtgtgagatataatctcttgtgaagaagtagttattgagataaatatatcaacaaaggtgttaagcccaaacaagttaaaacggatcaaaacaaaaggcccaaaaacttaatgatacgctcatccgtaggtgatcacaccctcgtaaatacacaacacaacgatctgtccttaaattccctcaattcattgaaaagtttgcaacaacgaaaaaaaaatcaaatcaaaatctcaactctagagatttattgttgacccgtttaccgcgattctctcctcaattcgccggtaaacccctaactctgtcggaaaaccctaattcgccgcgacggaaattaccaatactcgtttcctcgtagcattggatttttaaagctgttgattccagctttgttgaggtaaatattatcttcccagatatctatcttctgattctgattttattgaggtaaatattattaatttgattcaaattttgagaagttggtgattcagttggttgatttagggtttcatttgggtactctgtctaggccaaattcgttttgtattgaaaattttattctttggattgcaaaaagttgtcttgtttattattatttggtaaatttgaatttttgtggtttgtcatgttatttgttctttagagctgtgattatgatttgttatttgatttgatgtatgaagcctgcgcaagtttgtgtctttcgtaacattgaatcacgttcaatgtaacatatttcattgcaaaatagttatgggattcaaatccttggttagtggatagaacaccaatcttctaattttacgttttgttgtatgcctattgtgctggaaaatggctagcaatatacatcttattggcagtttttggttgttcttcccatggctcataatcagagttactttatggtttcagttctatagttcattgataattcatagcatacttttttccctcggaatgtgcagaacattcaggttacttctctgtatagggtttagttgacgaacccctagtaatatggaattgactgtgacattctatctaaaaaatataacttttacatcgcattaagaaatctaaaagaagttttgatgccagcaagaatg

SEQ ID NO: 6995 - DNA, 3000 bp, Unknown
  misc_feature (1)..( 3000): cDNA_ID_1807926_gDNA_ID_1621121_Annot_ID_172093 3000 nt of promoter + ATG
tataacaatacaacacagcttagtccgaatcaaacatattattctccaaatagtccacaggtttgtttattgctattaatagtcattactcttgaaaactctttaccttctctctattgtaagactgaattttggaatcaatgttaaaacagtacccacaaccgatgatggttactcagcagagaccaatcttgttcatgccgccaacgccataccaaccggtttactactttacttcaaaattcttgttttgtctagttacaaaaaaaaaatgatcaacagagttagattttgctgacatctttgattttattgcaggagatgccatacaaaggaagagactcttattagcttttggccaaaaccatgaatggtggtggcacaagagaaggtctcgagctgatggaattggtttcatttaatgtactttatttttatttatttccaaagcaccgaatcttttcatttttattctaaaatgaacacaattgatgtgatggtgatttagtttgtttaggtattagactagattttacattagattcgtgctgatctcatttctttattcacttctgttgtgtctccctattcaaactttaacgttaaatcttttagttgtatgacatattctgtgtggagtttgttttatttatataaaaacagttaggtaggaaaaaaaactttttcatttgtgaaaaggaaaatcaacgattgtagttcaatcttacatatacgtgttaagacatggtagggaaaaagtggagtgcgtctatgattggatttgaaagcgtaatgtttaaaatttggaactattagattaataatgggtttagtcttgtcttgtcctaaaatgcatataaatcttattgcggtgtgttaaggatcgaggttaggggagattcgaaaatattaactttgtcgtgtttgaaaatattagtttaagtaagtctataaacataaacataggtaaatcaaataattgatttctaagaacttctagatactgttgatatataataataatatttgaagtaacacctgtaacttccctcgttcgaagcatgatagttacgcatttcttttctctaaagcaaataagtaaaaggtacgtgtagcaaacaacaattaatcttccccacaatacaaagtctcgtattacttcaattattactagttaaacaaagtgtcattgtagtgaactacaaataggtgtccaagaaatagaaatgttgctatatactatattctttcttttggagtgtatttatagtgtttttttgtcttccttataattactattcagagttgtggattaaatgcagagagatagtgcagaaattacgattcattgctgctttgtgttggggaagctgcatcaagaaatgtgaaaaagggctctttcgctttgctttgctttgcttgacttgcaataatatcaattaccccaactacaaatataaaatatttttaatttattcgcttaaatgctactatattgattgcgctataaagagatgttgacaaccttccacttaaacttttgctttttaaattaaaaaaacaccttcttaaacaaaaacaaaaacaaaaagacagaaaaaaaaagtacgcttagataatacataattacatatcttcaactatataaacaatgttttagaattctgcacatttttgttatgaaacaattaaggaatatgatacttcagataccctctatatattatttagaatctttgaaccttgtaatatatatgctgaatagaatcgcatataaattgataaaacatcactgatatgaacataaaaataaaggtgttaaacatctttgaaataaatggaaatatttaccataaacatttttactttggtttttcttgtcttctattttccttcctaacattttaatactatcatttatatatttagatatatttctagccttgtctagattatacacgcgtcacacttctaaatttatatctatcttttactagatttttctattatttattgttgcctacatatttctattttgttttgtaataaaactaaacctgatttgaaaattataaaagcactacgtgacacgatttgattcgatatacttaatttttgaaacataaacaatataaacaaagataagaaaaaataccacaaatagaaatgtcaaactctgcaaataaattcagaaatggaaacaaaataatattttaaaatatttaataaattgtgtgtgaataaatatgcatttgttgagagaagaaaaccataattaaaaaaaaaaaaagagaaaaggagtcaagattagtcttttaagccatagccaatacccaatttgcagagacagaggaagagagagaaagatagtgaagagaaagaaacaaccatgttctgaggaaggagacatgcatcatcatcatcattcatcatcatcatcatcatcataatctcaagcttattacttaacttctttttctctccatctcttcttaccaaatccaaagcaccaaaggtctctctctctctctctctcttcttgttcgcttaatttatttggtagtgatgttatgatttggttgctcagtttctacttatgatgatataattaaaaataataatttttgagttatgagagaaaaaaatcttttggttggtttctctgttttcttggatcattaagttcaatgagatttgatgagtttttttatctgttcaaactcagaaatttaatctgtcgattttagtttttgtttgcatgttgtgtaagttctagccatgttcaaagtttgaatcttttggaaccctttagatcatgaaacaatcttactgtgtcattgaacctggaatctgtgttttaggattgcttttataatcttttggtatcatttctctcttgtatttgttgattatgtggatcatgaataatatcatatgatttatgactggacttgttggtttggacatttagtttattgaagtaaagatttgaagacaatg

SEQ ID NO: 6996 - DNA, 3000 bp, Unknown
  misc_feature (1)..( 3000): cDNA_ID_3438546_gDNA_ID_1621121_Annot_ID_172091 3000 nt of promoter + ATG
tcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttgaggcacatgagaagaccttgctccgagagaactcaggctaaactccggagactggtgatgatacatgacgggaagtcatccttggctacttatgttatcggttacaaaatttcttccttttaaaaactttgctttcatatcctctacaatctctcactctatattgagtgacttgacgaactttcaaatcattgtcaaactattttgttaacttccgattctctgagagtacaaattgcattaccctattacatacaatgagagaagattcagggtcactaagagtaatatacacgcatagatcccctaatgctctgaagacaaactggacacttagggtttaactctcgttccacggttgaagcacatcgcctgcaacatactacatgtccacagggaataaacgcaggtactctccttcttgacacgcagatcacacacaattctccatctgggatttcatctgcatcttcgggttcatcatcgaccacagaatcgttcggtctctgtggcagttctctctgatggttccattgtttccatttattccaggtcctgaagataagacagttaaacagatttcaaatcgaaacattgcccaaatctaaaaccaaatctgatctctcacaactccagtacctgacagcagcatagctaaggatgccaacagacacaatgcccaagataacgctgcccaagaatataaagttggtctgttccataaggtcctcaatcatcttgtccttggtcatctctgatctgcaaagattattcataaagatttatatatgaacagcaaatagagcctttctgcaacaatggactaaatcttgtcaaatgatcaacagattgagaaaacataaagaagaagatgaagtaataatttgagctagaacgcaggcagatatataagaacgaaaaatattcagataaaatctcacaagaaataaggaagatcttggcacgatttgatttcaggaactccattattaaaactgtagatgccaacagctgttatatctttcccaggtggtaaaatcttctctatatcaagcagaccaaccttggaagagaaaggattacaaagttagccaagaacaagtaaccatcagttcctcaaaaccagaaatttctttgaatatatatatactcacaggataatcggggtacaaaaaggcttgaagaaacgaagaattaataggctgcaagcgattatacacagtggtaagcggaagaggttgccttgagccatccatgttaacagcgacaaaactagagttcgattgctgatcctttccaacaatgacaaatgggacctgcacaaagcaaaggatacacaaaacaagtttgatcatggatacagagccaaagttgaaagctctgaagctgatagagagactttaccgttctcgtaaaatcagcaccgtgtttgcgcaatgatctctccaacataaaccggtgaccagtggactgaaacaatctcttccatccactatacacatactgtcaacaacaaaatgatgacattagaaacatacatttcccttctgagatcacaccagtaccaacttacataatcctaacttaatcaatcacaatgaacacctaatcatgaagaaatcatccaaactctttaacctaagcctttgataagaacacaaagcaaaattaggtcaatgtcaattgcaatttgagggaaacataaacacttagggtttagagcaacgtacagtttgcgttctctgaatgataagagctttatctccagtctccggagagattaacacgttgttgttcttgtaaccctcatcaccggaaattttcggtttgacgactccgcgaaccacaacgattcgctgatcattgctcttcctgttatcgttagtctctgatttgtcttcagaagccggaagcagtgatcggaggtcggaaatggagacttcgggtgcatctttgatcttcttcaacgcggcgttggtagaagcatacttgagagcagaaccgacggcgctaacagctaaagtcagtccgaggattgcgccgtcgaaggagagagcgatgtccgtcaatagattcaagagagcacgctccggcgaggacattgtggtaatttcgatttcaacgtcgtagacacggtcacacggacaagtaaacggaagagaaatgaggctattatcggtatttaatattatacattcgaccgtcgttctaatttgggtctttaatgggcctatgcacgagtgaaatacaaaatactagtaataaatagcgttttagttaaattacatttacaccctcaacgttacagcagatttacaaaccaaaaccataaatatcagatctagagtggcagagattagtatttcccgattcctcgccgccgttcatcaatctctccgtcgtgtttctgccactagctctccaccaaactttctctctcgcattaggtatttatcgcctctttatggcatataatcttgtgttttggaacttattgatgaagctaggttagaatctcctttgtctttcttatctccgattcgtgaagctctaattcttatttattcgatttatgtaatgtgttgctgttacacgatgtttgcttgtgagattcgattgaaacttgtgttgttgcaacatcaattctgtataagaaaggttcttaatttgactctgtagctttactttttttttagttgtttagggataaacatg

SEQ ID NO: 6997 - DNA, 3000 bp, Unknown
  misc_feature (1)..( 3000): cDNA_ID_1816391_gDNA_ID_1621121_Annot_ID_172090 3000 nt of promoter + ATG
aggaaaactaaaaaactaaaatcatgaatgaaaaactccaacaaaattatttttttaaattgtagggaaaccaaaattttaaaatcttgattggtatgaaaataagtttttgaaaaacaaaaaccaaaaactcttaaaaaatctacaaaacattcaaggccgttgataactgtatataaaatactagtttgataaagataagagaacatataagtaaagaaatgaatttttttttttacacgacgttgtcctcttttacagtatcaaattacaaacatttgaatgaatgtattgtctgggcttggtaacgtgattgatcatggaatgagatgaactagaatcttgtattgtaagtgattgagttaaggtggcattagttgctagaaatgcaatcatcagacgatgaattattaaataaattatcatttgatattcagatctcatattgatacatgtaccgtgttcttacatgacaaactcgtcgtttccccataaaattcgaatattttaacacttatctggactttcgacgattgctttagattcgagaatctcaatgcttgtatattactagtaccaacttgaattattctcagttttccacacatttgaattattgtataaccatatagtattaagttattatcacagttacaatttaaaaagtcattatgtaaacatctgctagaaatccatgaaatattatatacttcctctatagcataaaattgtacggtcggatataacaatatattccaattgggaacgacatcaagaacctaccatgaattcgagttaaaatagtagatttggcactgaaatgttttatgttttacattgcagtcatacttcaaagatttagtggttcttgttctcatcatgtccgagagcatacctatctaaattttggttattacttctcggttcgatccatttggttttccccacaaggtccaacccacgagcctagtgttgtctttagtgacacataacaatcctcgcagtaaaatatgctattgatatcacgacttgtaaaatatgatagatatcaagcctctattagtagatggatcaaatcatacatcataagttcataacctacgaaaacaacactacattcaagccagatcaataactaatagcccaatgcagtaaaaatgggcctaaaagcttgctcgttttgcgtttatttttgggtgagagaaaagcccataggatcacgaccggtccacagaaacaacaataaatcaagccagaccaataaaaactacggtttgacattgttcccgttacagactaaaccgaaaataaacacgttgtgacgaatggtacgttagttattacgtggttgcgtggaaaagaagaagttccacgtggtgactaaagtttgcacgttgcctcttgacacttttgcttctaacgtaaccatttctaaattttgttttggattcaattaatttccacgatattgaacgtttatattcagaaactcatgtatacatgactttttcagtttccgaccaacaatttaggtctcatttgaattgatttggacatgaaaattgttagaaaagttattaaattgatgtattatttaccaaacttttgttgcattctatcgaaagtcaattacaaaaacaggtgttgatattattgacttaagatcgtttagaagtaagaacagtatattgtcgtgattagtttgacgggtatgatcgaatcgcaagactcaaacaggaccgtcgattttatagggtaaacgattcccacaagtcacggaggctgagagccttgagcgtaggtgctgacctggcacacaaatgtaaaacttggccaccaattaagacacgtgtcttgttaagctccgtccccttaggccacgtggcaactgtttttctttggcagtgatggttcttctttgagagttcgtcggtgtccttatcggaaatgtaagaattcgtaaagaaataaaagttggcaattactataacttaggctgaaatgtctgtattgtccttaagcaataccatcaaaatttaataattttgttaactaacaaaattattgagaacattaaagtgaaaaaaccattcgacatattccaattttttcacattctttgttaaatttctgattttctccttctctatgactgttacacaattgatcaacggacgtaagggtttggagtatattgtacatttttttttcttaaacgagaggagaaaaaaaaaagaagggattcctcatccgcaaatagattcattgaatcaaaaaaaatcccaaccagacaaaaaacattagaatcatgcagtggatcccacttccgaccatttgctgatttttccgtaaatacattctagatatttttttaaaagaaaacgcaatttagattttaaattctagattttaaattctagagaagtaattcgcgcaaaaactgtaatcaaagtttaaattcgaaaattttgattagtttacgttgatcgaacaaactacaaagtaccaaaaaacagttatttatagtttcataatcacaaatggataacgacattagtaacaacattaataacatcatcttagtttaagtcagtagtaatctatggttaaacaaaaagggtaattaagtaatttgcattgctcagttcgcttccattgctggatttaacgggcgaataagaacaccaccaaggatagattggtttatttctagtttcttcggatctataaagtagaagaagaagaagaaaaattctcaatttctctctcacaatctcttcgttttctgtgattttatttagattttcccatttcaatctcttgttagaaattgtatatatacctagatcgattggttcgtagatctgtttgtttttctagggaaagttctttgattctccagaaaattggacgaagctttggattcaaattccagaattaaaaaaaaacagaaaaaaaattctttaggttttcattttgaattcttaccagagagtttca

SEQ ID NO: 6998 - DNA, 3000 bp, Unknown
  misc_feature (1)..( 3000): cDNA_ID_3049514_gDNA_ID_1621121_Annot_ID_172078 3000 nt of promoter + ATG
atgataaccattcataagtagttagacttgctgcatcgtcttcgccagaggaagggattttgccggcagtgaatggtcccaaagcatagcatggtgtcccagctgcataaaaatgtgtttgacccaaatgtgagtcttaattttgttattgttaatttagtttaaagggaagatgagaaatatatacgggttaaaggtgtcccagggttgctgcttgaacaggttggagaatccggatccattttcaatttacggagaccacgaacattgttattccccttggtaaccatgatgcttctggtgacttggtcgcttgagagagaaggaggagaagatcggacggtggataatgaatcgtgctttctcaatttcccgagaccattgtccggcgtcggtccggccaccgtttcatcccacagcttgtgtaggaaccccatccgatcaacaaaaatttatccaaaaatatataacaatattttttcaaattatttcgggtttttattttactgtctctatcttctttttttttcctttgcaatggaaatggttttatagaggtagtagagaggtaaggatgaaagagaagagagaagcattgaatatttttagtgaggttaattataagctttggcttaattaaggagattttaatttaaggataaatatgctgactaatccaatcattagtctctaatctcattggtgaatattctataagctgtgtcttaacttagaatcacaaactactagttcagaactctacttaagaatcacagaggttttcaacaagctattcaagttcaaagctttttaatttgcccatgtttaagacaagaagatggataacaataacaacaacatgatgataatcagagtcataacttctctacatttacacatcccacaaggcagtaacaataacaacaacaacaacatcaaaacctaaaatccagcttatcatagcaaatatcataggaacatttgtgtgttcaattgtcagctacttacattgccgttattcttgccattgcgatcatcatcatcatcaacgatcctcctttctcctcgctgcctgctcctctcttcctcttcttgattgttctgtgttatctccaattgagttttcaagaactgcattctctgcaactccatctctttagcaaatttcatcctctccttttccagttccgccattaacttaagcttagcagtttccgccttctcataagcttccgtaaatccaagtatcgccctcgccacatctccaactccactccctccacctccactcttatccaccttcaaccgctttggcatatgaaacgaaagcggttgaatcggttgcaaaggtgggagactctcagcagattcctcaggagaagcctcaggttcaggatcagactcagactcagtctcagaagcactacgtttcctaaaatgccaccgcatcgaatcagagcctctcttctcttgttgttgctgcacaatctgattacctttagtttgccgtttaaacatactcgaacggctattcccaagagctcctcccataggagccttctctgaagcttttgaagaagcaatgaatgttgtagtaccaccaatcaaactctcaagcttcttgaagaaaacccatttactaggtccatcaccagaagcaatcttagctttctcttgcttatacttcttcttcaccgtatcaattctgttcttacactgaatatcagttttagggtatttgcattgacgactcttgttcacaatctcagctacttctttccaatgttgttgcttcaaagttcctttacctggttcagagaatcgatctccccaagcttcgattagaacctttgtagcttcttcgctccaacaatcatctcttcctcctccaccaccaccgcttcctcctcctcctcctcgtccgtttctgtttccgctaccaccaccaccggttacagaaggagtatgaaccactaacgctaaagcgttcatggacggagattgagaagaaagccccggttgtggtttcttcacgacggccaccgtcacgtcgtttgttggcaaaatcggcggagaaggaggagcttgtggtgaaagggaagaatctcccggagatggaattgactgaatctcgtcgtcgtcctccatgaaaaatcgatcgattcggagaaggtaagacgatctgaggattttgcaaaattttggatctgagattcgctcaccggcgaggggataaggtcaccggataggtaatctccgttattgacccgatggatatgttaaatgacgaaaacacccttcactctttcctttaataacaaaagaacaatattagaaatttagaaccgtgacagtattcgaatggttttatggtaaatactcaaatatcgctataaggtatttatgctttggccattttttcgttaggaatattgaatatacacactgacggatttcaaaatttctctaatatacaaaagtatttttattttcttgtctatagtatggttaggtaggttgtctcaagtctcaaaaactctaactaaaataaaacgagataaatcaagtctaatgggctaaggcctggaataactttcaaggcccaataaaaacagatataagaaataaaaatacaaaatagaacaaagacataaatcaagtccaatgtgctaaacggcctataaataacttataaggcccaataaaaggagatttaatgacgtggaagcttttgaaacaactctcaagttcactagttacttctagaaattttctctggaactttctagctcactggtgtttactcactatatatcaatggagtgaaaatttcaaaccccatactatcaaatcgaagaagaggaagatccaattggaaagggttatcctaattcccaggtaatgatcctattctctgtatcgatcttttcctggaaaatttcagaattgttgatttttttaactgttttgttttctggcagtcattgatcggagaagatg

SEQ ID NO: 6999 - DNA, 3000 bp, Unknown
  misc_feature (1)..( 3000): cDNA_ID_3049518_gDNA_ID_1621121_Annot_ID_172076 3000 nt of promoter + ATG
gcatgactacagttacggttattacgattacggtttattaaccaccggttatggttataatttttttttaactttaattttaaccgttatatatacggttaaaacgattacgattaaatacggttacggttaaatacggttatagttacatacggttacggttatttgataattatgatatagttaatatataagacaaaatattatattttttaaactttataataaaataaataaatagtgatatatcaaataatatttattttacgtgattttgtgtttcaaatatttatagtgaatcagttatctatttttctttaagtaaaccaatgaataaaaaaattaatgatcataattataatgattgaattaattacattttccaaacaaaaacaatactaatgagaagatgttgtgaacattaagaaacagtttcaagagtataaataataataatatgaactacttataatttgatttatggtaaaaagagtagtggagtaacttcgatcatagtagtggacatattaaacaatttaagttactattttagtgaaataattatttatttatacactattataactatattttaaggttttgaaaatacgattaaccgtacggttttgatacggttacggttaattaacggttacagttagtatattttcttaaccgtaacagatctattttcactgttaacggttacggttattaaccgttttatacggttacggttgggttacggttaataaacggttcggttacggtccaaaataccgttacagttagattttggttatgcctacacaccgtaacgactatttttctcgaaaatttacttttaatgtttgatgagaaggtattattgtacaattataaattttaatataattttcgtttcgatacacaatataatctccaccaaaatctttttcatcatggctataatttagtttataattttacttacaagaaatgtttaattgatatcttgagtcaagatgagtctaattaactttataactatataagatgcatctaatatgttatataaaaaaaacacaacaaatgaacataactaaaagaaaatcaaacataacttgttaaagtactgttttaaaataaaacgggtgggtactcacctaattattttaaacctactcttgacactaaactggcctataaatagaacaccatggaaaggaaaagagacacacacaaataaagaaaacgaaaacacttttatacttatattgcagccatggctccgactttgcaaggccagtggatcaagatattttaattagttaattaaagtttcaattcaaataagtcccttctccgatgtggtgctcgaatttgggacctccatacttttcatatgagtagatggaggttaagccggtagaactacataccaacgcccggattattctatttaaattgataattcaacttttcgaaagttcataattttgtacaaaagacattatctaggttaacttggttattgccagtttgccactaaataacagtacgtagtattctatcacaaaggctaaataatagtacgtatatatcatcacgaaggctgaatattgttgatagtcgttacttgttttttttttgataagctataatataacttttatatgctttccaagttagatcatggtattgattaaagagataattaaggatcggatatctgaataaatatttctttaaaattaaaattaccaatcatgtatattcaaaccctcatacagatcggtttaaattcgaatttattattgcaatagacatatttttaacaacatgtaatgttatttaaattattatttagaacaagattagtatataatatagtttttcaactttagacttatcttatagttatatatttctaaattttatgttgattggatatgaatattttagatttggaagtttgaattttatgttattacttttaagagaataccattattgttatattaatgctttaaaattttgaattagattcttataattttatgttatatttgttggtaaacatattttaaagaatctactgtactttgttttggggtcaagtacggaaattaaattttagatatttgagtattcagtgttttagaaatttagtgttcatagacgtaagaggaaaagttgatgatacttgaattaagtagaacacctaagcatagtatttaaaaggtttccatatagttgaccaaaaaattgaaacttctatttttaatcattaataattctatttagtactgtgcacagccattaactaataagcgttgaatctagtttttttaatataacatctatatatacatttttgcagctattttatcaaataaattttagagttggacttatttacaactcaatgtcattagcattaaatattttttccaaaataattaattttacattaaatttttaatttaaattgtcaatcacattatcaatcaaatttaatccaaacaaacttcacatcaatcccttaaaattagcataaacttcacattaattatttagacatgaaaatatttatttaaagatttaaatcttctaaatttttgcttttagagttattatatcattacctaaaaggcaaaaaatattaattttttaaaatattattatttgtatatttaaacttcataaaacattattaatatttgaatttataaaaagtttaatctatcaaaaataattaacatcattatataatatatagagtttaaaaagatctcaaaaaaaaattcgtcatattttgtgattcgaaattttaagaatgaacatatattaaccaattggcgaaaaatatgtgggttcaacgtcccgcaacgactaaaatattttgacaatgattcataaacatattataaataagatcaatattaataaagtaaatagtttttttttttggacgggtttggcaggacgggtttgacagaacgttacttagtaacaatg

SEQ ID NO: 7000 - DNA, 3000 bp, Unknown
  misc_feature (1)..( 3000): cDNA_ID_2160220_gDNA_ID_1621121_Annot_ID_172073 3000 nt of promoter + ATG
gtcaccgcggtataccgcgggttaaaatctagtataacttcattttacatccacttccatgtgaacaaatgataaaattattattttatttagaaaagttttatagtatttttctcatgtttattttcaaagattacaaacaattttgaacttgaatttgaaaactgaatttggaatcaaaataaaccaattattacaaaaaatattagcttataaatttcaaaacttatatatatgagtaatttatatttgaggaattcttagtttctcacaacaaaaataagttttgtttctaaaaataacacacatttgcaaatgttctactaatagcataaatttagtgttaagagattaatatttttcttttaaagattaaattattttcaaaaagttatatagaagtaatttatatttgaaaaattctcacaaataatacaaaaataagttttgtttctaaaaataacacacattttcaaatgttccactagtgcataaatttagtgttaaaaattattttttttcttgtttcacaaagattgatgttctatatcacatcattaatttttttattgctgaccaataaaaagaagagagatatatagttaatattattaaactaacaaaacaataattttaaaatataaaagttgtttttcttaatttgtgtgaaaatctcacaatatcaaatttggtggaacaaatggagtagatattgttccaactcaaatcacaaaaatgttgaaaaataattcaatattacgctcagaaaaatgtaaacttatcatactatgatgttgatttagaattgtttagaaatatttaaattaatttaattttttaaataaagataacatagtcattgtattatcaataactaattttatctttgacaatttatgtgataggtactataaaatttacttttatactagtttaatatatatatatatatgtatattatattaatatatttgttttatcacgaaattgtcgctatgtggccatatttttaatttttttcggtggcctgagggcataaataattattttatttggatacaagattgtaacttcattcatggatcagcagctccatgtgttcacctcgataacgaaaacgatattttgaattagtcaaattattgattggcgataacgtattgcttctacgaatgttatggaattaattaattaatttcatgtacgtatcatattttcttttttgaaattttgactaacattttaacactttttttggccagtagtgagctgttttatgttttctgatatagtttttctttacagcttattaaaaaatttagtcatgtgatatagtaaaaatttgcgtaattatcttaatttgtgtgaaacatgtcattattaagatagtttatcaaaaacatgtcattattacactttttataaaacataatgaatatcttacaaatctactatttaaactaaacttattcatagatttggtccatatcattttatacttactataatttttattaagtttacttgattttaagtttattgaaaaagtgtgggcacaacaacacacatgcatgtgttggtggtggttgagaaataaaataaaaatgtgaattacaatagcattttcccctataactaacaggttgttctacatgactaaatatcttctaaccagtggcattttcataggcaattataaatagtatattaattagtgtaatatctaaaagaaaaaatgtatataagacaataaaaatacatgtatttaaagctaaatggagaaaaaagaagcaaaagtgttatgctagagatttgatcccggagttgagggtgtcaagtgacccccctttttcctaaataggtccgcccctgtttctaactaacatatttcttcaaaaatgcaaaaacaaattgagatttatcttgtcgcaactttttttttttaatcattatcatgtcgcagtttgatggacccgtgattttgagtttcttcatttttttctatatcattaatattatatatatatatatatgcatatatatttgagtttgagtcagatcaatttatactgattagttgtaaagaatttgaaactttgaagcatggataaagggtttaaataaggttttagggatttaggaattcatgtttaagattcggttagaaagtataggattcagtttttactttttaagatttgtagtttagttgaatatacattggtgctcttttaattatttttaacaaaaagaagaagttatttttaacaagataaagactattaaaaaaatctcttgaaaataaatgatgttttggttcaacaaaacttgaatacattaattattaagggttaacaaaaaaaattattaagggtaatttaaaaactgtgagagaaaaaacattaatcattgctcaagtctttcttcttctttttttggtcgctcaatgctcaagtgtgttctgctttctagagcagcaactttttgacaaaaggaaaaagaaaaacatctttctcaaccttattaaaaatagaacaaacgtgtctaggtagaagaactgtagaaactaactagttagtttcaattgatataagacatagcaaaaacgtgagagattgaatattcacggcgttgtggttttcttttgctaacaatgattttacatgacatttttgcgaaacgttttattttcttaaaaaattgtgttacataattgtttttttgtttgttctataattacgtaacagctcttaacgtttacaataaatatatattttctaacgtttatatttttattagatattttttccccaaacttttttctttattttaaactgagttcgtttaatctttaattatagaacattcttttttttttgtcatcaattatagaacatgttaaaagctcttttatttccaaatattttacaatataaatatattagaggaccgaggaacttattgtacctcatcattcttccttctggttaactgaaaatg

SEQ ID NO: 7001 - DNA, 3000 bp, Unknown
  misc_feature (1)..( 3000): cDNA_ID_3049521_gDNA_ID_1621121_Annot_ID_172072 3000 nt of promoter + ATG
tattgtacctcatcattcttccttctggttaactgaaaatggagtgtagttcagtgagtgtactaggaatattactggtatttcctctccttcataaccttgtcaccatctccgggcagaatcttccggcggtgggtttgttcactttcggagattccaacttcgacgctggaaataaaaagttcctcacaagtgctccacttcctcaaaacttttggccttacggtaaatctcgagatgaccctaagggcaagttttctgatggcaaaattgtcccggactttattggtaagtttgtaaatttatctctattttacacttttaattttttcaaaaggaatcagattgttttattatatctttctaatcccaagtaaacatatagaggacaacatatggtttgtggattgatgcttatttgttatccttcatgttaaaattctgtcccaatacagttgttaaatattttacttaaatcaataaatgattttataatgagttcgattaaaaataagcaattgcaacgggtacttcaatattgcaaactcttttataatgtgtgaaaagttggtaaaaacgtaacgggctagtaattgttttttcaaaggtctcaatctgaatcagcctgatttctttaatattttaacaacgtatacaagatgaacacgctctttataggtataatgctataatgcatatcatttaaccattaagaaaactagctactcgtttttataggtactctatactaaatggaaattttgattggtaattaaagatatatgaaattgatgaggggtgaataaatcacagcaaaattcatggggataccacacgatttaccgccggcgctaaaacccggcaccgatgtgtcacgaggagccagcttcgccgtcgggtccgcttccattcttggatctccaaaagattctgtaagctcacttaaaatatttgttaatcaatcgtaaagcaatgtcataataaagattcacatttttttggtagttggctctgaatcaacaagtgaggaaattcaatcagatgatatcaaattggaaagtggattacattcagaaatcagtgtttatgattagcattggtatggaagattactacaactttaccaaaaacaatcctaatgctgaagtttctgctcaacaagctttcgttacttctgtcactaaccggtttaagagtgatatcaacgtaagtattttcatccaaaactaatcaaaaattaatacgagttagtgatatagatatgttgttataatgattaattgcagttgttgtattcatctggagctagtaaattcgtcgtacacttgctagcgccattaggttgtttaccgatcgcaagacaagaatttaaaaccggtaacaattgttacgagaaactcaatgatttggccaaacaacacaacgctaaaattggaccgattttgaacgaaatggcggaaactaaaccggatttccaattcaccgttttcgatttctacaacgttattcttcgcaggacacaaagaaacatgaactaccgtgagttacaattcgccattcaaagttccacactatcattaatatcgttatatgcttttactttgaagcaaacatttaataatacttgttgttatgactaattagggttttccgtgacgaatatatcgtgttgcggtgttgggacgcattatgcatatggttgtggtttacctaacgtgcactcgaagttatgcgaatatcaaagatcctacctttacttcgacgcacgtcataacacagagaaagcacaagaagcgtttgctcatcttatctttggagctgacccaaatgttatccaacctatgaatgttcgtgagctcatggtgtatcctgttaatgagcctatgcgtgagttttgggaggatccaatggatgagaagttatcgttagtccaatactagtggatctgtctacctcgtttagttcttgagctcactattttctatctctagatcacgtacgagctcttggaatttgtaatgtattgttcttaattagttgcgaagtaaaataattaatactgtttaaatcctcaactctgcttattttcataagaaaaaaataatcaattaatgggtaatttgatagacctgagaatataaccaaagcatatatatgacctgctttgtgctcatattagacaagtttcgggccatacgcactcattagaacgaaatgattgaatttggtggaatcatttaagacttatggatttcaaattacataactcacttgagtcattttatttacttttttttttgtttttttttgcaattcttgttgtaatgaaatagtggaaatggtttcaatttttaactgttccaaaattattttataataagtgttgttttaggttttaatataaaattttggttaaagttccaaattttatttatactgttttaatgtgttaactagaatgaattaatcatagtaaaacaatttttttttagtttgtagtatttaaaaaaaacgaacacttgatctgaaatgcatggagtattttcttagttacgttttcataggtgagaggttccatttgacatgtttttttatatattttattgaaatataggaatatgcatttaaatcttcttctgccctcaatgcatgatcgatcttcttgatactagtaacaataaatgtatcttgaaaattaagaataaataaaatagaaatgggataccagttgtgcattaactaggtgtgtagaaaaaagaaaaaaatgaacctcgagcaacacgttatcatatattcatatttaaataacaatatttttcaattgctaaattgcttttttcttaaaaacaatctttttgataaaaaaaattcagttgccaaattgtgtagtatttacaatataaatataacgtatcggtctacgagctaagacacaaaagcaatcttctactcatttactgttctgtttcactttctctctctctgtatactctctaaatg

SEQ ID NO: 7002 - DNA, 3000 bp, Unknown; identical to SEQ ID NO: 7000
  misc_feature (1)..( 3000): cDNA_ID_4370923_gDNA_ID_1621121_Annot_ID_56281 3000 nt of promoter + ATG

SEQ ID NO: 7003 - DNA, 3000 bp, Unknown
  misc_feature (1)..( 3000): cDNA_ID_1840670_gDNA_ID_1621121_Annot_ID_56283 3000 nt of promoter + ATG
gagtttccactttcatctacaattaaatttcaaacattagtttctaatacgttagtttattaaaggaaaatgtaaatacatacgcttataagttataactaaacaattaagggttacaaagagattattggttttcactttcctcgttatgtctttgggatttcctaatttttttattctaacgtaatacagtaacaaaaacaaacgttttctcaccaaatcatctctactagttcaaaactgaaattaatcatgtattttactttactttcttctatttattctgtttctataaatattttcatcttgcaactagtcatcgtaaaaaaaaaaattctactactgaaacgtcttaaaaatattttaatattttattttgtctacactggagcatttttttaaaaatagcttatgatacttgttactcttcgcacggttttggttagggttttcccgtcaagaaagttagttctcaaattattattgaattttttttaatctccaaattttgttgattgtaccaaattaatcatgatgtcaaaatgatttgacggaatgaattaacgggttctatcaagccacttgtgacttaatggtgaaactaatttaacttgatgaacaaacattggtaattaccatgtaaaatcaacaaaattccagaatttttctttacatttttctatcttttaattaaaattaaatatatatgtattaccttggtcttcattagatatcttatattaggatactgaagtctaaattaatcctctatcgtggcaaaaatatcgttattaaaattcgttgtatcaagtttatatcaatattttatatattaaaaaattacatattacatattaacataatatatgtaatgtcaactattttgaacaaacatatattaattttcattgtaataataaccagatgtgatcttccaattactttctcataaaccaaagaaaaaaatggttgaaattttcatactgtaaaacatatgcagtactttcaaagaaatttcaaaacatttttgttttatcattgtcttgttaaatgttcttcaatactaaaataatgtagagtaaatttggaaaaatgcattgtttatgtttatacttttgaaaaatatcctcttaatgtttatactactaaatcttatttatttatgaaaaaatttcaaattaagcaacgttttcttatattttttttacattaaaaaaaaattctttcaaaagtataatatgttaggtcacattttaaaagtttgccttaagcgacaatggaccttggcacggcaccgagattcattgatgcaatacagaaaattttgataaagatactaaactatgataaaatgttgcacgttaatttgtgggaaatgagtagttgcaataaaagatatattttccaaagtatatatagttaaaactgtgaagattgtcatttatacgtgaaaacgtgcaaaactaataattgcgataaagacaaaaaccgaaatatgtagttgggattaaataacaactcttagtttattttatttgtttgtctaatatttaattttatttatgtgttgtatgcatatgacataatgattggcttaaattaaaatgggtgaacttaaaacttatccttatataaatcaaagtccctatgaccatttacgacatttcacgcttaatatgttgtcggttgaatagttagaatgtgggagtacacaccgaaatacacaccgttaggcatgactacagttacggttattacgattacggtttattaaccaccggttatggttataatttttttttaactttaattttaaccgttatatatacggttaaaacgattacgattaaatacggttacggttaaatacggttatagttacatacggttacggttatttgataattatgatatagttaatatataagacaaaatattatattttttaaactttataataaaataaataaatagtgatatatcaaataatatttattttacgtgattttgtgtttcaaatatttatagtgaatcagttatctatttttctttaagtaaaccaatgaataaaaaaattaatgatcataattataatgattgaattaattacattttccaaacaaaaacaatactaatgagaagatgttgtgaacattaagaaacagtttcaagagtataaataataataatatgaactacttataatttgatttatggtaaaaagagtagtggagtaacttcgatcatagtagtggacatattaaacaatttaagttactattttagtgaaataattatttatttatacactattataactatattttaaggttttgaaaatacgattaaccgtacggttttgatacggttacggttaattaacggttacagttagtatattttcttaaccgtaacagatctattttcactgttaacggttacggttattaaccgttttatacggttacggttgggttacggttaataaacggttcggttacggtccaaaataccgttacagttagattttggttatgcctacacaccgtaacgactatttttctcgaaaatttacttttaatgtttgatgagaaggtattattgtacaattataaattttaatataattttcgtttcgatacacaatataatctccaccaaaatctttttcatcatggctataatttagtttataattttacttacaagaaatgtttaattgatatcttgagtcaagatgagtctaattaactttataactatataagatgcatctaatatgttatataaaaaaaacacaacaaatgaacataactaaaagaaaatcaaacataacttgttaaagtactgttttaaaataaaacgggtgggtactcacctaattattttaaacctactcttgacactaaactggcctataaatagaacaccatggaaaggaaaagagacacacacaaataaagaaaacgaaaacacttttatacttatattgcagccatg

SEQ ID NO: 7004 - DNA, 3000 bp, Unknown; identical to SEQ ID NO: 6998
  misc_feature (1)..( 3000): cDNA_ID_3049514_gDNA_ID_1621121_Annot_ID_56284 3000 nt of promoter + ATG

SEQ ID NO: 7005 - DNA, 3000 bp, Unknown
  misc_feature (1)..( 3000): cDNA_ID_1816407_gDNA_ID_1621121_Annot_ID_56286 3000 nt of promoter + ATG
accggaacttcttaaccaaattctgagcaagtctcctctcgagtctaatatacttagacccttcttcactctcatcatcatctctcttcctcttcccattactctttatcactaaagtcctctcttcctccactgtaacctaatttcccaccaaaacccccaaatcataaattaaattaaaaaaaaaaccctaatttcataaacaattcaacatttctatgggattatatcaatacctggatatctgattttgaaattccggggatatcgagataaaatatgtattctttgggagattccaaaatgtctattgggatattattgctacttcctcttccacgactctcgttattactttcgccggaacgagaaatcgggagaattagcttctcgatcgcctccggtaagccaaaaaagtggttaatcgcaacagcactcatcttctccgatcaatgactgccagaaaacaaaacagttaaaaaaatcaacaattctgaaattttccaggaaaagatcgatacagagaataggatcattacctgggaattaggataaccctttccaattggatcttcctcttcttcgatttgatagtatggggtttgaaattttcactccattgatatatagtgagtaaacaccagtgagctagaaagttccagagaaaatttctagaagtaactagtgaacttgagagttgtttcaaaagcttccacgtcattaaatctccttttattgggccttataagttatttataggccgtttagcacattggacttgatttatgtctttgttctattttgtatttttatttcttatatctgtttttattgggccttgaaagttattccaggccttagcccattagacttgatttatctcgttttattttagttagagtttttgagacttgagacaacctacctaaccatactatagacaagaaaataaaaatacttttgtatattagagaaattttgaaatccgtcagtgtgtatattcaatattcctaacgaaaaaatggccaaagcataaataccttatagcgatatttgagtatttaccataaaaccattcgaatactgtcacggttctaaatttctaatattgttcttttgttattaaaggaaagagtgaagggtgttttcgtcatttaacatatccatcgggtcaataacggagattacctatccggtgaccttatcccctcgccggtgagcgaatctcagatccaaaattttgcaaaatcctcagatcgtcttaccttctccgaatcgatcgatttttcatggaggacgacgacgagattcagtcaattccatctccgggagattcttccctttcaccacaagctcctccttctccgccgattttgccaacaaacgacgtgacggtggccgtcgtgaagaaaccacaaccggggctttcttctcaatctccgtccatgaacgctttagcgttagtggttcatactccttctgtaaccggtggtggtggtagcggaaacagaaacggacgaggaggaggaggaggaagcggtggtggtggaggaggaagagatgattgttggagcgaagaagctacaaaggttctaatcgaagcttggggagatcgattctctgaaccaggtaaaggaactttgaagcaacaacattggaaagaagtagctgagattgtgaacaagagtcgtcaatgcaaataccctaaaactgatattcagtgtaagaacagaattgatacggtgaagaagaagtataagcaagagaaagctaagattgcttctggtgatggacctagtaaatgggttttcttcaagaagcttgagagtttgattggtggtactacaacattcattgcttcttcaaaagcttcagagaaggctcctatgggaggagctcttgggaatagccgttcgagtatgtttaaacggcaaactaaaggtaatcagattgtgcagcaacaacaagagaagagaggctctgattcgatgcggtggcattttaggaaacgtagtgcttctgagactgagtctgagtctgatcctgaacctgaggcttctcctgaggaatctgctgagagtctcccacctttgcaaccgattcaaccgctttcgtttcatatgccaaagcggttgaaggtggataagagtggaggtggagggagtggagttggagatgtggcgagggcgatacttggatttacggaagcttatgagaaggcggaaactgctaagcttaagttaatggcggaactggaaaaggagaggatgaaatttgctaaagagatggagttgcagagaatgcagttcttgaaaactcaattggagataacacagaacaatcaagaagaggaagagaggagcaggcagcgaggagaaaggaggatcgttgatgatgatgatgatcgcaatggcaagaataacggcaatgtaagtagctgacaattgaacacacaaatgttcctatgatatttgctatgataagctggattttaggttttgatgttgttgttgttgttattgttactgccttgtgggatgtgtaaatgtagagaagttatgactctgattatcatcatgttgttgttattgttatccatcttcttgtcttaaacatgggcaaattaaaaagctttgaacttgaatagcttgttgaaaacctctgtgattcttaagtagagttctgaactagtagtttgtgattctaagttaagacacagcttatagaatattcaccaatgagattagagactaatgattggattagtcagcatatttatccttaaattaaaatctccttaattaagccaaagcttataattaacctcactaaaaatattcaatgcttctctcttctctttcatccttacctctctactacctctataaaaccatttccattgcaaaggaaaaaaaaagaagatagagacagtaaaataaaaacccgaaataatttgaaaaaatattgttatatatttttggataaatttttgttgatcgg

SEQ ID NO: 7006 - DNA, 3000 bp, Unknown; identical to SEQ ID NO: 6997
  misc_feature (1)..( 3000): cDNA_ID_1816391_gDNA_ID_1621121_Annot_ID_56294 3000 nt of promoter + ATG

SEQ ID NO: 7007 - DNA, 3000 bp, Unknown; identical to SEQ ID NO: 6996
  misc_feature (1)..( 3000): cDNA_ID_3438546_gDNA_ID_1621121_Annot_ID_56295 3000 nt of promoter + ATG

SEQ ID NO: 7008 - DNA, 3000 bp, Unknown; identical to SEQ ID NO: 6995
  misc_feature (1)..( 3000): cDNA_ID_1807926_gDNA_ID_1621121_Annot_ID_56297 3000 nt of promoter + ATG

SEQ ID NO: 7009 - DNA, 3000 bp, Unknown; identical to SEQ ID NO: 6994
  misc_feature (1)..( 3000): cDNA_ID_1816387_gDNA_ID_1621121_Annot_ID_56298 3000 nt of promoter + ATG

SEQ ID NO: 7010 - DNA, 3000 bp, Unknown
  misc_feature (1)..( 3000): cDNA_ID_1816504_gDNA_ID_1621122_Annot_ID_56301 3000 nt of promoter + ATG
tttggaaacttcccaaatacaccgaactccaaaaaaactcagtctagtggaacaacaccaggaaaagaagtatgctcgggtagcactgtttcttgtcaaggcatgagaagtacatcatttactctagtctctgatgaaaaattggtatcttgtcgaaaaggccgtactaaaaaagagatagcaatgcttcggcaaaaatcatgtgtggaaaaaattaggacttacagcaaaggcagtggctataaggcggcaaagtttgcatcagttggcagcttccttttagagaaaagagtcaaatcatcttctgaatttgtgccaagaaattcttcatcaaagataacagcagagattggagtgaaagtttcattagctgaggatagcggctgttttgtaagaaagaacagtaagttggattcacctgtggtagtggtagatgcaaagggctatataactgccttacctgctaggtcggtaaaatctgcttcaaaaaaaaagactggttctgagtctgtaactctgataccatcagcttcagaaaagaagtctgattcttcgataccatcaacttcagaaaagaagtctggttctgagtctgaagagaaggcatctgtgtctgcaaagctagcaccagattactatgctgggatcccatatgatgcagctctgggtatatatgttccccgggataagaaagatgaattgattctaaagcttgttcctcgagtgaatgatctgcagaatgaactgcaggtctggactgactgggctaatcagaaagtaaaagaggcaactggtagactacttaaggaccaaccagagcttaaggcactaaggaaagagagggaagaggcagaacagtataaaaaagagaagcagttattggaagaaaacactaggaaaaggctatctgagatggattttgcgttgaaaaatgcgaccagccagttggaaaaagcattcaatactgctcacaggctcgagctggaacaatctatactgaagaaagagatggaagctgctaagataaaagccgtcgagtctgctgagagctttagagaagcaaaagagagaggggaaagatcactgaaggatattcactcgtgggaagggcaaaaaattatgttgcaggaagagctcaagggtcaaagggaaaaggtgacagtgctacagaaagaagttaccaaagcaaaaaatcgccagaatcaaatcgaggttagccacttttgtagacatacgttaggtcttcttgtcttatgacgattatcgataggtacccgcaattcaccatatgtctcatctgctaacgtcccttcctttcatattcgtatctctggtaacgattttattcttttggatacatatatatcaccttgtacattgctatatctaaggaatgcgataaagtaaaggaagaaaaaatgtcagtatcaggtgtttttagtctactgcatccttctgctttaaagtagctctagaaatgaagtgtagtaatatcaagagtgttgttgattgcaattgatgttttttatctatctaggtttggtcgatgttgtatcaggtgtttttagtctactgcatccttctgctttaaagtagctctagaactgaagtgtagtaatatcaagagtgttgttaattgcaattgatgttttttgtatctatctaggtttggtcgatgttgtaagtttgagaaagggttgtttttagttataggagttgatgaagacatctaacgaaaattcctctgcaggctgctttgaagcaagaaagaacagccaaagggaaactcagtgctcaggcttcattgataaggaaagaaacaaaggaacttgaagcgcttggaaaagtggaagaagagcggatcaaagggaaagcagaaaccgacgtgaaatattacatagataacatcaagagacttgaaagagagatctcagagctgaaacttaaatcagactactcgagaatcattgcactgaagaaaggcagcagtgagtcaaaggcaacaaaaagagagagtcttgggatgccgaaagtgaaaagagaaagagaatgtgtgatgtgtttatctgaagagatgagtgtgattttcttgccttgtgctcaccaagttctttgctttaaatgcaatcagcttcacgagaaagaaggaatgatggattgtccgtcttgtcgtggaacaatccataggaggattcaagctcgtttcgctcgctccgggtgaaagctttcttaacagtttaaacttgtagaaacaacagtctctcttctatctatgaagaacacaacaacttttggttaataatcccatcttggctttttgaatgattttaactaccaagccaattagactacacgtggctaccttatggtacttattttcatttttgcccttctaattttctttattaattaatgtattcatatcaccataaactgcaaaaaaaaagttaattttggtgaataaatcgacgccaagatagaaatatcttggtcacaatcaaagattcaataatgtggggcgtaaagcaaagatttataaactatgaagggtgtcaatgcaatgttttaaaaaaatacagatagaactacacttatgaaagttccgcgtatgaaaagtcaaaaaagacattaacgttgaccaaacaaaaaaaagaaagaagaggaagacattaacgaagacttcgtcgccgacgactttctggatttatcgttgttgttgttaatgtttacctcttccgatttgaagcaaattagggtttatttccatccaaaatctccttttctcatgctcaatgatcaatttccccccatttcaaagttatctctctcatctccaattttgaattttctcccgatttgtctggctttctccattgctgatttttcaaagttttcttctccattcgtcgtatttctgggaccgttcttccctatactcgccatcgtcaattcgactttgtgagtctccctctgcgggagttcatcagcgtcggcgagatg

SEQ ID NO: 7011 - DNA, 3000 bp, Unknown
  misc_feature (1)..( 3000): cDNA_ID_1808095_gDNA_ID_1621122_Annot_ID_56302 3000 nt of promoter + ATG
gattcggattcggtttctggaggatctaggtcttccgtgaagacggatttgaagaaattcatagcgtaaagctcagatcttaccaatcggtactctcagataatttgtttgatccgtgaaagaatcaatttgaagagtgaaggattcgaattagcgtcagaaataggaagatcacaaaagacttgaagcttgtcgctgcagagacgtctaatttttttcccatttttttaatgaagataaataatactttatttggcgtcaattatcagattaatgggccagaagttttataaatgggccagaagttggatatgttagtccaacaaataacacaaaaccctagaattcattcaagggaactaacgtcaaggtttttgctcttcttctctcccaagtcccaaactcgttttgcatcgccattgttgtgttgctggagctaaatagagagaaagagagagagtgtctgtgatggtgatgagaaagctacagttaccgttgagccagacgcagaaggttaggtttgagagagcaatcgagcggcttcaatcactgtcgtcgtcggctaactctgacgcttctgttatcgtcaccgactctattcccgtcaaccatgacgatgccttcctcaagtaatttcatctcattctcccttctggattgaaatttttgtcaaattgcgttttcacgattggttttttcattaaaggggacatggaacttccgaggtcgatggtgagttgctcgcgacggtctgtggagtagtggagcgtgtggataagcttgtctatgtacgcaccttgcgagccaggtctgtgattgatctttgaatttgtttagtttcccagaaaatgtgaatagaatggactctctactctgagattaagtagaactgatggttttgatgatctacgttttaggtacaagcctgaagttggggatattgtggtaggccgtgtcattgaggtagatttttgttttggtgtttggatttttgaaatcggattgagtgagtaacataaaggtttcaatcacattgcacagttactggattgatctttacttattcaggttgctcaaaaacgttggagagtggagctcaacttcaatcaggatggagtactgatgctttcttccatgaacatgcctgatggtattcaggtacagtttgattcttgatattttgccatttggatgattgcttttggcttcaatgatataagtttattgttgttgccagaggcgaagaacctctgtggatgaactcaatatgcggaatatctttgtagagcatgatgtcgtatgtgtaagtcctgtgattagtaatgttccaatctttacatatcttaacagttacgtcaacctgactaaaagggttccctctttggtttgttcaaactcttaggctgaagtacgcaactttcagcatgatggtagcttgcagttacaagccagaagtcagaagtatggcaaggttggttctcatttggtcacatgctcatgtagttatacctttcgctagtctcttcctctgaacattgattaatccatgaatcgctacagctcgagaagggacaacttctgaaggtcgatccttacttggttaagagaagcaaacatcactttcattacgtagaaagtcttgggattgatttgattattggctgcaatggtttcatatgggttggagaacatgtcgaagtgagagatcctatggcaatagatgatcagaaagatgaggaaatgatctcatcctcctccacaggaaaagagcaaagccatattccactcgagactcgacaaaccatatgcagaatcgggaatgcgatacgtgtcttgtctaatctaggcttcaccgtgacactagaagtaatcatggagactgttaacctcagtaactcaaagaatattgacatacatgatatgcttggatcagagtttcacgttgtggtagcagagaatgaagctgaaagaagacgtacaaagaggaaaaagtgaaaactacccctttttgtcactgatgtatcagagacttgtaacgtgtattagatcattcggtcttgtttgttactcagcttctattgaaagttcgaattttaatctgattgagatatgtagtatgatggatgtgtttgatactattaactgtacatcagattagattagtcgagttatgtcttttggagacggctttcttctttcattcatgaatttatcggtttcgacttttgtagctgaaattcgttttgtgaaaggatctacagttgcagaaacaacatagaaaagattcgctgccctttttagctcggagaagggataattgggaaatgactaaaataccctcatgagaatccaagtaataacagcgattaccaaacctcttctctcattcacgaaacagtgttctacggccaatttctctcgctcgctccacactcccaaaacaatattcttcttcttcgatttctcactctctgtttgtcgctaccgatcttatttcccgctatttttgttccggcgccgttctccttaaagtcgctattgtcttcgttgaaggtcagtttacggccttttttaaatccattttggtgtattcgtgattgtttgtgggttgaatgatcgtgcgattatttggggtttttaattaatttcgattcagtaacggttctgaattgcattgcgattaagcacttaatcagaaagtagtacgctttagatttgaggaatctctgtacatttactaggcaaaaagtttactttttttttttggcgtatttctgggattgcattagttaggcgattgaatcacgtttctgaaagctacaactaggagatgaaatcatctctcttttgcatgtatacagataatttagatgattttggtctaacatctttgatactttaatggtttttgcatatgaaacaatttcgtatctatgttctacgcttttttgtgtgtgtttaacttaagtcgttcatgtgtaatggattaaaaaggtgatg

SEQ ID NO: 7012 - DNA, 3000 bp, Unknown
  misc_feature (1)..( 3000): cDNA_ID_1816482_gDNA_ID_1621122_Annot_ID_56309 3000 nt of promoter + ATG
tccacattcatctcccatattaagcactggaactccaagtgatatgtactgtataaacaagaaattgcggatttgttttagccttctttgaagaacagctgatttattcgttgctccttcttccccacaattccaacttagctctgaagctagctcagggccactgaaactgactatgtcaacaagcgagagtcctgagtttcttgaaatgtagttgaaggagaaggccggacctcttccatcggtaaatacgtcaccacttccacaaattcttgtagccagatcactaagaacgcctcttccccttaaaaaatttcttacatttcgacaatatcttgtgttgagttctgcccatcgcttccaatgtgggaaccgtacttcttttggcatcatttcaagtggatcccagcaatcagctattagtttggtctccgcaagaagtggatcaaaagctattgcttcaaccaaaggaggacgagagagctgttcaccgtgaacgcctctcaagagagatgaagcatttataaaacaaaatccatctacatgaaactcggttacccaataacgcaagctctccaataccaactgctgaacaacaggatagttacagttcaagtaacttttagaatctagatcattggctcttcccttgtagtaataggaactgtcatcaattccacgaagagctccagaatcagcagtatgtgtaaaaactacttccaaaagtacctctattccctcactgtgcaatttcttcaccatcactttcattgagttaactgcggattcaaggctattggaaggtccatatatgtccattggtgaaaagaaatgaaatggaaaataaggacctttttgctcggagaatgagaatattggctccaaaagaacagcgttggttccaagggttttcaaatggctaactttctcagctacaccagaaaatgtccctgctacgttactaggcaacttgctggatctgtgttgtgtaaaacccttcacattcaaccggtaaacaagaagtttctccagaggtatgttcggagacacatcttctccccaatcaaaagaaggactcttagataaacttccaagatatttctgagagacagatttaccaacgactgtggcatatggatccaagacaattggctcaccttcaacatcgacatcttctttagagtgagctgtctccttgcaacggtagccatatctcacaaaatcccatgtattgtcaactgaagcatgccaaacatcacctgttcggttgacataaggatcaagatcaagttctaaagcaggtttatctgttgtgctatcatcatacaagcataaaaccacgttcgttgagcttcttgaaaagaacgaaaaattccaagaatcatcatctggcccggaagaaaggcctagcggcaatggatgaccagcagtaaaaccaaccgggatacagaagtcagtgtccctgtgagtcagcatttcttgaccgtccggatctctacctgacactaacttcaggtgaaatgataagtagaaaggagattctttcccatcaaattctagccctagcattaactcagacaaggagcttttcacaaatgtagtttctgttgtgtgggtttgtgagtcttgggaagagttttcgaaatccagaggcaaaaaacacgaagaatcagacctgtagacaccccaaaccatcaccagcctactcttgtcatcaccactaagttccaaagatgagacataaaccaaaatgctgtacttttctctcttcttttcaactttgactttaaccagagcacctgcttttgtcctgaatgaatatgatgttaccttcttcaggtcatcagcctcagctcttctactagacaatgcctctctcagctcgatggaagtctttgaagcacatatcttactaaactgataactttgcaacgcgcttgtaaccaaatcacccatgaaacgttttcgtgtaaacattagtgtctcggatccaagtttaatcttgttcttcctaccagtaaaaagccttgcagaaggaaacttccatgttctagtgatgccattattgagacaacaagatcctatcccaactgatggtgaccacgcagccattgtttaaacaaagcaccaaaaactttaatccaggttatgaatatccctgttaagaacacagatcaaaccccaaagctctttattaagattgaacgaaagaaaacagaaaccaaagcagaatttcgcaagggaaactatatccaataaacaactcgttgaataagctaaattcccatctcaaagctaaaatcaaaacagaacccacttagcaaagttttcctaccatcggcatttcaaatttccagaaattaagaaagatagtgtagtagaatcaacaagaacaagacgtctcgggatcatgattcatcggaacactaagaaataattgaaaaaaaaaaggaacacaagaaagcgtaaagaagagacaaacgtcgtcaaaaaagtcgagcttactgtcgcataagcatcatcaccgccattgaagcaaaaaaccaaacttggaaacagagaatttcacaatgattgaaacagagatatctaacactacccatctgatgatcgagtgagtgtatgtgtccatgagtttatgatttgattttttttgggtgaaactgaaatgttttgtcttcttccttcacgaactctccaccttcacctcacgcgcctacaaaacggtttttagcgattgtaacatagacacgcgcgtaaggtgcatgtgggggttgaaaaggagtgatcttatctgggccgagcccataggcccaataattttgaaagatacgacaaaagtacttttcagttttgaaagttcaagacagaagtgagctgagctgttttcacttcaagagtggatattgccgttttaaggtgtcacttcaagagtggatttttactacttttgtttttagggttttgtttttggagcctaaacattgttagtttctgtca

SEQ ID NO: 7013 - DNA, 3000 bp, Unknown
  misc_feature (1)..( 3000): cDNA_ID_1807717_gDNA_ID_1621122_Annot_ID_56310 3000 nt of promoter + ATG
gttcgttttagactgcatcggatgaaaaaaaggctcaaagatgagctagaagataagaatactgttcaggagtatggctgtcctaactgccaaaggaagtaaagcccattactctttatgtgtttataaaatctttacatggatgagttgtattatgttcactaaagttgaatagattttcatttctgatgtagatataatgcgctggatgctctgagattaatttctatggtagacgattcttttcattgtgaaaattgcaatggtgaacttgttgtggaatgcaacaagctaacttccgaagaagtagttgatggagatgataatgcaaggagacggcggcgggaaaacctaaaaaatatgcttcagaaattggaggtatctgtatactgttttagtggttcaatatgcttgattgtgttttcttttattctggctttagttatataatttgtgcgttgagagaatttgagtatgaaatgcaggttcaaatgaaacctctgatggatcagttaaatagagtaaaagacctaccaatacctgaatttggatcttttctggcatgggaggcccgtgcagcgatggctgctcgcgagaatggtgatcttaaccctaatgatcctttgaggtcacagggcgggtatggttcaacaccaatgccatttctcggagagacaaaggtgatcactagttacacttttcaatgtatatagaagttcaatgttataatggaagatgaggcagtggtattgtaatgaaatttccatttgtttgtccagtcagttcatgttaaagcttttttcattgcgcatatacatctgcaaattttccctgcacttttcctccttcattgtggtttgttgatttcttaaatcttacatggttaggttgaggttaacctaggtgatggaaacgaagatgttaaatctaaaggtggagactccagtctgaaagtcttgcctccatggatgatcaaggaaggaatgaatctgaccgaggaacaaagaggagagatgagacaggaagcaaaggttgatggtggggcaggagcagcagcaaaactttcagatgacaagaaatcagccattggaaatggagatgagaaggatttgaaggcatgcttttggggacaaatcctttatatctatttagactcccacagtagcttcgtacttctggatatgtttcaagaatcttgatacagtattttcattttgcttcaggatgagtatctcaaagcttactacgccgaacttatgaagcagcaagagcttgctgcaaggcgaaatcaacaagaatccgctggtgaaccaacttctggcattcagtcgggtactgtatactcaggtcgtcaggttagtatgaaggccaaacgtgaagaggatgaagacgaagatgaagaagaagtagaatgggaagaaaaggctcctgttactggtcagtttgagtttatttacttcatttccatttcgcatactcgttgatcaaatgaaacgacacactagttagttagaataaaaggaaccttgtttagtagtatatattgaaatcgcagagcttcaacaagaagaaacttgttaagacatgctcataattaagttagattacacaggtctgtcatggttatatgatgtaaaaagattatgatatgctcgatttggtaacttaacattttacgactcttgcagctaatggaaactataaggtggacttgaatgtggaagcagaagcttcgggtggtgaagaagaagaagaggaagacgacgtcgattgggaagaaggctgaaaaacaaatggatcaaccattgatcatagaatgaagtggtcgattgtgaattctcatgtacactataatgattaatgacttttagtatctcaccatctacaccaaaggttgatttatctgtgaaacaaaaatggttttatggttttggacaaaagtccaatttacaagggtgttactgttaagtgttgttgtttataattctgttgggaaatatttatggcgatatttgacatgtggttaagtgtatttttgaattaatctctctttttgtaatttttgtttctttcgtaaattagataaatctgttgagaaatagattcacacgcataacgttcatttgcttcatccagaaaaatattggaaaaactaattaattcagtattatttttgtaaataaaataaacaacaagccaatcataatttaaggtactttcccagttcgacaaaatccaataaagaaaataatatttgtcccttgcccattggttgttgcatggacctagccgagaaagccacgtcagtgaaagtcaacaacttgacccaaataccctcggatacgcaacaaaattacgataccacccacagcacgacttagtcctcaagtcgttaacataagagacggagcaaaactttagttacaaatcgttcctcctcctcctcatcttcctcacagctctcgcttctgatctcttacttgcacagaaatcgaaaattttctaaagcttttgttctattctcttcgttttcctctggtaattgaatcgtcgaatttgaaacttgattttcccgtgtgtatttttttgatgatttgtgatcgtttctaaaaattatagtttgatcttttcatgatccgttgatgattatgacggctaggtatatctcttttctcttttcttttttttttgattaggttttacaattctacaattttagaaagcttgattaggtgatactgagtttgtacttttcggatcattgctcttttgtcttctgcacttgtatgagagtgtgtctctctcatctattttcatatcacggattttttcttcagggtttttaacattagggttttcacaagaggcttgtgatgtggctttactagtttatatgataaattatttccagagaatttcttgtatgctagtcttctttgcatcaaaactaatattttgcttgttttttttttctgcagagtttattaactttcactgatg

SEQ ID NO: 7014 - DNA, 3000 bp, Unknown
  misc_feature (1)..( 3000): cDNA_ID_1816478_gDNA_ID_1621122_Annot_ID_56311 3000 nt of promoter + ATG
gggggtgaactgacacacgaggaaacaatgattataagcggagctctggatttgagccagaaggtatgtatttgaattagatgtgcgtatctgaaacctacacaggtcatgctgatgaacaagttatgttgtaaatgaaatgatttacttgctattccccattgatctggatttagattctccatgaaaacttgttgcacgaggatgagtttactttgttgaactgatgcatatactttgattctttcgccttccagttcagaacatatcatatactgcttcaatattacttccaatgatctaattcatatactttcgtttactggaagttcagactgctgaggaggctatgacgccaattgaatcaacattttcgctggatgtaaatacaaagttagactggtgagttaaggttagagttggccttttttcgacaaattgttttctctatctggcaagtctttgaaaagtaaactattttccttggtctatctgcttagtaataacgcatggtttgaaatcatgaattttcacctcctaaatgcagggaaacaattggaaaaatactgtcacggggtcatagccgaatcccggtctacttagggaatccgaaaaatatcattgggcttctattggtacacctgtcaaacttttgcattacttcattttactaaatcctactagattacatacgtctgtatccgctggtatcatctaggttaagagtcttctaactgtacgagcagagacagaggcacctgtaagctctgtttccatcaggaagatcccaaggtatatctgacttccctgagtataagttgacctactcatattatgtttctagatagaagtataagttcccatacattgcctttccagggttccatcagacatgccattgtatgatatcctcaatgagtttcaaaagggaagcagtcacatggctgcagttgtcaaagtcaaagacaaagataaaaagaataacatgcagttactgagtaatggcgaaacacccaaagaaaatatgaagttttaccagagtagtaatttaacagctcctttgttgaagcatgaatcccatgatgtagttgttgatattgataaagtaccaaagcatgtgaaaaataggggaagaaacttccaacagaacggtactgtgacgagagacttaccgtgtttgttggaagataacgaggatgcagaagtgattggcatcatcaccttagaggatgtctttgaagaacttctacaagtacgatcttatgcttttcgtttttccttttctgacctcaaaaatctctcttttatgcatatttttttctatatacatttcactttacggagctttcctttggtgatttactgaaaatgcaggcagaaattgtggatgaaactgatgtttacatcgatgtacataaaaggtattgtagtggtatttattacttctgagtcacttatctaatgtttaccaaaggaaggttctcactaaaaagtaaaagtgcatcatattttgctattatttcagggtacgtgtggcggcggctgcagcagcagctgtatcatctataacacgtgcttcaccagcggtaagcaagcaacattggctgatcaaatcttcggcatctcttaaccaataaatttgaaaacttgtgaggggttaacggttattttgtgtgatacaggagattcaaagcaaggtaggacaaacggtgaagaagctagttgggaaagaagcacgaggtacaaagaattacacaacaaaaatcacagagcctcttttagcagaatcagatagatagtagttaaaaaggtttaaggttcagtagcacttactttgttgtatgtttgtgtgtgtctatatataaagttgaaataatgaacaaaaaaaagagaagaaaagagttttgtttctttcaaaaccaataaaatggtacataccgatttcatcagcttgaacgatatgaagtatgagcacaaaagtggccgatgactcaaaatgtatttccatctttctccttaatgcccaaacgagagatatcatctatagctcgataccaaatccattaagtaagtattcacgtaatgtagtaagcaacttctcaaaaggccaatcccatggccatgagtaagtgaatggcatgtcgtttaagcaatgcatatgggtcaatccaatctctggtaatatttttcttccgtggaatgttaatggatttgatgatttgagttcatttatccaaccaaaatcttgttattaattcaattataatcaactaaaataaaagcaaattttttgctaattacagatacaaataaaatcaattatggaaattgaaatgaaaattaaaatgaggttgatctatatacggtaattggtaaatgttaacaccaaaaacagataaaaacacaaaaaagggtagacagagaaaaaacaacacagagacctctccgtcgtgttctctccccctctcttgaactttccggtaagcttcgtcgattttcctgttggacaagtgattgtaaaagtagatagttttgattaacctagatatctccattcttgtagaaacttcacctatagctcagtcgggtctgattgttacttcgaattgagtcgattgatctgccttataaaccctaatttcgtggtccttgtgcactctcacagtttccgaacccttattcttgattttctgaatttcctgagctctctcttgttactaatttgatttgaaagatggatttgggagtcaattcttctcatcgatggctctgggttttgaaattgagttcgttgtttctatgatttttgagcaaatatcatctccgttggttacttttagtgtgtttaagtttttgaacagctaatctctgttagttacttatacggtgattgatctgttttcagtttattctctgtatcaatgcagattttgtatcaaacacgaacctaatactgcttccttgactggtaatgtaagtatttgggttgttaactccatg

SEQ ID NO: 7015 - DNA, 3000 bp, Unknown
  misc_feature (1)..( 3000): cDNA_ID_1816472_gDNA_ID_1621122_Annot_ID_56313 3000 nt of promoter + ATG
gccagatagagaaaacaatttgtcgaaaaaaggccaactctaaccttaactcaccagtctaactttgtatttacatccagcgaaaatgttgattcaattggcgtcatagcctcctcagcagtctgaacttccagtaaacgaaagtatatgaattagatcattggaagtaatattgaagcagtatatgatatgttctgaactggaaggcgaaagaatcaaagtatatgcatcagttcaacaaagtaaactcatcctcgtgcaacaagttttcatggagaatctaaatccagatcaatggggaatagcaagtaaatcatttcatttacaacataacttgttcatcagcatgacctgtgtaggtttcagatacgcacatctaattcaaatacataccttctggctcaaatccagagctccgcttataatcattgtttcctcgtgtgtcagttcaccccccttaccagcctatgttggagagaaatagcatgtcaatgggagctggaaacaacaatacttttgataatcaagcaacgtaactaactacttcacaaatcagacaaggttacagcgtaatatctgtccttttcctattctggattcgccaggttagatcataaagggaaactacctcctggctgtgaattgagacaagggctttaagctgagctcgcctaaatagtgtgtcattatgcccaattacagcatcaagaacctgaggcatgtaaaacgttgataaaagtaaacatctacagctccataccactgtggcataataaatgtatcaacttgtgttgatgatataatcaatgcagttagctctaacaagtaccacttcttaaagacattgctagatttttcaacaaatttccaaatcttccatggttgtaacataacgttctgactattgtagcaactagtgaaacaaaaccatttattatgacatttagtgctctattaaagagtagtctacaacaacatcacctttccgatagggtaagcaatcggatagcagattatcatcaaaatgcgaaccaaccacaaaaagtttgcgccaacagcaagtccatatctagagcatatagcttgcggaattatctggttagaattgcaacaacatagtttgtatcagtcataactgaagagaacacaatttgataccaagaagatatgtaaagtaagttacctctccaaaagcaagaacaaaagtaactgagagtaaaacagccacaaaaggatggaatatcttatccaggcatataggaagagcctgagacaaaagatccaagaacaaaattcactgattctgaggtgcacaaagacagtaatttatcgttgtaaatcagaaaaactagggtaacaaatcaacaataattaacctccatagcagctgcattgcaaagaagtagagtcacaagaagttgatgctgcttctttaccactggtaagattgcagctgcaatatccaaaaacaattcaagtaactccgtcaagagtaaaaatagagactctatcactctgcttttaacaaaaattacagaataagaaattagaaatcaagttttaagaaattctatagccattacgaattgaacaagtcaggtatgtaattttgagccaacaacacacagatatcgaaagtcgaaaaaaattaaagaggcgtaccggcctgttttttctcggcggaggaaccactctgttggagaatctcgagctcaacgagaccaagggacattagtccgagtgtgagacccgacattattccggcgaagagtacgaggaaacacgcgacaccgacgacgacgaaccaccacggagaaccgaatcggatgtcctcggcttcaaagacgaaactgttgagcgagtaagcggctcttaccaacgccaaagtgctcagaacaaccattgccgcgcttcgatgagagacaaaatcaaacagagacggagctagagagagagagtgtgtgttttttttgttggtaaggaagaagacgacgatgaatacctttgatacggggatacatggaccacctgacacgtcagcatcctacatgcgttatttccttatttttctctctctttttttaactcatgcgtttttttgcgttattcttcttttaattgatttgttggattattgatgacttctgagttttgctaatcatcttatttattcagcgtccaccggttttaacgcccgagaacgatatacaccttacctgattacctctaatcacattattcttgagattatcgaaggtacatttggaccgctagcaaaaaaaaatatgtaaatacttatttttcaagttacaaagctaatgttattgacaaaagaaaaaggaaaaaaaaggatgaaatcttggaaagctacagcattttgttctgcccaacgcaaattgtaacactaaagatttcgtatggtcaacgtgaatgataatttaatcgtaaatattttcttaagtgtaaaccggtatttaaattcccttaattcatcggaaagattttggtataaaattgatttactttctttgggcttttgggggtcaaactatgagcctaataatggcccaaaaagacttggcggaaattactttttttttttatttgactagtgaaaccggaacgagcgagacgcaacagaatctgaagatcgaaggacagtgaaatcgaagaattgaagcacaagcttctccatctctgcaatctctctatccatctctcgtcatcgcatgtttcgcttcccaattcggaagaaagagagacgacgcgtctgaagcatatctccgtaatcggggtgaagaaaaacgcggcgagaagaagaggcagattttcgttttgggagggtagacaaatctggcgaaagtggagggcctaagggcgaggccgtggcttaagccaggagcttgtataaatggagatcaatatgactacgacggttcggaagacgaccattccaggccttggtggcgccgtcgtctcagatccttgtatatggcagcc

SEQ ID NO: 7016 - DNA, 3000 bp, Unknown
  misc_feature (1)..( 3000): cDNA_ID_1816468_gDNA_ID_1621122_Annot_ID_56314 3000 nt of promoter + ATG
ggttcggaagacgaccattccaggccttggtggcgccgtcgtctcagatccttgtatatggcagccatgtcctttactccgtccacttttcgaatcgctatctcgttgctccttcttgttgctatcgtctccgccgtcatttttctcccggtcgaacaggcaatttctccctccctcctcattcgcgtgtagctttagtgataatgtagcaacgatagtttctgtatattctaagtttagaaattgatacaacggagtatttctggagctcgctagatcactagagaaactgtcctagatcaggcgaatggtactttatatatgatttagaatcatcattaatcatcattgttatgatccctttctgcagaaattgaaggacttcttgttatggattaaggaagatcttggaccttttggtccacttgcattgtaagtttttcatgtttgctactcatttttgtttctaccacttattggtttgttttggtgacactgttttctggctgccgtaaaaaatcttgtgatgagccttttttaccttattgaaatttttcagggctttggcttatattcctctcacaattgtggcggttcctgcttctgtactcacggtagttctggattcataactatgtagtgaaatttagggtgcttttctaagatgtttgtccaaagttttcattacaagataggatacttagacttttaatccggttctgatagtcttgattgtttctctctgcagctaggtggtggttacctttttggcctgccagtaggatttgtagccgactctcttggagctacattaggtgcaacagcggcatttctgcttggtagaacggtatgtctcttatggttccatctgttttaatatatttcgcttgcaattgtgttgcttgccataaccacagaagtactgattcctgttttgtgcgtcctcacatctaggcattttatctaagtgttgcatcttggctgtctcattgttgctaatgatatatcttttgtctttctggtatcatgcagattggtaaatcttatgtcacttcaaaaataaagcattacccaaagtttcaagctgtttccgttgcaattcaaaaatctggcttcaaggcatgaaaatctagtaacactctctataataattgacagtttgttttccttcagagatctactatgcgtatggcaaagtacctcaatttcctggctacatttaattgattgactactaactaaatgatgatattttcttcctgtgcagatagtcttgctgctacgcgttgtccccatactgcccttcaatatgttgaattacctcctatctgtaactcctgttcgcttaggggaatacatgctggccacttggttgggaatgatggtactgacatttctttaaaatccgcttgtatattggccatttatactttaataatggtggaagaagttagcatgcatgttaaagtgctgattgctaacattatacataatagtaattctaatcttctgaattgttttgatgtagcagcccattacatttgcgctagtatatgttggaactactctgaaagatctttctgatattacacatggatggcatgaggtgtcagtatttcgttgggtaagttttcgctcatttacttccacttgactagtagattggaaatgattgtagatgagcttgaatgaagtcagaagaatgaagatagttttgtgtttctgctgtaatgcataattacttatcacttatcatttatactgagattactaggtttagaagtttgtagtattagaaaaataacaacttgtctgaaatgaagtttgaagtatgccttattttatgaggtttattggaaacatcttggtgtatatccctcaatataatgtagagttgcttattttccataatatgatagacatttctgggatctgaaatattgagaatgtagcttaaaaatcctgaggatgaggatttataaccaagtccaaagcatcctatgtgtagggaagaacattgtgatagtctcgcatctgcatttatttagttggtattttgtagctttgattgaagtatctgagtgcccttgcattgtaagtctgatttctcgtttcttctgcattgtcatttgtggatgcaggtaattatgatggttggcgtagctctagctggtaagtctcttctgcagtcatgtccaaatatatatctagctagcttcactacattgtgagaagtggaatgacaccatgtggtctgtgttttaacccgtctttttttgggtttttgaatgatgtgggtgcagtaattctgataatatgcataacaagagtggcgaaatcatccttggacaaagcattggctgagaatggtactgaattagatgggaagaagaatgacgacgcttccgtactcccgatcgcagagccaccaccggatctacaagagcctctcgttatcagaatcgacccatccaatacttgaataatatagacaagaagaaacctcttgagtttgtaaatttcgcgaaattttcttaccgagtgagttattagaaacgttttgtatagcatcataataccatacttcacagtttaattcgtttgttctttagttgattattttggtatatacttgaggttttgaaatcttgtaacttgtaagaatgcccaaccggtggctacaataattaaccggaaattaatttgactcgagtccttatcagaccggttgaatcggtcgagtcaggtcgggttagaaaatatcaatattcgggcatattccttggccttcatacgtgtgcgtctgccattttttttctaaactccgaatcccaaaattgttgccttccttcgtctccgatcattttcgtggtgtctgtaaccccaattacaattcgaatccattagcgaaagaaagagacttcctttgaaagagaagagtctcgttggctcggttttctgttcaaatcagcggatttcctcacatttaattgttcaatc

SEQ ID NO: 7017 - DNA, 3000 bp, Unknown
  misc_feature (1)..( 3000): cDNA_ID_3049545_gDNA_ID_1621122_Annot_ID_172133 3000 nt of promoter + ATG
gttttattttagtttatctgtataatatgtctatatgttatcttgtcttttctatttttagtacgatttcttgaggagactagtaatgttttatagttctattaaatgtattaatgttaaatggacttattataatcataattattatagtcagattttataaataatcatcataacaaccaataactgaataataatgtagtggtactatttatcttctttttgtacgtgaagaagaagaaaagaatccgaaaatgtcctttaggaagcttcctcgaatgattttcccatacacaactcttttcagttttcccactcattttctctgtgtatagatttccgactgattattatcattgtttgacaagatatattttctagttagaaaatttctgagcggttcatttcattccactcatgttctctgtgtatcgatatacaaacttaaaaatgaggtcttacaaaatacttggacagaccaattattatcaatgtaattaggaagacctgtacgtagacaacatcagtagtagtagcaggagttaatatttaattaggagcatcaatagtagcagttgcatatgaattaaatgattcgaaatgaactaatattcatatattatatcaaagataatgatatcttggagtatttatttaggtcaccagatgatgatttatattttaaattacatttttaaaatcttataatgaacttacactaaataccaaataaaaatttctgttcagtatgatttaattctataccagtaatttctaacacactataaattattaaatatagttgaaatgacttacgtaaatgtttttttttttttaattacgtgcgaaaaatgaatatgtggtacgtacaacggccacatgaacattaggaaagattgttcccacacgcccacatgaccatcacatgcaaaatctgctcacttctccttttaactcccaccattttttttttttaattttgccttttgctctttcatttagattctgtttctggattttccttgtacgaattgtgaagagactctcttactttttttctcctaactttctttttgcgttatcataccaaagtgcatgacctcattaatcattttactttcttttttttattataaatttttaatatttcgaacgttattgtttacttgttgtctcattggtcgatataatattagattttgcttatacacaataaacacatagaaccggtaggtatatatcatataaaatttgaagtaattttatgcgtgcatccatcaactgagaatcgatatgcatgttgttttgccagcatcaatcgtttgtttcaagtttttggttatagaataattggtaaatgaaacataaaacatgagcattttcattatagtctcatataatattggataattctaaaaaaaaagaaaaagaaaaatctaaattaattcatggtggtttagttgttgaatgtctacctttaaagataaaaagcatggttctagttcccttggtttcgagtctaattatggttggccatttcaaatgtttctagcatattcgtctctttcgtaaattttagagtaatttggaattcatccaatacatatattatctttcgagaatcggatgccttttcattacggttttttttttggttcattaggagttagttacttgaccggttataacgagactatgagtcaagatccaaaactctggtgttaaatgttataaactcacagaaactgtttcgaggtgtatgtattctgcatatattccccgacatggacgaagaaattagtctcagtgtccgtacataatgaacatcccaacatataaattttgcaaagtatataaatgtccaccaatgagaattagacaacctatgagtaatgtccaatctaaaaccccaaaagtgtgtaaatatattaaagtgtcctttgtttctctgcaaacgaatatcgagagagaactctatttccatggttctatgtgccacttgatgcttattattggccactatctcatgcggcacccatttctgtgatatctcaatcattctttttaataatcaaacgtatttttgtttgcgcagtttctattttgagttttgatgaccttcttttttggtaacctgatctcttaaaccgaacaatcactagtttatattggtaaccaccatatcaattttggcaacaaaaacaaagccgctacaataattttgtatggttaaatatgtgcattcattatagtttactacgttataatgtttcgactaatatatgatgaaattggtcatcagctcatcgcatacaacaagatgttgtaacagttttagttatgtttccttaatggaatgaaactaatttgaacggaatccgagagatatgaaacataaaaaaaatgagagggttttataccaaataatcttatgttttatcattaggtaactttattttttgtttttaattagtggaagtacacgtgtaatgaaaaataacatacaatatggtcatgaactatattttttttgtcaaactattcgttactaagttatttgataaaaatagcacgattatacgcgcgatgatatatatcaaattgtggaaaatgttataaagtagaaaattgggccgaagctggatccaattatgattctcaaataacgtgaaggaaggcattttagtcccctctatacggcccaaccactcgccaccgcttattggtccaacttcagggtactttggtaataaatcaaagcttagcttttgaaattaataaagtataggggttgatttgttattctcagtttctatcgggttaatttgtcatttgcatcgtttctagtttccacttttgttgggtgattttcttctctggaaggatctgtttttctcttcttcgtcttctctcacccgcctactgactttttttcaaatttcttcagcaacacatacatacagtcacaaggtttccaattttcgattcacgatggaaatg

SEQ ID NO: 7018 - DNA, 3000 bp, Unknown; identical to SEQ ID NO: 7016
  misc_feature (1)..( 3000): cDNA_ID_1012855_gDNA_ID_1621122_Annot_ID_172125 3000 nt of promoter + ATG

SEQ ID NO: 7019 - DNA, 3000 bp, Unknown; identical to SEQ ID NO: 7015
  misc_feature (1)..( 3000): cDNA_ID_1816472_gDNA_ID_1621122_Annot_ID_172124 3000 nt of promoter + ATG

SEQ ID NO: 7020 - DNA, 3000 bp, Unknown
  misc_feature (1)..( 3000): cDNA_ID_3049554_gDNA_ID_1621122_Annot_ID_172123 3000 nt of promoter + ATG
tcaggatttttaagctacattctcaatatttcagatcccagaaatgtctatcatattatggaaaataagcaactctacattatattgagggatatacaccaagatgtttccaataaacctcataaaataaggcatacttcaaacttcatttcagacaagttgttatttttctaatactacaaacttctaaacctagtaatctcagtataaatgataagtgataagtaattatgcattacagcagaaacacaaaactatcttcattcttctgacttcattcaagctcatctacaatcatttccaatctactagtcaagtggaagtaaatgagcgaaaacttacccaacgaaatactgacacctcatgccatccatgtgtaatatcagaaagatctttcagagtagttccaacatatactagcgcaaatgtaatgggctgctacatcaaaacaattcagaagattagaattactattatgtataatgttagcaatcagcactttaacatgcatgctaacttcttccaccattattaaagtataaatggccaatatacaagcggattttaaagaaatgtcagtaccatcattcccaaccaagtggccagcatgtattcccctaagcgaacaggagttacagataggaggtaattcaacatattgaagggcagtatggggacaacgcgtagcagcaagactatctgcacaggaagaaaatatcatcatttagttagtagtcaatcaattaaatgtagccaggaaattgaggtactttgccatacgcatagtagatctctgaaggaaaacaaactgtcaattattatagagagtgttactagattttcatgccttgaagccagatttttgaattgcaacggaaacagcttgaaactttgggtaatgctttatttttgaagtgacataagatttaccaatctgcatgataccagaaagacaaaagatatatcattagcaacaatgagacagccaagatgcaacacttagataaaatgcctagatgtgaggacgcacaaaacaggaatcagtacttctgtggttatggcaagcaacacaattgcaagcgaaatatattaaaacagatggaaccataagagacataccgttctaccaagcagaaatgccgctgttgcacctaatgtagctccaagagagtcggctacaaatcctactggcaggccaaaaaggtaaccaccacctagctgcagagagaaacaatcaagactatcagaaccggattaaaagtctaagtatcctatcttgtaatgaaaactttggacaaacatcttagaaaagcaccctaaatttcactacatagttatgaatccagaactaccgtgagtacagaagcaggaaccgccacaattgtgagaggaatataagccaaagccctgaaaaatttcaataaggtaaaaaaggctcatcacaagattttttacggcagccagaaaacagtgtcaccaaaacaaaccaataagtggtagaaacaaaaatgagtagcaaacatgaaaaacttacaatgcaagtggaccaaaaggtccaagatcttccttaatccataacaagaagtccttcaatttctgcagaaagggatcataacaatgatgattaatgatgattctaaatcatatataaagtaccattcgcctgatctaggacagtttctctagtgatctagcgagctccagaaatactccgttgtatcaatttctaaacttagaatatacagaaactatcgttgctacattatcactaaagctacacgcgaatgaggagggagggagaaattgcctgttcgaccgggagaaaaatgacggcggagacgatagcaacaagaaggagcaacgagatagcgattcgaaaagtggacggagtaaaggacatggctgccatatacaaggatctgagacgacggcgccaccaaggcctggaatggtcgtcttccgaaccgtcgtagtcatattgatctccatttatacaagctcctggcttaagccacggcctcgcccttaggccctccactttcgccagatttgtctaccctcccaaaacgaaaatctgcctcttcttctcgccgcgtttttcttcaccccgattacggagatatgcttcagacgcgtcgtctctctttcttccgaattgggaagcgaaacatgcgatgacgagagatggatagagagattgcagagatggagaagcttgtgcttcaattcttcgatttcactgtccttcgatcttcagattctgttgcgtctcgctcgttccggtttcactagtcaaataaaaaaaaaaagtaatttccgccaagtctttttgggccattattaggctcatagtttgacccccaaaagcccaaagaaagtaaatcaattttataccaaaatctttccgatgaattaagggaatttaaataccggtttacacttaagaaaatatttacgattaaattatcattcacgttgaccatacgaaatctttagtgttacaatttgcgttgggcagaacaaaatgctgtagctttccaagatttcatccttttttttcctttttcttttgtcaataacattagctttgtaacttgaaaaataagtatttacatatttttttttgctagcggtccaaatgtaccttcgataatctcaagaataatgtgattagaggtaatcaggtaaggtgtatatcgttctcgggcgttaaaaccggtggacgctgaataaataagatgattagcaaaactcagaagtcatcaataatccaacaaatcaattaaaagaagaataacgcaaaaaaacgcatgagttaaaaaaagagagagaaaaataaggaaataacgcatgtaggatgctgacgtgtcaggtggtccatgtatccccgtatcaaaggtattcatcgtcgtcttcttccttaccaacaaaaaaaacacacactctctctctctagctccgtctctgtttgattttgtctctcatcgaagcgcggcaatg

SEQ ID NO: 7021 - DNA, 3000 bp, Unknown; identical to SEQ ID NO: 7013
  misc_feature (1)..( 3000): cDNA_ID_3049558_gDNA_ID_1621122_Annot_ID_172122 3000 nt of promoter + ATG

SEQ ID NO: 7022 - DNA, 3000 bp, Unknown
  misc_feature (1)..( 3000): cDNA_ID_3049532_gDNA_ID_1621122_Annot_ID_172118 3000 nt of promoter + ATG
aggatatatggtgagacggtttggatcaatattaatacggaatgatatactatggtaaaattctaaaattaaacaaaatttacaatattaatacaaaaaataacttaaaatttcagaaatttagttatataaatcatttcgagatgtatcatacataaaaaaaagcaatagcatatatctataaatcatctttaaaacaaaaaaataaaaatttttgagaaaaatataggctcgttgtgtacttcttaatatgtttatcatttataaatactattaactaaaataaaatctttaacttgttaacaaaaatataaatacgttgtgtacccggatgaatatctagttattaacaaaactgtaccatttgttttgtagaattttacttattattttattttttggaccaaaccaacttattatttattggcatgtctagttagggaaaatgtttcaattgaacatgtaccgtatgtgtgcatgtataaatagaaattttatgattggattttaataatgcaacgaatcgatgtgaaactattagtgtaaaaccacaatcgacgtcctttgagaatttactggtaagaagaacacagaaaaggatagaaaaggatctggatggatccaagagaaaccctcgcgtgagtaattaaccctcacttaaaccccaatcaccatttcaaggcgagaaagcaagttgtttcttgagtaatccaagttgtttctattttgcgattttaacgggtcaaagatttgctctaagggaaggaggtagaacagttggagccggtgtggtatcaaaagtgatgagctaagtcgctatagcagatttaaaagttcttcaaacgaaaaaacacaactgttctctagtatctaaagattcatctctcatgagatttctactactttgagagtttatatcaaataaacgagagattagtgttttaaaagaaaagcttctcccagtgtgatatcttcactttattctacaacctaacattgacaaattaacctttaagcaagccaaagaatggagttagaaactagactccaaatcatcagcattccaacattcaaccaaacctaagtgcaaccatggcaataactgtggcagctctgaagtaaacttctttgattcttctttccactttatttgagacttcttcttcgttgattgttttcctattgaaattaacaagggcttccctgagtctactcacagaccacgagagcaataccaaactcaaactcattgcaccctcgaagaattggtttgcgcaaaagggtacctgcctggaagcaacattacaaacgagaaagaagagcacagccataccagtgccagcaaagccaattgaacactgagtcaaaagctcgaagagttctccacgtgatttctttagagatagcattgtggtttttctatgttgttcattgcctatcatcagagagagaaggctctcacacgcatgaagacggtttcgttcgtagaggtcatattccttatctcttatcttcggattttgtttctttggtgaaggcttgagcctggttttcttcggactgttggaaatcgaaagaaacgttttttaaagatgcaaaagtaccaaaaactagttgatgatattagatacctctttggaggagctagtgtaactgcgtcctcgggtagctgcagagtgtctattggtacttcactgtcgaatctgcagaatgagaggagagcaaaaacttaatgttaaacccaaaaggatgagactcataggtatgaatcaaacttgcagtgaagaattaactaccgctgaaactgcgggacaagccgtgagagctttctccatcttgttgagttccttaatctatgaaactcagctgccgtagagaccaaatcattcaattcagctctgctacttgagaacagaatgttagcatccaccatgagatccaataacggctttgcatatggttgctgagaacttgatcttaaagcatctagacccatcaattcagataggagagacaaatcgaatccttcttctttgagttcttcttctgatctagacaaaaggaactctaacacctcctcttttcttgcatactgctgagtgatccccaagcttaaacacacagggtctggtccagtttctgttaaccacagttcatgtcagtcgaaaaaagggattacaatttggtgaattcaactgaaatttgatcaaagtcacataccatgaacatccatgagtctatgcttcatcatggttgaatcaaactccaaaaagtggttagacttactaaaagaagaaaaaggtttcaatggctccaagagttgtgatttcaggttaaaggagctctccggtaatatctcatattttcttcctccaggattcaccagataagcccggcttgtctgaatcattcatagacataagaaccaaacaaggagaagacagaaccaggacaagaattcaacgagagattctaaacccaagtgttttaaaacagagaaagtaaaaaactgaccttgatgatctcgttgcttcttagctcttgaaggagactaaacctaagtgttgaatagctatgagaagccattgagaaaaaactgacttcttatttttttttctcttcttcgtcacaaaaccatggaaacaaaacgaaaaagcttatcgtcagcaatctcgcctatatatgcgtcagatattataagatttgtgtaaatcttttctttattcagttttggctggtgaccaaaacacactttgagtttttaaatatttaccctttgaggcacttattacttaaattaccaagaacatacccaatcttttcaataattacataaatatacctttggtttcttatattctcgaaattaacccaaagatcattagggtacatacattctttactcgagagagagaagttctaaagtcctcaaatcccgcaaagctttttcagcttctttgttgaattgcgagcagaggtagaaatcagcaggaaacaaaa

SEQ ID NO: 7023 - DNA, 3000 bp, Unknown; identical to SEQ ID NO: 7010
  misc_feature (1)..( 3000): cDNA_ID_3049566_gDNA_ID_1621122_Annot_ID_172113 3000 nt of promoter + ATG

SEQ ID NO: 7024 - DNA, 3000 bp, Unknown
  misc_feature (1)..( 3000): cDNA_ID_1816460_gDNA_ID_1621122_Annot_ID_56318 3000 nt of promoter + ATG
cttgatgattttcaagaatcgaattgaaatttaaggctcgtaaaagtttcgttttggttttaaatctattgaaattagcaaaatttatgcttaatgttaagataactagattatcatattcactcattacatcattttagatcaagaaatacttcgtcggctccttgttaaatctatcaaacataccactaaaaaaaaaaaatcttaaagaatgattaaataaatttaaccaagcagtagaagtggaattgaaattggcagagttagtgcgacgacccaatcacctgtctccaataaccgcctcaaaaactgtcgaagcccattgggcacttgcaaagcccaacagttggagttccagctcacccactagccgttattacgcaggctaatttttcaacgtgcgagaaaccagatttcctttttcccgaagactatttagggaatttcctctcttgagccaaattttcctttttcccaaggggggtatttaggtattttcgtctctctcggccaagtttcctttttccgttcctccgtaataaagctttcattctttttgtaggtttccattagaagttcagaaatactgtttataaatacaaatccagagtcagagatccattcgatagcactttcctctctttctctcatcgtaaaaccgttcttcgttttttctatttctctcgtctctttcttctacccagatcactgatcaaccgtgaattttactctactctttcatcaattttactgtgtttaattcataaaacaaaacaaacgatcgatttttgtttttttttggggatgaagatcagaagcaaaagcaaaggctatcgtcaagagatcaaatcaacttgcaccgactccaacactctgttctcaaaaggtacttttcgtcttgttggaatttttggccaaataacgtcttttttttatatggtatctaattactgtattctggttgatcgcaaaacaaagaattctcatgtttaaagtgggtttcgtctaatccaatttgaattttaggtcttatattatttccctagctctaaccctaatcatatatttctcaaagtttttgatttttattcaagattccttctaatcaattatttcttctttgtatgtagatgtggttgcaacttcggagcttttttcatctgtgatatcgtagcgtgtgaaagacggataattctacagagacaatgcatcatcccattcggtcaggtcaattttcatccctattttgtttataatctataatcttatagatagtttaattacaaaaaaggtttttatacttttgatttttcaaaacaaaatatatttctcaaagttttgatttttaaaagttttcaactcttttttatttttctttttttttataaatactaaattaatatgacattttgaaatctaaccggattttggatcccgccatttaaccttggtcattagcgattccacaaatccaacaagtttttcacatcttcatgtatatttagcatttatttttcttaaaaagttttcaactcttttttttttttttttaaagttttataaatactaaattaatatgacgttgtgaaatctaaccggattttggatcccgccatttaaccttggtcattagcgatttcacaaatccaacatgtttttcacatcttcatgtatatttaacatttatttatttttttaaaaattcaactctttttttaaagggttatataaatattaaattaatatgatgtcgtgaaatctaaccggattttggatcccgccattgaaccgtggttattagcgattccacaaatccaacatgtttttcatattttcatatatatttagcatttattttttattttcttttcttaaaaggttttcaactctttttttttgttttaaggttttataaatactaaattaatatgacgttgtgaaatctaaccggattttggatcctaccatttaaccgtggtcattagtgattccataaatccaacatgttttcacatcttcatgtatatttaacgaataaattgttaaatttttagattttggtgtaaacaaataagacacaacatccaaacccctaagaagtgtccttggttcaatatagcttacatataatttagtaaactaaaaacaaattatttaaaattactaaaaaatgtatttatttttatacgattttaaaattatatattcatattgtatatatttggataagtgttaaattttttgatttcatttaaacaaattggacgcaacatcaaaactcctaagagatgtcctcggttcaatatagtttacatataatttaaatttttaacaattgtttttatttttctaaaagttatttttaaaattatatatatatatatatatattgctattaaactataaggtttttttggataagtgttaacattttaaattttgtgtaaacaaattggacataacatcctaacccttaagatgtgtcataggttcaatatggtttagatgttaaatttgtaacccttattttattttattaaaaatgattttaaaattatatttttatattactattaagactagatttttttggataagttttaaatttttaaattttgtgtatggtttacacataattttaaatttgaacacttgtttttctttttaaaaaaatgttttgaaattatatttttatattactaattaaagtaataattctaaaaagaaaaattttaaagaaaaaaaaaactagcagaagttttgattatatgatttgaattttgatcattatggatattcacgttttttagtacataggtgataggactagaaacacctaaaacacttatgattaattaaagatcatggtatgttttatattagtctttcatttatctttattatgcttttttattattattcaattaatatttgttcaaatttgagtgagactgataataaagagattcaagcagaagaaaataaagtcaaacaaaaatg

SEQ ID NO: 7025 - DNA, 3000 bp, Unknown
  misc_feature (1)..( 3000): cDNA_ID_1816456_gDNA_ID_1621122_Annot_ID_56319 3000 nt of promoter + ATG
gactaatatatgatgaaattggtcatcagctcatcgcatacaacaagatgttgtaacagttttagttatgtttccttaatggaatgaaactaatttgaacggaatccgagagatatgaaacataaaaaaaatgagagggttttataccaaataatcttatgttttatcattaggtaactttattttttgtttttaattagtggaagtacacgtgtaatgaaaaataacatacaatatggtcatgaactatattttttttgtcaaactattcgttactaagttatttgataaaaatagcacgattatacgcgcgatgatatatatcaaattgtggaaaatgttataaagtagaaaattgggccgaagctggatccaattatgattctcaaataacgtgaaggaaggcattttagtcccctctatacggcccaaccactcgccaccgcttattggtccaacttcagggtactttggtaataaatcaaagcttagcttttgaaattaataaagtataggggttgatttgttattctcagtttctatcgggttaatttgtcatttgcatcgtttctagtttccacttttgttgggtgattttcttctctggaaggatctgtttttctcttcttcgtcttctctcacccgcctactgactttttttcaaatttcttcagcaacacatacatacagtcacaaggtttccaattttcgattcacgatggaaatggcggaaggggaaggaactacagaggagaactacgacgtagacatcgcgaccaccgcttcttcattaggcggctccggcgtcttccatatcatcaatgacatagtcggattcgtcctctatatgcaccagcagatcccttcgtatgttatctcttcctatcttcgtatctctatgcttcgatgtatccttcgatctggtgatgatgtatctatttgtttgttcttcaatctctccgttaatttctccgattagtctgttggttacgaatttatcagaagaaaaatagtttcgtggttatgaatttatggattctggatggattagtgattaattcctggtaggtgagttatgttcaattctaggagaaattgaaaagctctacgcaattgtgcacactacttccttttggttttagaattaagtctgttgtatccactatgagtgttttactgaaaaccagaaacttcaatttgcagctttggttttggctacacaaagctccttctaccaatatgactgttgttggttatttacatctgtgcagggtattacaagacatgagccttgaatttgaaggattgcaaactgaatttatggatttggtatgttagtcctacagacgccattttcactttaaggtctaaggtctttttcacactctaagaatcttaggttgtaggagacgaatcttgcagaacctcaagtgaaaccactggttagaagaaaactgatgagtagaaagagagaggtgaagaatgagattaagaaactggagaaactgatgaaaaccatctctagtctccgaagtgcgctgcagttaatgatccgtgaagctcctggcattcagaaagttgtgttgattcttggtggtagtccattacggcctcaaaatgcttatgagttgttattcacacaacgcagagaccatgttctaggctacgaaggtgactttgctaaatccaaagctgcagaagcactttcaaaaaaggtttattctttttcttacctctgttttcatgttgcttgtgatttgtctcttttcaattttatctgctgtgataagtcaaaaatggttgagcccttcactcttggctttacagactatccgagcactgatctcgacgggtgctggatcaacttcctacccaggtaacttttgcataaattgcaaacttctttagcattgttgtgaattatggtgtaatgatttttttcccttcttctgagttgcaggtccaatgaggctcttcatattggttcatgctccacctactttgaatcttccacaacatttccttcctaaacgtgacttcagatacaacagaaaggtatacacttctctgctaattctatttcacacatccatgtacaacattccgattttccgtcacctgcaaacatcttttattattgcagtttgtgccttcaaagttgagattcaagtgcagaacgcaagacaatgcaacaaattctcctcccacaaatgatctaatatggtacttctcttattcacaattctccagttacacactaaacaagttcttgaccatgccttactgtgtcattgcaggtatcaatgtcgacatgtgataaagggattagctttccatcaaccagttgaagaataagactttagagtttgtttgtatctctctattgttgtaactaaaccctgttgcaaattttagaaaaaaaccagcattgttgaaacaattccaaatcttgagatgacattgtactactactactgcatactctaatactctgttgttttaacaaaatcaggattgttcaactattttatatttttggacgaattgttaacatttaaaaacctaattttgtcgagaagtttaatatacataaagttagggggtcaaacgcattaaaataaataaatagggggtcagaatgaaaaagaaacaaagctttaagtttttctaataagagtcctcctcttctgtttgctctggttacttcggcaaacacagacgcaaaattttcttcttcttcttcttcttcttcttcttctaccttgaagctgctaccggttcctctctcagtcgttgataacacatcgaagcttccattatcacctgtaagttttctcctgttatcttctcttcgcttgatctcaattgttccttctttctcgttgttcgggtttatctactccaacttgaatcgcttgttttgctaaagtgaattcgagttttttagggttttgttagttctaatgccaatttcgatttctaggtaggaggaagaagatg

SEQ ID NO: 7026 - DNA, 3000 bp, Unknown
  misc_feature (1)..( 3000): cDNA_ID_1989601_gDNA_ID_1621123_Annot_ID_57861 3000 nt of promoter + ATG
tcatcgtagaatttagacagaatttccaatggaaaaaggagaagagacattgtggttggttcaaaaccaagataaatatacaaaacaatcacttaaagtagttagagtgattttggtttagaatagcatgggagcacatctaagagagtggaaaagtctacaagtgttgactcaatttgagagtagattggtctagtacctctgagagaacactgttagttctacaagtacataccaaataagtatattgggtaaaagataaatttggatccattagtaaagccataaagccactagattcctgaactttttcagtttccttctagcagtattggagttgatgatttgtcgatcaatctccttgaagatagcatgcagcgggattgtagtaaggttaattatggaagacgttatttctccgtctccaaatatgatagaccaaagtgtggattagaagcagtctcagggtttgtggtgatgatttgtttctaacatttgtccattccagcaaaacaagccaactgtcaaaaatcgtggacgccaacctcagtctagacataatcgaatcccaaaaagtctgggtaaaaaggcactgcaagaaaatatggtctcttgtctccaccgagccagaacataggcatcaatcaagaggaacctgcagtccccaggaagcaagtttggatcttgtagataacatgtcaaggtttgtgattcacatgtggaatacatgctttggtgttgaacatttgaaccataccaaagcatcccagtctttttcggaatctctctgcctaaaaaccttccatgttttgcttcaagagaaacctatacaaggtttgtcctcaagaaaccagtcaaaaccagtgaatcaagcaatttttctcacatttaaaaataaataagttatactatcacatttgtcaaacacattgttttatcttcatcgtcattgaaccactaataaccaaacacacctcattttattctaatatatctagaatttccaaatttagatttttaccttatataacatttttataatttaatgctttgatttttaatgcactttaaatttgaatattaaacatcttcatattaaaaatagagtcatttggaaatattattaataaaactatttataaaattaaatagtacagaatttataaaatgtaatatcatataatttatccatatatggcacgcattcttacctagtttatccttaaattatcaagaaaaaaacaaatttaaaaatattttctacatttatgttaataagtaaattttacttaagttaggaaacatagtatcaaatttcttattttacttaagttaggttttgaagaattaacctcgatttgtatctatcgtgtttttaaaaaatgaaaattgacatttatccttaaatttataagatatatttgtaaattgtattgttctcattagtataccctaatcacttttctatctctctataaatacctgtaaatctcattctaaaataaagtcaatacatttagcctctatatggtaccaaagcttacaattctaaatggtataaagaatatatatgatatattgtgaaaatgttggtgccacttacctcggtaccaatccggttttctattctcgaatgaaccatatatatagcacttaattcaagctggaatgcttcagattactcatgtctccattggtgatcagttagcaaatacattcactaaatctttagcgaaatcaatatttcaaaaaaaaagttccaaaattagagctacacgagtacttccatactaaaaggacgtataaagaatatacatgtaaaccatattgttatatcctaatcatttttttctatctcttaaatacttgtaaatcttaattctaataaagttaatgtattcggcctctataaaattttattttatatatacttaataagttattttcatactccatatgtttcttttatttgattttctagaaaaaaaatgtttcaaaaagattaattttataggttttcaatacaatacttattagttataattgataaattgtaaacttcaataaaaattattgaatattattggtttaaagttattaaaaattttaaattataaaaaatagtacatttaaaaaacaagatttaatatgtctttttttaatatttatgtttttcctaaaaaatcaaataaaaagaaatattaaaaatattattttcctttttttattatttttcttttcaaatatctattttctaaatccatattatgtttttcttttataaataatctcatttcgccatggagaacacgagtaattctcctggtgtatgcctaaaaaaaaaagcaaagattataatatgagtatatataattatatatgacgtaacctgcgagatgttgaattgtccacattgtaattgtcacgaacacttaattaaatcttgcgaaaaagagatctcaaaaatatcgcgagaaaaagaaaaaaaggataatatgagaaaagccaaacgaagagtgcatcgaaagctgagagcgacataataaaggagagagaaaaatgtggggaccagactggacgtgtgcacagaatattcacactatttgaattttgttttcgaatccgccactctatctccaaatcaacttatcactcaatttgataataacttaacctacctctcttataaggaagcctacttatcaccgacgaagactccgcttatatctgataagtcggtagaacgatgtctctgtgcaaagaagaacgcgtccaagaaagcgaggtctaaagtttctcaatcccccaatcttctcctccttctttatatattctctctctctctctccatttttctctaaaagctagagctcttcaaaaccctagaaatcctcgaaatcagagtctttacctgggctcgtgtcttcagagctcggattcgtgtttctttcgtcgtctctcttcttcgtttctcgtcagatttgagattcgttgagaatg

SEQ ID NO: 7027 - DNA, 3000 bp, Unknown
  misc_feature (1)..( 3000): cDNA_ID_2995955_gDNA_ID_1621123_Annot_ID_172144 3000 nt of promoter + ATG
tgattaatcaaaggtgtgtttcttttttctttcctcatgaccattctgtatgttgcagatgaggtttggatgacttcgttgttggatgattcattgtgcatatgttctcttgcagcctcaattggcagcaccagttgtgcaagaatcctaggccaaacccagatattaaaactctattcacagaccacacttgcacacttccgaatggtcctctcgcaccttcagcagtcaatcagcctgttactactttgacgaagccagcagcttatccgtcacttggacctcatgttgtaagaaacctcgatgtttgactgctttaatcatgttttttgaatctaaattaatcttaatgtttgtggaatctgtattacatgtagccctttccacctggtcctgctgctgctaatgctggtgctttagctagttggatggctgctgcctctggtgcttctgctgtccaagctgccgttgttacacctgccttgatgcctcaacctcagaatcaaagttagtttttgacgatcctctagatttctaatcctcgacttatcaataactatcatttcagtttccatcaaaaacttattatttttcttccaaaaagtgtcaatcttgaagcgaccaagaacaccaccagcaactccaggtatagtagattatcagaatcctgatcatgaactaatgaagcgtctccgccctgctccatctgtggaggaggtaacgcgaattcttttctttttctggaaagctgtttatataattcttgcatcttctcaaaattctaagcatttatcattttccaggtgacatatcctgctcctaggcagcaagctccatggtcgctggaagatttgccaacaaaggcagctctggcgctgcatcaagggtccactgtgacaagcatggagttctaccctatgcaaaacacgttacttcttggtatgggggtttgaaaaaaagaatacaaattctaaactgtgtttgaagttatatttctgttatctcttatttggctttctgaatgaccgtttgaatgccatcagttggatctgcgacgggagaaatcacattgtgggaacttgccgctcgagagaggctggtttcaaggccattcaagatatgggatatgtctaattgctcacatcagtttcaggtttgtctttacagctaagaagtttttagtttatgtgtttgatgtataaaggcggaattcaaccaaatggctatgagaagtgttggagataaaacgtatcagcaaactagttgctgtgcaagattcttatacttgcctttcttttggcatcattcaggctttgatagctaaagaaacaccgatatctgtcactcgcgttgcatggagtccggatggaaatttcattggtaagcttcccgtcatgcattgttggattttaattgtatgttgtctatggtctctggtctcagtctcttattgtgcaggggttgcgtttacaaaacatctaattcagttgtacgctttctctggacctaatgatcttcgccaacatactgaggtaagcatacttgtgatctgtacgagaaatattgcgatgtaataatatcccactgagactagatcactttttcacagattgatgcccatgtcggtgctgtgaacgacttggctttcgccaatccaaacagacaactatgtgtaattacttgcggagatgataaattaatcaaggtgagataaagagtcacaaagtttcactgttagatatcaatgcagctggctaacttgatcaatgtggaacaggtatgggatgtttctggtcggaagcattttacttttgaaggccacgacgctccagtttattccatttgccctcattacaaagagaacattcaggtgcggcaaggattgaatcaaactatattttacatcaattattatactgttttaccaatccgtttgaagaacaataaagtagacgacacatttcatatagtattatcttgcctatgaatttctgttctttaccaaaatacatctcgttcttatttggatttcagttcatattttcaaccgccatagatgggaaaataaaagcctggctttatgataatctgggttccagagttgactatgatgctcccggtaaatggtgtacgaggatgctttacagtgctgatggtactaggtaagatcttaaactcataaacatttccctcttctataccgcttgttcttcactcctcagtttccaaaatcttcagattcttttgtttactccggaggatactgagttgtgtccttgagtttctaatcttatctttctgttttaagtttaccttttcagtgctttctgatgttttttcccccttcagattgttctcttgtggaacgagtaaagatggagattctttcctagttgagtggaatgaaagtgaaggatcaattaaaaggacgtataaagagtttcagaaaaagttggcaggtgtggttcagttcgatacctcaaaaaaccattttctggctgttggtgaagatggacaaatcaaattttgggatatgaacaacatcaatgttctgactagcactgatgctgagggtggacttccggtaagtcccaaagattctttttcccatggcttgttgcttggatgttcgtctttttaggtttgcatataacttgtcccaacttcaggctcttccccatttgagatttaacaaggacggcaatcttctagccgttactacggcagataacggatttaagatcctagctaatccagctggtttccgatctcttcgagcgatggaaactccagcttctgaaacgatgaggactccagttgatttcaaagctgtaatgtttctcaactttgtattacattttttcccttttttacatccactgtcattacaagctgtctcggtttacacactttggtatattctgttaggttcctggtgctcctgttgcgtctgtcaattgtaaagttgaacgaggctctcctgttagacactcacaaatg

SEQ ID NO: 7028 - DNA, 3000 bp, Unknown
  misc_feature (1)..( 3000): cDNA_ID_1989600_gDNA_ID_1621123_Annot_ID_57862 3000 nt of promoter + ATG
aataaaatgaggtgtgtttggttattagtggttcaatgacgatgaagataaaacaatgtgtttgacaaatgtgatagtataacttatttatttttaaatgtgagaaaaattgcttgattcactggttttgactggtttcttgaggacaaaccttgtataggtttctcttgaagcaaaacatggaaggtttttaggcagagagattccgaaaaagactgggatgctttggtatggttcaaatgttcaacaccaaagcatgtattccacatgtgaatcacaaaccttgacatgttatctacaagatccaaacttgcttcctggggactgcaggttcctcttgattgatgcctatgttctggctcggtggagacaagagaccatattttcttgcagtgcctttttacccagactttttgggattcgattatgtctagactgaggttggcgtccacgatttttgacagttggcttgttttgctggaatggacaaatgttagaaacaaatcatcaccacaaaccctgagactgcttctaatccacactttggtctatcatatttggagacggagaaataacgtcttccataattaaccttactacaatcccgctgcatgctatcttcaaggagattgatcgacaaatcatcaactccaatactgctagaaggaaactgaaaaagttcaggaatctagtggctttatggctttactaatggatccaaatttatcttttacccaatatacttatttggtatgtacttgtagaactaacagtgttctctcagaggtactagaccaatctactctcaaattgagtcaacacttgtagacttttccactctcttagatgtgctcccatgctattctaaaccaaaatcactctaactactttaagtgattgttttgtatatttatcttggttttgaaccaaccacaatgtctcttctcctttttccattggaaattctgtctaaattctacgatgacaaactattacattctagcttcttgattccaaacctataagcctaaaccaaccagcatcattttctcttgttcagcctaaaaagaaagtttagacacattaccttacttgatggaggaggttgattttcagtccttgatccctcaaatttcttcagaaagtttcctccgacatgcttagtcttcttcgttgtctccgagaactttgaaaaaaggtggatccggtggaagtagtagtggatccgacggaggaaagggagagcgtggcgtcgacagctatgaagaagattaagaaggatggagatgaagaagttaaccacgtcgtcgttgagaaataaaagcaaaactaaaactatttatagattataagatgaaattaagggtgaaatagaggttgcaaggcaaccctaaatacccttattgatgtcattttttcgggaggatcttttctctccctcttctctctctaatacctttcagagagaaaataggttctcgacctgattttgggggctagagtttttatggagacttatgtcacaatgtcgttgggctctgcgtctggcatcacttgcgtataagcggtggaagctgttttttccgacatcggtggctctgtttaccactgttggctgacacttccagtactgattggcttcttctgcaacggtggctggttatgtctccatcgattcagcctctggcgattcagatggctagtactggcttttgtccggatttgtttttagtctttcattctctcgtttctctttagcttcagttattttgtgtttggaccgatgctttggatttgattgaagttttgttcgtaggtttgaatgaaagcaagccccaaatagcaaaatttccttaacgattgaaaactttttgattaaagaagaagatgaagaagatttacagatttgtatcaagtggagtcatatttgcaacaaaagtcaattggaatttcgccttggtttgtttgggcgaagaagatgaataagctttccggcgatttctgcttagaatgaagcttccgacatcacaacaacttttcgataatcggagactccctcctcctcttcaacttcccacatgtcttccaacttgtttctcatttgacacgtgttttatatgttgtatacaagtttttccttcagtttagggttctcttatttgagcttttggacttatgattttttttactttagtgtttgtaaaatattggcatgttacatttggctttgtattataattaaaacacacttgtaaaaaaaaaaaaaaaactaattgatgttcattacactcatatatatatataatgaatatacttgctagaaacctaaatacatgggctttagatgggctagtagataggaaatacatgggcttgtcaagttaaggtagaagtcatccacaatgccacttgcattcaagattctctcacaagtctgaggaaatgtttttacgaggctttacgggttaacgctgctggtgaagaaaagcagagtgattactaggaaacagagcttgaggtttgtttctgaaagcgagaatccgggtgcgattcaaatttatagcccttagccaattgcttcatgtaggcttttcttgacagcgaagttacctcatcgactttagcttttcttccttcggttagatcgtagtgagcatagtcgaaatccatggcggaacctgtccaaattttccttggaagctctccgaggaagaaagtgttcttgaagtggacaccaagctttcatacatgtatccattattattactaaacacgaagaaaacaaaacggatctaactgaatatactctgaagattattagaagaaattagacagaaactaatcaaatgaagcctgcagagaagagaagagaagaaagcgttaaaagactaatcaaataaattcaagcagagagtgagagagcggagagtattgtttcgtcgcttgtgatttgagaggaggaggagtgatggagaaggtttaccaatgagagaacagacc

SEQ ID NO: 7029 - DNA, 3000 bp, Unknown; identical to SEQ ID NO: 7026
  misc_feature (1)..( 3000): cDNA_ID_3049574_gDNA_ID_1621123_Annot_ID_172145 3000 nt of promoter + ATG

SEQ ID NO: 7030 - DNA, 3000 bp, Unknown
  misc_feature (1)..( 3000): cDNA_ID_3049570_gDNA_ID_1621123_Annot_ID_172148 3000 nt of promoter + ATG
cttgatagaagctacggttgtcatggttatagagaaagactgaaattctgctctgattttgactcaatgatgacgtcgataggtcttgctctgtgtttgacacaccactcatcaatggttctgtccattgttgatgacgatgatcctcaattagcgaaggaggaggagacaatggattcgttgtggaagaaaccgcacgggtctgaccaaactcggtctggtttttctcgggttggagtaacagaagcttatcttgtagtactcgtagaccactttctaacgaatcctccatctctaagactttctccgacaatttagtgtcgtcgaggatcttcttacgtagaaacagagaaaggttggttcttttcttgcatcgctctctctcgtgtaatctgctaaacctctcagccatgtctcgaacttttgattgatcctccggccatgtcttgatgagttttccgtcacgaccatagtatatgacacagacatcgatgttgcacagagttgaaagctccaaggctttcttgaacatggtctgttctctcatagacaaattcgtggtcttttttgcagtagaagaagaagacagggacgatttcttgaaacaagtttggtttctcacagacaatttggttttcttcttcgtcgacattgaagaatccattgttgttgtttacccacagaaaaagaagaagaagatacctagtttcttatcagagagaaacctagaaaataaacttagtgtaactaacacacggttcagggttatatagaattgtgaaattcttgtatttccatataatatttgatattgattttactaaaccaagagagacaaattgagctgtgggttttatttcctttttctttagagtatcttttcttcgttaaatgatgatgatttacttctattaatctaaccgttgtgatatttaagtaatgaaattccctttttgtttgctgtctatgagataaatcttaattagatacgattttcctttaccaatatcaatgtaaccgttgtagatacgatcttagatacgatttcccacatccagtatcttattatataaagtatagtttttaaagttactaactcataagattgtggcacgtgtcaagtctaataatgagaagtttatatgtgtcattaaagatttaactttttaattttcttaaaaaaatagaaaaccttaaaaagaaaaatttacatatattaatttcttattatataaagtacagttttcaaaattactacctcataagattgtggcacgtgtcaaatctaacattgagatgtttacatgtgtcattaaagatttaactttttaattctcttaaaaaaataaaaaaccttaaaaagaaaaatttacatatattaatttatatatatctaacaatatttaaactttatttttcttaacaaaaaagaaaattaacaaatttgaaaacacatatattattggtcaattaaataaataatcatgtattaatttaaaagaaaaatcattaagtatgaataataactaattaaaaagaccacttaagtttaaaataacaatataatttatttaaaattaatttaattggataaaattgtgtttatcattgtaatatagtgttttcatttgttaaattttgaacacaaaaatatttttaaaatttagtgaccttattataataaatttttaaatatttaagatttattctaagaattttaacgtattcggtgattgagcaacttggatcctttgatatgtcactaaaagcttataactatgttttattgtaaaaaatttaacgcatgtagtcataagttaaaacacaagatttttggagagaacaacttatatgatttacttttcaattacttaaaaagaagttagtatattttttaattaattttaactcatttaaaataagtttacataagagaaaattacgccatatataaagaaacattttaaaaagttttgcttttcaaatatttttgtggattttttttttgttaagttttgtttactgtttattatttttttaatatcaacaaagatatatattagatctgatataaatatatttttttaataaaaaaaaattcacttaagatgaagtgtttagaatgaaaatcgagtatattatgatgaaatagatacttaaattgtattgcaaaattgaatgtgtaagatagaaatttgtaggttattatttagaattcaaatatcatcaataagcttgaatgtgtagaattaaaatgtatgataaaagagaatgtataagcatcaaattttgttaaataaaaaaatattaaattaattgtcaaaaaaaatataaattactattttattattcaacatttgaatactgtcaataaagatttacatctaaatcacacacccgcctatttaggcggccttattagttttttataaaatagtcccaaattttagttttaagtaaacacaaagaggaatatttatactcttccgagttcgctgacatatggtaaaatgggccttcgttttcttttatccgccttcattgttgggccctagcccagttgttttttttgcgcaaaattaatacatcgatggggattgactcttgacgctgtcgatcatcactattcactagcactagtaacaatgaacaagtcattgcttacctgcagaattcattttccacgatcaatttaatttggctggacaaaatacaacgtttttttttcatgttccctgtacgtaactaaaaagtaagacaaaaggagtggaaatggacattattcaacgtaaagactttttaagtcgttgcgtttaacgtgaaaaacgcctcggagggtcaagctgtgttggaattatctttgtggaatagagtctattatttttgtatataaagagatgggcatgaaaacatgttacgtaccatcacaatttccagattttatttttttgctttttcactatcaatattcaagaaaattaaattagcttaagaatgatg

SEQ ID NO: 7031 - DNA, 3000 bp, Unknown
  misc_feature (1)..( 3000): cDNA_ID_1816574_gDNA_ID_1621124_Annot_ID_56325 3000 nt of promoter + ATG
aacatacatttcaaaaatattatgtcaaacaatattagaaaaacaaaacttcacaagttactacaaaattatatataaattagaaaaaatataaaataaaactcgtgtgttcatgtttataattattattgaaatgttaattataatgtgtattaaattgttcagtgtgatatcattgttgtataaaatttgttttgaaacattatatcttttatgttttaataatttcaattttaaatttcaatgtatttgaattatatggttatatttgaaataattgaactaaatataactatttgtaaaatatataaattataaagactaaaatgaaatataagaaagattttaagggtatttgaggttgtactattcacaccctaaaaaaataaagggttgagggcttgttagagttcaaaaagccctcaaatttaaggatttgaggtgttgttgaagggttgcacacgcttctcttccttcattctcagtaggttaccgtccttggaaccaatgcctaagatttgcccttgcggtctggccttagtctaaagacttataaactgtttgatttcattttgaatttactaaacacaatcgaactaaacaaataaaacgtactattttttaaaaatattttagttacatctttatatttaaaataatttaatcattttatgtaagtataataaaacaaacaaaaaaatgtataatataacaaaattattctttattgtactcacttaaaaacgtttaactaaaatagaaatgattcagaaacgaaaacaaaaatcaaaccaaatgcaaaagtaaaccgtattttctttcgattttagtgtcccgtatataaaaccaataaaattagaaacctgaaccaaaccgtaaacttgattgcccctcaatataaggacaaggattagtcgagttatgtaaacataaaagatttgtgtcagaaaaactacagtataaattctataaattaatactctataaattaataacttttataaattaataaattctttcggtcccgagttaggaccagtgtaaaatgtgacacaaatcgataaattaataaaataataatttttttgaaagtcctatgtaaatatatggtctcatcaatatcataaattaataattgtataaatatatatataattgtatatatatatatatatatatatatattatagaaaaaaattctttataatatttttttgcttaaattcatatttgttctttgtttgactatagttttcatattttactgtatcaaaatttttggtgttattttctaaacattattattatgttttacttgtaactgattttagaaagatattttctacaaagaaagaaatcttatagaaattttttaaaaatttaccaaattaggaaaatctctttatatatttattattaatttatcgataaattaatacctctctaaattaataaaattttgcagtcccaacattattaatttatagaggttttatttagttagtgtcataatatcaaatgctaaaaatatatatagcatcttgagaagaaaaccatcttatttcttaattagaaaagaccatttctaaattattattttagtttagtctctatttagtttttgttatcacagacttgagaattaaaattcataaaaagatgtgtagatggtctggtcgaagacatggtttataataatcgattgcttccaccgagagataaacacaacaagtcatcgataagcaaagcacatattcacacttttttttaattcatatacattcaagttcattataggcttacacatcatttcaaaagattttgtcaattcatcttttttcctcttgccgatgtgccaccttcttcgcttggcgcttcgacgtgtgcggtgagcgtattttcttacacatattatattacactaaaatgtcaataatcgcgaatgtttgcggcagttgagatgaacaaattagattagttttaatttataattcacaaactatatttataaattataatgagagtacaataaaaataattgaaattatcgtaactaaatataaacggtttttacatataagtaaagttggtttacggcagtttataattcacacaaaaaataaagcgaactaaattgctaactaatttgtccattctaacaatatcaccagtcaaacttaatatttgataggttttgacaatctaataaaaaccgtgaataaaaaagagtaatctaaatttattttatattaagactgcaagttttgtggattaagtcagcatattttttctatatttttataacgatttatgaagaaaattgaaaataacatttttgaaaaatcaatgataaacattttatatcagttttactatgtaatgaaggtttagtttttttaaaaaaacatctgtatcagttctttttcaaaggcgaaatttaaaaacaaaaaatatttgggaaaactaaatttaaaggatatctacaaaacaaaattgtccatctatttatttttcttgtaaattagtcaaatgtaggtttttcaaaaaaaaattaagtcttatttacccttattttattttataattaaaaaaaattataattttctaatttatttatacaaaaaaaatagtaattttaagtaaaattttaagaatctaaatcctctaaatgtataagagtttttcaaaaccctattttttgtctctctttcttctttactcggtttaaaaaaaaaacattcagctctataaaaaaaattcataacgaaatagtcataacgaaattttttcatatgccaccagatagtcaaataccattgaccgacgtgctagaagaaaaaaaataaaaaaatttgaccgacatgtcatttataatctttgtatttaattattattatataattttaagatatttctctaaaataaatatatcaatcgtcttctcctaaacccagcaaattcgtttaccagtcatcaccaccacaacctccggcgaaaatg

SEQ ID NO: 7032 - DNA, 3000 bp, Unknown
  misc_feature (1)..( 3000): cDNA_ID_3049650_gDNA_ID_1621124_Annot_ID_56326 3000 nt of promoter + ATG
ttttcaaactttataatagatatatttaaaatcgaaccgtgaacatgatattattgtagtgaatagaaaatttaggaaaacataaaattttgtcttatttcacttaaaataaataattgcatacagaaaaatatattttaaggattgttttgataatgttttgcaattcaagtgtaagaactggtggagcatgaatccaatagattccaatggagttatgtataaatcacaatgagattaactatatgaaatcatagttagggaaattaaagattaaggtttataaatgtattttggacaaaaagaggaataaaatacaagtaattaatatctttgcctagataacctcaatacaatttgaacttcaaatgaacttggatggtaagatatattatagaaaaagtttggagtagaaaattttgaattataattcctaatatttcaataatatttttttgcctatcattgtttcagtaatatctacaatatattctaaagataatttttggaaaaaatcttcattgatattatatataaatcacatcccatatttgaatgaacaaatatttttctacctatgaaaaattcaaaattttgactaataatatgcataacactactttatatacatttaaagtctcatgtttttctaaaataatatactatttatagtaattggaataaattcatttgaccctcgaggagatatattttaatataaattataaatattattattttggtactacaacaaggattaaaaccttattatgatattttgacatgtcgaaacatgttgatttagttaaaattgtgtggaaaaatttttgtttatgatatatcgtgggctaattaaatttcggtgtgttgcaatgtatcatactcatttcagctttcttagctaaatattacttgtacttcaatgactagtacaaaacacccaaataccatgaccttgcttgttttgatattctctaataaaacccaacttggtttaaacatctctaaaatctgacttagttccaagattgaccaatcatctaccttcttgagatgcagcctcgtgattatacttcttgactcttcatctagtttctttagatgtagtcccatgatctttcaatgacgtacgacttctctccacatatcatttagaatcttcattagatacctggagactcctcctctatgcaacatcgattgaactcccttgaagtaaagtctcctcctttatcggtacaaaaggttttaatagacaagccgacttgcttctctaaaactcttgaaaagcttttgaaccgatcaaaacttgaatgaatatgtcaacaaggaaccatcttgttcttgttgactgattcaaactcctcttcacatctttcctccattaaagcacatctttagcctcttggctcattacttgttgaaagttgacgtctcttacttttaacataagcttggtggaacaatccataagttgtttcggactgcataacatagtcttcaaggtaccgcgactgacttatttgtcgacccgaccttctcagttgtggtactccttgaactacttcaccaacctcattatggtattttttagtgatatcctccatgccatcatcttcttcatgtacttctccaacatcttctctgtgaatcaactccaatatgatataaccgagcatgtcatgtccttgtagcttcagtagaaagtccatcgacaagtgatgttggataattcctaacttgaagagcaagatatctccttttagtagatggtagaagagatacaagaaaataaaatacaaataacgtcaagttggacataatttgtaactcttccttttcaaatcatgactaaactctaaatttagatgtaatttagcttagtggtaggtcagagcaaatggatttggtttatacgtttgcaattatgtaattccatggatgtagtttgaaagaccaaacttcattacaattatgtgtatcaatttattttgcttactcgtatctattttatcactagaatacaaagattttgctaactccaaatctattattttcagacaagcatatcctgtaaatcttcaatcatccaaaaagtgatgttgagtttagatccaactccaaaatgtatttatcttatttttaagtaaaaaactgaagaaatgagtttgcgaatcttttaaatagttattttgtataatgcatattagagaaagaacaaagataaatttttgtatcaaatatttaaactgagttaatggtggtttatgaagggtgttatagtgcattcactcccttatataatcgatatctctaatcccttggtaaaattaaattgttgtattgaatttttttatgaaagagtaaggtgagttgcaaattttgcttggcctcaaaaattcttctctctattttttcatttacatgtttgaagtgttactttttactttgctaagatatttcagtgttactttttaatctacatatttcattgttattttttaatttacatatatcaatgttatttttccactcagataaggtgaaatatttcagctaacttaaagtgattatgatcatcaacacctatttcatgtcaattttttgctaaaaaataaacaaattggtcataatgttcaaaaacttgacctcaccatcataatacttagtacttactggtcaaacaaacatatgttcagaacttttgtattgatggggaaggttacttttgtcgtaatgttacaaaaaaaaaattgttactgttgagaccattataaataatcatgtcatgttctttaattatcaactttgattgtcatttaattgtaaatttcgttagttaatctgtcctcttcttgtaattaaataaaaatttgtttcaataccaataaagttgtcctaaaaaaaaccacccctctaaatagggagtgagtgagagagagagtgatagtgagaacaaaaaaaaaacatcatttcttctcgcactcttcacctgctcca

SEQ ID NO: 7033 - DNA, 3000 bp, Unknown
  misc_feature (1)..( 3000): cDNA_ID_1816559_gDNA_ID_1621124_Annot_ID_56333 3000 nt of promoter + ATG
tggtgaggttgggaaacgcatgaaggtgagattttcagacagatttttcgatggttcggataagatgtgctagcgggtaatgattgttcatgtgtcgttgttgatatatctcactccatatattatatagttgcatgaaagatcagccactgatttagccttagagcatgtccattggttagtttcttaataggaatccctaacattttataatactaaattttgataattttatagtttaggattgttgatgaatcctttcagtttttaatctttaatggtggaatctttagatgagtttcttacaaatttaaaaaaatatttttgagataattaatttgataaaacttaataattattacaaataaaaattatcaaagtgccaaagcttttttgctgatgatgtggtaaatctctgctaacacagtttgaaatgctttctcgacatttgtggcttcaagagcagaagtttccaagatagagagaccttctgtctcagctggagtgtgaccatcttcctcagctactgatttcaagtggtttagattagctttgttcctagttatcatgatcacaatgttggaatccgtatggtctcttagttcacgtagccaccttaagacattgtcaaaggtctgtcttttggtgatgtcatagacaagaagtgctcccaccgttaaagtcgtggtcaacgaccctattaaaagaatagcacaaagccaaaataagcaacagaacacaacaaaagcagaaactagaaattgcgcaacacacctcattccaaaatccaaatcaatgtcactcaatatcttcgccattttagaccattcatgctctgattcatacaaacccgcaagtttttctctaataacaagtgtctgcaattacaccaaaacaaattgtaaaacaacattattaacatagtctcagctactcgaaaaagaacatccttagtaaacaaacatctcaaagtagctttcagagtagttttcaaacaccctaatgtatctttcagagtagcttaagtatcatcactatcatacaaaacagagaaccctaatgtatctttctcaaatcccaattcacaaaaccctaaacttgataacatttaaaaatataaccctaactaatcgtcgatctacagaggcaaacagaaagaatcataccttcaaaaagcagttggagtatggtttaaccttaacctccgatttgcttcatccaactctccgatttgtcgcagatgttgagcaccgtcggttgagatgatgataacggcggaagggagacgggtttcatcggtttactcttccgatttgatgatgcagatgccgaattctgcggatcgagctatcgttcctctgtatatcgtcgtcggattttataagagaaaatgaaaccaatcgataaatgaaaaaaacagacacaagagaactgaaaaaaaaagagatatgttggaaaataatacgtttttaaaacataatatgaaaagtagtacatatactattcacaattagtaatatagtcggttttgattgggtgagagagagagacatgtggggcatatttagtcggtcaagtttttaattttttttttttattacacattccctcaatgtttaataactaaaatgcttattagtaaattttatttttctaaaattgatcatataaataaaaatctatatttttctctatcatttgatatgcattttgtttaatgatttttaaattttatattataaagcattgtacagattagatcattgtacagatatagaccgctgtacaaatgtagactaatgtacagatatgcaccactgtacagatatagactattgtacaaatatagatcaatgtacaaatatagactattgtaaagaatgatgtatctgttaaacgaagtcataatttactgttaaacgaacaaatatttttctcaaagttttgatggtgtaaccgaagtccgtatgagtctttggttttgtatcttctaacaaggaaacactacttagacttttaagatccgtttgcggttctagttcttatactcaatcatacacatgacataaagtcatatttgtctccaaaacagtaaccgagcttctttatgcttcacaaatgttaaacgaacaaatatcttctgtacatatgcatcattttgtatagtggtttatatctgtacaatagtctatatctgtatattagtctatatctgtacataggtttatatctgtacagtgatctatatctgtacagtggtctatatttgtacagtgatctttctttacagtgctctataatataaaatgtaaaaatcattaaacaaactgcatatcaaatgatagagaaaaaaacataaatagttgaaaatgacatttgggcaggatcttttttattctgctacatctgattttcaactcagacttttgctgatgctcattaatggtctatatctgtacatatatatattactatattactaattgtgaataatatatatatattacttctatagttaagttttaaaaacgtattagtcttcaaacaaactctaatataaatgaccataacgttagctaaatgaatgggacacggaacttaaacctcgaaccaatataatttcataacatttaaattcttataaaatatattctatataaaatttgattaatatattgaatattagttatggttaaggaacatatattctcacgcagacatgtgcaggaaatgtataagagaaatatggtgccgtaaactcaaaagtgtttaatatttttttctatagagaataattcaattattgttttcttaattagaaaacaagacagcgaggtggagaacatggaggacatcaaatccaatgcaaatatacgtaacgagtttacttgaatctccatgcaagtcccatgcactcaaacccgtgtatataaacccctccaaggtcatcgtttaatcatcaccaaaagaagcacatcaataaagaaaatacaaaccatg

SEQ ID NO: 7034 - DNA, 3000 bp, Unknown
  misc_feature (1)..( 3000): cDNA_ID_1816550_gDNA_ID_1621124_Annot_ID_56336 3000 nt of promoter + ATG
ttgaacccattgttcagatctcttttcgtgctaatctcctagtttattgaagataaattgattcagacgaaaccaaaaaataaagtgattctagtcctagtaaagaagaaaatgtacttgagaaatctaaaatagacgagcactgtcattcacgggttttatctcagcattcctgtcttcctgaagttgatttattcttttatgacctgggctctgttggcagttgctaatattggtggttatcggtgtgaacatcatggtgcacatctgcaatgccacctgtgtcaaggaatgatgccctttagagccaatctccaagtgccgttacactgtaagttacagtacatgattctttattttgcattgttcactgtttaaataatctaacatctagctctcaagactggtttctgtacttttttcccgtcttgatattgtaagttcattgttgttgttactttcaattgctctacatcggaaaatttgtaccgagtgaatggatgctgttcctgttggtaaacatgttatgtaatgatatctaatatgtcgtctgcgaaactgggggaaaaaaatgtgatgctggtagaatacagagaataatatttgtatgtttcttagagctgggtattgcaaggttggactgataagagactaatatttaaacatgttcagtaggaaaggaatctctgacaattatatatatacacatttgactctagtttattgcaggcaagggatgcgataggccgttttgcggtgcttactggagttccgagaatgttacacaaggtgtatctggtccagtctgcgttcgcgaaacttttagacctgtaggttgagctatgattctccaatgtctacctatgctggttatgttgatactgctgtatgttatatgagtttagaatgatgtagttaagactgatatcttaaacctcttactttaacttagtttttcgtttctatctatgaggtattgtaatgtaaaatgtcactgtggttaggattacgatgatcaagatagttttgtttatttttgctttccatattcgacatttaccatgtggtttcccttctgctccagtggcttgcatgataatgttcataagatattttttctcattatttctcactaatatctgcagatctcggaacgcacaattacaaggattccattcataacccatgaaatgaatcgccatgaacaagatgtaaggagttttctttatcaggttattgtttcttattttctattggtgacattctctgtggactgtagataacgcaaagatgcattgcccatatggagaaaactgtgccggatgttgtagcagagtggctcaggcttttcaacaatagagaaataggtaatctcaagactctcagcttagctatatagcacattaagaaacagctgaacttgatttacctccttgagctctacaatgaggaaatagttcttatcattcttgatttgcttatgtattatctattgagttttgatgatgtctcttcatattcagaccgctcgagaatgcctctgaatcatgctgagacgataactgcatcaacacatgtttgcaagtaagttcatggtctagtgtgtatactcttgagatttaaggtctcttaagtttctttcgattgtgttttatacatgtagtgattgttatgataagctggtgggattccttttatactggttccggataacactgccgagaaatcatttgccagcggatgtagcggctagggaagattgttggtatggatacgcatgtaggacacaacaccacaacgaagatcatgctcgtaaacgtaaccatgtatgtcgccctaccagagggaaccatcacttttagtccgcttttcatcttttcttttgattatattttgggatattctgtatgagtagttagaaactgttccttgaatagttatcaaaatggattattttgtcatctgctatatagaagatggtgtcgggtcagacctttatttctgacataccaatcagatcaaccgttttcttagcaaatgtattaacaatcttatgaattagccattttgtgtgtttcaaaactttcaattgccaataaaaatttaactacaatatcaaaatgattcgttgcgttattaaaatgttgttatctcaaaaatctttaatactcttgggtctttttcattttggtcaaaatatttgggtctttgttattcaagtttatgtataatcaaaagccaatcgttaatgttgtatattacactaaagcagctcatttacggtccttttttccatattacccatgtgtcaaaatataatttggtaatcatcgtcagatgtgacaagcagataagttttctagtttgctaatgttaattctgtaatcatcgtcaaataatcagattcaagttcaaccagaaataaagcattaaacaaaaaaatcgatcttttatcatttcatggccaaatcaatgcggctagcaaattcagcttatcaattacaaccaattctataaagaacaaaaaaatcaaaaggtggctcagaagtgcttgaaaggtaatcacgagattaaaaaatctcaatcatgtgataaaaggtcattttttcttcatcatcaccaccatttttgttttcacagaaaaacttcaaatacaaaattgcaaataccgtaaaacaacaaactcaaggttgatcttaaaaggataacaaaaaccagaatctgtaagctttagctagctcgaaaagataattttgacaaacagagatttaaagatttgcagttctcaataacttctcagtgtatcagttgtattatatatatagtgaacccagaaattagggcaaaccctctgttaaaagaccaaaatagccctaacaatgttcaattatttcgaaaatactctcacagtttccttggtgtctccgccattactccaaaacttctgcttcttcgaaatttctaagccttaaagtttgataatttatctcgaaagacatg

SEQ ID NO: 7035 - DNA, 3000 bp, Unknown
  misc_feature (1)..( 3000): cDNA_ID_1816538_gDNA_ID_1621124_Annot_ID_56339 3000 nt of promoter + ATG
gaatcaatgcgttgttgtgtgaccttaaacagaaggagtttctggacaagtacgagagcttcgtgcagctcgtagccaaagtttatccgagtgaaaacgttcctggagtaactgaaatgagaggacttctggcttccatgtaaaaaaacaagtgatagaagtatagaaccataactgaaggcagttgttgttatatatccgccatcgccctttattactacgttcttggtcatttcacggatacaagtgatgttacaattattgtctgagcagattattaattctttctttctttctttctatttttccagttttataatttgagattacaagtgatgttacgactttctctctcttttctctcttaatattttagagagaggaaatcttctctgatgctccaatttggctctggcaatggccagtttcctcagtggtgttggtcggattttgtctagtgtcgttggctctcttagcagagtcggctagctctgtcttcatcgattcgctctcgatttggatggctaagtcccggcttttgttcggatttgttttttgttcattcttttctattttacttcgattttcttgggtttgattagatctttagatctgggtgtgtagttttttttttgtcgtcaacctgtttccttgattttggaaagagtacaagagtgaccaaaacccaattacacaacatcaaagcccaactataaacccaaccaaaatttacaactaaataaaatattaggattaattatcaaggacacgtgtgcttgtgcatgttaagattggaaagacgttagtgaatcatcaccgccgccgagttgaaatcgcccatgaaaattcatgatcaaaattcacctatctccaccatagattccgtcaacgaacaactaccttttttaatcactgactcaaatccttttgcccagtaattcgagtatgaggagtaaatccatgaaccatcagatctatgaaacgctggaactcgtgagaagacgagagttcagattggtcgcaaacacgctatcaactattctatgccggctagtagccaaactccactcaacacaattctcgattttaaagtgaagccttcaactacagccgattacggctccaataggagatgaatgacttattatcttcttggtcggaattgaacttccaatgatttcagagatttcgattatacactcggcataaattcttccttgctggaagaaaactaagagctgcaaaaggaacaaaaaaacttaacaaacaaaagccaagatagtttagaggatctcgcacataggcgagaaagagaaaaccggacatagccggaaacaaaatccgacatcatcatcgtcggaaaatgaaaggccaaaagctttctctctcaaaaacttttgagagagaagagagagaaaacctgcataacgttcagatttgttttgatctgggtgtgtagctttttgctcttcccttgctttaatgtttttttcctcaaatttttgttggtcctacaataatgagttgccacgttgttggaactacaataaggagttgtcacgtaaattcaaaccaatttactgaaatgggaacaaaaaagtcgtaatggtggacggagtgcaatcttatgtaggcagaagaccactctttttggctacataatgtgtttgaaattgataaatctacgtatataattttagtagcctttttgaccaaaaatctctttattatttattattaacatttagatctttacaaattatatctcaactaaatattgtattattaaaaacttataatttattagtttgcactaaatacttgaattaacttattcttttattacatatttagtctctacaaaatctatcttaaaacatatttgtctaaatttatatttttaattaaatcttatcattattgaactacattcaattaattactaattttctaaaatttctgtatctatattaaatataaatatatgatttttcttttacttttatttgttattacatctaatttatttgattttatataaaatacatatagttaataaaatattagatttgttgttgcatatcatgtaattcaaatttttaaaaacaaacatatataactcaatcgataaagaaaaaaaaatgtataaaatgtcccacattacttaagaaattgggcaatgattcaaaatcttactataaaaagaaccaaaagtttgaatacgaataagtcgaaagcttgatttatgaagcatccaaaattaaaaatgttatccggtttactctgaatcattattttaaagaactgaatttttaaaaatttaaaaatattaaaaatattaaaaatttgaaaacttttaaaaagttatactataaaacgttttaaatatttataataatattaatacgagacagtatattacgagtgaaattctaaatattacaataaaaatataattataaagtttagatcgttgttattatttttttgaaatttcaaatattataaatatttaaatttttcaaaaaaagataaaataatatttaatttcacgtgatagggttacatggtaaaataagttttagttgatattaatatagaatgatatataactatacgcaaaatcttaaaatttgaagacaaaattcatttttgttgataaaaaaatatacgcatgtggtataaatatatatataaataatattaattaaaataaaatatttcactttctaatgaaaacttcaacccaccgccggtcaatctctggtgcattagattattgtaatgagtttgattgcgctcgtttcctttttgaaattgtgaacatgtcgttgttactatcatgaatcattcaaacaaaagaaaagaaatgggaacaaaagagagattcaacctttcttggcactacaataaggcttattgccacgttgttggcactatttttctcttctctcttctaccggtcatcacctccttgctggatccgcaacaacaacaatg

SEQ ID NO: 7036 - DNA, 3000 bp, Unknown
  misc_feature (1)..( 3000): cDNA_ID_3022241_gDNA_ID_1621124_Annot_ID_172219 3000 nt of promoter + ATG
cgtttctttcgaattaaaaacgtttcggtgatggtcatttctccctttccatagcccgatatcagtctcatcattttgttgtgcaggtttctggcttttgatagcgttttcaaccgtatttaagaggtcctgcctatgtttctttcttcgattcatggacattacctcccccacagttgcagtaactcagattcccaagtcaatacatcctcttatcccaagtttttcatatagacagcctatattactccattcatcaaaccaaaatgaggtcgtttctccatttttgacctctactctatagaactgttgtgctatccctctatattccatatccaagaaccgcaagttgtagtgtcttttactgccgagaaggagccttttcttatgaaatatttctttacccattcaacccacaaagatcctttagccgacagtatacgccatatcaactttaatacacttactttgtttgcttcttcaatcgaccgcagccctagtccaccttcattctttggtgtgcagacctcagtccatgccacttttacctttcaagggttcatcgatggtcttgaccacagagaacttgaacacagtttatctatttcttgaaagcatgctttgggcagccggaaagcagctatccaaaaatttgtaagactgaagatcaacaaaaatttcttcacatgttgattttcaaatttggaaaactctatacaattgtttctagcagacaagataaatgtaaattttccacgttctatgacttttcagtacctcattgattcacttcaacagactactgtcatcattagtcgataacgtcaccatgtgaaattaatttgctcgtgcaacataacatatgttgttcaacaagtatatttattcatccatgatcctcgtcccaagaaagtcatgctatggcacttgtaaatgcatccaacgttacgttcgatgtattttaatctcctcgatcatggccgtgctatctttttttattatttgttttggccatgcaaaaatattgctacttcatttttgtaattttatcacatatataaatgtttgaactatgaaattctattaatttataaaagtattaatttatcgataaattaataattattaatttgtagagattttagactaattttgtaatttaaaaaaaaatattatgtctgaattttttcttcttctttataatcattatatttttaactttacgatggtaacgttaaacctcaaataataataaattattaactttagaaaataaaaaaaagaacgttttcgatgtagtaaaaagatattaaataaactttaccaagaattaatataaataaaaataaaaatattagcaaattcatatttcactatttttcttccgtataacatatatatatttaaaaaaacttttacaattattaatttatgatattaatgagaccatatatttacataaaattttcaaaaatttattatttaattaatatatcgatttgtgttattttttacattgatcttaactcttatacgataatctgaaaacaatttaggctcttattggtaacacacataatgcagaaaatttgccaataaaaaaaatctgcataattgtattagaaaacgcaaaaacgtaagatttgtatttttgttttaagtaaaaattcattatgccaaaaagtgtgtatataattatttatttgcataatataatcttattattctatgcatacaaatattagcaattgtaaaaaaaaaagtatcatagtttacacaaaattatatcattagtaatacaaaaaaacattttcataactttttaataaattttaattatcttacatttttagtatcgaaaattactcaaatatactaatttgttttaaacattattttttattaagtttatatatatatatatatatctacatatatattgttaatataatattttttttttaacaacttcaactttattaaattgtataaggttgatacaaataagaaagtaagaaacgaggagggacaataaagaactgatacagagtagtagtagacagaacgtattgagccatcttatctgcagcactatttcgttcacgattgacatggagtagagatacgttggatagtttggccatccaatgacgaatatcgtaaagaagagcccctatcagagaatgatcatcaccattattgatagttgctataagttcttggttgtctccatcaaaacaaacattttttattccacaagcccaaactacttgaaggacatgtaacaacccggtagcttccgcctgtaaaggtgaattagtcgatggtagttttcaacagcctgtaattaaaacctttccttcatcgtcccttatcaaccatcccgtatttgtaaaggatcgtcccagcataaagccactgtcaaaattacacttcacccatcctcttggtggtggtcgccattgagaacctctgtcatgaaccgtattcttgtttgtttgactacctcttgtgccttcagtataactgtttgcttccagccattcatttgcctcgtgtcgtcctatgtgttcttcggtttgtggcagtctcatgatcttcttgaaatatttatttgtcattttgcaaaatatatccaattaatatattttaaaattagtttcattcgacgattttttagtttgcaaattttcattctgcgaaatttttattctacaatttatgtcattatgctattatgcaattttagcaatcggaaccttaaggaaaaaaaccgacaagcgaaccgttctgtatgtatttcggttattttcagccagccctatttatttggttaagcttagattaaaaagtttcggtttggttcaatttgatatggtttggaggtcaacaacaaaatcaacgaactgaataaagcgatcgcgttggttctcttcttcaaaacaagctctctctgtccctctctgtctctctctttgggtaatcggaaaaatcagaaaa

SEQ ID NO: 7037 - DNA, 3000 bp, Unknown
  misc_feature (1)..( 3000): cDNA_ID_3049604_gDNA_ID_1621124_Annot_ID_172210 3000 nt of promoter + ATG
gaccggagcaccaatcttgctccctactctaaagacacattcgttccatgtttgtttgctctttggaatgcctttagatgctttatttttatactcatatgtggcgaatatgagtttaaccaatccgagatggcaatcttttccgatcttcaatatatcacgacaacattcatctgtaattggcactgtctcatctaacatgttcttgaaaacctcatttccgcattttgagcttggcttttcagagcaagcctcaagaaaatcgagctgtttatgcgagtaatggtgagcaagctccctatcatattccattgcgggtgaatcagcttcttcgaatggagcttcaccaggagcttcgacgtaaatatcaaactttgaagatggagatatggccacatcttttggcacctcctgtgaatatggatcaatttcttgggagaaaattggacgagccatgtaaaacattacaatagacacgagcgttaccatgagtagagattttgtcattttttttatggatgtaagaatacttttagtattgaatgtaagattgatgacatgaaacaagaaaacaagagattttataggttaatcactaaaagatatttgttcattaattaatagttatatgttactaacttcaacatttaataattttgtttaagatacgtttatattaaagactatgctaattttacaaagttgtaactttaaagataacaacactctctttaaagactatgatcgaacattactgtagattttgggcaaacttaaagataacaacactctcttttttcttcaaattattacaaatcaaaaatactatattagacacaatacgattacatgcattgttttcacgcctgatccggaccgtccggtccgacatggtaatccgctacccggacatttttcctatttgggtttagaactaatactcgacaatctaaaaccagaaaaatccacaaaaaaacccttcattaacttgcgatctggtgaagcgattaaaacaggccggctatgggttttaaaattttcatttgattttggaatagaatctagggtttcaaactatattcacttatttttagaactttttcatcatttaatgttttagatttggtgaagacttcacaatcccgcttttaaagaatgaatagaattgtgagagagaaaaaacaaaattcattattttaaattcgtgatgttttcttagtttattttcgtcatcaatgatctctagtatttctgttatggttttagattttagttggacttaaaaataataaataaaattttaattgattattattgttagactaaaatgacgatcgaatattacaatgatttagtattcatcaaatttaattaaaatttagttgtttattattgttagacttttgttaaacttggtattactatttttatttttatttaatataaactatataacttttctaaatattaaatatattaaataatttttttttaattgacttgtggtcaaacccggttgacacaatggccaagtggccccaaaaggcagtccgattcttcgtgtgggttgggtttaagaaccatgttattattttattttgttatcgaaattaatcgaactttttggttttctggtcaaaattgagttaaataggggtaaatttagttgattgggttcggttagtttgaaaataattaattaaaaaaaatgaaaaacaaaaagggtcgagagaggttaaaatggtcgagagaggttaaaatgatgaagacggtagcgttgcgtgagcacaagtcgaggatggttgtttttaatgcattgtatttttattttttaaataacgtttagctgtctgaaaaaacagaatgacatacaaagagtccatcatctataatctctctacaacttctgtggattatgtatcaatttgaccatgtttgaccatctgaataaaaaggagatttgtggaaaaaaattcttgtagtcgtctatttttataactttatccttcatcttaaaagaatacaaaataattttttgaagtaaaaaataattcacaatatttgcagaataattttataaagtaaaaaataatacataatattgctattgttaagttttctcatattttttaaaatttgataagtaatatatcaattcaaagaactcgagacgaaaagttcaacttacctttctatttttgaaaatcaaatgtatgtgaacgaaaaaacgtttataatatatgtataaagcctaaattgcatattattttttactttgaaaaattatttcgcatttttcaaaaatagagagtaatgttacaaaaataaacgactttaaagctttttttgcaccaaaccctaaagaaaatcattgtattgtatctaaatgaattccttgagaactaccaagataataagaatattgtatgtggtccatcactctatgttattgtaagtgtctatacatataatttgcaaaaagtgatcctcgtatgattcatatccgagtgtagactataaaactcatgaaactgtagtctcgtagaaattacaataatatatctagaaggtgataagttatttatgttgtggtacagtggggaacctatatttgcatgccccaaaggtaccaaattcaatccttttaactacactattttttttttttcttacccttttgattaataggctaaaatttcacaattaaacctgaatattatatttgtacctaaaaaacaaaaaaatgaatattatatagttttcgattggttggtggcatcattaaattttagttagaaagatcaaacacgttgatcactcgagtcacctaatcaaaacaagttaaacacgaatattttattagtctcaatctatcattatttcaatgctggtaccgaaaatcatcatttaaacaaaaagtcttatattggctctctcttcaacttttaattttctaccaaacatatacatcaaagcttgactctctttttctctcccatg

SEQ ID NO: 7038 - DNA, 3000 bp, Unknown
  misc_feature (1)..( 3000): cDNA_ID_1816519_gDNA_ID_1621124_Annot_ID_172202 3000 nt of promoter + ATG
ttctccgtcttgtttcagttggattctcaacttcatcaagtgatgcttctttgcatgcttgaacttcaccaagacattgttgaacaaagtttcagaattctccttccacaactccaaatcctcatccatttctcccttgcctttagagaagctttcctatcttcttcatccctttttggagccttcctcttgaaggtacgatatgtgaaactgtttgtaattgattgtactctctcctattcttttcttcctttttttgtttcttcttcttctactttttatttttctttttttctcttcggtttctcaccgttgatttgttgtctccttctttctcttcttctcacagcggaattcttgttatccattttttacttggacatgctccaagaccaagataagctttgataccatgttggaatattgagagaaaaagaaaaaattgagtaagagataaatatctcttctcttgtgaagaagacaagaacgaaaatagaaaacttttaatgaacctgaaacttattagttatttacatgacgatacaatgagtatatataggaaacaagtagactcaacaacacaatgagttgtgtctcttcatacttgtgtctcttcctacttgtgtctcttgacaaataactaccttaatacataaaattttaaatcagaaactcaattatcgaccaacactctgacccaccaatccagtacaaacctccgaaaaggagtagctattcgacaaccgacgtgtccgtcttccaatctcgttcctagcaaccagacgaactcagatttatcctctttttctccgatccgattaggaggaagcgaattgtgggagaaaccaaggttgatggctcaagcaagtactgagaatccaaaatccacaaaagctttctaaaatcaaagtggatctacaattaacctccatgacgagtagtagtgaaagcaagattttttggttgtttggagatagtttctaatgatctatattaacattttagaaatacattttaaggaatccaatcgggtgagttggatcttgcctaatttctacaaaaacagaagatacttactataaattaatgatagttcaaaatcaaagtgtaatatttagtttgtctttcaataagttttaatcagttagaataaatttttaaattgactcgaattacatatattttaaataaaaatattattataaaaaagaacaaaatgatgtttagttattatgggatgggttattattgtgagataggtttagatgagacatgtttttaagacgggatggatttagatgagacagttttttttttttttttttaacatcttcttttccattgttattatgatcaaaagttttccagctgtaaggctgaagaaattacaatcggaatgtaatcataaaatttaaattgttcattctggggtaagtgactcttggcaagaatatccgccggtttgttctgttttcggttgatccatgtgaatctgcattcctgaaaccgttgcttccaagcttgaacatctcttatccaattaaaggtatcaaaacgtgattttctcctattgaggatttccatcacctccctgttatctccttcaaaccagatttttctatgaccgtggctccaacagctttgcattgcgataagaagagcttgaaactcgctttctagagcattagaagtgtggttccctgtcgcttgacctgcacctacaaattggcccgactcatctcgaattacccatccagccttacttggcatctcccgattgtacgatccatcatagtacaacaacaacttaacaaactatctgcaacaactcccgctatggatcttttggcgcttatggaagagtcgaaatattctaacttttcagaaaaggtgcattccatgggacgataatcttcgattagcaaagagagacgcttctgaatggcaggacattgcggatcacccccaactatcagcaccatcccaccggcgacaacatgatgatcagagaacaagctgttggacaagaccaccccacggctgaaagaaggagacaggtttatatggcgggatgagttttgatcgatattaatatgagacatctcaataaaattcaatattatagtatatcaaaataaatgctaatcttttttgacacatctaaatgtgtatttgtaatacaaagttactaaattacgtatgttctacgagttaaatctaaaagcatcgaaaatttaaattatataattttaatacaaaattaataaatagaaaataaaatattgtcatgtggtatacttttggtcaagtcctaaaaaataaaaaaatatgaaacttattaatatcgtaaacttacgactcattaaaaaccatacacaaacttatcaaaaattattaaccaacacaaataaccataatctaatatataacaaattctaattttataaaaattaaaaaataaataaaatatttaacatgcagtgtatttcagattatatcctaatttgttatcaatagacgaagaaattgttatgtttcaaaaaaaaatctttagcaaataaaaaaaggaagctgaaaaataagttagaagtccaaattaataagccggttgcatgaaaaaagaagtcagaaaaaaaggaaagtacaacatcggagagaatctaaaaacaaacactcataatagcagtatataacaaacaaacaaaaaaaaaaaaaaacggttaagatctaaactctctccgtacaatccaacggttgtcactaaactaggatggctttaaacctagtaactcacataaacccaaaaaccggacccgtatttgccagttaccaccgaaaccgaatcaaaaacccttaatttcgacctaaactttgccatattaatacaactctcaaaacacaactctcaaaacttcccctgtttggtccgaaaccgaaactactaaccctaatctctcacatcacataaacaatcacttcacatagccgcaaaatttaatg

SEQ ID NO: 7039 - DNA, 3000 bp, Unknown
  misc_feature (1)..( 3000): cDNA_ID_2993312_gDNA_ID_1621124_Annot_ID_172201 3000 nt of promoter + ATG
cgacgaagaccgaagcgtcacttaacgcctagctagaatcctacaaaaaagcaacacaaacataatttatttataactaattaacaataaaataaacactatagtgagccacttgaaccatgaacttcaacgaccaacagcaacacaaacttgtggacaagaataatttatttatatgtaatatgtggacgtgaattatttgttgaacctccaagactagtgataagaacattttactagtaattctgaccttaagaagttcatttcaccacaaacgacataaaatctaatataatttggttaaatgtaacatacagtatgtaactatgggttaggaatggtttacgcttaccaaaccaatttagtcaactgacagttctgtgaggtttattcccaataacttcactagaaccactcatttctcactagaaattcttttgttgcgggctataaaagggataatgctagagaaattaaagcacatatacaagaacaaaaataattctataaagaataaaacgtttagagtaagtaagcttgtagaagtaaacaaaaaaggttggtaatttccgccacctgaattcgagtagcattagccatcagagttcgagtaaaacgtttagagtaagtaagcttgtaaaagtaaatagaaagggaggtaattccgccatctaagttcgagtagcattggccatcagagttcgagtaatttaacatggtttctccagacttcaaaattagtctttagagcatggtcataggtgatactcataaagtatcattaagaactttttagtattatttataatgtttgtttaataaatatattttatttctttttagcaaatgcgacaaattaagagatgacatgtcagatgatactggtatcaaaaatatcactaagctgatactgatcaaacttattttaattatttatcaatataaaaataatttttggacttatgatattttagaaatattacccgtatatatggtattaggtatataaaatttttacgatcacctaaattataaaaagaaaaaacaaaacaaaacaaaaagtaaaccgaaaagggtcttgaacggtaaaaattatctctttccttgccttaaggtccaattccagattaaatccgagccaaaatccatcacaaaactggattaattaaggcatgtgctcgatttagcgtttctgaattaaactcttacgtgtatgatatttggatgtgtatataatgtctggggtgagtaaaggaaaccgaagttgaaaaaacaaacaaacttgacaaaagttaattagtttaatggttaaatcatgaaatgtcaccaccgaccacttgatctcccatgctgtagttgaagaagtttgcctcagaccactttagtagcatacaaaaaagaaaataaataagagggtgttattcagttatggatttttctagaattgaaatgcaacactaaaataaacttttaactcaaccgatccatatatgtagatgagttcaaaaccaacaaaaactaaaaaaaaaactatagataaattggtcgcatattaaaagattaaaaaaacatggtgaattaagtatttatctacaaattatactaaatacaacattttttatgttcaaaaaaaattggactgtcattttatctgttatatatatcggaaccacgatatgtaaaaatttaataaaatatcaatttatttttaaattatactttttcttaaaataaaataatcaatcatgaattattctattctcggagtctaaaaaagtaaaatttaaaacaatttaatttatgtagaataatgttttgtatgaaactaattttgttgtctataattaacaagatcgtttatgtttgcaaaaacaaaggaaattttttttttttttttttttaatatctcgaagttcaagccgaaaggcctacatctccgagatgcaggatccacaccagattttcaacaatggaggaatataaaatatcaaaacgacattcatattaagctatgtattatttaagtttataattaatgattttagttaaccaaatacagttgatttatataaaatttggattatcctattgaaaattatgcatgtccaaaacttcttatgagatttatatgtataagtttatataagggtttatataattattaattattttttacataaaagcctaaccagagacaaacattttttttcttctaaataatctatcaattattaatttctagaggttaaactaatgtatatacataatgtgggtgtgaatttttgttggttttgttacattcgtttatttctgttttctttatttttttcagttaagctagattgctaaggaataaaatttgaaattagtttagctcatttaaacaaaatatcggttagattcagacagttcaacctattttgaaaatctattcagttttttttttttataaaatgaaaaatccgaagctcatttctcagtattatagtagagaagtgattttttttgtttaaattagtttagcataagcacacacaaaattgttttacattacatcacatgtgatgatgatgtggataagtgtatcgatcatccgccaatatttactgattactgtaatataaacattaaaatttcttcaaaaatcaaagattctattgtacctttctatttcctctagagatttcctaatgaagaaaaaaccagcaaagtcattatcaaattcgaccgtccattcgaagacgtacacgtctttgtagtcaacaccatttacctaacttcctagaaaaccacgtaacattgcatgtgcctagtttctcttatataaccccaatcaatatatatatatatgaatattgaagataacatcgttaaattgcttttaggttctcattatatcatttctctttaacttcgcaaacttctcctcgataaaatttctctctctaaaaaaaaacaattagaatcttgccttttacagagtaacactacatgccgaca

SEQ ID NO: 7040 - DNA, 3000 bp, Unknown
  misc_feature (1)..( 3000): cDNA_ID_3049617_gDNA_ID_1621124_Annot_ID_172196 3000 nt of promoter + ATG
tttttagtgccaaaatttacttttcccgccaaaacaaaattccgccaaacttttttcctgccaaaaagaaaatttcccgccaaaatgtttttcccgtaacaaattttttctcaaccaaaataatccttttaaaaatccttagaaagttttttaaaagctttgatagttattaaaaacccttataaatcattttaaaatctttataaagtctttaaaaacatatgtaaatactttaaaaatcccttttaaacctttgtgaatcattttaaaccttttacaatagttttaaaaggatttacaaggatttacaatgatttttaaacctttgtaaatccttttaaaatcttcttaaaactcttataaagtcttcacaatcattttttaactcttagaaacaaatttgttagtattttaaaacatttattattctttttgaaccattttaaaactcttgtgaacctttacaaaaggttttaaaaaaacttacaagagtttttaaaggattttaaaactcttgtaaatattttaatttttttttaaactattgtaaatcctttaaaacccttgtaaacccttgtaaaccatttaaaaatctttttaaaactcttgtaaacccttttaataattttgaaccattttaaactcttgtgaacctttacaaaaggttttaaaaagatttataagagtttttaaagagttttcttttaaattctttaaaaatcttttaaaaacccttgtaaatattttaaacgccttaaaaattccttgtaaatcttttaaaacacttttaaaccctttaaaaatcttttaaaaccctttaaaaatcccttgtaaatattttaaaacccttttaaaccctttaaagatcttttaaaatcccttgtaaatctatttccagccaaaaaaatatttttgcgggaaaaatgtttttgagaaaaaaactttgatggaaatttttttttcgaaattttttggtgggaaatttattttggaatattttaggcgaaaaaatattaatatttcattttgttaacctaaaacaatttcgaaatatgagtaaaatggtcattaaaaatttaaagaggtataaatgaaaatggcaaataagaaaaggtagaattgaaaaggggtagtgtggaaaggacattctgagcaattattcaatattgtatgactactaaattctcatatgcaaatgtgaaatcaaatttgtattcaatcacttgtttatataatgtctggttctttagatattagctcacttcaggtaagaaaacaaaatgtggtagcctcattacttcattagtgcaaagaaagtgattctttgggataaatttggataattttgaatcaaagctgtagtaggacaatacacttttatagtattttttattaaagggaaaactcaacatctaaaggcaaggaatatccaacagtttgaacgctaaacaatcaagggacaagcagagcgttttctaaataaagttgccgttctttgagagccgagctcgaaccgtaatctggcttcatcacacacatagttcatcttcccggtcgtcccatctctgcaatcaggaaaatgcaacctcgatccaaacctcatatcacctctttccttaatattctccataatatctttcacaatcacaccatccatatctccttcagaggcaatcgatgtaaccttaagcagcttaggccaccacggtttgatattgtaactaaatactcacaagagttaatctatgttagttttcgaaacaaaagaaatatgtgaacaaaactaacaaccaaggagtgaaatcttttgagtccacatgcaatatgtgatacaacgaggattcatccctctcagtatagactagttattctgaaacatagcttcctcactaccgcaagaatcccatgatacaacaactacgctcttacaacaatggttaatttgatcacgattcaataatcatctaccatgattcactctctttttggttaaagttcaaagtaatattttcgcatttctttgatataaaacgatgtcgattatttggttcatgactttttatttctcttagtttcacaacaacttcgctctcacaacaatggttaatttgagcactaaccaatgaccaattgaccatgcatgattcactctccttttggttaagttcagacagtgtaaaagcttttcttgttacaaaatgctgtcgattttttggttcatcaattttattaatttcttttgcactttcaccaacacctaatattaaaaagaaaataaaaacaagatccaccaattcaatgcgatagggtaagtgactaaatgttcattgccgttgtcaccctttgaacccaatttaggactcaaagagccgtctgattatatttaaccttggtcgaagtatttctaacgagctggtaagtcctcattggtccattatattcactgtccacaataattttaattacttgtacgactcggttaactccttctaggaaaaactaaagtgtacctacctagtacatacgtacttcttcatattaccacaagtttttttttttttttcttgcattcaactacgtgtttaaagtttcggccccaaacttcggcccaaaaacaaaaaccaaataaactattacaaaaatctttgttatcatatcacactatcatttcaagttttcaaccaatccatactcttaacaatcccattaaattgagatttattcatattaagaaattatgctgataatatttaactaccaaattaggccgattcataccaaaactatagaatatgtactaaataattccattaccttcgtttagtcatttttggcggtttatttcttttggatagatctcatgtcagacctttttagactattcattatggcacctaccacactagtgtgtctccatcttctgtatttatatacatatatcataagtcagaacaaagagaaagcaaagaagagaaactaaaacagagcttttttcacatg

SEQ ID NO: 7041 - DNA, 3000 bp, Unknown
  misc_feature (1)..( 3000): cDNA_ID_3049621_gDNA_ID_1621124_Annot_ID_172194 3000 nt of promoter + ATG
ttgagaaaattgtttatcggagaacaacatcatctctttttgttttttgatatgcttaaagttaacgagtctctcagtgattgttagaggggtacggtttgttatgtgttagacttatgttagattctaggatggttgttgctaagccaaagttcttgattaattttaagtatgagatttaatcttcataagcttgttgatccttcgtttttattttaatggtcagacttgatccaatgtttatgttcatttgaaggcgaagatcttaccgtttgtcaaacatagctaattagtggtggtattagcaacagatctttaggactgtcgttgatctgttgcaactcagtcactaaaaattaacaaatcttatataaacaagaggaatattaaaaagaaaaaaagaagatgaaaatgaatatcaaaatagttgtgtgacgatacaatatattagagatggactacaacaattcatgaatcagggtcacagactaaccgttaaagcagtaaatttgtctgcccatctcataagtgtttgaattaaaatttaggtcagtcgagagctgtgtgctatatactagatagtctacccttaattactatgtttggttttcgcatggagatttactataaatacacaaacaagtaatagtgctcaaattgtgaatcaacccatgcactaatccttttcatcaattcggtcacggttaggataatggattccgtaatatggtaacaaatgcattttctgaaatatcaaactaacatcatttaatgattatattgtttgatacattttatgatatatcaaactctgtaaatcaaccaatatatatacaattacagtctaacttatcttttttttttttaatctgtgaatggtttagatttgcatggatttaaggacataactaattaataatggtttagcgtcttgttgttttcctgtttgggcatgcgtgcttctcttgagtcttttgaccttgtaatctctattattggaaatttatgaagaaaaaaaagagtacttgtcaaaagataatcttatagttgggttttactgtaagatattgaagtttcgatgttttacttatatctgaaacgattgatatttgcaataataatagtacgatttttttttgaaatattatgaaaatctacaagagctccgattttgtggtaagtcaagatcgtaaataaagacaaaattaactcgagtctcatgcaatgttgtatatggtatacaatacatcaataacctattaattaaactttgtaaagatagtaaaaatgattattttggtttacgctatcgttcccttttttctatttgacatgtgcatttttacggaaagatcgaagtcgcaaatatagtcattaatttagtcaaaagatgacatgcatattaagttcttaacacaagcaaagtcttgtatttcatattattttctttatttcgcttattcattattatattgttacttggaccatttaccttgatttgttacacaaaccatgacacatgcaagattcaaatacgacttagagtttgatcagagggttcctcgctgcagaagttgcataagcatttaacaccaatagcgttgttctcttcccaacggcatactccacctttcgcgcccttgttcttacggcagttctgatcacagaacgtcgggaatattcgaggtgcacagtagctgaaacccacatcgccgccgtattctttcaggcacttcctatcatacgcttctatctcaggagtttctgcttatatttgtattcatatagataggttaaaaagcaaataaaaaaacgatgtataacgaaacttgcttcgataacggagaaaaataatctctggaaccctatgatgaatcacaaattttaacaaatatgaagtgagttagtttaccaaagatagccaaaacgaggatgaaaaagatggcgaaggtagaaactgacttcgttgccatggccaacttctttgtctctgtctttttctctgtctctactctctaatatttatatttcactcggagttaatatgtatgcgtaaatggatttgcatgcttaacacttgttgaggtgcaatactattttatatttatcgcttggacaaactattatcacgacttcacgagaaccacaaattcattacttagttttcatcactctatgaaaaaaaaaaagtatatttacaaagcaaaccaaaaatgaagtgggaaaaatggtaagacttcaagaggttatttaatactttatttttctcatttcgggatcaacatttaaattgaggttcaaccagtttcatcttatgctatgtgtttcaagctaccatagtaccatccactctctttgacgagcacgacaagcccccaagctcatccgctcaattgataagtttcatcggcaaaaatagtctaatccgcatacaaatttgtatgtaccaactaccgaaactattggaactaggcctcaatcgagtatttgatttggtttcattcagttctggttctttctgttgtagagtttatgatccatataggaaccaaatttttggttattttcagatatttttagacatttacgattattttctaaatattttttgatatttttttatgattatgatatttttggttattctatctaaaaataattaatattttggttattcatctttcagatatttttggttatttcagttcggattctaaaatttaaaatccatataagtatttttaattttggttcggttgttgttcggttcaattatggttcggttctttcgattcttttgtccaggcttcagttttttaattaacgtttttttttccttcaaattttttgttggcactacaataatgaatgacttgccacgtaaattcggaaccaatttactgaaatgggaataaaatagagattcaactttcttaatccgtaagcttaattttctcttctctcttttacctccttgctggatccgcaacaacaacaatg

SEQ ID NO: 7042 - DNA, 3000 bp, Unknown; identical to SEQ ID NO: 7041
  misc_feature (1)..( 3000): cDNA_ID_1839118_gDNA_ID_1621124_Annot_ID_56340 3000 nt of promoter + ATG

SEQ ID NO: 7043 - DNA, 3000 bp, Unknown; identical to SEQ ID NO: 7040
  misc_feature (1)..( 3000): cDNA_ID_1816531_gDNA_ID_1621124_Annot_ID_56342 3000 nt of promoter + ATG

SEQ ID NO: 7044 - DNA, 3000 bp, Unknown; identical to SEQ ID NO: 7039
  misc_feature (1)..( 3000): cDNA_ID_2993312_gDNA_ID_1621124_Annot_ID_56344 3000 nt of promoter + ATG

SEQ ID NO: 7045 - DNA, 3000 bp, Unknown; identical to SEQ ID NO: 7038
  misc_feature (1)..( 3000): cDNA_ID_1816519_gDNA_ID_1621124_Annot_ID_56345 3000 nt of promoter + ATG

SEQ ID NO: 7046 - DNA, 3000 bp, Unknown
  misc_feature (1)..( 3000): cDNA_ID_2056932_gDNA_ID_1621124_Annot_ID_56346 3000 nt of promoter + ATG
aataaagcctctcttgcctccaatatatctctgaatgctcgtcttaaattaaaaattcctatattctatctgtttctaaataaaaacatttgttagagttttcacatatattaagaaaatatattaaaagctgactataaatatatatatatatatatattttttatgatttacagttttaaattatttaaaccgataatattcaaatattttttttgaagtttacatttcatcaaaataactaataaatattgcgtagataacctaaaaactttattttaaaaaacaaatatttttgaaaaacaagataaaaaatctattatttagtaacagacagagtagcatattaagttcctagggagcttcacacacattggtcctgaataatatgatccaaataaacatgaaataaactgagcatgtaaatgcatgggccatgtatacaatacagagcagacatggaaagttggaaacatatggaagtatgaatcacctggattacataatatactcagacatcataaaacatcatcattccatttttgaagtaaaaaatttccccacattttagattttatttaagacaaatgctcttctcttgtattttctatataaatatcgaaaatcacattcttctagtttccacaccttatgttctccaatccaacacatatattttctttcacaaaaaaagacatattttaccttgttttgttttacatattcttatattttatcgatttgtctttgtccccggctcatgggaatgtcgaataggtcagtttctacatccatttttttccttgcattggtggttttgcatggaattcaggacacagaagagagacatttgaaaactacttcgttagagattgagggaatttataaaaaaactgaggccgagcatcctagcattgtggtcacatatacacggcgtggtgtccttcagaaggaggtcattgcccaccccacagactttaggccaacaaatcccggaaacagcccaggcgttggacactctaacgggcgacattgattcgatcatatcatacgtcataatcttatatcatatagaaaattacatgtattttcattcagacttgtcttctaatgctaaaggggtgtttggacatcactttatcatttcaatgttttgacagtactatgatcattatgtctttgtcgtgggtttgttacactgtcacgtattgtaagattatataatgaatgaattgcttttaaaaattaatatatacattaatgataaatcccttgctaaactgtctatgattgctagttgatcaatgggtttcattaaatatagacctaactgaaaacactttaagaagaagtttagtaggaaatatttacttatcacgctttgttttgggtcaatggttaaattatttctaaatacgaattcttagacgatatagaataacagagttaaaatattcaaaatgtttatggactaacgatatgctcattgagatgaagcttttattaattaatacccaatctcagtcttttaggtccctcgttttttttccttgctttaccatctttgtttatcttcttttcttttatatttttatttttggtatcaatgctaagtatttatacaattttcaaaaaatttaacagaaaatacacgaatatcggaaaagactgagaagctaacaaaaagaatgaaaactacaataaaacgcaacaaggaaaaaacacaagcgataacccatctagttgattctaagaagattcatgattgtctcagtttcaaagaactcgactccgcatcgctgttgccatgagcaaactcttccctaggcaagccttcaaatcctcatctttccaaatataaggttctccttcaagagccaactcttaagtatatttattttgttgatttgagaatagtacttggaaagaagattactgattggttcatggtaaagttattaagtactctcatatctgccatcggcgaggaactcacatatgggaggttgacattaacggagctgcatattctattttcatattttttaacatggatgcgaatgttacataagaaatgaacggttttgttttaccaaaaatctttagaggcattttgtttcatttccaaaaaataagaatgaaaggttttgtttaccaaaaattatattactctaccctttactttagatattcaaattcatgacattgaagatttttgtttggcaattaattagtcactaactaaactacctacatcgtctttaactctttatgaaaacaaaacaaaaactatcaacatcgcacataataattgattttttttaaaactcttttgttaattaattactactctaattaagttatctacgtcgcactaaacttgggttagttaaaaaaaaaattacaagttaaaaggttcctaaatcaacaatcttaaaatgttagttttctctaatcccatttctcaaatgttagttttgcagcaacaatctttatgtagatattttgtttcacaatttttttctttttcctctatttaaaaactagaaagtaaaaccaaaaaataagttaagaaaataataaacaaaaaaggaaaaaagaaaagcagaaaaagaaaagtacaacatacgagagaatctaaaaaacaaacactcataatagaaacaaaacaaacaatcatcaaaaacctacggtcaagatctaactctctccgtacaatccaacggttttcactaaactaggtcagaactaaaccgtatctttaaaacctagcagaacacacacagaaacccataaacccgacccgtatttgccagttaccacaataaccggattaaaacccctaatttcgacctaaactttgccattaatagatatctcaaacacaactctcaaaacttgccctgtttggtccgaaaccgaaactaaccctaatctcacatcacatcacatagcaatcacttcacatcacaaaacacctcatagccgcaaaatttaatg

SEQ ID NO: 7047 - DNA, 3000 bp, Unknown; identical to SEQ ID NO: 7037
  misc_feature (1)..( 3000): cDNA_ID_3049604_gDNA_ID_1621124_Annot_ID_56347 3000 nt of promoter + ATG

SEQ ID NO: 7048 - DNA, 3000 bp, Unknown; identical to SEQ ID NO: 7036
  misc_feature (1)..( 3000): cDNA_ID_3022241_gDNA_ID_1621124_Annot_ID_56348 3000 nt of promoter + ATG

SEQ ID NO: 7049 - DNA, 337 bp, Unknown
  misc_feature (1)..( 337): cDNA_ID_3022237_gDNA_ID_1621124_Annot_ID_56349 3000 nt of promoter + ATG
ttcgtaaagttgttttctatttacttaaccctgatttgtcttaatatccggaagcctaattaggatgattttgtactttcagaatctaatcttggtcaatggtcgtaatatttctttaattgttcatcagataataaacagtagaaaggtatgaaaacgaaagtggtgttgcgtgcattgaaaagaacacaagtgatgttagataaactgtcattgtgcagctcagttttgtctataaatcctaaactcagaaattatctagagatttcaacctttcactcatttgtattctattacaaatcattgagtttagaaataaaatttgcagctgagaatg

SEQ ID NO: 7050 - DNA, 3000 bp, Unknown; identical to SEQ ID NO: 7035
  misc_feature (1)..( 3000): cDNA_ID_3049625_gDNA_ID_1621124_Annot_ID_172192 3000 nt of promoter + ATG

SEQ ID NO: 7051 - DNA, 3000 bp, Unknown
  misc_feature (1)..( 3000): cDNA_ID_3049629_gDNA_ID_1621124_Annot_ID_172191 3000 nt of promoter + ATG
caatgacgatggtaatgataatgatgatttggggatcatggacattgatgaagctgacaagaaacctggtaaacttaaactgcttgccatcagtaaagcattcgctacatattataaggtctaatggttctgaaagcaaaacaatattccaatttttgcaggtaaaaactctccagacctgacggcattgaatgaatctcttcaagatttacttgatggtattcaggtaagatgtcccccaaaataaggtttctatgtgaaaacctagaggtagcgttcatttgtcttactaaataagagatttgtgttcttgtcatcgcaggaggatttctatgctgttgttgactgggcatataaaatagaccccctacggtctatatcaatgcatggtataaccgaacgttatctatctggtcagaaagctgatgctgcaggatttgttcgccttttgcttggagatctggagtcgagaatttctatgcaattcagccatgtagtccgtctactcagagattgtttagtttttgttcctggcataccattcctactaatcaattcaagttgactttaactgcagtttgtggatgaagcttgtcaccaaattgaaaaaaatgaacgtaatgtaagacagatgggtgtcttgccatatattccaaggtaatcaagaagtccatacattgaagtgccatgtgaatacttatttatgtccccaccagttagtacttccgtccaccctgtttataatttcagtcaattttgtggttctgaactatttctcccatttagattgttgttcaggttgactataggtgatccaagaacccgttatagtattaacatgaggctttcctaatattgttatctcattttcatagatttgcagcacttgctactcgtatggaacagtacatacaagggcaatctagaaatttggttgatcaggcgtacacaaaatttgtgagtacagctatttttatgagtttatagaacatgactaatgaaattacacaaaccatgtaagcaataatagacagtctctgattgcatatgatcttagttcacttacaatgtataaacccaccattagctcatgacttcattcttaacaacaacatataagtaaagtatatctcagattgtctctgcatttactatcgtcaatttcttttgtttctttccttgtttagctgatagagtctgactcctaatgttttataggtgagcatactgtttgtgaccctcgagaaaattgcccaacaagatcctaaatatgcagatattctccttttggaaaactatgctgcttttcaaacttggtaggtccttttctaactctctctctcttggtttgtcttcttattccctaaccttgtacattttgtttgtgcagcctgtttgacctggctaatgttgtgccgactttagccaagttctatgaccaggcaatggaagcatatgaacaagcttgtacgcgccacattagcatgataatttactatgtaagtggttctccccatttgcagctaatagcataactcccgtttttttccattcttttcgatttattgttaagggtacacccgtttgtgtttgcttcatgtgttctctcgtccctgcagcaattcgaaagacttttcctgtttgataaaaagattaaggatctcatgtatactatcacccctgaagaggttagttgttgttagttaactagttataccattgtttcactttctcattgtgtaaactatgtattggcgtgttactctaggtttctagggtaaaaacaaaataaaactgatacattatctctatatttcagataccattccagcttggtttatcaaaagtggaactccggaagatgttaaaatcaagcctgtcaggggtaagcaaatgttcattaagagtgtattaattgttcacagaccttttcgtagatcattttccaattcttctctttgtgtgtaggtggacaaatcgattgcagcaatgtataaaaagttgcagaagaatttagcatcagaggagttgctaccatcgttgtgggataaatgcaaggtacccatttaaactgaaaagttgaggagagtaataaataacagtgcattattagctcagtgtttgaatcaatgcgttgttgtgtgaccttaaacagaaggagtttctggacaagtacgagagcttcgtgcagctcgtagccaaagtttacccgagtgaaaacgttcctggggtaactgaaatgagaggacttctggcttccatgtaaaaaaaacaagtgattgaaccaaaactgaaggcagttgttgttatatatccgccatcgccctttattactacgttcttggtcatttcacggatacaagtgatgttacaattattgtatgagcagattattaattctttctttctttctatttttccagttttataatttgagatactaaaacttgccattgactgctccttcaccatggtagtaggataaaattcattaagatacctgaatattaacttcccgctattaggcttattgatgactttgttaagtcctgcttgataaaccatggtagtaggatctagagatgtcatgcgcagtaacagctgatatgggaagaagaatgaagtgagacacgtggacgaatgagattagaagttgaggaacggtcaggattaagacaccaaaaacagagtcagcgtttaaatgaagctgagaatgaagattttacataatcgtgaaaattgttgaagtttgttgttcttctctttgaagtttctgggtttcgaatattatgattcatcctctgtgaagaacattgttcttacaaggtgaatctagagtctcccctattttatgaacattggagctcattgttatccttgaatattaatcggaagtgttattttggttgattgatcgattgtttgtgattgaagaaacagatcctagtttttctgtatcaaaggtatcagagcgaagacgattctcggtcttcaacaatg

SEQ ID NO: 7052 - DNA, 3000 bp, Unknown; identical to SEQ ID NO: 7034
  misc_feature (1)..( 3000): cDNA_ID_1816550_gDNA_ID_1621124_Annot_ID_172187 3000 nt of promoter + ATG

SEQ ID NO: 7053 - DNA, 3000 bp, Unknown
  misc_feature (1)..( 3000): cDNA_ID_2041665_gDNA_ID_1621124_Annot_ID_172185 3000 nt of promoter + ATG
gctgatttaaagtgatccaaaatttgaccctgtctccgaatctttggaatagaagctcagcgtagtttgtgtagtcctccctattcacgtatcgcacatattatagatttgatagcagtgttacatagcctaaacaaaagaagaagaaaaaaacccaaaaaactttgaatcaaaatcgttaatgcacttacactatacgtgtgcttaagaaacctccatattcgtcttctaaagtttggggaacatcccaatgaaatatagtaacatatggttctatgcctgtattcatgtaagttaaatgttaaataaaaaatataataaaattatgaaaaatgtatggttaagtacaagtatatatcgaatttaccatttgctttcaactcgttaatgagattgttgtagtatgttatcccattctcgtccactcccccagtcagtcttccctctgattaaggatataatcacaaaaattctgggtcattgaattttaaatttaattaactagttcttttgttaatataagatgaaatcatgaagactatatgagatgtgtgttttctggtttttgtatttacttggtaagacccttgaccatgctatcgagagtctgtaagcttgaacattcattctttttagtagtttgacatcatcctgttcaaggttaagtgaaagttgtaaaattagattgaaattacaaaagtactgaaaaagtatcatatctacaacacattcatcaataatgatagcctcttctcaccttataaagatcatacgaatcacaagcaagatctcctgaactacgatccggtactttttctgtatataaataacaaaaaacatgagtcatgaccatgcatgaataactctttttaacatctaaatataggtattattttctccacattgaagaccatgggaaaaaataatatgttagatgacctggatatctatgcgtgaaatagtcccatccattaagtgctctatgtgctgcaccttcaatctggtagaacaaattaagtcatgttggataaattgtaacaaaatactaataatgaaaaatcctatatatagctaaaaatcaattcccagaagccaagatatatatacttgataagccgaagtagctgcaccaaaagtgaaatttctgggaaatcccgtacggttgaatgcatgagtattatcgcagtggaagggttctttggccttgcattctggattgcaaaccttttggctactcgaaacgacgacaaagagaaggacaagaacagctaaagagtagtgagcttttggaattgccatggtttgtattttctttattgatgtgcttcttttggtgatgattaaacgatgaccttggaggggtttatatacacgggtttgagtgcatgggacttgcatggagattcaagtaaactcgttacgtatatttgcattggatttgatgtcctccatgttctccacctcgctgtcttgttttctaattaagaaaacaataattgaattattctctatagaaaaaaatattaaacacttttgagtttacggcaccatatttctcttatacatttcctgcacatgtctgcgtgagaatatatgttccttaaccataactaatattcaatatattaatcaaattttatatagaatatattttataagaatttaaatgttatgaaattatattggttcgaggtttaagttccgtgtcccattcatttagctaacgttatggtcatttatattagagtttgtttgaagactaatacgtttttaaaacttaactatagaagtaatatatatatattattcacaattagtaatatagtaatatatatatgtacagatatagaccattaatgagcatcagcaaaagtctgagttgaaaatcagatgtagcagaataaaaaagatcctgcccaaatgtcattttcaactatttatgtttttttctctatcatttgatatgcagtttgtttaatgatttttacattttatattatagagcactgtaaagaaagatcactgtacaaatatagaccactgtacagatatagatcactgtacagatataaacctatgtacagatatagactaatatacagatatagactattgtacagatataaaccactatacaaaatgatgcatatgtacagaagatatttgttcgtttaacatttgtgaagcataaagaagctcggttactgttttggagacaaatatgactttatgtcatgtgtatgattgagtataagaactagaaccgcaaacggatcttaaaagtctaagtagtgtttccttgttagaagatacaaaaccaaagactcatacggacttcggttacaccatcaaaactttgagaaaaatatttgttcgtttaacagtaaattatgacttcgtttaacagatacatcattctttacaatagtctatatttgtacattgatctatatttgtacaatagtctatatctgtacagtggtgcatatctgtacattagtctacatttgtacagcggtctatatctgtacaatgatctaatctgtacaatgctttataatataaaatttaaaaatcattaaacaaaatgcatatcaaatgatagagaaaaatatagatttttatttatatgatcaattttagaaaaataaaatttactaataagcattttagttattaaacattgagggaatgtgtaataaaaaaaaaaaattaaaaacttgaccgactaaatatgccccacatgtctctctctctcacccaatcaaaaccgactatattactaattgtgaatagtatatgtactacttttcatattatgttttaaaaacgtattattttccaacatatctctttttttttcagttctcttgtgtctgtttttttcatttatcgattggtttcattttctcttataaaatccgacgacgatatacagaggaacgatagctcgatccgcagaattcggcatctgcatcatcaaatcggaagagtaaaccg

SEQ ID NO: 7054 - DNA, 3000 bp, Unknown; identical to SEQ ID NO: 7033
  misc_feature (1)..( 3000): cDNA_ID_3049633_gDNA_ID_1621124_Annot_ID_172184 3000 nt of promoter + ATG

SEQ ID NO: 7055 - DNA, 3000 bp, Unknown
  misc_feature (1)..( 3000): cDNA_ID_2041710_gDNA_ID_1621124_Annot_ID_172171 3000 nt of promoter + ATG
ccttctacgtgatacatatgcaacttcttctaaacgttattttttttaacgcgcacacaagttactattccaagtctaacttttacgagtaacacttgtcatccccacatcgtctccctggcgaggagttcgattctaaaacgcgttcccacatggatgcagtggtgctcgtcggacaggtctaaaaacctatttccgaagaaataatccacatctttacttaagtaagctaaaacttacacttaaagatttaaagccgacccagattcgcaccaaataagctgatagtaaggcagaacaatataagccgagtccgctcgcacgttctcactgacctagaggcatccgcagggtaagccggacaccagcgccgcacctataaagtacgacgagtcagtctcgcatacttcatacgtaagccttgtgattcgagttcaacgtatacaggataagtcaagggacgccttgccccataatacgtttcgaaaccaagcttaaacgccaaggaaaacctcgcagaatataagccgaggataaccttgcacaaaaaactcaagaacaagcttcaagtcatcactaaattctccgtctagctcatcattgtcacttcgtctctaagacaaactcctattgcgtatttagataggataagccgagctgcagatcgcaccgaatctaaatttcacagcataagccaagcccaaccttgcattcataatctgaagtcaagcttagtctcgctcccaaataacaaacaatatcaagctgaatcaaactaccagttacggttaagccaagctcgatctcgcacatacaaagatcatttcctaaaacgcatgacaaagacacgatccacgacataacttaaagtcgtgccgatctccccatgcctagaagaagatccgcaaaatcaacatcatcactcagtcttacgtcatctcctcgctcgccaaaacaagtttgtcgcactcacggccataacaatccattgtaatgccaaccaagtttggtaccacgcaaaatcaatcaacattcacactgatcgatttcgacgattgtgctaagcggacttacttcctcgctactcgacacggatccacgaaaacctaatgtcaatctccataaatttatatccacaaagcaagtgttcccagccaagcgttccttgcagagcattactcaccaagcgttctttattaacaaaactatcaaacgttcctagctcaaaaacctccaacgttcaatccttgcctaacaggcgagcgttacttaccaagcgttcatcgcagaaccaacaagcgtttctagctctaaaatacggagcgttcagtcctcagcgaactacaaagcattcccatccccgaagcaaacgattgagcgttcttcactaagctacaaagtaatcctcatcaaatcgccgaactaatctccaatcttgctaagcatcaataatcgcatcgagctacacctttggcgatgccacactacatctatcacttacaaaacgttcagcctccaccgaaccttctcactagacgaagccatcacatggaacagaaccatcttgttgacctgatccatcgcatcaaacaaaacttatccccgatcgttctccacccaacgctaggcattcccataaacatgcaaaagatctaactagggaacttcgcaaactcccagcatatcgttgctaggcatcttagcaaactcgtagtggatcagagatacacagctcgacaaactcccagcatatcgttgctatgcatctttgcagactcgcagtggatcagagctacacagctcggcaaactcacagcatttcggtgctaggcatcttagcaaactcgtagagaatcagagctacacagctcgacaaactcctagaagcatgaagctaggcatctcaacaaattcgtagaatatcagagctacatagctcgtcaaactcctagaagaacaaatgttgacagctcgacaaactcccaccaaatcagagtcaagcattcccgcaaacctgtagaagaacaaagctaggctgtctcgcaaacttgcaacatatcggagtaaatctcgcaacgattctccctgaactcattgccgacctcattcaccgactcctttcccgccgaactcccttagcgattcaaactcatagcccatgtaagaactagatcacctgcctacctcgacgcaagattcttgccgagaatacacgcgttgtgccgacctcgactcacattgcgcacgatccaacatgcaccgacctcgacgcatatcatgcgaccttgacgcaattcgtgccggcctcaacggaaaattgtagccaagctcaaatacctcgtgctcacatttacgcatttcacatcgatctcgcctaaacatctctacggccgacctcttttatctttcatgctcctcacactaatctcaccaagtacaccttcaaaattgacctcattgaactcttttatacaagaccagcacgccttgcatcgattttagtatcttcaccgagacgttcctcgttcaaacaactttgctcttgcacaaacacctaactcttcaaaagcgcttatctccaaaaatcatcaagctctcccgcgagctcctatctcaaaagatcttttagctcccccacgagcgcacatctcgaaagatcttctacctctccaacgagcgcatatctccaagataatcaagctctcccacgagcgcatgtctcctaagatcgtcaagctcgcacacgagcgtctatctccaaagatcatcaacctctccaacgagcgcatatctcagagatcttctagctcgcccacgagcgcctatctctgagatcctcaagctctcacacaagcgcctatctctaaaattttcaagctctcacacgagtgcctatctccgaaattgtcaagctctcacacgagcgcctatctccaagatcgtcaagctctccctcgagcacctatctccaaagatcttctagctctcccacgagcgcct

SEQ ID NO: 7056 - DNA, 3000 bp, Unknown
  misc_feature (1)..( 3000): cDNA_ID_2041716_gDNA_ID_1621124_Annot_ID_172169 3000 nt of promoter + ATG
aaggggtttggggagaacggagtagcttctttattaatgacgaacgaaaagacaataattaacagaacggaaaaccgtaagtacagaacggagaaccgaaagtacaggtcggaaaatcgatattaatggtcggaaaaccagaaaatacagaacggaaaaccagaaaataagagataaagagctaggcagcaattctctcttaaatcctctgagtggtgacttaggttctggatccctcttcttagtagtgtctcctcttatttataggcaagaagctgatctagggttctcttagtctctcttgcgatttctccgttttgcccttctaaatttatcgggctgggccaagccgtgatgggctgagctgtgatgggccgagcagtcattctgatgggccgttgttttgatgggccgttcttccttgttagtagctttcttgacttgttctatttgtgtttgggccgaattgggcatggagggcaaagcccgtatcccacaattagtcccccccgagttcggcgagagaaggttgcttgcgatcggcgaacattttcctgaaaccggaactatgccaatttggcccgaaccaaggaaaaattctttgtttgagcaagtgtggatttttgcaagagtcagagaatcgcaagaggtggaaagatatatgctcgtttgagagctcgacgatcttcgaagatagatgattgtaggagagcttgattatcttcgatgataggcgctcgtgggagagctggaagatctttgaagataggcgcttgcgggagagcttgacgatcatgaagagaggtgctcatgggagaaattgatgagtttggagatagtcgctcgtgggagagctataagatcttctgagataggcgctagcaggagagcctgacgatcttggagataggcgtccgtggaagagctttaagatctttggatgtatgtgctcgtaggagacggaagagctcgacgatcttggacataggcgctcgtgggagagctagaagatctttggagataggtgctcgagggagagcttgacgatcttggagataggcgctcgtgtgagagcttgacaatttcggagataggcactcgtgtgagagcttgaaaattttagagataggcgcttgtgtgagagcttgaggatctcagagataggcgctcgtgggcgagctagaagatctctgagatatgcgctcgttggagaggttgatgatctttggagatagacgctcgtgtgcgagcttgacgatcttaggagacatgcgctcgtgggagagcttgattatcttggagatatgcgctcgttggagaggtagaagatctttcgagatgtgcgctcgtgggggagctaaaagatcttttgagataggagctcgcgggagagcttgatgatttttggagataagcgcttttgaagagttaggtgtttgtgcaagagcaaagttgtttgaacgaggaacgtctcggtgaagatactaaaatcgatgcaaggcgtgctggtcttgtataaaagagttcaatgaggtcaattttgaaggtgtacttggtgagattagtgtgaggagcatgaaagataaaagaggtcggccgtagagatgtttaggcgagatcgatgtgaaatgcgtaaatgtgagcacgaggtatttgagcttggctacaattttccgttgaggccggcacgaattgcgtcaaggtcgcatgatatgcgtcgaggtcggtgcatgttggatcgtgcgcaatgtgagtcgaggtcggcacaacgcgtgtattctcggcaagaatcttgcgtcgaggtaggcaggtgatctagttcttacatgggctatgagtttgaatcgctaagggagttcggcgggaaaggagtcggtgaatgaggtcggcaatgagttcagggagaatcgttgcgagatttactccgatatgttgcaagtttgcgagacagcctagctttgttcttctacaggtttgcgggaatgcttgactctgatttggtgggagtttgtcgagctgtcaacatttgttcttctaggagtttgacgagctatgtagctctgatattctacgaatttgttgagatgcctagcttcatgcttctaggagtttgtcgagctgtgtagctctgattctctacgagtttgctaagatgcctagcaccgaaatgctgtgagtttgccgagctgtgtagctctgatccactgcgagtctgcaaagatgcatagcaacgatatgctgggagtttgtcgagctgtgtatctctgatccactacgagtttgctaagatgcctagcaacgatatgctgggagtttgcgaagttccctagttagatcttttgcatgtttatgggaatgcctagcgttgggtggagaacgatcggggataagttttgtttgatgcgatggatcaggtcaacaagatggttctgttccatgtgatggcttcgtctagtgagaaggttcggtggaggctgaacgttttgtaagtgatagatgtagtgtggcatcgccaaaggtgtagctcgatgcgattattgatgcttagcaagattggagattagttcggcgatttgatgaggattactttgtagcttagtgaagaacgctcaatcgtttgcttcggggatgggaatgctttgtagttcgctgaggactgaacgctccgtattttagagctagaaacgcttgttggttctgcgatgaacgcttggtaagtaacgctcgcctgttaggcaaggattgaacgttggaggtttttgagctaggaacgtttgatagttttgttaataaagaacgcttggtgagtaatgctctgcaaggaacgcttggctgggaacacttgctttgtggatataaatttatggagattgacattaggttttcgtggatccgtgtcgagtagcgaggaagtaagtccgcttagcacaatcgtcgaaatcgatcagtgtgaatgttgattgattttgcgtggtaccaaacttggttggcattacaatg

SEQ ID NO: 7057 - DNA, 3000 bp, Unknown; identical to SEQ ID NO: 7032
  misc_feature (1)..( 3000): cDNA_ID_3049650_gDNA_ID_1621124_Annot_ID_172167 3000 nt of promoter + ATG

SEQ ID NO: 7058 - DNA, 3000 bp, Unknown; identical to SEQ ID NO: 7031
  misc_feature (1)..( 3000): cDNA_ID_1816574_gDNA_ID_1621124_Annot_ID_172157 3000 nt of promoter + ATG

SEQ ID NO: 7059 - DNA, 3000 bp, Unknown
  misc_feature (1)..( 3000): cDNA_ID_2029027_gDNA_ID_1621125_Annot_ID_172233 3000 nt of promoter + ATG
agcggtgatacagactcggtggttccagtgaccgcgacacggttttccctcagccatcttaatctcccggtgaaaactcgttggtatccttggtacactgataaccaggtacgatatacatacacatactgcatatatatatgtacatggatatgtattatgtaaaaggtattgatgtttacctgtggtcacaggtgggaggatggacagaggtttacaagggactgacctttgcaacggtacgaggggcaggccacgaggtgcctttatttgaaccaaagcgtgctctcattcttttcagatcattcttggccgggaaggaactcccaagatcttattagctactttaataacctaaacatagagtaagagaaaatgtcccgaaggacaatttggctaccagattaggaacctattccgagtaaactcggtattcttctacttttttttctgttaaaagctcgattcatttccacaatttggaaactacaaaactatttgggagagcatttgagtaattgttgataatcaaaagaagacaaaggttcaaatatctctctctgattcagtagaacagagctctatttctctctgcctgatcgatatacaacaaaaagaactggacttctcatacctataagttgaaagaaatcacaaaaaagattaagttttgttactttaatccatcaaggcctggtggcatccctaagctctgcgcaagatcactcattctttctttcatagcctgtgaaattcaaaaggttctataagcaagagatgaaagaaaatgaacacttatagttgtatcgtaaaatatagtatgcgaagtctttaccagtacactctttgaatgtgcgtctttgtatgcttctgtgaccagcagtgaaagtttctgccaaaggaagacaagaaacatgagaagctgaacatagctttgatcattcctatgtagaagcaagtgcaagagaaagtaaaggtgaaggttactcacttcagaacctaactccattgctgcatcagtgatatcagtgcgaattggttgctggttacctgataatgtaacctgatacacaagttcaaagcttttggtcacttaactagtaagagatagaaaaacaaactaaaaatagcatcattgtgtaaattatccacagtagtattgaatcagacagcacatgtctcacatccatgaaacatgatcccgagtcagtaatctaataataccttgacaagctcgccttgacaataaccatcaaattcagcactgaaaaaaagagaatcaaaacattgatgaatgaaactcataaagatagaagaaacttaaagaatatagtaatgcaaatgggttaggttaatggtgtggggacatacacagcaagctccttctgcactctaacagcctctacttgaacaaccatttgagctttcttcactgtctcatacaaattctgcatgttacctagaattcctgcctaccacaaatagaagaaagcaataagaaacacaacagcttctgagaaaaacaggacacaactgtagaattgtgttgttaagactattgaacatgaaccctaaaaacatgtacctttgattgtccatcctctttattgtccttttttccgcctccgaataatccattaacacgaagagatctgttattatttccagattgcttccgatttaaccaaacaatgttctgtctactacttcgttgcgccgcattccctgaaattgcaatcccggaaaataaaacatcagagacgtagatgatcaaacactatacgaatctagattagtctaattgagacaagctcgcatggtaatcacacttgttcttctccaaattcaaattcacacacaaactcaatcacatacttatggaaataaaccgagagaatgagagagagaattttaagaaactaaccatttgagaaaggagaaagcaaagtcttgaagaaatcagtgttcgtagccgtcgaagccattgttctcctgaaacagagaagtgtgcttcgacaagataaacagaaagaacgagatatgtttcttaaagactaataagattgtgccacgtggaaaagcttgaggatcccttaattgggtttaatgggcttttaaaattgatgcttatatgagaaaaagcccaaagaagagattattttcacaggatttgggtccaataataatatgagaaattgagaattatgcaaaaacatgtatttgactaaaagaataaataaaagtacatcatatatacacacattatacacaccagtcaccaatcatctctcttgtcaaatctccatagttgcttcttctcctgtttcactgtttgtctcaaccaaactcttatttttttttgctctctttctctctataccccaatttctttacatacatatccaacaatattaactctttcatctcttcaataacccagatgtgctttttaattcaaattctttacaatttatcaaacccacctcacaaagacatgaacccaatcatcaacaaacacaataaaaggaagaaccttttttttgggttaagtggtcagcatttcaataccccttctgcaacttccaaaaggacacacatagaaataataagtgaaaaagaaagaaagaaatgagaaaaaatcaaaactttttctttctttctttcctctctttaccatctttgatcactagtcctagttttctgctacttgtctcatagacttctcacacacaaaaagaagagaaaaggaaaatccaaaatttttaattttttcaatatcaattttgtttgtaatgggcacccaaaggaaaatcaatcaattatgtggtttcttaagtcttttggtcagagggtttcatacatggaataagactctcaccattaaaacctaatcatcccctttaccttcgcttccttctttctccttcacacctccctctttctcgcttgcttgctgtctttccaatctgcgattcctaaattcactgaacggatccgatg

SEQ ID NO: 7060 - DNA, 3000 bp, Unknown
  misc_feature (1)..( 3000): cDNA_ID_2990739_gDNA_ID_1621125_Annot_ID_172241 3000 nt of promoter + ATG
gtagacatcgtttttgcttttaagaaaattgtaaaaggtcaaagattacataaatagatagtccgttacgttacatttttaaaattacgtgttttcctagttcctactatcggaccattctttgtgtaatcgtttgacacattttcaagtttatagaaattaaagtcatttatattcaaaaacagattagtcttttattttataagatgtaaaagaaaaaattggaaagatttagaaagaattagtatcttgaatattatggactagttatttttttttcttcaaaaggatgaaaacaaaaaattacgatcaactcatagtcatagtggttcaatagttaaattttctttttgtgattttaaacatcgttgagtactttaaaaacttttcaacatttcctatttgtaaattggaaaattatatatattcttaagtttcaatgtttttcccaaactgactactttaccttacgtttatatgatgatcagaagttcagaactactattcgaatattattttaaaaatatttaagaaaattatagcagaaatatgtgtgataatttattagttaactaaacacatatcaagagttagtttattttgaaacaattaataataaatctaataattcatttagctttaaacagtaaattattttggaaatcaaatctatatttaacgtagacaactcatagcaatttattaagaaatcaatccaaattaaagatttttttaattttaaactgaaacatattgtttttgtaataaaaagtaaacaaaaacggacattaatttagcaaatcagagagagattactcttgaatactcggttaggaaatcccaaacctagctccgaacccccaagaaacaagatttagctccaaaccacaatgactatataaacaccacatcaccatctcatattttattcacagagaaaacaaaaacaaacgagagacaaaactcaatccaaaacaaaacaaaagccaagttttttgtagtaagtaaaaaatccaaattatgggaatcatagttccagttttgacccttgtcttcctcttgtttgctaaagtgagccatggtgcctccaatcctagggtgattctagttggtggatctgtgggatcatggaaggttcctgattctcctaacaacactctcaatcactgggccgagaacaaccgtttcaaagtcggcgacttcatcggtactcgatatatatctctctctatctctttacttctgatatatttatatgctttgattctcttgtgatcatatgttcataaaaatttatatgcatggttgaatatttgatatatatttgttgtgcatgtgaaatagtgtggaagtacgacatgaaagtagattcggtactacaagtgacaaaagaagattacgagagctgtaacacagcaaatcccttgaagcaatacaatgatggaaacactaaggttgcgcttgacaaatctggcccttacttcttcattagtggtgctcctggtaactgcgctaaaggcgaaaagattacccttgttgttttggctgaacgcaaatccggtggtggcagcagcagcggtgacgctcctaaggtttctcctgttagtcctacggctcaaactccagctccagctcccggtccagctgcagcccataacgctgcggtggggttgaaggttgcaagcggttggttcttgaccgcagtcgtggttggtttggctatggcttagagcttagaggggtttggtcgagagaatgtagtttttattgagttcactttttagcaagatttagttttatttttccagattgttgacgtttcttttgttcccttagtttttcattataaaagatctctctttctgttttttgttatgtgtttgggatattatattcactcttaaagcttataatctatagtttgttcttgccattttgaatctaaaatttcaaaacctcaacaaggcaactacttgccgaccatcgatgaactgatcggattaatcaaccaaagtttaacaattttcattttttctatgagatatgttgactcaataattaatacaaagagattcagtcgactctatcttaatggtaataggattcatttgtagaaactaaatatatttatttaccaaaatgaccattgtgaaagtggtaattaaaaaacaaaactatatatggtgtccaagagattcttctatctctaaaataaaagagaatatatatgctacgttatggaaactacattttgaaatctgccttgcatgtactgattgatattctaagattgttcttgattttgttggtaacgccattgtgcgtggtaataaataagacgaggccaagtggataatgtgctaatctaattccattacttacacatatagtacatctttgacttttaagtaatctatcgttactaattaataattatgataattaaattacccgtttcacttatatcatggcaacgtttctgaagaaaactatactacacatttacgctaacagccgtataggagattaaattctaagaattgtacgttcaaagtctgaattaattcagagaattttgtttttgttttcaaaatttaaaagttggtatatattgatgaaattagttcaatgtagaagaaaacagtggtgaatggattttgcgatgaaaggaaaaaatggatttagtgattaatttaattcaacgtataaaaatgcttaagtttgataatgggtcactaaaagaccattagttcaaatgggccattgttcaacgacttcaaaggccttgtacaatagtttgctggcttcacttacaaaaacggcatgcaatctacgtcacaaactagaaaatgcaatccgccgctttttcaaagtaaaacgacacacagttgatgtttagaaagtgaaaacagtagagcagggaacccctgagagataagcctgaagatgacacaaattacatgagcaaatcccacgcatgtttttgctccagattccgcc

SEQ ID NO: 7061 - DNA, 3000 bp, Unknown
  misc_feature (1)..( 3000): cDNA_ID_3092564_gDNA_ID_1621125_Annot_ID_172242 3000 nt of promoter + ATG
aattgtacgttcaaagtctgaattaattcagagaattttgtttttgttttcaaaatttaaaagttggtatatattgatgaaattagttcaatgtagaagaaaacagtggtgaatggattttgcgatgaaaggaaaaaatggatttagtgattaatttaattcaacgtataaaaatgcttaagtttgataatgggtcactaaaagaccattagttcaaatgggccattgttcaacgacttcaaaggccttgtacaatagtttgctggcttcacttacaaaaacggcatgcaatctacgtcacaaactagaaaatgcaatccgccgctttttcaaagtaaaacgacacacagttgatgtttagaaagtgaaaacagtagagcagggaacccctgagagataagcctgaagatgacacaaattacatgagcaaatcccacgcatgtttttgctccagattccgccatggatgtcgcttctgctcggagcatctcttcacatccttcatgtaattgcaagtttcggattgtagcttattttgtcaataaagtaacttcaatatcttcgggataactttttcttaattatgttcgcagattatggaaaaccgatttgttcatcacaatcatcgttgattcgggtaaattttcgttttatttggatttttttactctttattgattgattcgcctttcgtttctgagaaaatgatggaacgtaatctgcaatggaagcttaattagaatttttacttggtgatgttaagtgaagtatcaagcttttagttattttcattaaacatattctggctctgttgagattttgatgtggatttggatagttggacatagttgaacaatgaacatgaagctctcttctaattgttcttattctatgaaatcattggagatgcagatttcgagggataaagtttgttgctttggtcgcatttctaatggcatgacgagctttactacttcccttcatggtaaggcaatcaaactatagttttaattgtcccttgatgcggttttgttgctggtcggggcgttacaatatcatttcaatcattccttgctatatataaagacttgtaattttatataggatctactcattttgtttttgagatctgatcgagttacttatccatatatctatttcgacgtgagatactgagatgaatcttttaaatccttacttgcttcgctttccatgtttcttctttagctgtcccgagtgaaaaatttatgggcgaaacaagacgtactggcattcaatggtctaaccgctctttaagacatgatccttacagatttcttgataagaaatcacctagatcaagtcaattggcaagagatatcactgtgagagcagatctttcaggagctgcaacccctgactcttcttttcctgaaccaggttttttttggctaaacctttgtgaacaaatttcatctgttttggtagattacaacctacatcgttctttttgtttgttagtttctgtctctatacacaatcctttcttgttctttcaactttgaagtgcagagattaagttgagctcaagactcagagggatattcttttgtgttgttgctggcatttcggctacttttctcattgtcctgatgattattgggcatccgttcgtccttctcttcgatccctataggagaaaattccaccacttcattgctaaactttgggcttccataagcatttatccgttttacaaaatcaacatcgagggtttggagaatctgccatcatcagacactcctgctgtatatgtttcaaaccaccaaagttttctggatatctacacacttcttagtcttggaaaaagctttaagttcatcagcaagacagggatattcgtaattcccatcatcggttgggccatgtccatgatgggtgtcgttcccttgaagcggatggacccaagaagccaagtggtatgttactctttgtttctcccacatttttcaagtgttttgcttttaaacaatcttcaaagtgttttaactcttgtgcaaattataggattgcttaaaacgctgcatggaacttttaaagaagggagcatctgtgtttttcttcccagaaggaacacggagtaaggatggtcggttaggttctttcaaggtaaacacagtctcaagattcttcttgatcatgttttggtatgtgtgttaacataagaggctggcttgtgatattacagaaaggcgcatttacagtggctgcgaagaccggagttgcagtagttccaataacgctaatgggaacaggcaaaatcatgccaacgggtagtgaaggtatactgaaccatgggaatgtgagagttatcatccataaaccaatacatggaagcaaagcggatgttctttgcaacgaggccagaagcaagattgcagaatcaatggatctctaagctgatctcagaagttgtcttttgctgcgtctctgatgaacattgagaagctttaatttttacatgtggaagaattaaatgttgagatcttttttagtcaaaaattgtgatgctccctttaatgacatttaaaagaaactatcagtttttggtttattataaaattttgtatatttcgttgtatctcgcgaattatcgtacgtatcacagtcttggccgcattgtcacgcctcccaggaaacagagtccttcccagtccgtacgtgatttccgacttgtaatcccagaagacgtctccttccaaattccaaatctcatgtgagttttattgtatctcttttgttgaactgtgtaatttcggtctgttgaatgtatcgagttgaatcagagattcctgtgttctcagtgaaactgaagcaatatatactgaaatagttgtgcttataattcttgttgattctcccatagatgacagtagatcatctggttatatttatgcagaattgaaggctcttattctagttggaggattcggaaccagattgaggccacttaccttgagc

SEQ ID NO: 7062 - DNA, 3000 bp, Unknown
  misc_feature (1)..( 3000): cDNA_ID_2172861_gDNA_ID_1621125_Annot_ID_172239 3000 nt of promoter + ATG
gcattaaccagtgtatactctacaactatttgttcagattttcaaaaatgttataaaaatttgatataatgaaaatatgcatttgagtttgtgtacagaggaaatactacattgctaatatttgaaggcaaatgtggatcttgaatcagaagaagatatgatttagaatcagaagagaattaaagccataaatgcaatattgcacaatgattattttatcttatgttatcatcctctaatatgcatgtaaatgctaacatgcatattctttattatttacatggtaattactaattagcgtaatttgatgatacacaatcattttttttttgtcatcgatacataatcattcctatccatatatctcaacattaacttttaggtaaaaaaattggaaatcatttgactgtgtcttgattataataaagacataatatatccataaatgctgattggtgatcaactaggtgacattaaagtcaaaaactctattcgtgataatccaaacaaaggaaaaatacagaaaagaaaggtgtacttaccacaagataaccaaagaaacaaacaaaccgaaattttttctataatactttgtatatatcgcatccaaaattgttttataccgcatgttttcattaggaacttaagtggcttatgagctgacaacatatcatgaattttaaaaatatatcagttcgattactatagtaatattttaggtagacaacaaataacattataaaatttcaaacacttaaaagatcaaatttacttaaatttgcaatgtacaacacaattgacaattttaaatggagacgtaagatgtatgacacctaaatttgcatatactgatatatatacatatctaaatttgttcctcaccatgttactataaagattttctttgttcctcaccatgtattggtcaaacgaaccttcatagcttctgtcatattttgagagttttattcaatattcataatccgagttgtggtcaacacaagttgttaagcatcacttctccaccagaccgattaaacttctttctttattcaataatcaaatcttctgataactagtatacaaaaagttataaacttaaatagttctccatctgtcatgtaatgttaccaagagactattactaacagtaccattgcaaaaggctttcaattccgttgtgtagtaaaaatgataggtccaaatcggtgcccaaaaagctggtagacaatgttggatatatatgtaaatatatttctcagaagattaaaaatacttgtaattctcttccttttttctcttataattgatgtttgcattcagctgttgcctgatgatatgacttcacattgttattgtattggtttacaaatggttttaaaaagcgaaatgttgtagttagtgaagataaaattacaaaatttctagataaattatacaaaacgtatgagtagattgtttccaattacaattcttgtgctttatataaacaactacaattattgatttatgtaaatttttacgaactatttatgtatatatgatttgtagacttgtagtcttctttctctctaaacgaggttcaaactcggagataacttataaaatgtttctatatgcataaaatcgagtttgattatgttataaatcacaccgcaagtgtatttatgaaacaatggggattgcgaccctaattctattcctaacaagtagacctttaaccatcgaagtcaaaacaataaaaagtgctggcgtaatgatcggcagatccgaaggaattgcgatcattaatggttgaattttatgcaacatgcacgatctatatttatggggatttgatgcaaattattttaatttcacttatgactacggtcgattaagatttaacgaaaccatttacattactatacattataatagtcgaataaaggcctttgtaaaaacgtccatgggcttttgtaaagaaaactaaatggagaaatgtgctgaagctaaacgaatccaccacattaattttcctacacgagtttctcctattttatttcctcacctacatgaatcaataaacttaacactatcgcgcgacccatgggctaagtagctgatgctttttagcgaagggcccgcaggcaagaagagcaaaacattaaaacgcaccgttttaaaagttgccgcgttggaatatcatctgcgtgtcgctagtcaatgggacatcaaaatttcattattcaccgtccatgactcgtctcccaccagcttccttccacgaaccaaacttggtttcaactttcattattaatctttttttttttttttttgcaactttcattattaattatttaatgttctcttacctgtacaaaatttagctaatttcatatttaaaaaagaattgactaaaaggaaagaaatcccaaacaagataaaattaataaattttctacggactcttgaccaaaaccaaattctattctccctgggaacaaaataaagaatttattctaaaaagtaaaaaccctatatatataccaaggaatcaatagaggatcataattttacacaccttttttttttttttttttaataatatagctctcgtcgtttataattttttttttttcgtctggggcaaattgtaatctagaaacgacaggaaccaaggtttggatcctccccctcgaactctacgattcgttcttattctcaatctctcctccttgttgttgttgttggatattgaattctcggattgaaaactcgagatccgtgttctgtttttttttccttcccgattcaacacgatcaattggcaattcgttgtttgcgtttcctgatccgttaaagttgattgcttttttattaaatctgcaaaaatattctgacttttatgcttttggatttaggtagctttagaaattggacgatttatttcagctcattacgatttgatttgaaagatcgttttttttttgttcagggttacgaaattgaagatcgaag

SEQ ID NO: 7063 - DNA, 3000 bp, Unknown
  misc_feature (1)..( 3000): cDNA_ID_3049681_gDNA_ID_1621125_Annot_ID_172236 3000 nt of promoter + ATG
atgaaattagctaaattttgtacaggtaagagaacattaaataattaataatgaaagttgcaaaaaaaaaaaaaaaaagattaataatgaaagttgaaaccaagtttggttcgtggaaggaagctggtgggagacgagtcatggacggtgaataatgaaattttgatgtcccattgactagcgacacgcagatgatattccaacgcggcaacttttaaaacggtgcgttttaatgttttgctcttcttgcctgcgggcccttcgctaaaaagcatcagctacttagcccatgggtcgcgcgatagtgttaagtttattgattcatgtaggtgaggaaataaaataggagaaactcgtgtaggaaaattaatgtggtggattcgtttagcttcagcacatttctccatttagttttctttacaaaagcccatggacgtttttacaaaggcctttattcgactattataatgtatagtaatgtaaatggtttcgttaaatcttaatcgaccgtagtcataagtgaaattaaaataatttgcatcaaatccccataaatatagatcgtgcatgttgcataaaattcaaccattaatgatcgcaattccttcggatctgccgatcattacgccagcactttttattgttttgacttcgatggttaaaggtctacttgttaggaatagaattagggtcgcaatccccattgtttcataaatacacttgcggtgtgatttataacataatcaaactcgattttatgcatatagaaacattttataagttatctccgagtttgaacctcgtttagagagaaagaagactacaagtctacaaatcatatatacataaatagttcgtaaaaatttacataaatcaataattgtagttgtttatataaagcacaagaattgtaattggaaacaatctactcatacgttttgtataatttatctagaaattttgtaattttatcttcactaactacaacatttcgctttttaaaaccatttgtaaaccaatacaataacaatgtgaagtcatatcatcaggcaacagctgaatgcaaacatcaattataagagaaaaaaggaagagaattacaagtatttttaatcttctgagaaatatatttacatatatatccaacattgtctaccagctttttgggcaccgatttggacctatcatttttactacacaacggaattgaaagccttttgcaatggtactgttagtaatagtctcttggtaacattacatgacagatggagaactatttaagtttataactttttgtatactagttatcagaagatttgattattgaataaagaaagaagtttaatcggtctggtggagaagtgatgcttaacaacttgtgttgaccacaactcggattatgaatattgaataaaactctcaaaatatgacagaagctatgaaggttcgtttgaccaatacatggtgaggaacaaagaaaatctttatagtaacatggtgaggaacaaatttagatatgtatatatatcagtatatgcaaatttaggtgtcatacatcttacgtctccatttaaaattgtcaattgtgttgtacattgcaaatttaagtaaatttgatcttttaagtgtttgaaattttataatgttatttgttgtctacctaaaatattactatagtaatcgaactgatatatttttaaaattcatgatatgttgtcagctcataagccacttaagttcctaatgaaaacatgcggtataaaacaattttggatgcgatatatacaaagtattatagaaaaaatttcggtttgtttgtttctttggttatcttgtggtaagtacacctttcttttctgtatttttcctttgtttggattatcacgaatagagtttttgactttaatgtcacctagttgatcaccaatcagcatttatggatatattatgtctttattataatcaagacacagtcaaatgatttccaatttttttacctaaaagttaatgttgagatatatggataggaatgattatgtatcgatgacaaaaaaaaaatgattgtgtatcatcaaattacgctaattagtaattaccatgtaaataataaagaatatgcatgttagcatttacatgcatattagaggatgataacataagataaaataatcattgtgcaatattgcatttatggctttaattctcttctgattctaaatcatatcttcttctgattcaagatccacatttgccttcaaatattagcaatgtagtatttcctctgtacacaaactcaaatgcatattttcattatatcaaatttttataacatttttgaaaatctgaacaaatagttgtagagtatacactggttaatgcggactatgcataaaacatacggttccacatgctaaattgttaaataatttttattctgttaatagctcccccctagttaactgattcaaattacatacaagaccaaaatttctttttcttatgtgttttttgaagccgaaataatgacaattcactttcaccgcatatggcgcgacacggttctatgtgggtgaagcaacaaacaccacagctaaatataagcccaaccatttacatatactagctttgatagtgttgtgaacaagcctcgtgaatagtcctatattggctatatagatacaaactcgtgaatagtacacctataatatatactcaacatatatgccaataaataagaaaggtccactcacagctggccaacctgcacattgtgtagtatctcagcaaaacacacattaaataagaacctccaaaaccccatccatcaatctatacttctcttcacattcacacacacacacacatatatatatatatatatacaaacataaatacagatacatctccatatactatatgacctaattaattacacacacacacacaaaaacccattgaagaaaaaaaaagcgtggagagtgtgtgagaggacacgaaatg

SEQ ID NO: 7064 - DNA, 3000 bp, Unknown
  misc_feature (1)..( 3000): cDNA_ID_2999487_gDNA_ID_1621125_Annot_ID_172244 3000 nt of promoter + ATG
tgcatgaccgaatattttttgtataataggtgacaattaagctattgatcattcacataaatattgtacataacactcttttagttataaatttatcatgctaatgcaacactcaatacctagactatataattaactaacagagagagatgggagaaatctgtttcatctacatttttaccgcctttccatttcccaatctattaatgtagtgataaaatgcatctttccatttttttttttttttgacgtccatcaatgatcaaatccctttacgattgcgattcacaaagaatcaatgccaaaatacacgtcgcaaattcgtaatgatatagtataatgcccaaaaaacacgtgagtaaataagattaaaccaactgtaatgtctaatcacatatcttgtaatttaaaccggtataataatactaaaccgggaaaacctaattgttgtcttgcattttccctctatggctcaaggtataattaaaatggatatcagttagatgcatactgcatacgtttttaacatttcgaatccataaattcagttgttgcgataatccaaaactaatttgctcagtacacggaccaaaccaaaaaccggttcttttagaccaaaccgaaattgtctactcctagtcctcctgcatatatgccccaacacatctctcaatcctctcatcgtcaataatatctttatatgacaatggtgaagcagataagaagatacgctctatttcaagccacgccagattctgagttcgtgaaggagatgtacggaggctacttcaacgtattcgtgtcggctttcggagacgaaggagagcaatgggatcttttccgtgtgatcgacggcgagtttcctcgcgacgaagatcttgagaagtatgagggattcgtcattagtgggagtttacatgacgctttcacagaagaggattggatcattgagctttgctctgtttgcaaaaaacttgatgtgatgaagaagaaaattcttggcatatgctttggtcaccaggtttgatattattatcatccaacgttttcttcttcttctatcatttaaaatatatcatacttgtataattttttaattacttaccactaggtaaaatctttacataaaagtgcatgttttttctttcgtaatttctctttttaaaattcgatgtacataactgttttgcctaacttcataagctatgttgtagactagcgttagactagatgaatctagttctattcaaagtaataaattttaaattataaaagcatactgcataattgaattagaatcatcatgccatattcataacatatcgcatgctatatcattttcaagttttttttttcaagttataatgcagtattgcatgctatatcattttcaaattaaattttgcgtggaatatatatatatatatatatatattgaggataataatcatcaaacatcatgttttataacttgaaaatgagatagcatgcaatatgtaatgaatatggaaaagatttaggctgtgtaatgaacatgtaaattttaattttctagtcagatattattattatagacagaaagtaattaaagaagaaaaacataattttttgttgttgttgtaaaatgatatatttgggtaaaagatattagattaagtacactgttatatactttataaattctttatatgagtacgaataaatgtacttatcaaagaaataactaatgtatgtgtgtatggattagtttcatctacacatggtggttaataatcctgaaaacaatatatatacctagcttacgtttttttttcttgttttggatttagatcatatgtagagtaagaggtgggaaagtgggaagggctcgtaaaggaccagacataggcctcggtaacataacgatcgttcaagatgtgatcaaaccgggtgattacttcgatcaaatcgagtcattgtcgatcatacaatgtcatcgagacgaagtacttgagcctccagagtcggctagagtcataggattctcagacaaatgcgacgttgagatattctcagtggaagatcacttgctttgctttcaaggtcatcccgagtataacaaagagattctccttgagatcattgatcgtgtccacaagatcaaatttgttgaggttcgttttaaacgtctatctttggttttattaatcctattatgtatagattggtcggtcttctaatgtcccaacccttgggagattattccgctacgtacccaatttaaattccgttgttcaggatatatatatatatatgtagccagggtgaggaatctctaaaacgattttttaaactaaaaaatatgtaggaggaaattttggagaaagcaaaggattcgatcaagaagtttgaaccagacacgcagcgtttgcacatgctttgcaagaattttctgaaaggacgaagaacccactaattggtttagtttccacgttcatggtctaaataaattctactacgtttgtgtaatttcataactattatatggtcatggtcatcacataatgtaacatatcttcgcttttaactaaattaccgactgctataagaaataataataataaattaccgataaacaaaaagaagaagactggtatttgtaattttaatttagtcatttataagtgggtataggttacgtgtataaatagattatttgatcttcaaaaaatacacgtaaaatcgagctacggtaaacaaataaatgtgattctaaacttagataaattattaggtggagttgtcatcttatagacagctaatctcgatgtgtgattctttttttttcaactaatttttgactattttttttctgttttctttatttaacaaaaatctcacttggcgtgtctgatcttgttccccgtcgtcgtctctaacttacacatttccattctccgaatctctatctctccttttgcttcatcggtgtgatctctgagacgaaagaagaagaagatg

SEQ ID NO: 7065 - DNA, 3000 bp, Unknown
  misc_feature (1)..( 3000): cDNA_ID_1013226_gDNA_ID_1621125_Annot_ID_172253 3000 nt of promoter + ATG
aaaatagtgtaaagacaggtacattacaaagtcaagagtatttacccattgatttgcattttgtatgtttgaagaaagatttgctaattgtgtttgctaaagatgaatgtttaagacattcatcgagatcttgtcttaacgacttgtcctctagaagcttttctctccatcttctccctctttttgcgagtcttctcatcctcaacacctccctaagttcagtcatatagacaaaacacagtccattttaaatgatcatgttttatttcccccttgttcaaagcactttgagagtattcaagacaaagtgattacctctgaaccatgtgacaatagtcccttaataagaccagaagctttgtatgctccaaatgcagggatctaaaataaaaacaagcaaaagtaaatggttgcatcattcctacagagcaaatctgttgtttgccttaaaatatggcaataaagaaaattgagatgggtatcataccactaaatacgcgtaccaaaactttccagagatgatagatccgacctgcacaaagcaggtgatgtagagtacatcatgcaaatatctgcaaggaagaatagagcatcaggcttatactatagaatctaccataaatccaatccaccataaagatgacgattatgtagcaactgataaacgataaaactcggagaaagccacaactagtaaaacatcactcatttcaaacaactgataatgaaacagtcctcctactattgcttttggttatggaaacagaatccaactatacagaaacacttgagacaaaagcaggcactttctagttgatcaatttaaaagacaaatctttccgaacgtacccacacattccaggagtgctcatgtcaaatccaccatcaagaagttcaccagcatcactaacactaggctttgccatttgatgaagaagcttatatggaatcccgtaacctaacgatgttaacacaagaccaatccaatttttccaggtatgacttgaatgcgaaattataaccctcactaggacatacaaaatctgcaaacacatattgccaaaaacatcaatcctcgaattcatcgaaacaaaatcagctaaacattgaaactttcgagacctaaagatcaaattcaacggatttttagttccatattgatacaagtaacgtatctaaacaaatctaagctcaacggattaatgtattgagaatttaagaaatgaggaacgaggaagttacgttgcaaaggatcataatgagacggagcttagccatgtgtcgagcgttctcatctttcctcttctttgctccttgattcgccatgagttaaaagagaatgatcaaagagacgaggaagatagttttttcagtttctgtaattcttcttttgctttggatcttcacaaatggtgtgagagaaaacttttaggtgtctaagcttgtttaatccaattatatattgacacctgtacctttttgtcgtcctcttttctcaaatacttttttcacgcaggaaatgttttgtttggctgcgtgtcgtaattacgcttttccttgggtttaggacaaagattcttaatttgggctttcgtctatccttatcagttgttgttggaaaactgaaacagttctatctaaatgggccagaacaacctaaaaggcccataaaatctgacatcttaaggcctatcaacagaaaactgcattatttcagttttccaataacaaggtctgtgtgaaaatcaccggcgctcggagaagacatcaacataaaaccttttaccgctgttccaaaaactaaaaagtataccatttctatgatcaatcggtaaaacgatatttataacggaacaagaacaaaagtagtgtaaatttttttccctgttttatgttgttctatagacaaaaaaaaatgaagatatcatatcttgtgggcctatatccaatatttgagtgtagcccatatttggatcaaacatcacgtcttacacaatggttctcggatatcccaatctgagtatggttttaggtcaattcaacatagtattattttgtcaacaagcaccattatagcaaaaacaaagatgtatcaaagaaaagtagcgttaggggttggtcagaaaaagacatgtttgcagtgtaagaaatgacgtggacacgtggaatcatacgcaatgcaacatgtcatcattaaggtccattgttcaacttacccattgagaacaaaactagaaaaattatagaccgttggatcatctttaaggaccatgtctgattcacgtatctctctcccacttggaatatgcttagcctatgtatgggacacattcgctaggtccaccagtatcctgtacgcaaacgcaacatcgagaagcttccgtttccaatattctatactataattacaaatgttaaaaattgtttataaaatttgtaatttgacttgtagacatcattagggtaaagatatatcaagaaattacttttttcataggaataaaaatagtcaactctcttaaataagggacaaatacaatcctctaatgacctggaaaacaactatgcaatcaacattaacaaatgtaattagaagtacaacacaatcaattttggttaaaaaattgaaagtatataaaaataaaaaaataaaaaacgtgtcttagttgataaataactcattaatcacgcctctatctctctgttttaagagtttaacagttaaagatcttcttctctatcttccttatttgactacatctccgtttattcttgggtctctctctatctctcttatccagatttatcatcgtcattacatataaacatcaaacttaacttttcaatattctcattcactttttcctcttgtgctctaattcttatccggatccgatttctctcatacaaagattctgtttttcttcttgggttattgttcttgctctgtttccgtatctcaaagtttcagctgctgaattgaatttgcattgatcgtag

SEQ ID NO: 7066 - DNA, 3000 bp, Unknown
  misc_feature (1)..( 3000): cDNA_ID_2999484_gDNA_ID_1621125_Annot_ID_172246 3000 nt of promoter + ATG
tttttgttctttattcgtttcgtctgagagaagcctcctttgtgcctgtaaaccttttttctctctctttctagttctctctaacccttaccttcttttctctttcataattttgcatgtctgtctaattaaatacgactgtaataaaatttctaatttagtaaaacaaaattatttttagtgttaagcaattaaaaattcagcagttttacaatagttaaataaataagctagttatttaatttagtctagatttgactggaaatgacgttattaatgtatttagtggttttttcatcaataaattactaatttatatatagacgctaaaaatccagcgttatcgctaatgatttgggtgaaaatttgaaagatttggtagtataccactctgtcggtgttccgacagtataattctaacatcagtagaccattgcaatcaagttctcaagtgtttttatctttatattatatgttggtttaaagccggtttgcatccacagtgcagcatgtataccggaccaatattgttatgttaattaacttccagtcactcattgctaaacttcttttgatatgcatacaaacacgttttaacttatgaaatcttgacttccgttttttattcgatttctactaaatcgagacatgatggacaattatttaaatgaagtgatatagacaattaaataattgtatcaatacaagcttgaaaatggtctgaccaaaaacatgtgctccctagtcgaggctcggttttatcgagacaaacaccactaaaccctatactcattttcatattcatattcataaatcataatacgtactatataaaaacacactgattaaaccgaaccgaaactgaaaataattggtaggtgttgattatgctgcagaagagaaagatcgaaaggcctaagagtgacacgtgtacggagatggtatgaagaagctaaaagaatagagatagagaggttgaaagcacgtaggcaatgacttgtgaggtgaaatgacagagcaaaggcaaaacaaaaacaaaagagttacgaatgagacagaatgtctcaggaaacgtcagcttcttctgttttttggctcttcatttcgtaaaaccaattttcttttggaactgtcacggaaagcccacatggtgtgggatgatatgaacctgtccattaatttgaaacttggaaggagaaacaaatcagaagcgtgaaattaggtcacttggttatcaatgattctgttttttgggaaatcttggtgtttgttctcaaattcagatatccattgaaaatagatgatcttcgcctagtaagtattgaaaattatatgattttctaaggaggttagctggttagtgatgggaagcaacttgttagtccttttagctatggactgagacccatattattgggccataatcgaagcccataggaccataatcgaagcccacaagtccacaatattgcttcaattggtgaaagatactgtggattgtagagtgtgtagtagacgtaatcaattttctacaatagtagatgtgtacgtaactggacgagtttctggactatattcgaatttcatctttgtagtttgtttatatacttggaccaaaaaagattataactaattaaaaaacagcggaattgacaaatgagaacaccctccttgaaacggcgaagaaatagtcaaatgtgcgatacttattttttgtaaaccttaaagattttgttttttctttttgataatgaccagttcccacaaaaacaggtaagttaaatcaaccatgtgcatactgcaagaagataacatctctatatagttgcgcaagaatataaaaaccggcgttatttacgagttacagttttctaacagatttggtgaataacaaggtttattaattgtagatatctatatatatatatatatatatatatatattgaagtatgtatgtgttatatattgcataaatacattcaagatagttatttatttaattaaaaacggtaaaatatagattttatcaaatgacatatttttagtttaaatatggtacaattaattttaagatttactggcacatcaaatgatcaaaatgtggttgataattgtgttgattattgttattgataaaaccattttcttttcaattaaacaggtgtggtttggacgaatcctaatcatcttagaagaataagacgattttttttttgccccagacgattaaaacatatcttatgattggcagccacacatatgcactttttagtgagatatgatattacgaaatgctagtttacgtatagtttctaaaatacaaatttcacgcactaaactacggacacctagttaagaaataattattgatatgatgtatgatagtatttaaactatataataaaatacaaaaatcaaaactattattttttaaaaaaaaagaatcacatagtgtaaatactcatgtatttttctttagtcatcacaaaatttacttctctagatttttaaaaaagttttgagctattaaaagcatttatatcgtgtagagacataaaagtatatcaataataaaaaaataatatatatttctaatttaattatgaaatacttactacttaatttcttttgacaagtgattccattatttgtttattgtttgtctacaaatgatatccatgttcaaactgtgtcaatcattcagaatagagtcaacaacggttgccgtccacggtccactccggcctctaaacttttttttttttttaagagcctctaaacttttttttctgaagtaaacaacaaaattaaaactataatatatacaaaactgttacataaaacgtggaaaattaaaaaaccagtaggtaggtcgaccaaatcaaatctcatataaatacatacatacatacgtctttattctccactgctctatttctcaatctctctcctaaatcaatcaatctttgtattttcatttagccagaacaaaaaaaatg

SEQ ID NO: 7067 - DNA, 3000 bp, Unknown
  misc_feature (1)..( 3000): cDNA_ID_2172957_gDNA_ID_1621125_Annot_ID_172273 3000 nt of promoter + ATG
atgcaaagataattatctcatagggaacaaaaggttaaagaaaaaaaggcctgaggcacctgtaggatagccaatcactcaagtccatccacttatacaccattgaccaagactccttaagattttctttcacccataaaagctgcaaaaggagaaatcttttttcgtcaagctcaaacacaaagaaagcaatcatataaagaacccctataagaaagttgtacctacttttggtggctccatttctggagaaacaccgccaccacagtactgcaagactggagaattaaatgagttgattctctctgcctgctttacagctctatggtccatccatacaataatgtttcttcttgaatcaccactccacgacactgtaacaggagatccctcagcatcaaccgccactacaaacaaaaataaacgttacattgtcaccgttaagctcctcttattcagccaaacacaaagacggttataagcagattctacacaccgagagagcacgtggcagcaaagcctattcctttcacttccacatccgaaacatttgcaagagagcaagcagatttcacagcagcacaaactgcatgccaaatatctgttgaagattgctgttccaataatattatcaatgtcaaagttaatctctaaacaaataagccatgatctcccttatccaacataataacctcaatacagtctccatccttccaaatctgtattggactagtagcagatcctagaagcttcccattatcatcgaacaaacctgcatcataatcaacttaagctacaaaaccaaaattgcattgctggtcgattttcaacattaaaaagaatcgatttttagtagactgatatcaaatttcatcgccactaaatcaatcatcattctcacgaatctaagaagactacaatttttcaaaattgacgagattttaactcggggaataagacagaaggattaccggcacgggcgcttccagtgccaacgtcgacaccgagaaaaacggagcgagacggaaatggatttaactcagcggtggtcatctgaacggcaacggcggaagctacggaggtgacgatgactttagtggctcaccttcctttatctactttcctttcctttatacatcataaccggattgttcttggttagtagagagccggatttagctaatttggatcggtcgaaccacggtccacgtgctccgttttttcccctgttttatgactaataaaaccctacaagtccgttctttgacctaaaaaataattctccaagttgagtcttcttactcgattcatcgggaaaaagagatggcagatcgtatgactcgaatccctgtcgtcaacgcagactgttgcaagcctaagaagtagcttcttatgcaaggtacaattaccctgcaatgactataactcgaggggacttcaagctgagattgaaccaaggagaattcacggattctcagattatagttatgttgggagagaatggaacggggaagacaacgtttatcaaaatgcttgcgggttcgaagcttgatattgatgaagaaggatctcaagtacatgagataccacagttctctgtttcttacaagaatcaacatatgtcaaaccgtaaatttgagattactgttagagatttgatacacaggaagatccctaacgcatatgcagaacaccaattcgtgtcagacgttatgaaaccgctcaagatcgaggagctcatggataaaagcttcaacaaactatcaggtggagagaaacaaagggttgctttagctttatgccttggtaaatctgcggatatctacttgatcgatgaaccgagcgcgtttcttgattcggagcagagaattatagcttccaaagtcataaagagattcattcttcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatcttttctttggttgaaacactgtcgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaaa

SEQ ID NO: 7068 - DNA, 3000 bp, Unknown
  misc_feature (1)..( 3000): cDNA_ID_3092430_gDNA_ID_1621125_Annot_ID_172271 3000 nt of promoter + ATG
cgtcaagtaacttatttatgaatcaaagaatcaatcatttagctgcactctggaggaacacctcgaggaaacctttttttatcggagcaatagttgtaaaccatgtatttactctgtacccctttcattcttgtctggccattcgaatcgagtttttgagtgaaccattgggaatttgcgggacaaactgactttccattaacccatacacatccctcgacattgtagtttctgtaataagcggtgaaaggagcttttgaccaatctgttttctctaatcctccccttgtagcccaatgctctgcttcccatagactcgcatatagcctcattggttgctttgttgggaatgggactccacgtgactcggcattcataaactctctaattggaatcccatcaacggtaaaactggagagaataaaagattcttggttcatgagtttatatcctcaaacataaatattatgtatggtacaaaggaaggagtttcgacacttacataattctttgtggattccatgtgatgcaataagtgtgaaagttagcggttgggtcaaaccatagatgaaattgttgttctttgtctcctgagccttttgtgtaaacattagtatggagagtatatggatgaccacttatgttccccaaaaactcgaaatcaatctcatcccatgtagttcccggagatttaagctacacaaattagaacatcatataagcaagtggtacgaacattttatgaaatagcaaaacatgacaagaacgttacatgttacttacatagaatgttgtgacggttccagcagagttaccagggacaagtttcatttgaacttcggctttaccatagagaaactcttgattagattggaaacctgaaccagaggatttgtcaagcgagagagatagaagtttcccttgattatcgtgaatctttccacgaccatcaccccaatgtatcttaacgtctttgtggaagctgcctgcatagacgctgatagattgtgctgcaaagagaaagagaatcaagaacgtaaaagacttcatttttattagatctctctaggagttttgatatctcagatgtatattgttgatggaatattgaggtaagtgacattagtttatataggggaaaaagagagatggaagtttcatgggtttgatcatttatggtgcatgtgcttttgtctactcggaggcacattcacagcttctaatataattatgtatatagattatttgattcgttgttggctgttgccaagtgaatccaataaaaaactctttctttatttgtttattgttatcaaaccgaaataatgtttggacatttgtacaaaattgaatggtcccaatgttttgatatgtcaacacggcttcgactttcgagcgcaccgcctaactaatgagaagctcaagatgtctgagaacactccgaatgaggaagcatattcgacaatcgacatcatccgatgccttgtgtcagacaaaacagcaaaaacgacagtgtttcaaccaaagaaaagattgtgttgggcttaagtgattcagacccaaaccaaaagaagcccatgacattacaacggtcattcattctcaactaaagacaaaaacagatgaatgcgagttcttcttctacgcaatcggtttgagattctcatgtgtgaagaaaaaaactagtctaatatatgggaacgattgaaacaaaccgaattcaaacaccataatatattctcaaaaattaaactccagatggatctaataaaattcaagagatcttataatagattgaaggggctaggaaagatcaaaacgtgagtttctcactacttcaggttttctccggtgaaagattctctcaatgtcatctctctcttaatcatccaagtagtaataacatcccgcaagcttctggtcactatccttcatcgaatcgagtttattgattcttggtctgaaattcgtaggatctcgtctgaaagtgatgttcaaacgagacaagaacaaattcattccactacgtagagactgaggagaagatgccgtgcaatccacggaaggttctccttcatacacaataactttatctgccaaatacgtagccattatgaaatcgtgcaaaagccgccttcttcatctgaagaatgaatctctttatgactttggaagctataattctctgctccgaatcaagaaacgcgctcggttcatcgatcaagtagatatccgcagatttaccaaggcataaagctaaagcaaccctttgtttctctccacctgatagtttgttgaagcttttatccatgagctcctcgatcttgagcggtttcataacgtctgacacgaattggtgttctgcatatgcgttagggatcttcctgtgtatcaaatctctaacagtaatctcaaatttacggtttgacatatgttgattcttgtaagaaacagagaactgtggtatctcatgtacttgagatccttcttcatcaatatcaagcttcgaacccgcaagcattttgataaacgttgtcttccccgttccattctctcccaacataactataatctgagaatccgtgaattctccttggttcaatctcagcttgaagtcccctcgagttatagtcattgcagggtaattgtaccttgcataagaagctacttcttaggcttgcaacagtctgcgttgacgacagggattcgagtcatacgatctgccatctctttttcccgatgaatcgagtaagaagactcaacttggagaattattttttaggtcaaagaacggacttgtagggttttattagtcataaaacaggggaaaaaacggagcacgtggaccgtggttcgaccgatccaaattagctaaatccggctctctactaaccaagaacaatccggttatgatgtataaaggaaaggaaagtagataaaggaaggtgagccactaaagtcatcgtcacctccgtagcttccgccgttgccgttcagatg

SEQ ID NO: 7069 - DNA, 3000 bp, Unknown
  misc_feature (1)..( 3000): cDNA_ID_1014815_gDNA_ID_1621125_Annot_ID_172269 3000 nt of promoter + ATG
tcggcgaagcatcgacgactaatttcgtggcggcgagaccgtcggcgaagaccgatgatgcagtgacgatgagaggttgtggttttgctaatcttgccttggttggtatagacaaagaagagcttcgagggagactagcgatgcctgagtatcttcgtatagctatgagagattgtatcaagaggaaagattcaacagagatttctgatcatttgttacttcctggaggcgccgccgctgatatggctcctcacgcgccaatggttgtgtttattaacccgaaaagtggtggtcgtcatggtcctgttcttaaagagaggcttcaacaattgatgactgaagaacaggtctgttttttaaaaaacaaaaactttttttttgtttgcaacttatgaaatgagctcactttacttaacttttgaaatgaacttgagatcatatttttgtttgaagaagattttaaatcttgatttgggagtttactttctttttgacttcactagatttgtggttagattgtgaatggaaacactctgttttggtttaatgagtataactatgagcctatggcattcttattgttctgacatcatcaaatgttctgttttttttttctctgtaattttgtttagaagaagttataaactgttttgtcttaaaaagactgtgattcctccttagttagtgagctcatgttaatatttgcaatgacaggtatttgatctcacagaagtgaagcctcatgaatttgtacggtacggtttggggtgcttggacacattggctgctaaaggagatgaatgtgcaagagaatgcagagaaaagatacggatcatggtgagtatctatttccaaagtattagttagcaattggaattagatttgctaagttagcggcgatgattgatgataggtagcaggcggtgatggtaccgttggttgggttcttggatgtctcggtgagcttcataaagatggtaaatcacatattcctcctgttggagttatacctcttggtacaggaaatgacctctccaggagttttagttggggtggttcattcccttttgcttggagatctgctatgaaaagaacattacatcgagcaactttaggttccattgctcgattagatagctggaagattgtagtgtcgatgccatctggagaagtcgttgatcctccttattctttgaagcctacaatagaggaaactgcacttgatcaggctttggatgctgatggagatgtacctcctaaagcaaagtcttatgaaggagtgttctacaactacttcagcataggtttggaatttggatacatgaagtaactttatctttcattgttcttaataaatttctacaaagttaaaccttttgaagtaatttggtattttcttgtgttgtttaggtatggatgctcaagttgcatatgggttccaccatcttcgcaatgagaaaccgtatctagctcaaggccctgttacaaataaggttgctatatatcagaatcttcattcttgtctaagtttcattaattagctgtttttttggtttgtaatgagattatgaatcacactcgtttcggttttgcagattatctattcgagttacagttgtactcaaggttggttttgcacgccttgtgtcaacaatccagctttaaggttagcattttctgtgaagagagtaaaccaaaagccttttctttactcaattcctgtctcttgttgtgttgacatgttgtggtaagatgaatttgcaggggactaagaaacattatgaaaatccatattaaaaaggcaaattgttccgagtgggaagagatccatgttcctaagaggttcatataaaactaatcttatctttgattaaaactaaaaaaatggcttcacttataatctctctggttttgttttggtgtagcgtaagatctattgtggtgttgaatctttataactatggaagtggaagacatccatggggtaatctcagaccaaaatatttagagaaggtaataatgttttattcagtacactaatcttaggttttattgctttctctacaagctttaacagaacgtgttcgggttttataacagagaggatttgtggaggcgcattgtgatgacggactgatagagatcttcggtttaaagcaaggttggcatgcgtcatttgtaatggctgaaattatctcagctaagcacattgctcaggtacaacaaaatacatccaaagtttctttataagaatcggtttaacctcggtttgatattaaaccgtttatcgttttaggcggctgcgattagatttgaactaagaggaggtgattggaaaaatgcattcttgcaaatggatggtgaaccatggaaacaaccgatgaagagtgattattcgacttttgtagagataaaaaaggttccttttcaatcgttaatgatcaatggcgaatgatcgaggaaactcttttcaagaagttgtaaaaggattaaaaaagcatgattctttatgtatttctgttccatcaattagtcaaaatagtgatctatgttgagcttttgctacggctgttgttgtgctagtgaagcatttaactttgtgtattttatcaaaaaaagatggttatttattcaatagtcattaatatacaattaagatataagcaatcatcttcaggtagaccttgaaatcttgtaaacatgattttgctgtctttaaactctgtttcttaagtcgtttttcagtgttttggagatagtagtaatgggtctaaaaagttaaataatgtttttgtggggagaaaaatgaaaatagcagattttcgaggatgggaagagtaaaacatatatttgagaagtcgaaaagtgtgaaatatttgttctgtctcgcgaggaagagagaaaaatcgaattagaaattgcaagttttagggttttagaaaatctatcttcttcactgagttttccagctccgaagaacacttgcaacttcaggcaatt

SEQ ID NO: 7070 - DNA, 3000 bp, Unknown
  misc_feature (1)..( 3000): cDNA_ID_2172943_gDNA_ID_1621125_Annot_ID_172268 3000 nt of promoter + ATG
gcaaaacattctgtagacgactttgtaatattttgctaacaaaacagctaacattttttttctaagtttattaaatctgttgaatgtttgagtcattttcttttcttttaccataatattgtaggccaataaaagatgagaggtaccgactagttgtgcaatcaatgcattcatcatgaaaaagttgaattctctttgacgcgttagggactccccgaaaaggtctaccttttccattttaaaggagcacaaattttttaatgcgatttctaatttcataaggtatatgatcatgtgaagatgaaaaaagccttcctcaaaggctacttattaatttgtgcagagagactatcatatgtatagattagatagcacaatttagttcttccaaagtcatcaaaaataaacttatgtaagttgacgtaaataatacaacgatgatcatatttcaatatttcatataaaagggcctctcgctgtggaaaaatatttgatgcttcaatgatcagaggcaaatcaaaatctgtaatgaaggatttattataaaactaaaactataatttgtcattaagctacaaaacccattcttaaatctcaactaaacccattaagttcattattggtagggccgaatcacattgatggctcgcttttctttcttatgataaatacaaattcttaggtgtactttgagtgattcaagtgtcacatgatgccacacttatttctttcaaaacatccttaattacaaacaattttattttatgatcaataaattttaatgatattcagtcacaataatctttgaaattacatatattcaaacttggttatatgcatccatgcataattgaatattagtatcatttgagttcacgactttaataccatcacttccaaacagagcggcccaactcgaatccataaaccaacacacacaaaatagacacaaattgagtctatggattaaatgtcaacactgatccactatagtctatatttttataatttttatggaagagtttagtcgaacttcagtgcgaaagaaagaaggctaagcaaccttaacaactcacttaagatttagccgtgaaactaaaatttggctaagcctcaaacctgaattacccttgtttgggttcatatgccgactcattacgtcccaccgctacttccaaaggcacgagtccatgtgggtcataaaatgacgtgtacttgtttttttcttacagagatgaagaacttaactgatttgattccgttcagaaacaacggattgaaaacatgttgattccgattcgtataatgtctagattccttttctttaactcgtaaatcctttcttggacgcggtttcgagactttgacgttgataaaatgtgaatatgtgtacatgtccacctttgcctcttacgttgacggtcgacaactttttgcaagtcttccaatttctttccatttatgcaatttttcccctcaacctatttatatcttcactatatgctaatctactcattttaaatacttttcattaaagatcaaatttaagattaatctgaaaggtaccaaattttatttatgattggaaaacgatgcctaaccaataacaaaaatgactttcattagcattttgatttattaaaatcctgaaaataattaagttggtcctagacacaaaactaaaatatatcattccaccaacatcatcatcatataatagaagtttataaatgttttatttgaattttagttcaagttacttggttttagaaaatgcgtaaccaatataaagacggctatagtatgaagcgatgttgatgcggaattgatctttagttaaacagctcttaacttttacaagaatttaagttatatctcaattaaaatttggtttcgacaacccctgaatcgtttgtttgttgtggaacgaaaggtttgtgtgaattgctttaggcaggttacagaggaattaacatataattcaggttttttttatctatttaaacagttgaacagttttaagttttaaccatacatgaatatatttttatcttgattattcagttacatttggattgaatagagtcggttaatccaaattagtcaccttttcataagattgtttatattgaagaactaactaacgtatgagaatcaatgtttagacagacttgagagcatttgtgaaaaatttaggtcccctgtatacccataaaacccataggctataatgggcttaaaaatacaagataattgttgtatggatcctaaaattcaccacctcggcccatacgtgagttatgtaaatgaaagttgaaataaaatagttatgtaacgcaccggttatttaggatgcaataaatatataggcatatctccctaaccagaaaagaaaaatgaatattggacagcttcacgatctaataacacaccacacccagtagggcaatatagtcataaatatgcggcccatatgtcacatcctgacacagtccactgcctcatttaattgtcccttttaccctttttacaatcttaacgtgacaagtaaagcatttaatagtctctctttctgtaaacttacatagttttgcatttacaagtcaaatatcaaaatatgcaggtattattaggggttttaattagggtaacaagtaaaaaaaactttaaatttgtagtcttacgatagaaaaaaaacttccttctcattcgccttaaaagatggtcacatataaatcaacgagatttaaaagtagtggcaattctgtaaattcgtaatactagtaagggcattttcatgtcgtttttttaaaaagttgcaaaatctacacgtttaaatacgcacatcgaagtacaccgattttgatttgctctgtcttcgaaaactaatcttaaaaaacaaaacacagaactgtcaatttattagtcttattgaattgtcttcaaagttcgatcatttttttacgttttattttaatttgtttctccaagaatctgata

SEQ ID NO: 7071 - DNA, 3000 bp, Unknown
  misc_feature (1)..( 3000): cDNA_ID_4262150_gDNA_ID_1621125_Annot_ID_172267 3000 nt of promoter + ATG
ataaccaaaccaagcgtttggagaacacaatcagaagaactctcattcatatactagttgttttcaaatgtttgtatatgattggatatatacacatgtaaagtttatcagagacaccataaaataaaataagtaactggtgctacaaatttcatctaattcgacaaatgtaaattacaaagctaaatgactcgtctaaggtaagtgataatgttagtgcaaacatttagtattatttttgaactgcaagatgattaagtatttttctaaatcatgactatggtagtactatttaataattaaatgaaactgtatattcgaaagtagaaagaagaggtgtggaattggacaagagaagagtataacagagaaaagtttggtgtaaaaaaggctgcaaaggagttggttaaaaagtgagtgaactcgataaacgcgtaaccctaaaggcaaagcgtgcgttactctttccccaattattttaccttttaaacttttttttttctttctcttagaaatgattacggcatttttaaaactagttatctcatttatatttataacgactacaatatctcatgacgatggtaaatcacatgaataaagtaaatatgattcgactacttggacgagttttgaagttgtccacaattagttttggataataattgtagtgagtgcatggttactgtactcacatttcttctaaattacaaatgtctcacaaaacctagaattttaaaccatgagagctcttcaacatactatagagattaatttgtactctaatccggaatcctctggatactaataaaattaatgaatacttgatcacctctttactttcgttgcttataaatttattcatgtagtttgtagtatgaaacatgaaagtatgtatagtcgatactccatagcattattggttctgaaaaattgaatctcacgtaaagtacagtattaagtttttcgtagacatattgcaatgatgagaggtaacaaatgaaataaggacaatttgtttggtgtagaagaagtaagagtcatgtagcacaaaaagattgtctattaaatggtctctgaatttattgggtcggctcgcacatcggcacatgtgatgaccttaccattcttgtctctgcatttaatattctttatccaaataatgatacaagtgaagttggtaacaaaatcgatcgtcaatgttttgtaatttctttccttgttccaaaaggatgtcaagttgtcgtgcagccattggctattttgatttgttataattcaagtttagcgtttatcttgcttcgatggaaagacatttaatcaaaattatgatctttgtatcaaggaaatgaattcgtaacacttatgttacgttcttttcaatttgtttccggttcttctaatagaaaagttaaaacgttattttcaaaatgattgtgacactttggattgtatttcagttccaaatctaaaagcaagactggcacatgatcgatgatacattaaacacacataagctataacagtttgaagtaattctcgtaccttcgagtcagaaagatcaaactcgtagaatttatatgttcaaccttttcatttacttcaaagtgaagttctatgttacaattgatttccaaaatgctaactacaaaataaaaataaaagagcttttggatcggcgtaaaagagacagcagagagataaaaaggcaaaatacgaaaaggtgaaaaagctttttgagtcgattccttttgcagggattgcgtgtgatttacagatatttcgtttttttaaaacaaaacaaaaaacccaacgaatacaaaaaaactcacacgttttcaatagcgcgtgacatacaccgatcaccacctaagctgatcacgagtcagaaaaggcactcaagcaattatcgtacacgcgccactttaaaacgcgtgaacacttttgtctcattactatgactagattcaaactttaatttcgtcatcaaaactttattagttgctacctttttctttttttccccacattcatctaaacttagtaatttaattttttgcttttttccaaacgttttaattagtagtagtaaacatcaatatcaaatttctaatcttttccatataaagtttgttctcaaccgtatagcagcaacttacaaaaaaacgttaataaatcttcttccaatcttgtgcatgaacttgttgtagtcttgatgattatttaaatagtaacactaatatctcttctaaaatacgaaagatgacactgaaaacagagcatcgtattcgccgttttaagacctatatcggtattcatttagtacctatttcgagttttaattctctgtcatcacaattcacaaataatttaatcttaataattgggtctcaatacttaagtagatgttaattggtctagaaatgaagaaattaagcaattttcaaaaccaagttaatgactttgaggctcaatgcatggttactattctctatagccgcagacacaaaaggacactatcgtaatctcctcaatgctccttataatatttggcgtcgaataaattcaaatagatacacatagaaagctataataatgagagagtttataagttcttgtgaaggcaaatgatccaatctttccttttcttctcctcaaattttctttcttttcccacgcgcttacacacacactgcaaaaaccacagaaacacagagaaagagaaagacaattcaaacaaaagcttcgattttttacctttctgtttgatcggctttttgtttttctgtaaaaagccatcttttgtgtttgatcctttctttttttttacctgattaaacaacttttctcctctgcattttttcgtgacccttttaaatatcttgtggccggtcctaaaagttctttatgcaaaggtttcttctttataagataaacaaaaggtgaagaaaccacaaccaaaaaaaaaaacttcttgttgagaaaagtttttttgagatg

SEQ ID NO: 7072 - DNA, 3000 bp, Unknown
  misc_feature (1)..( 3000): cDNA_ID_2172926_gDNA_ID_1621125_Annot_ID_172265 3000 nt of promoter + ATG
tttctgcaggatgtgatgagaagtttagattgcacgggactagacgataggcgaaaggtgaatgattacgcgatgagcgagtttgaaaacttggtcctatgtgtttaaaggtcagttcctgattgcagtattcggatcatttaggtagaaaaaacaatgtgaacaactgcagagatacattaccagattgaagtctgtatttttcttctctttgtgtgtaaatatgaaacgaaggcggtcaaattatatataagcttcttctttcttccgttcttatgaagttttatgcaatcatagaagcttcttgtttgctgcagagttctgttataagtttctacttttgatagcgtggttatctgaattccaccaagtccatttttcctcttactatataaatatcgagtaatttggctcgagttagttcggtttctttcagggttggtttttcttggcagccgatgaattcttggattcatcgaagtagccatcaattagtaggggttcaggtttttgttgaattgtgcttagtagtttgggatatagtagtgaccatattgtcatttttagttgttacaaggctctgaagtctgaaccatattatatataggaagaattcatcaaggtgcgatgatatttctatcatttgttgagatcaaaccttcgatttatacattttggaataaccagagtcgcagtctcacgttttcatacctaatgatttagagtgttcactcaatctccaagttagagcaggctaatttcggcaaaactcttacctgcaaaccattatttggtatatgtgagtgtacataaattgtcaccggaattaaaccatcaaataacttgtcacaagcactttttctgcatatccgaattcgatgatgtgaagaaaatggttgtaccaattttcaattgcacatatgtctgtcattttcagattatgttacatgtaaaaaccaagtatggttattatattttgttttcaaaatgagaatcaaaataatagaaatcagtaagtatttcttatcatggtagtttactttgattggttatcttattctgtgtaagctctcgacgattttattcatattttgaaatactatacaaaagtcatgatgtgtgtacattttccattaggactttctagacttgagcattattttccttgatagcttcatcgacgtttaggccctgaaatccaaataaacaaactcataattaaaatcctgcttttctaaagtaacaaagaatattaagtgataaagattgggagaaataattacggaaaataatcaatgttaataatcccagcgacaggattagcgatctgagcaaaagcttctcgagaaagatcgagcgtagaagcacagccactgggacaatggtcaacgatcttgaccttcacggatttccccgtgcaagggtgaggcacggcgttacgaggtccgctgcatttcacggtgaacattttgccacaaactcgaccattgtcccataatgtatcactcgctgcagcgatcatcactccttcttgagtacctctgtaacatgctgatgctatcaaacatgaaataaaagaaaatgattttataacatttcgctgtaggttgatatgaaaatgtataagataagtttgttgtttgtatttgttttataattttggtagtaaaacacacaaaaattcttacgagtgtaacttgtgtaaaaagttgcaatcccgggagttgcatatgagaaagagaagagaaaaacaagaacggtagaaaaaaacacaatacttttactcatgattcgtatttatttgtaagagtgtttatctttgaaatgtgacatatctatttatatatctgctatatattatatgactaactctaaatatgcatgtattgtaattgtttgccattgaaatatctttgactgttcccattttttaacatgtgtatagttgtaaatttgttatatttaatttcttcttatctgtgttgactaaaggtttagaaagattgttatcctcatttgatagcaaatttacagccaaagactccagaaaacgtttactaactacgctgatcaaatttgccacgtaaatttatatgaacaatctcataaaaacaattcatcaaaaggaaaaaaactctccttttataggtcctaaatgtagtgaaatcaatatttatggactagtacatatggaacagttatgaggcgagcgttaatgggccgaacgagacgataagagacattattctaaaccaagctcaaccacgaagataaccggatcataaccgcaaaatgaaccggaataaaacgtgagaaacaacgagataatattaaaaatgatgcaaagaatttctgaatgtaaaggtaggtatggtgacataaggaatggagttaccgaggaagctgcccttgtcggattgtccttatcacttcccactcggcattaccagataggaagctcagaggacagagataataattggaacccaaaactgaaccctattttatataatctcatcaccaatactttatccttaaatgaagtctggtttcgccctttgttttctcctctagttttcttgtaacgccaaactacattctgtatgatcaaaatttagtaacataatttatcagaaccccattgttttaaaacgtgtctgtgtatttgtgtttatatacgcttaatcttcttctttctagttaaatttaatcaatttaatgaaaaatttggtatataaaaaaaaagactttgctcacgagttcctctcataagggccaaaactagttaaaaagttatcgtcaaaaactgatataaaaaagatgtccgaatattcccgcatataaatatctatcagacaaactcttttgtacaatatactttgaatccgataaattttcgatcttcaaaatccataaaaatctctcctttatttagccctaaaacagagtattagagtttgattcgtaaaagagaatatttttaatctccgccgcaagtcg

SEQ ID NO: 7073 - DNA, 3000 bp, Unknown
  misc_feature (1)..( 3000): cDNA_ID_1031563_gDNA_ID_1621125_Annot_ID_172263 3000 nt of promoter + ATG
cacgaaggcgagaagcagagcaaactctgtttatcgagatttggtgggcaccactttattaagtcaaaccagaagaaaacactcttccttttccttatttccattatttttattttataggttacacaaaaacctattttcacttgtttacacgaaactctcaaaagcctgttactaatagaacttagaagtctaagctagaaatatactatattggcattattttgggcagtggatcagcttttcattgtgctgatataggagagagatatatatctatatatataagggacgaaacaagatttgggaattatgagaaggttcgattgccttttctatgactcgaagcgaatcttgtgttatgcacttttgattaagtttattctacggtgaatgaatttaccggaaaaaaggtgtaggaaaaagtatatactcaaaagttatacttgatgcaatcacacattacattgatttctttaattattgtgttgttgataaaattttggtacgaagacgttgacataagccatttaaatcaaattatcattattcattttccgtcaacttatgtcaacatgaatcgatttaattatttcaatttaagaaaagccttatacacttttcggtatatcacatacggataatacctacatagtattgtactacatacggtatatctagccgttatttgttgtatcattattttcacgtattacaaattcattagaatatgcatattaattgataatcttggcttggcagaattggaattcgtctttatatatataaaaaacgtacggtaattcatatatgatctcataatttagacaaatctatagggacgtgacttaattttgaatttctcaatccatatattattaccctaaatctatttattccgtttttaatattttctttggagtttacaaagatacatataaatattagacattaaaagtttggtgctcgatgctttggctatagttagaaagtccactcacttttgtgtctttgacgtacatctccataacctataattttctacctagtcatttaaatatttcaaggtactttcataacttgaaggcggaaaacatgtaaaaaaggttaccttccagaagaaataatatatactatttattgaagaaataacatattcgctgtctatagattttagttttacatgttattttctttcgaaatcacctgctccctttgaccaattaaaccgagtgactaatataacaactatatgaaatgttgcagttacaaattagtttcgttaaaacaaattttgattagttttgtagaacatcaaaaaaatgattgtttggaaatatagataagactttttctaaataaatttggtactgggagtggcgtttttctaactaggcaggtttgcaaaatgcaacatgtttgactttagttattttgcaagcttttcttctttctcaaattaaatagagaaataaattagaattcgatgaatacaatcatcccgtaacgatgcaatttatctgtaaagacaaaatgttatattgatttaaaagatgttggcaagatagacccatgagccaaaagcataattgataaaaagtttgatcataaaactggtagagttcttatacaagattagacaaaaacacagattagttggttttgaattatacgttgatactcaatgtgaaaataatgaaaaacatcttagggttgggatcaatgggacaatgaacttttaagttagatctcccacgatcttgtaacaactaatttgtcagtacatgtttttttctttttttcttaactaataattccaacctaaaatttgaatctaagagattagtcaattgtttgaaatattctccattcgacaccttttctcacgaatcattattaaaacgtaacaatacaacacatttaggagatatataaaatgaaaaactggaccttataaagaggaaaaagaatcccccatgtgcatgtgctatacagataacatttattgctttgccaataaatttcagacccttgcttaactgtccatctaaataaaatctataaaatatcattagaatggcctcctcctaagcaaaaccatcccaaaaacttaatagccttcaaatgaagactgaaattgttagaactattagatacttaagaactacgaattgttaagaactactttgttaagaactacgaattgttagaactattagatacttaagacacatattcacctaggctatgttatgccttaagagatttccactaaaaatcacttaaatagtcctaacgactcatttaacaggttttatgcacaatttaaacaacatcgattttattgacaactgtgtatactcgtgctgcagtggtacgtagtcatctcaaaactgaagaaaatctataaatataaacattctctagtatctctgtagatcaactcattttggtgcgtttagactgacacaatagtcttaaacttctgtatgccgctcgaacaatatttatgttgtcatcatcaattcgacggtattaagaaactaaactaaacatattcaagcccgcgtatccagattggtgggcttgagagtgtagttttaaagcattttaacactcaacaaaattcgatggctttcaatttaacttcggcccatcgttagggagccccgttcactgaaagacaaacatgttatcacaatctctaattggtaggatcgaaacttcgaaagatttagcgatttttacaaacgccgcgttacgcgtttattacacaaacgcgaaaaaagcgtcaggaaagattggccccttgcgcactcttgcttttttctggaaacgtctctgaacgaccaactatagatcgtggaaaattcagattccattgcgacgaaaagaaggcggcggattcaaagaacacccaaatacaaatcgaagacggagccttttcagcaatttcgttttattcaacctctggaacaccaatcatctcaaactgattga

SEQ ID NO: 7074 - DNA, 3000 bp, Unknown
  misc_feature (1)..( 3000): cDNA_ID_2172918_gDNA_ID_1621125_Annot_ID_172261 3000 nt of promoter + ATG
ttggcaccctatcaaaacatctgcttcctctaaagtaactatgaatagctccattaaggaacttaattagagcatatatataatgacagtccaaaataaagtctccctcttgtagtattaaatgtcttagctatatgaacttaacgaaagaaacttcccatgtgaaaacacccactcctccaacgtcactaattaattagcaactagcacaattattaatcacaattcatttttctctctccatgttatgcactaatgaatcttgttttagcatgtttcacattgattgttcgggttgttaccattttaaataatgatatgtttcaattcacaatttcatatagatgacttatgtacgcaactatgcattttcatattttattcttaaaaaagtatcggttcgtagtaaagtctgaattaagttttttacttttgtccttggaagagtacggaagaagacactaatctacccttgatttaaggagacaaacatatcattaaaaggagattatgtttattgattttagattataccctaaacattatccaattaaaataaaaacagttactttaattgacttttaggctgtatcggtcgtagactcgtagatagcagtagataccatgaaactgaagctaatccactcaccattccgtcggttcttctacctttttaacttcaaattatttcacatggcctacacatagactatagtatacatttatctaagaccatgcgttatatgattatgataagaatggagctcgtaaatagtatatcagataaagttgaatgaaaaaaatagttgatcggtaaaataatattatacttgattaattgaaacatatattgaggataagctagagttaccatttcctataactattctacttagattagtactcttcgtatgaatcatatgttacattttatatacactttgataaaactatttgttttacatataattctgttttgcatcaatggactctcactattgcatcttgtgaactcgtctgttttattccccatgatgagtgatgaaaccatcagccacgccaccaatgatctcaaacattatttttatattatagttacatctgtcaacactcaacagtaacatcaatgtattgttctgcaatgtcatctcacatatcttttgcaaattcaaaaagtacgagatatctctctgtagatcaagaccatttggtgttctttgattcaagacactagaaacaatttgattgtactataaatcctcaatttttggaagtttatcaactgttaggacaatcgacctgtcagtaaatctgaatttcttatatgatagtaaatgattttaaaacatatcacagccgtcaatcagagagactgtgagagtcaccgttgaaaatcactctttggtgagtgaaaaaatgtaaaagtaaaagaaccaatgggtaagggtccctccacgtgtgcacatgcgcttcggtggacgcgtgcatgcaagagtgttgccacattaacgacgtcgtagaatgtgattaagggcacaaaacattttaatcaaagaaaatttgactgatggtgacgacaatgagatggtgggcgtgtagagttcggagaatgattgttgagattcccgtaaattacggaggtccattggaaaacaaatccccgcaccagaagatccatgttcgatgtattttgttggagaaaaaaagctaattttaatatcaaaaatatttctctttcgatagttgtatatatttatcgaacatcaacttttatattcatgtacatctatcaatatcattttttcgttttctgaattaaattgaccaatataaatgaattattattgtttctttttcctttttatcaacaattattattgtttctttttttctttttcaaaaccaggctttcccaaagtttgcggatcgccacgttttaaccactaacaccatattgatgttatttgttgtatgtgtataaaaaaagttatggcacagttaatgtgttgaccatgcttttcatatttgatacctagttgtgaatgtatcactgtgaagcatcaaaaagaagatgaaataatgcaccgtataaccaaggtgtgcactgtgcaatgcaatgcatcataaatttctcaaattctgttttttgtatgtaaattattgacgtataatggtaaatatgattaatagattcactcattgttcgacaataatcaaactgaatattgctcgataataactgaacatattacattaacaaattacgcactcacaatcgtcagaaccagccattattctcagctatacattctatatcatttgttatctttttataaccttaggtgatttaggtgatccaggtcacggtaagtatatatagattataaacttttatggaagactgatgactcaatctacaacattggagaaccacaactttttaatctatactttacgttctttaacatttaaatttcaaaactgagatggacttttttagttattatatatgttctaactaagtaatgacaccaattcaaagataatctagattatttagcgtgcttatataggcctttatttgcttggcgacagcgctgactgataaggttgtcagatagagaattacatgttaaatcaaatatgtgaacatacattacatacatatatatacgagtgatgagatcattatatatcacggattcacggagtgtgaaaaaaaaaaccaaatgaagctacgcagttgacagaaaacaaacgaaagatacacaaaaaatgttttttttttcataaaatcctcataattgcaaaacttaaaacatcaaaacgtatatatatcatcacaaattttcggcggaaacaaataataatggacaaaagtttcctaaattatagggtaatacaaaagggtacgtgggccattcgtagcatgtgcatgcatgtgcttctcctatctcctattgcccccaccattttccctctccttttgaaacaattaaa

SEQ ID NO: 7075 - DNA, 3000 bp, Unknown
  misc_feature (1)..( 3000): cDNA_ID_1411786_gDNA_ID_1621125_Annot_ID_172274 3000 nt of promoter + ATG
agatatcaaaactcctagagagatctaataaaaatgaagtcttttacgttcttgattctctttctctttgcagcacaatctatcagcgtctatgcaggcagcttccacaaagacgttaagatacattggggtgatggtcgtggaaagattcacgataatcaagggaaacttctatctctctcgcttgacaaatcctctggttcaggtttccaatctaatcaagagtttctctatggtaaagccgaagttcaaatgaaacttgtccctggtaactctgctggaaccgtcacaacattctatgtaagtaacatgtaacgttcttgtcatgttttgctatttcataaaatgttcgtaccacttgcttatatgatgttctaatttgtgtagcttaaatctccgggaactacatgggatgagattgatttcgagtttttggggaacataagtggtcatccatatactctccatactaatgtttacacaaaaggctcaggagacaaagaacaacaatttcatctatggtttgacccaaccgctaactttcacacttattgcatcacatggaatccacaaagaattatgtaagtgtcgaaactccttcctttgtaccatacataatatttatgtttgaggatataaactcatgaaccaagaatcttttattctctccagttttaccgttgatgggattccaattagagagtttatgaatgccgagtcacgtggagtcccattcccaacaaagcaaccaatgaggctatatgcgagtctatgggaagcagagcattgggctacaaggggaggattagagaaaacagattggtcaaaagctcctttcaccgcttattacagaaactacaatgtcgagggatgtgtatgggttaatggaaagtcagtttgtcccgcaaattcccaatggttcactcaaaaactcgattcgaatggccagacaagaatgaaaggggtacagagtaaatacatggtttacaactattgctccgataaaaaaaggtttcctcgaggtgttcctccagagtgcagctaaatgattgattctttgattcataaataagttacttgacgttgtctttgtaactcaatggttcttcttatctataatttttcaattcatttgttaccaaatatatgcgtgtttgtgtaagatcttttttacaatgaacaatgagttcttccattctaaaaaccttttaaaacatgtcgttactatatacgtacaacgatacttggggataaattgaataatatataaccttacttgatggataatgaatggcccaaatttcgacctttttctgaataaaatagaattttttccaggttttgtttcaagcttagtttcaagcgcagtaggatataggtatttatactttaataaaagaattcagcgtgaatggaggcgagaagcggtgcgatattttagctgtgttgaacgtccatatcccaccatatcttcatttagcataatgcatgtgagtatgtgacacatatatttatattattgtgcatttgtgcttccatagaggttggcatcttattttgtatgttaatgtgcggatatttagttgattaatcaaaaacactttgaaaaacataatataattaaattttattgatcaattcaacagtctttgtaagaaaaattatttctgtaattggaagtgtttttaaggtttagttaaatatgacgactattatgctcttttgtatcgtttttttttggattgaacgctaaactatacgagtgcatgggtgggtctgtttggtcgtaactcgtaaaataaataaacatcagaaccctctatgcggcggggagggtttgcgcttaagtcaaaagtcagaagccgtgttgacaaataacctcaacgcaggactagcatgtgatatacattattaatatctctgttttgtaacagtaaacgagtaaagaaaactaaatattgaaggacatatataaatgataagcttactactttactagttactggttggatgacgcacgtactggtccaagattcaacatcacaattttttttacagtccaaatttccaaaatatactttatttttgttcaaattaaaggaacatttttcttgatctagatatgtttgttatgtttaaggttcgtttcaagctaatattaagaatggcttgtttcaatgtgaaaaaggttatgctcatttgtaaatggatattgttaaatcagtttaagaaagtttcctacgcactaaacgtgtcaaactaaatctcaaggctataacttattttatgtattttgatcgggtactagctttaatcatgctgttacaagattcagttacattctattacaccgtccaaacttatgttgttatcttcacccaaataaaatgaaatgttttctgctgggagatcgattaaaaccaaaagaaattatatttgacaagactatcagccaaattaaaatcaagattcaactatggaaaacttgtagctatttttcaatacctaagttttaggaaactttgccattatattggtgtttatctaaggattagaacatttattttagttaaattaaatcaataaatcgtaaagttgttaattaggaaaaaaagtattaaaatgcaaatatatttgtcattcgaacctctatgcggtggggagggtttacgctcatgtttgaaagtcaaagcagtgttgataataatctcaacgcgggaccagcatgtgatatacgaatgtctatatacattattttctctgttttgtaacaataaacgagtaatgaaattatattttattggtttcaatttgtaacaaccagcaagaggtctaatgagccaactagaatacagcccacgataaataatcaaacccatgaaacttccttctctctttcctttgccatttccaaacactatataaactcatgtcgcttaactcaatttttcatcaacaatacatttgagatatcaatacacctccaaaatatatacaaaa

SEQ ID NO: 7076 - DNA, 3000 bp, Unknown
  misc_feature (1)..( 3000): cDNA_ID_2993900_gDNA_ID_1621125_Annot_ID_172255 3000 nt of promoter + ATG
tatctttcttttctcatcagaaccaatttggtacacaagaatctactgcaagtgcatattcctcaaaggattttgttttcatgttaatttattggcgtatctcggtctaaatgtaaccagcaaactatctgccttgttcaatatgtacttccactaaactattttgcattccattggaaagtgacctccatgaaatgccgctcatgaatactcttaatcaatcatccaccaaatgttgcaggatctttttcgcacagaaccagaaaatgttgcatatctcattctcatctcttagtccgcactccacaccctacgccactcactttggagtctgctcttaaaatgatgttatgacatagtaagatatgaccaacataaaccctttcacactcacgacatcttcttatattgcttatttcttaggatcatgaatgaattgtttcgacaatactgagaacgatacacgtcttcaatattctgcataaaggccaacatggaagtagctatattttatcgtggaactagccataatgcttgaaataaacaatgttatactcataatatcaattaaatgtttgtgatatactactatataattaaccactagtaacttcatcatcatcctttttattatttttgggtcaactatatcattatccttattcaaccaattttattcttatataagaggaaaatcgaattaggtaaacggaaaatgcgattactttctgaactcaaaagaaggaatcgaaacaatttttgttataatattaacaattttcgtgtggtctttatcaaattacgatcctgatttatgaacacgtggcgctaagttagttcagtttcattcattgagcttttaattgaacaatgagcgttaccaattttgtgttttttttctcgcaaaatgattttttcttgttcagaaggacacgaagtgttcatcatcttcttacatggcaaaagtacgaaaacatctgagattgtggcacgtgtgttaccctgacgactctcttctcgtccctttttcacttttccagtttcaagttaacacgcggattgggcccggaggtttcttgattcgtcaatcgttagccacacacaagttttattctttaaccttttattttctttagttagtttcattgtaaacaatttttttttaaaaacaaaaaaaaacagaggttgacctagaaaagaaataaatgcagcggtattgaattgttttcttctcaacagtcatcatcatcatcaataaaagaaacatcaaatcaaatagttgaatcactgtatgaaattaagagccagaatttcacagctcaattgcaactttgcaaccgaatggctaaaaacccttacaaaaaaaaagacgaatgattgcaaacttgcggaattaaatgcaaatgcacttataacaagccgcagtacttaatcatcagtattagagtgacgctaaaaaatttgtatttgaaagaattatgttcattctcattaaaataagagtaggatacatgttatctctagacctaacatgtaacctaattttataactaatgaattcacattaaagcacgtacaagtcaatacaacatctccataacattcaagacatctttaatttggatctttttagggttgataatcacaacttttcgatcaaaaagatatatagatcgttcgttaattacaaaaaagtatgtaaagagtataatggaaacattttaagagtaaatttcacaattaaaaaaaactatagattatacaaaatgaagtgtctagagacgtggtaggttgtgtggcttgtgatgaaacttccccacgtaaattctcatcccaccacaatctctacctactaactgctaactactttacgtccagcgccctttcgctgttttgcttttattagttcttctcttatattttctcctagtttttctacttttttttatttatttattttagttttacaaatcttgaaattctatattatagttaaattttagaaagccacctttgtgtgagttttgcttatgcaattgccgaccgaagtttgttccattctggcgttctcaaacctaacaactgtaactacatctttcattcataatcagattgttttaataatatactcatatctaacaatatcaggagagttccagcagttttattcatataactggtgtagtttgaacgataaatagaacttattatagaattaccatcacccaaattttagtattgaactattcgatgagaattttgacatattcatggagctaaagaaatatgacgacgcatcacattttgatatgtacagtctctacattttttcaaatacatttttttctttttcaaatctagtatcaagtacaaacgaatgtctaaattcgcttggatttattaaaaaagtatctttaagtttggtgtacagtttgggttaaagtactgtgtaatataggtggattgttttgaaaaactttgaaccgatgccgatatctaattgattttcttgtttttttttggtaatttgaaaaccattttaatttatttggttacatatatttgtagtattcagtaagtaagaaacaacataagaagattggaatttgatattagctggtgctactaattttggagtgtttctgaaagaagacacacgttccaaaattgtcaacacgtaaacaaaaaccaataagggattgacttgtggatattggataaccaagcaattaattaagatggtttagagacgtaaaatgattaattaagaaatagtactaatactttattggaaaataagagatgaggtataataaaagatgagtagctgggaacgtgcaacagaaaaatagttcacccaactttctcctattaatacttgcctcttctctcttcctacttctaaccttctttttctccttcatcacacacatatacacacgctttcgtttaaactctctctgtttcaatcattaatcagaaagaagcaacacaaatatg

SEQ ID NO: 7077 - DNA, 3000 bp, Unknown
  misc_feature (1)..( 3000): cDNA_ID_1816629_gDNA_ID_1621126_Annot_ID_56352 3000 nt of promoter + ATG
ggtggtgtggcataaatggaatttggtcgctgttggttagttggtgactcactctcgatcgtgcactgtattagtattttaaaatataaacaaactgataaagtagtatcatataatagtgttttacttactatccgtagaaattggaacgcattatcgcataaaaagtgattcgtaattggttaaaagggacatttaactttaccataggtaactatattagaatcctctgtccaccatagaagagattattctattttgatcctcatcaataattgaagtaaattagttatgtacacattagtttctcttataatccgcgtgattacttatggatgacaatgataatttcacataaataatcaagtgaatatgattacgtagcaattaacaaaggtgttagattttttacttcatagaacaaaatacgatagtttacaagtaatgtaagtacttgtagtcatagagaataatgcttgtgtccaaatttagaaatggttacttgttgatgcagaagatagttcaaacgtggacatcaaggatataatgtcacatcgcccgaattaatttaaaccgcgaaaattattcacatattgatggtcccaagtgattaattaatacaacaactgaatttgcatgcatacaataatgaatacaaattttttttaaaaaaaagtttagaagaaaaacaaaaattagattctcatatgtaagaaaatagattaatcaaaattttgtgtaagttcaactaaatggttaatatggtacgtagatatgattatatgaagccataagaaacttcattttcttgaatagaccatatatcttaattaaatggtattatacatcatcatatcacgaaattgatagataatcttatccgaaattataatgacaaatcgagaaaagcttgtccccacacatgtggcttaaataaaagtccataatccgacagaacttatacaataacttgtttcgtttgtttgtatttggttgaattgaaacgatagatcatttgatattcaaaaggccaaagctgccgcaaatgcttaacaacaatgctaaatgtcttttggctttttttttcattcggtgtcgttttggtatttggtctatacatcttttctgatgaaagatcacaaagattcacgacaatttataacgaataatttttctctgtttccgttttagaatttgacccttagttaatttacttcttagatcttagttctcaagagtcggtcaataggatctaggaaatcatttgactttttttctgtcaacgataatcgacttttttttatatgcgtgagaaccaagcattacatgagccttaatcaattttatatgagtcagaatttacctatgcaacttctctgtgcagttggacattttcccacactatttggtctatagagtgtcaaaaaaggcttgtatatcgtcgccaaaactttatttttataagaaaaatagatttcatacaaaaatcttcatcatttgtttacataactttcaaagctgaataacagtggatctatttcggaaaatgaactcaaatttgggattgtttaggttagtgaagatctactttggctcgatttgagaaagtttaaattcattttgacttctctttttgttccttatatattattgatcgttattagatatcaaatgtcactatgcatgttagctaaacattctttgtgggtcgtgtcgtggctgatcagatgcttatcgtggactttgaaatcataatagacaagacaaatgaacggttgaaccggctttacatacctggtttctagctaaaccaaacacaagctcggtttatcatttttgaacattaagaatcacgtaacagagcgtgtgtgccttctaaagaaaggctttgtctagttttcttcctaagacatgacagaaagtttggaaaggcaacatgtttgtgcaaaatatcaaaggaaaaagtttctgagcttcctatcaaagctttatgcaaaggcctagaggattaaaattcatgcctgccaaagatcagaacagtcatgaggagagtctcaaatgggccttagtaagtagctgatagattacatcagcaaggcttcaaaagaagatacgaaaacatcaacaaccatttgttttcctcatgttcaaaatggctttatctacataaaccattaatacaggaagaagtccatcggttcgtctcttcgattatatgaaaaaacacaaatacatttcatcagtttaaagagaaacaaaacaattatatttgatgaagtggtcaatgaatgggtaaatataaatcttattatatctttatgcttaagttttctatatttagacaaaacaaaaaaaaaattcaataaaaactgtaaaaagaaaaaaaaatctctatatttttaataagtaccattttaacactgttatccaaaataataaacttataaaggtttgttattttacagagaggaaaaaattcatagagaaaatcggcattagtttaatatttcctcaaaagggcaaaataataactgaaaaagagagaaaaaatcagaagaggacgaaaagagaggatccaattaaaaatcggattagatttttactaaatcaagacattgtctggtcaaaatcaccaaaaagaaaaaaaagttagccataacaaaaaacttggatccttcaccaactcatcatcattttacattgtgttgtaagatcttcctcctatcttttttcctatggacgatagattcgaatctaactttctcaccttcatcacaagatcctcgtcctctttctcgtagcctcctccttctaccttctacgccacctttaaacccaaaccaaatctttaatcataactcaaaacattttgctctcaacaacaacgacaacaacaacccacacaggttctgttttttcccctgcatttgtgcctcgtgtcaaaatcgtttggtgttagttttggttatttatcgaagtttgtgtaggaattagagaatg

SEQ ID NO: 7078 - DNA, 3000 bp, Unknown
  misc_feature (1)..( 3000): cDNA_ID_1816622_gDNA_ID_1621126_Annot_ID_56356 3000 nt of promoter + ATG
caatttcaattatagggtttcggagataattagatattgcttcttccttttttcgttgtatttgtttaaatcctctctgctttggtctgtgcttgaaacttgcaaactaaatacgttggatctgttttgttgtaggcaactcttgaagatattggtatggacatgacagaattaaatacccttacctacgatgatctcgatagtgtttcaaagctacaaaaaagtcggagatatgctgatataatgcagcaagtggaagaggctcttgaaggatctgtattagagtacaagaagctaatcgtggactgcaagcagctcttagttgatattgagaatgaaatagtcatcgtccaaaactttatccgtgacaagtatagagttaagtttcaagagcttgagttgcttgttcctcacccaatcgattatgctcgtgttgtgaaaagaattggcaatgagatggatttaaaacttgttgatcttgaaggccttcttccatctgctatgatcatggttcttttagttactgctttaaccacaaaagggaaccaactgccagaggatgttctgctaaagacgatagacgcttgtgatcgggctctggatcttgattccgcaaggaagaaggtccttgaatttgttgattgttgcattgtgtgtgtcacattctaaacctaatgtgcttcttggtctactcatagccatctcatgcttcggaaacaccctcctcctctgcatctggatacaagtctctggaaaacgtaaagcatatcaatgtagctgccaataggtactatatatttctttccaaacaaaaatgatggaactctgtttatctttctctttacttacatattggttctgtgatatcaaaagcaattaagaccacagaaaaccgttgaggcttaacctcaaacatcgaacaaaaagaccgagactcgaactccaacaatctaatggtttcccaatttgtcaaaagtgtactataattatatcttctaaacacccaacaaagtattagccatcaacttataatactctaaacttgatttctctaaatcttttcataccgagacatctaaagtagcactatcaagattactacccgtgacctcagcctcaattacaaaccgggaggtcacaagagtttcttataaacacggttttgaagaagctaaaatggtaaaggtaatggtgtataaatagaatactaagtgcggctaaaggtttgcaaatgagtagtcttatggtggttgtaataaaacagaggactggttctcgaaagagcggcaactaaatggataggtggctgtttgaattttgtggttggctgtatcgctttctgttgcgattggtcatcttcctctgcttttattcattgttctgttactgttaggctgaacttttgtaactttgcaagtacgtaaactaattgtaccactctgataagtatacttcttgataataacattacattcattttatttcaaatttacataccgacataaaccaaacattcctcaacgataaacaagatgaaaaatagaggtttaaaaagaatcgacaaataagtttaatgcgtatacgttaaacctccctgtaattgtgtacaaattacttaagtgaaaactgaaaagtgaaaaccttttaaaaagttaaaacgtgtctgtatatttgaattgattttgtgggttaacgttgtcgattgactactagatgtgtatgatattctctatatttgaattgattttgtaacaaaccatgcggtcataagagtttcttctaaacatggttttggagatcctaaaaattttcggtaacagaaaacagagtgcggctaaattaagcttcggatttacaattgctaacgttgcttttttgctgtgatcaatctttttcttcttcttttgtttattgttctttatagtttggctaaactttgtaactcgagctgtgaagtactttaacagtatatttaataataatacaataacattacattttttaggtcaacaaaattatgttcaaacctttaaaaagatgaaaaagtgtttctatagttaaactaatcttgtggattgaggactagaagtatactatgaaagtcacttttggcaccaaatttctttgctgtcataaatatcagagagtttgacaaaaaaaatttgttcatgcaattacacataagtaaagtgggagccatttttacaattttgtttactaaaacgtgtatgataatagaaaatctgtcaaaatctgtcaatgtcatacttggtatccaataatctctatgctaattggccaacaattttagtaagtttttaacatatttgtggttgtcaaaatttttatttttgcttttagatgtaagcatgaaactaaattcaagtaaactaaaaatgtatacgttttacaactcaaaaagttaaactaaagtcacaagtcacaacgttggtaacaactctgctttccacacaatatatatcacatctatgtttttgtctcagacacataataataccattagagaagaaagaaaatggagatatataatttcgaaaaaattaatgtttcgaaacacttcctgaaaatattcaattgaacattatgtcacggttgcctctgatgaaatcctttaaaaaaatggttaacttgttatctatattttgacgtaagattcaattgtattcgaagaaaataaaaatattaaaaacgagtacgacgacgaaagacaatctgtcactttcatgcatggtatccaataatctctgtggtaattggccaataattttagtaagtttttaacgtgtggaactaattaaaatttcttcttttggtttttagatgtaaagcgtgaagtataattcaaggatatacgcgttttatgactcaacacgttagaaacaaactctgaagattctctataaatatcatcaattgtgtgtgtttgctagtcctcatctatctcaaacacataatataatatcatcagagaaaaacaaa

SEQ ID NO: 7079 - DNA, 3000 bp, Unknown
  misc_feature (1)..( 3000): cDNA_ID_1816616_gDNA_ID_1621126_Annot_ID_56358 3000 nt of promoter + ATG
ctactgatttgccactctcacgagctttgtcaatttcttgccgcaatcggacagagatcgagataatgctaaaaagacgaaactctattctaatcttaatcatttgttaaataatgcgatttttggggttcactattaacgaatcttactcagttcttccacttattacatcaacacgtaccattatctttttttggggctaaaaacgcgtctcgttgcaaccatttagtccatgacacgtagtatgatgtcagacaaaaattgtttggctttttaaaatcgaactggtcagaccgaaccgtgcttccggttgtcgatcgagaactggaggactagtgtatagtggatgaaataaatgtaaaaaatgcattttaatttcgaggatacaacttaaaattcaggcccgacaaaaatagttactccaataatgcaagctatgctttatcatggagctagttatgtaaaactagtactatgaaactaaccatttaacaaacttacggttaaagttgtagatagagttatgggcaccggttttactaaacaatacatatgctttgaacttttaaagttgagcctaaatctatagtccaacactatgaatacattttcgagtctctccctgtgattgatgacgtacccagttatagaagtttaattggtacgtacaccattagttgcatatgtataatatatccatatagtacgattcaaaaaaatgacatttacaaatgaaaaaaactaaattatcataagacgtcatatctattgaagaatatgtgtgctttcatcctttttttttggtagggttatgtttgctttcatcttgatttgaaggaaatgtgtgatagtatatgctacagtaaggattaagttataacgaagaaagagattcatatctaaaatttaggtgtatactattttggaaacctagttcaattcaacaaaaggttgggtgaaactaactttctagttaccaaaattgaatgttttaaaataaaaatcaaagattcgtcatcagacaaccaacaaacttctacacaaattactataaatgggttttactgcagtactttagtagttgttggtcatcagttactaacttactatacatagattcactctaggcttagagtagttgttggccatcaattgttgtagcctttttttggtcaaaggtaaattgagaatagacagtaaatatagcttttgactatgtatagatccacaactgcactcaatttaaaacattaatgcattttgcatgcattcatatcatccgttcatgagattttatacattagtataagttttacacgacagatgttaaaatgttgaattaaatctgttgtcgccattgattttcatgctcacttaatagaaatgtctaaaagcgtgacaaaatgttatattgctacttaagatttttttttttttgccaaatttgctacttaatatatgatagttcaaaaccatgtttagctatggttatagcattgaaattatttggtattacaactaccaaaccatccaatttaaaatagtccataagtaaaaagccaagcatgacacaagagggctatgtgatggtattggttcgagaccgtgtggaatgcataatattttatagacgtttttcaatactaatatcttaaacttatttaaattaaacataatttattatcttaataatcatttataaaataaaagatacatatagctaacttaatagcctataaaatccaaagtataatacatcatttgtgtttaccaatatcaaagtaggataaatggaccagttttgagtcgttagacaaaatgatatataatataccatcaacaatagtaattaactctgaaatgcagaatcgcagaaaatagttgataaatcatttgtcattttctaatgtgatttcagttccctatatagtatagttgctatttaacaaatggtgttggaaagttgaaacatttaaactaaaagccaaaataaaataaaatttaagtctcttcttgaacatttaccattaaattttgttttcttctatacactaaagaaaaatctcctaaaatagatacagctttcattgctctttttgtttttaaacggttaaaagaagaaacaaactttaaataaccgttaaattagatattgatcagaaacaaaaaaaccggtttcgaaaacgcgttaccaaaccggatattgcttaaaaagtcccacttcaatttgtttttttcctgcttcttcttctaaaaataaaaactctactcttgtcactctctttttgctgtccctattttcactccactctttttcatttttttagtccctactttatttctcattcattatccttttctaattaaaaaaaattaataccaaatctaaacatcatcattcattttaggagatgtattagaccttacattttgaatgatgagttttagttatatgattttgatgattttaggaaagttgatgtgatttattgtaaaatcttttcaaatttcatctaaaaccatataatttggatttctgtatttttaagtgattttttttttcaaatctttcaatattaataaacatcaaattcataaactgtttccaataacagtgaaatttaaggtatattttttagttcaacaacactagatttcattagaatttttaaaatttataatgaataacataagatttataaatttacacaaatcacttaaaataataaattgaatacgctcctcttaaattattcacaaaattatacgttaccaactatacataaattataaataaattaaaaattaaaagtctataaatagatttaaatttaattgtgtagggtttagttatggagaaaacataattgtgtaagtttttttggcttctatatatattaccacaaatatataacacaatccgctctcaaacccaaacaagcccaccaatctcttcttctctgctcttctctctctgtagacactagaagaagaacaaaa

SEQ ID NO: 7080 - DNA, 3000 bp, Unknown
  misc_feature (1)..( 3000): cDNA_ID_3049732_gDNA_ID_1621126_Annot_ID_56359 3000 nt of promoter + ATG
cgccgtcgccggactctctccttccaatttccccaaaacccctccaccaaaagagcatctcactccacctcttctgatcggagacgctgcaaatctagctgaaacagacctcttcgccggcgtggaatggtcaaactccaacgccattggtttcacaacaaacggagacgaagaaaagtcgacgttttgtccccaagatcctcttctaggcttcgacccaatctcttgatcagttctttctttcggaaccaccaatgtctccggcgtcccaagcaaggggtgccggccaggtatgggttttgcccctttaatgacaggaacaggggatccaggttcgagccgatcaacgtagataaactgacccaactgcaacttattgctgagaacgacgtcgtcttgatccgaagggagagagacgtagatcgagtgagaggaatcagagattttgatgagaaacccttgtttcggctccagagacttctcgtcgagatcaatgggaacgatatctgtgacctgtaacatagagcttcggtgctctctagttggtttaattcctgttttcataccttggattagcttttgaagaattccaggtgccaaagctgccatttttgttgagcttttaagatcaagaacgatagtttcagaaaattcaataactgggtaagaattaagaaggagatgttgatcttaaggatttgcagttgctaggagccaacggtaagattaaaaaagcaaactttttgaatcatggctttgttgcaacggtcgaaattgctggtagatctgtgtcgcaattattctaatttatatccgtgatcatttggtttaacacttcacaaaaagcaacgatgagtctttttagtcagttcatggatttataatttatatggccaatttgaagaaccaatttctaatggttaagtctctagtatagtgtatttggtggttgacacttgacagtgcatagttggtggaaccaataaacatcgcatgattccgactacaaaattacaagaaagtcagaactgtttcaatcactttttctttactataaacagtatcttaattggttttggtaagggaactcaaacaatttcagcataatgagtagtttatttgtaggccagaagtgctaaagtaacgagattaccaatttaagatgataaatgtataaacaaaaagaacaaagtaggccttagatgttagaagaaaacaagggtctgattcaatttctaaacataattcaccaatagtgattcaatttcaatcatgaacattaatgaacgagattaaatagctttaagtcagattcactggcagagaggtaatggaaaccatgaagcataatgagtagtttatttccaggcaaagtgttaaaggtaacggaatcatcaattgaatatgacaattgtattaggtaaacagaacaaactagcccttagaagaaagcaagggtttgtgttttttctcgatatctccaacttctaggacaaactgcaaaatacagcgatgaaatgaaacaaatttcttggaatctatcaaaacttgcaggccatgttatagtgttgaagcaaatcctgcaaatatcgaatgcaaacttagattagtcactgtgcaaatagaccaacacaacacaagtctgaacaatctaatccactggttcaatgtttcgtaaatgtgaatcaacacatcattttactaccatcgataagattccactctcattaggtcagatagacagtgataggtcgtcacaatggagcaatagtatgacaaggaacaatttatacaaactcaatgcccttctgctacgttttcgtaataaaacatgcgaagaaaaagatcattagctataaagccgatcacttgatatactatacaaaaccgattacttctattagcatgtcaaggcagatcatttatggaatcctatttaccaattgagactacatttactcctagtctggaaacagaaattcagaatcaacttcaattctaaacataaatcatgaacacaagtaaaaaatttaccttctgataagcaactccagttttgattgctcagagatagcaatgaagtgagcaaagctgaagcagtaacactatgtaatggtattagtgaaatccctgcactcaattccacaggtaccctaaacacaaaacccaaatttacatttcagagataaaccctaattcttcagcataaagctcatacattgtagacgcaaaatcaaactatttctcgattgaaaacagatctatcgcctgtagaatctcggttctaggattcgatagctaacctggagaatgtgagtctacgaagtgagggacgagttgaagaagatgatccattcccgaaagcaattccggctgattttccgatcttcgaagcagaagttgccgctgatgaacgaccaaagagtatcttcccggaggatgacgatgcctgaagagctcttctcacgccgttggccgccatgtttactcttttctcaaactctcaaaaaaaacttcggcgacatttctgtcatttacgaaggtgaggttttaaacccgggtcgggtcggatctttacgataaggacccagtacaaagcttaattcggcccatagatatttaaaaatgagccgataaccggttagcaactggttcaaccgggaattaataactggttatcatctatgccttctcttttatcagttgagaaacctcgagacgaacgaaaccccaactttcgagtttgccgatgagtctagcctccatgatctccggctaaagatcaatgaatcgacgccttcctctgttcgtttgtcgattgattacaacgacggtgatatcctcgcggctgttactctctcgattcgtctgattttagtgcgtttgatcagaaatcggaaacgaatcatcaggagattgttcgtagattccggtggcagcatgaatctctccggtgtaaaaaggttaagcgagcctctcttgttgaaaaatatattgatg

SEQ ID NO: 7081 - DNA, 3000 bp, Unknown
  misc_feature (1)..( 3000): cDNA_ID_1816610_gDNA_ID_1621126_Annot_ID_56360 3000 nt of promoter + ATG
ttgtcgaaataacctgctcatataatttacttcaatatctacatatacatttttgcagctattttgtgaaataaatcatgtagttgagacttatttagtcactagattttaatgtttgtttttgttaattagaaaaaaaaattttcgaattaaatatttgacacttaacaatcttccctaaatctctccacattaactacacgattagttactaaaataaaacttccaaaatatttaatatcatttaattactacaaaattatcatttttgatattgtttttttccatgactataacaattcgattataatcatcaaaccggagagatatttgatagcatttaagtactacaaaattacaaaatatttagacaataattcataaacatatcataaataagatcaacattaataaaataaatgagttttttacgggacggattggcgggacgagtttggcaggacgttacttaataacaattgtaaactataaaataaaaatattttaaagataaatacaatttgcaaacttttatatatactaacttaaaaaaataaattgtttccgcggtgtaccgcaagttaaaatctagtatgttcatgtttttgtaattattaaaggtcaatcgaggctttacttttttttttttttttctcttttgtttctgctttcttttaagaagattgaagataaatgttacctaacctaactcatattttaagcataacatatcattctttttttgggatctacaaacgtataattatataattgtgggttcatctagtgcatgaaaatggaagaatccatcactttcaattaccgacttaactattttggcatgttatgtttgttactttttcccccttaaatttaggacgataaaaggattatattttttgttggtagaatttagtatggaaggataaaattaaatttgtttacatctatcacgtggttttcattactgtaaaaaagtgaatacaatccatcatcgtacataacaaacgagaggccagtagggtgtgaaactcataaccagaaacgatgttttgttatggaatcacaaggatcacaataactcttgttttggttaattggatatgtgtgtttataagttcacggttttgtgtcaacgatgctatgacaatgtaacagaggagtaatggagtttgacctctgtgtgtgatcagaaagacccacccatctctgtatatctctccccattgaagctttacctatatctcaactaacttggtccaaatccattattggatagaggaaattactgttttatgacaacaataaatttgtgaattatctatcagagaacctataaaggcatgaagtgttgtgagatcaaatcaacttcaatagagtttctgtgtttgtccttggcagagttttcacttcattcaatttggatccctctactaaatctgttaagtctgtttctggttggttgatacaatcaaagactaaatgccaatttccatgtgaacttcactctgtttcagtaactcaccatttcactatctactactattctagttttctatatacttagttctacaggacaaaacctcctttgcaaaatccgattcaatctcattcttgagtactagaagaagaagaactatactaagtttccaatgctctttacaccatcttaaacctataattgccaatttgcaagatttgaatacaaacaaacattcactccaccggattcaatatggtctctttttatcttcttccacgatttatgacgaaccaatgctccctgaaaaaccttgaaatgccctgcttatgaaggagaactttcccttttgcctccaataagtagcaaacctctccttccagttaaccacatcatgattgccttctgtcacaagatcttggcactcttccaagcacttctgcttccacaggtcattctacgaagccatgtctcgcagttcagaagaaacacaagccaatgtcccaatatccacaccgggaagcgactctagtatcttgtgttttagctctcgaggtagactgataaagcaaggtggaagttctaacccagttttgtagcaaagatcaaccaacagaggcgtaacaataccatcttttatcattctccaccacacgagtaccttacagtcaatgctcaaagtatcttcttcttcatcagatttcaaagtttccataagtaaatcaacaatgtgcacatagctacgtttatcaatagacaccacacgaacaaaactaccaacactaagagatccataaactacaacatcgcctccttctcaaaattcaaaccgactattcctttcacagaaggtagagtatagttaagcgataccaaagtcttcttcgagaagctaaaacgcatagatgaatcaggatcaaacaacacaaatccagattctaacataacagcatgaacagtcatgatcacaatcgtcaattcacaagtgtcaccagattcctccatcaatatatttttcaacaagagaggctcgcttaacctttttacaccggagagattcatgctgccaccggaatctacgaacaatctcctgatgattcgtttccgatttctgatcaaacgcactaaaatcagacgaatcgagagagtaacagccgcgaggatatcaccgtcgttgtaatcaatcgacaaacgaacagaggaaggcgtcgattcattgatctttagccggagatcatggaggctagactcatcggcaaactcgaaagttggggtttcgttcgtctcgaggtttctcaactgataaaagagaaggcatagatgataaccagttattaattcccggttgaaccagttgctaaccggttatcggctcatttttaaatatctatgggccgaattaagctttgtactgggtccttatcgtaaagatccgacccgacccgggtttaaaacctcaccttcgtaaatgacagaaatgtcgccgaagttttttttgagagtttgagaaaagagtaaac

SEQ ID NO: 7082 - DNA, 3000 bp, Unknown
  misc_feature (1)..( 3000): cDNA_ID_1816606_gDNA_ID_1621126_Annot_ID_56361 3000 nt of promoter + ATG
catgattgccttctgtcacaagatcttggcactcttccaagcacttctgcttccacaggtcattctacgaagccatgtctcgcagttcagaagaaacacaagccaatgtcccaatatccacaccgggaagcgactctagtatcttgtgttttagctctcgaggtagactgataaagcaaggtggaagttctaacccagttttgtagcaaagatcaaccaacagaggcgtaacaataccatcttttatcattctccaccacacgagtaccttacagtcaatgctcaaagtatcttcttcttcatcagatttcaaagtttccataagtaaatcaacaatgtgcacatagctacgtttatcaatagacaccacacgaacaaaactaccaacactaagagatccataaactacaacatcgcctccttctcaaaattcaaaccgactattcctttcacagaaggtagagtatagttaagcgataccaaagtcttcttcgagaagctaaaacgcatagatgaatcaggatcaaacaacacaaatccagattctaacataacagcatgaacagtcatgatcacaatcgtcaattcacaagtgtcaccagattcctccatcaatatatttttcaacaagagaggctcgcttaacctttttacaccggagagattcatgctgccaccggaatctacgaacaatctcctgatgattcgtttccgatttctgatcaaacgcactaaaatcagacgaatcgagagagtaacagccgcgaggatatcaccgtcgttgtaatcaatcgacaaacgaacagaggaaggcgtcgattcattgatctttagccggagatcatggaggctagactcatcggcaaactcgaaagttggggtttcgttcgtctcgaggtttctcaactgataaaagagaaggcatagatgataaccagttattaattcccggttgaaccagttgctaaccggttatcggctcatttttaaatatctatgggccgaattaagctttgtactgggtccttatcgtaaagatccgacccgacccgggtttaaaacctcaccttcgtaaatgacagaaatgtcgccgaagttttttttgagagtttgagaaaagagtaaacatggcggccaacggcgtgagaagagctcttcaggcatcgtcatcctccgggaagatactctttggtcgttcatcagcggcaacttctgcttcgaagatcggaaaatcagccggaattgctttcgggaatggatcatcttcttcaactcgtccctcacttcgtagactcacattctccaggttagctatcgaatcctagaaccgagattctacaggcgatagatctgttttcaatcgagaaatagtttgattttgcgtctacaatgtatgagctttatgctgaagaattagggtttatctctgaaatgtaaatttgggttttgtgtttagggtacctgtggaattgagtgcagggatttcactaataccattacatagtgttactgcttcagctttgctcacttcattgctatctctgagcaatcaaaactggagttgcttatcagaaggtaaattttttacttgtgttcatgatttatgtttagaattgaagttgattctgaatttctgtttccagactaggagtaaatgtagtctcaattggtaaataggattccataaatgatctgccttgacatgctaatagaagtaatcggttttgtatagtatatcaagtgatcggctttatagctaatgatctttttcttcgcatgttttattacgaaaacgtagcagaagggcattgagtttgtataaattgttccttgtcatactattgctccattgtgacgacctatcactgtctatctgacctaatgagagtggaatcttatcgatggtagtaaaatgatgtgttgattcacatttacgaaacattgaaccagtggattagattgttcagacttgtgttgtgttggtctatttgcacagtgactaatctaagtttgcattcgatatttgcaggatttgcttcaacactataacatggcctgcaagttttgatagattccaagaaatttgtttcatttcatcgctgtattttgcagtttgtcctagaagttggagatatcgagaaaaaacacaaacccttgctttcttctaagggctagtttgttctgtttacctaatacaattgtcatattcaattgatgattccgttacctttaacactttgcctggaaataaactactcattatgcttcatggtttccattacctctctgccagtgaatctgacttaaagctatttaatctcgttcattaatgttcatgattgaaattgaatcactattggtgaattatgtttagaaattgaatcagacccttgttttcttctaacatctaaggcctactttgttctttttgtttatacatttatcatcttaaattggtaatctcgttactttagcacttctggcctacaaataaactactcattatgctgaaattgtttgagttcccttaccaaaaccaattaagatactgtttatagtaaagaaaaagtgattgaaacagttctgactttcttgtaattttgtagtcggaatcatgcgatgtttattggttccaccaactatgcactgtcaagtgtcaaccaccaaatacactatactagagacttaaccattagaaattggttcttcaaattggccatataaattataaatccatgaactgactaaaaagactcatcgttgctttttgtgaagtgttaaaccaaatgatcacggatataaattagaataattgcgacacagatctaccagcaatttcgaccgttgcaacaaagccatgattcaaaaagtttgcttttttaatcttaccgttggctcctagcaactgcaaatccttaagatcaacatctccttcttaattcttacccagttattgaattttctgaaactatcgttcttgatcttaaaagctcaacaaaa

SEQ ID NO: 7083 - DNA, 3000 bp, Unknown
  misc_feature (1)..( 3000): cDNA_ID_1816598_gDNA_ID_1621126_Annot_ID_56363 3000 nt of promoter + ATG
gtctccgagtgtctcagtggaaccgattttggagccagaatcatcaagacgcttgtcaagtacccgttggtaagtcccaataagcatgtcagtatagttacaggaatctcagtcctgagaaacatcggaccgtgcaagcaaccccagaagagagggtaaaacaagagcctagcaatggaaccaccaacagcgattttctcatcctccagcatgaatacagcagtcagacacttaccaaccaagtcaaacacattgtacgctgcaataagcagaatagggtaccaatctgtaagaagctctgaatgaacatcctcagtaatgtatccaggaaatatcgacaatgtcaccatgtataagagaacaatcccgaaaccatgagatttaactttcgtcacgatatcccagagtgttgtcctccacgctaaaccggttaaagaacctttctcttcgctcttctctctgattagttcttcattcttacgctcctcatggaacttgatcaccggaagcttatgcgctacgttgtagaacacagcacaaatcaccataacaacaatccccacagcaaagtatagattcgcactttttctcaaaccatcaggatcttgaggatacacagctttagtcaaaattctcaatagtgacacaagaacacctacacatccaaaattcccaaaaacctaaattaatctaaccacagcaaccaaatcattctccattattgaggaagatgaaacatttaccggagccagcagttccggcgacaacagcttgcatatacctctccggcatttcaccggcaacaccgataagacctccttgcataagtgcatcacctagaccggataaggcaacggcggcggaagtaacatcgaatccggcgtataatccgacctgtcctttaacataaaccagatccaaaacaggaaccacaagcaaggcgattacgaagagtaaaagaccgagattgattctaaagctagcgaggctcttatgtgcatagaagacaacgataacgaatagacaaacaagagcaacgagcatgtagataacggcgaagatccgatcgacggccgtggaaggatagaggtaagagaagtaatcgacggcggtgatgaatgcgttccatggaagaagaaagccaacgccgagggtgaagtagatgatgtaagcgaagtggtaggaatcagaaggagcttttttggtagatccttcgtgaggattgaggagaagagaagtctccggtccggcttccgagtcagttacgattccggcggatttatcggtggtggtcatttgaatttgtttagtttctctcagttttggggatttttgggaaattcgttgactaatgggagtcattaaaacggtgcggttttgtatgtgtgtggaattacataaacggtgtcgttttgctggccgagcaaataatttggttggggatgcagtagcgtagacgcattagttggagtattttattttactagtttttgatttttggcaatggccctaaaacgtgtatttgataaataatttatatctgttgtagatgcgaatctcataaaatagtagatattattagttgtagtgtcctactgtgcttttgtccaaaaaaaaaaaaagtgttatagtgtgcatcaccattatcaagttgcattgcattatcataacgagttaatgacgcttgtgtcatccaaaacagatatgtatgttctggtagaaacagatatcataaagtgtttgttttccggcttccgcagtacaacaagagttcgaacaagcctcagtcttattcccatcatgtggatagttaccacatgaaataccccacaaattgcatcttttcgagtaccgagttagtcaacggcttaatctgctttcgaaaagaaacaaaacccgtaatttggaactttagcacgagacagctcttaaccttaaccaaatccatataggattccgtgtataatgttatagtctttctaggatatgatccaatcgagagtaaacacaaagttgtgtgtataccgtctggtgaatcttctgatgaatgtcgggttttaacattgagatcagatcagctgaaaatcatggacaacggttaaaaccaattacaaacatcgtcctttgtagaagagttccaggagagcatcaatggttttctatattatggagccacatatcttgatgatgatttggagattacatactaatgagttttaatggcaatactgaaaagtctgatatgataaggttaccaaacaataatccaaactcacccaaatgatttagtaatgatcgattttgatctctactaaagaagtcggaaaacaaatcgaccaaccaccgaatgagaaaatgatagatgtcgggctaaagccaattgaaatcaatcgaacggctttgctagaaaattccggatggcagagtaaagaagactttttctcttaaaagtatgaagagagaagagtgaaaactgagactatggaataactaatgtatgactatgtttactcttattaatgaagttctatcgagtaaaaaagatggtttttttaattaaaccgaccaattgaacaaaattttattaaaccgacattggaacaaaatttatcggaccgtcttagaaatctctctctctcacaccgtctttctctctccctatcaaatcccttctctctaatatgcgatcttcaaaaccctagtttcttcggatcgcttccaaacttgcgattatctccaagatagtcaaatccttcgctctttctccttttctttcttctctcttcttcttcttcttcttctcgttcgtctgcctcaccgatctccatcaatccaaagtattggaccagatcaccctcgtcgatatttttgattcgattccacaagtgattactagttctctcaatcggtgtaatgatcaattctctatcgtgttgaggatttaaaatcagtgcttaatccttctagttttggagctcctaactggattgtttctaaatc

SEQ ID NO: 7084 - DNA, 3000 bp, Unknown
  misc_feature (1)..( 3000): cDNA_ID_3049718_gDNA_ID_1621126_Annot_ID_172319 3000 nt of promoter + ATG
tacaaatgtagtctggttggtataagccttgttatgtatgtacgattgatgtcgtagtcaatgtagttgataccgtacaattcgatctaagctaatatttttgtcgtccgacttaaaactatataagcatcaatgttttggtgattacgaattagcaaaaacacaattttcaagaaggaaaaaaaaaatatttcacagtaatacattagacactcaatgacagctaactgtaaacaaaaatacaaaacacaaaacagtgtaatacaaaagaatttttatgtataaaatatgtcggttattaaatatccaaaaatgaaaatgtacttggatgttacagctatgagacaactactaagataaagaagaaaaaaaaaagggaagcttcgaaggtgggctttggctttgatacagacgtgcacagatcctttcccatgtaaaaactttgataattctgacgtgtaatttttccattggtaaaacatgttttgactttttacttacgtaagtggaaacgcattttgcaaaaaaatatcatatccctcgaaacacttatccattcacagaaacattctgatcctcgtttttagttaattcgtgtcgaactctcattggttcatatttacgagtccccacacctttagccgacgttggtgtctgtctggataaagaaagaataaataaaacgtttattttctataaaaatgttttgtttactattttcacaattttacgaaaataagagaaaatggaatttttttttttcgtgtggcggaaagtattgtagtattattttttctcttttgggggaatattatcaaagattcaagaatgtatttatttatggaaataaagaaggtgtttgctttttttgtgtgttcttttaaaatctttatataaaagaaaggtatctattgtttggttggtataaatacgcatgcgcattggctttttcgagtagaggaagagactagatagagtcgtgattttttttttcttttttaaattatcaaatggacgtgaaattatttattgaaaaataaacaaaaaaaaaaaaaaaagaagaagaaagagtctatcggatacgtcggatccaatctcccaatccgcattggctgtcgagacaacgtggatgtaaaataaggctttaagttcaagatcatttacctcaaagccactgagcctttaggttaataacgtcctaaattggctaatgtcttcttatgacatactcaaaatctatttttcttggtcgtcaaaattcaatactaatgatgtatatagatgcatggttcattcacaatatagtgtacttggttttttatgcctttccagtttcctataagtatgtatctatatagtatttgattttctaatccttcatataatcttaataaataatattgagttcaaacataagatatttctttatatatggatagagtctctagttgatcgtgtgtaggtgtttcatctttgaccagtggataacgatcagattatttaatttgaaacgttgtttccactttgtagagcttagactctatgtcactatgaaacgacttgtcaacaaagcattttgagccaaataatttaacatataacttggttaaaagacgagtttacgattattactattcttaaagttaaattatgtaatattttcagatttagttttcagtagtcacatgcttaagaacattaacatcagaatacaaccataatgattaatgagagatgtatgcaaaatatatcaactaatcatgttaaaaagggttgtaccattaattagtgatgcttatctgcttcattaagataataattaattttcaggaaaataaaactattgatttgaaattcttttacaaaatatcgatgaaattaaatcggcaataataaccaaaaatatacttttaattataaatgtgaaaaagggggacctcattatatccataaaaaccccagacaaataggtaagatacaagttgctaaatttaattaaaatcccaacaacaacaacaagattatctttaaaatacaatccatcctaaaccaaaaacaaaatttggtccaccatataaaaaaaaacatcatatgctaatatatagtttccatctaccaaactcaaaataaaagataagaagataagaagataaaaggacattaacgtaattttaatcacagcgtcccaagaaactaatccaaaacattatcgcgataaaaccgtacagagcaaaaagctactaataatattattattgaaataaaaatagatagaaaaaatagatcgttagaaaacgtgtatatatatatatatctgtgtattttgcaatatatcgtttttttttcttcgttatcgcattaatctctctctctgtatcttctcttgagtggagcgaatatccaaaagagttccgagtttctttcatccttcacgagcttatactttttcttctccattcgtttgtttttaacgatcaaaaacaacggcgaaggttagtctccggcggtttcttcgttgagatgtgacgacttttttttttgaacgtttataaagattacatattcatgtatttagatttcttttgttatgttaactgtttcattgatgttcgagttaattttaatttgactcaaacacggtaatttttttttaatcttgatctgttttgttacgtaatttttgggttgattttagcctgaaatgatgattttttttctttctagcttatgtttttcgtgaatcaatctttttcaatataaagattagtattttgttgaaattcattttttatttgattggctatgaggaatcagtttcttgaaatggaaatggtgatttgatttgatatgttcacaatatgaatgaagaagattagggttaatttatatatatgaaacaagaaagtttgtttatttaaggtaattgatatatttgttttgttgttattgccatttttaaggtattggaaataagacagaagctgttagctctgtttctcc

SEQ ID NO: 7085 - DNA, 3000 bp, Unknown
  misc_feature (1)..( 3000): cDNA_ID_1808923_gDNA_ID_1621126_Annot_ID_172315 3000 nt of promoter + ATG
tggtggcctgacccgagaatggtatcagttattgtcaagagttatatttgacaaaggagcgttgctcttcactaccgttggaaatgatgccaccttccaaccgaatcccaattctgtttaccaaactgagcatctatcatacttcaaatttgttggtcgcatggtaatatatcaggaccttgtcaatgcaatgatctgattgatcgttttttgctctctctgatgtgtttgtgatgtcactgcaggtggcaaaggcgttgtttgatgggcagcttttggatgtctatttcacccgttctttctataaacacatacttggtgtgaaggtgacttatcatgacattgaggcggtggatcctgattactacaagaatttgaagtggctattagaggtttgaggacctagcctttatttacctttatctattacatagctcaaaaatagaagtcaggtcctgtgctgtttgagccttatatatttgtccccttttctgtttattcagaatgatgtgagcgacatactcgacctcacatttagtatggacgcagatgaggaaaaacacattctttacgagaagactgaggtgtgtggtgattgatgttctttcttttgttgtgctttatcccaaattgcctagtatattgaattgatcattttatctttgatgaaaaggtgacggactatgaacttaaacctggaggacgaaacatacgggtaacagaagaaacaaaacatgaatatgttgaccttgtggccgaccacatacttaccagtgctatacgccctcaaatcaacgctttcctagaaggcttaaatgagttgatacctcgtgagcttgtatcaattttcaatgataaagagcttgagctcctaatcagcgggttgcctgagattgattgtaagttggcattctatttttcaatatttttgcatctatttgcttattcatttaaagttataataacaatcttgttatctgttttcttttgttttttagttgatgatctaaaagcaaataccgagtataccagctacacggtagggtcccctgttattcgttggttctgggaggttgtcaaagctttcagcaaagaagatatggctagatttcttcaatttgtcactggaacatcaaaggtaaaaccaatatttgcagcttctgtccaagtcgcttgagcttcattttctgatatgtactagtttttcttctggttgttttacaagcggtgtttctgttttcaggttcccttggaaggcttcaaggcactgcaaggtatttctggccctcaaagattacaaatccacaaagcatatggatctccggagcggctgccatcagctcatacatggttagacattattacaaagtcttttttttttcagttaaacgtggtcgtaattttcattggttctgttgcagttttaaccaactagacctccctgagtatcaatctaaggaacaagttcaggaacgcctgcttcttgcaattcacgaagccaatgaaggttttgggtttgcttgaacaaagcttaagaagaaggaagagcttttgattaagagcaagaaatagaaaacgcaagtggctatttttgtctgtccatatattatgttagtatattagtccattgttttttttttaggctttctctctatttccttagattttgttaaaaatagttgcaaactctcaaatattagtagttgatatttgctatccatttttataagatgagaaaattacataactgctggtcattattttgaatacttcctttctgtcacgcgtattggcatattcctcaaccaacatacgaaggccagtttgttatcacaagtttgcaagcccattgtcttaatatctcaactgtctccagaagcaagtctcataacatctagaagaggttgttgagcataccaagtgtgttccgaggaggataaacatgggagactccactccaaactccattaccttcaccacctgcctattcagcaaatgaagaatcagagtgtgtgcatggcatctctccgaaaatcccacacagggtcttgatctttgtcctccacgttcatcatcattttcatccattattgcttactcgccttgtccttgacgttccacatttgtctccagccaacaagtattgctggtataagctttgatagtttgtaaaataaacattagctaacataaatactcttttgcctcttatcaaaaaaaaaaaatgatgcttcacaagttaacacaccttcaaattttcttaaaaaacatctatatgcaataacagaattcaaattataatgcaataatgataagaaaacatttctcctccatcaaccaaaacgtgaattaacatctatcgaaaataggtgcttcacaagttgacacacttgacacacaaaatctacaagtgtgagagcgcttgttcataacgagtttaaagaatcgcaaaacacactcatattaataataatcaatcaacttttggaaatattcaatactcttttgttgatacatgtagtcttctaagataaaataaaaacgtatacactaaacagttttttttttttttttttggggtcaataacagaatctaaaaattaaagttaaaatttaaacgataaaagtatttaattgggacgtttatcaaaatgaaacaatgcattggatcggctttaaaaagcaaccaaaaaaaaaagagctgtcatgattgatattcatcatcacaaaataatgaaaattgccttattcacgtaataacaaaaagaaaatgattttataacagtcgaatcgtacggcagatatttgttggcccctcctcttatatgatatcatagtcaacaagagaacaaagccacagagagagagagacactaaaaccctaatctcttactcactgtctctcttcttcaatccatgtcttcaacacaagaagcgtctgttactgatttgcccgtgaagagacctagagaagcagaggaggacaataacggcggcgcc

SEQ ID NO: 7086 - DNA, 3000 bp, Unknown
  misc_feature (1)..( 3000): cDNA_ID_3049724_gDNA_ID_1621126_Annot_ID_172314 3000 nt of promoter + ATG
cgtgttccagctatgatcatgcaggctgtgcttcagctatgtgcccgtctaacgaaatcacatgctttagctatccagtttctggaaaatggaggcttatcttcactttttaatcttccgaaaaaatgttttttccctgggtatgatactgttgcatctgttattgtacggcatcttgttgaagatcctcagactctccaaattgctatggaaacagaaatacgtcagaccttgagtgggaagagacatataggtagagtattacctcggacattcctgacgacaatggcacctgtaatttcaagagatccggttgtttttatgaaagctgtggcttcaacttgtcagttggagtcatcaggaggtacggactttgtgatactgacaaaggaaaaagaaaagccgaaagtttctggcagtgaacacgggttttctttaaatgaaccccttggaatatctgaaaataagcttcatgatgggtcaggaaaatgttcaaaaagccacagaagagtccccactaacttcatccaagttattgatcagcttattgacattgtcttgagttttcctgggttgaagaggcaggaaggtgaagcagccaatttaatttcgatggatgttgatgagccaactactaaagtgaagggtaaatcaaaagttggtgagccggagaaagcagaacttgggtctgaaaaatctgaagaattggccagggtaacttttattttgaagttgttgagtgatattgttctcatgtacctacatggtaccagtgtcatactgagacgggatacagaaatatctcaacttcgagggtccaatctacctgatgattcacctggaaatggagggttaatttaccatgtcattcatcgattgcttcctatatctctcgaaaagtttgttggacctgaagaatggaaggagaaactgtctgaaaaggcgtcctggtttctggttgttttgtgcagtcgttccaatgaagggcgtaaaagaataatcaatgagcttacgagggttctatccgtatttgcttccttgggaaggagttcgagtcaaagtgttctattacctgataaaagagttcttgcttttgctaacctggtttattcgatcttgacaaagaattcatcttcaagcaatttccctggttgtggctgttcacctgacgttgcaaagagcatgatagacgggggaactatccagtgtctgaccagcatccttaacgtgattgatcttgaccaccctgatgccccaaagcttgtcactcttattctcaagtctctcgagacactgacgagggctgcaaatgccgctgagcagctaaaatcagaagtaccaaatgagcaaaaaaatacagattctgatgagagacatgatagtcatggaacttcaacttcaactgaagttgatgagctgaatcaaaataatagcagtctacagcaagtaacagatgcagtagataatggacaggagcagcctcaagtttcctctcagagtgaaggtgaaaggggttctagtctaacccaggctatgcttcaggagatgaggatagagggcgatgagacaatactgcctgaacctattcagatggatttctttcgagaagagattgaaggtgatcaaatcgaaatgagttttcatgttgaagatagggctgacgatgatgtagatgatgacatggacgatgaaggagaggatgatgaaggagatgatgaagatgcagattcagtggaagatggagctggtgttatgtctattgctggaactgatgttgaagaccctgaagatactggccttggagatgaatataatgatgacatggttgatgaagatgaggaagatgaggatgaatataatgatgacatggttgatgaagatgaggatgatgaggatgaatataatgatgacatggtggatgaagatgaggatgatttccacgagactcgtgtaatagaagtgcggtggagggaagctcttgatgggctggatcacttccagattgttgggcgatctggtggtggaaatggttttattgacgatattactgctgagccgtttgaaggtgtgaatgtagacgatctgtttgctctgcggagatccttgggcttcgagcgtagacgtcaaacaggcagatcttcttttgatcgatctggctcagaagtacatggttttcagcatccgctcttctccaggccttcacaaactggcaatacagcgtcagtttcagcaagtgctggcagtatatccaggcattcagaagctggcagctacgacgtagcacaattttacatgtttgattcaccggttctaccatttgatcaagtaccagttgatccttttagtgatcgtttaggaggtggtggggcacctcctcctttgactgattattctgttgtgggtatggattcatcaagaagaggggttggtgatagtcggtggactgatgtaggtcaccctcagcctagtagcctatctgcttcaattgcccagttgatagaagaacattttattaccaacttgcgtgcttctgctccagtagatactgttgttgaaagggagactaataccacagaagtccaagagcagcagcagccggatgttcctccatctgttggaagcgaaactgttttgggtgatggtaacgaaggtggtgaacaaagtgaagaacatgaactgttaaataacaatgaagttatgcaccctcttcctttgaacagtacaccgaatgagattgatagaatggaagttggggaagggggtggagcacctattgagcaagtagaccgtgaagcagtgcatcttatctccagtgctcagggtcaatctgatacttccggtattcaaaatgtgtctgttaccgctatccctcctccagtagatgatcctgattctaattttcaaccaagtgttgatgtagatatgagtagtgatggtgcagagggaaatcaaagtgtacaaccttcacctttggacggtgacaacaatgagctctcatcc

SEQ ID NO: 7087 - DNA, 3000 bp, Unknown; identical to SEQ ID NO: 7083
  misc_feature (1)..( 3000): cDNA_ID_3049728_gDNA_ID_1621126_Annot_ID_172313 3000 nt of promoter + ATG

SEQ ID NO: 7088 - DNA, 3000 bp, Unknown; identical to SEQ ID NO: 7082
  misc_feature (1)..( 3000): cDNA_ID_1816606_gDNA_ID_1621126_Annot_ID_172311 3000 nt of promoter + ATG

SEQ ID NO: 7089 - DNA, 3000 bp, Unknown
  misc_feature (1)..( 3000): cDNA_ID_3049732_gDNA_ID_1621126_Annot_ID_172310 3000 nt of promoter + ATG
tctgctgcttcaggacaatccgtctctttgatctccttttctcctgatcaatagaattataagcgatttcatgcaggatcgaagaagacccttcttctgttggtttctgattttcggttcttgcgtttatgttctgtgacttgttctcagcatctggagtagcagctacttcaatggaagtgagttcgccaatggtttgtgccatctgctggtgaaactccatgaacttctcaaagcacaccgcagggcaatcagcttttgctgatttactcagattggtgaacgtcctgtcccaacaaaaccacatcaacacattacattccaactcaaatccgactaataaaaaagcgtaggaaagaagagtttcgggttatatacttggtatgacgaacaacaatttccgtgattgtagcttctcgcaatgcctgaagggcaactttctgagctacctcccgaagctgagttgcttcctgtcaccaaagtaacacaaagaagattaaggaactatttgaactttcaagaaagatatgatattattccaagcatcaaacttcaatgaagaacacaaatggagttcaaatcaccttgcttagtatgttgagccttcctgataaattggtatctttctcgggttttatcttcttcgaggtagacaagggaacaacatcttcttgagcctctgaaatcaagaaacaagcattgtcctgaataaatcattgtaaacacactaaatgatcaatagaaatgttaaaagcaaaatatacctagagaggatttgaagggactaaaaagagaagcattgttctttttggcctgtctgtcacaaacacttctacttctcggaaacttcgaagccgacgaaacaaaacaactcttccttagcatcgccgtcgccggactctctccttccaatttccccaaaacccctccaccaaaagagcatctcactccacctcttctgatcggagacgctgcaaatctagctgaaacagacctcttcgccggcgtggaatggtcaaactccaacgccattggtttcacaacaaacggagacgaagaaaagtcgacgttttgtccccaagatcctcttctaggcttcgacccaatctcttgatcagttctttctttcggaaccaccaatgtctccggcgtcccaagcaaggggtgccggccaggtatgggttttgcccctttaatgacaggaacaggggatccaggttcgagccgatcaacgtagataaactgacccaactgcaacttattgctgagaacgacgtcgtcttgatccgaagggagagagacgtagatcgagtgagaggaatcagagattttgatgagaaacccttgtttcggctccagagacttctcgtcgagatcaatgggaacgatatctgtgacctgtaacatagagcttcggtgctctctagttggtttaattcctgttttcataccttggattagcttttgaagaattccaggtgccaaagctgccatttttgttgagcttttaagatcaagaacgatagtttcagaaaattcaataactgggtaagaattaagaaggagatgttgatcttaaggatttgcagttgctaggagccaacggtaagattaaaaaagcaaactttttgaatcatggctttgttgcaacggtcgaaattgctggtagatctgtgtcgcaattattctaatttatatccgtgatcatttggtttaacacttcacaaaaagcaacgatgagtctttttagtcagttcatggatttataatttatatggccaatttgaagaaccaatttctaatggttaagtctctagtatagtgtatttggtggttgacacttgacagtgcatagttggtggaaccaataaacatcgcatgattccgactacaaaattacaagaaagtcagaactgtttcaatcactttttctttactataaacagtatcttaattggttttggtaagggaactcaaacaatttcagcataatgagtagtttatttgtaggccagaagtgctaaagtaacgagattaccaatttaagatgataaatgtataaacaaaaagaacaaagtaggccttagatgttagaagaaaacaagggtctgattcaatttctaaacataattcaccaatagtgattcaatttcaatcatgaacattaatgaacgagattaaatagctttaagtcagattcactggcagagaggtaatggaaaccatgaagcataatgagtagtttatttccaggcaaagtgttaaaggtaacggaatcatcaattgaatatgacaattgtattaggtaaacagaacaaactagcccttagaagaaagcaagggtttgtgttttttctcgatatctccaacttctaggacaaactgcaaaatacagcgatgaaatgaaacaaatttcttggaatctatcaaaacttgcaggccatgttatagtgttgaagcaaatcctgcaaatatcgaatgcaaacttagattagtcactgtgcaaatagaccaacacaacacaagtctgaacaatctaatccactggttcaatgtttcgtaaatgtgaatcaacacatcattttactaccatcgataagattccactctcattaggtcagatagacagtgataggtcgtcacaatggagcaatagtatgacaaggaacaatttatacaaactcaatgcccttctgctacgttttcgtaataaaacatgcgaagaaaaagatcattagctataaagccgatcacttgatatactatacaaaaccgattacttctattagcatgtcaaggcagatcatttatggaatcctatttaccaattgagactacatttactcctagtctggaaacagaaattcagaatcaacttcaattctaaacataaatcatgaacacaagtaaaaaatttaccttctgataagcaactccagttttgattgctcagagatagcaatgaagtgagcaaagctgaagcagtaacactatgtaatg

SEQ ID NO: 7090 - DNA, 3000 bp, Unknown; identical to SEQ ID NO: 7079
  misc_feature (1)..( 3000): cDNA_ID_1816616_gDNA_ID_1621126_Annot_ID_172308 3000 nt of promoter + ATG

SEQ ID NO: 7091 - DNA, 3000 bp, Unknown; identical to SEQ ID NO: 7078
  misc_feature (1)..( 3000): cDNA_ID_1816622_gDNA_ID_1621126_Annot_ID_172305 3000 nt of promoter + ATG

SEQ ID NO: 7092 - DNA, 3000 bp, Unknown; identical to SEQ ID NO: 7086
  misc_feature (1)..( 3000): cDNA_ID_1816594_gDNA_ID_1621126_Annot_ID_56364 3000 nt of promoter + ATG

SEQ ID NO: 7093 - DNA, 3000 bp, Unknown
  misc_feature (1)..( 3000): cDNA_ID_1808923_gDNA_ID_1621126_Annot_ID_56365 3000 nt of promoter + ATG
atacaaccagttacgtatgcgctccccacaggatctgaagggacgtctgaatgtgcagtttcaaggtgaggaaggtattgatgctggtggcctgacccgagaatggtatcagttattgtcaagagttatatttgacaaaggagcgttgctcttcactaccgttggaaatgatgccaccttccaaccgaatcccaattctgtttaccaaactgagcatctatcatacttcaaatttgttggtcgcatggtaatatatcaggaccttgtcaatgcaatgatctgattgatcgttttttgctctctctgatgtgtttgtgatgtcactgcaggtggcaaaggcgttgtttgatgggcagcttttggatgtctatttcacccgttctttctataaacacatacttggtgtgaaggtgacttatcatgacattgaggcggtggatcctgattactacaagaatttgaagtggctattagaggtttgaggacctagcctttatttacctttatctattacatagctcaaaaatagaagtcaggtcctgtgctgtttgagccttatatatttgtccccttttctgtttattcagaatgatgtgagcgacatactcgacctcacatttagtatggacgcagatgaggaaaaacacattctttacgagaagactgaggtgtgtggtgattgatgttctttcttttgttgtgctttatcccaaattgcctagtatattgaattgatcattttatctttgatgaaaaggtgacggactatgaacttaaacctggaggacgaaacatacgggtaacagaagaaacaaaacatgaatatgttgaccttgtggccgaccacatacttaccagtgctatacgccctcaaatcaacgctttcctagaaggcttaaatgagttgatacctcgtgagcttgtatcaattttcaatgataaagagcttgagctcctaatcagcgggttgcctgagattgattgtaagttggcattctatttttcaatatttttgcatctatttgcttattcatttaaagttataataacaatcttgttatctgttttcttttgttttttagttgatgatctaaaagcaaataccgagtataccagctacacggtagggtcccctgttattcgttggttctgggaggttgtcaaagctttcagcaaagaagatatggctagatttcttcaatttgtcactggaacatcaaaggtaaaaccaatatttgcagcttctgtccaagtcgcttgagcttcattttctgatatgtactagtttttcttctggttgttttacaagcggtgtttctgttttcaggttcccttggaaggcttcaaggcactgcaaggtatttctggccctcaaagattacaaatccacaaagcatatggatctccggagcggctgccatcagctcatacatggttagacattattacaaagtcttttttttttcagttaaacgtggtcgtaattttcattggttctgttgcagttttaaccaactagacctccctgagtatcaatctaaggaacaagttcaggaacgcctgcttcttgcaattcacgaagccaatgaaggttttgggtttgcttgaacaaagcttaagaagaaggaagagcttttgattaagagcaagaaatagaaaacgcaagtggctatttttgtctgtccatatattatgttagtatattagtccattgttttttttttaggctttctctctatttccttagattttgttaaaaatagttgcaaactctcaaatattagtagttgatatttgctatccatttttataagatgagaaaattacataactgctggtcattattttgaatacttcctttctgtcacgcgtattggcatattcctcaaccaacatacgaaggccagtttgttatcacaagtttgcaagcccattgtcttaatatctcaactgtctccagaagcaagtctcataacatctagaagaggttgttgagcataccaagtgtgttccgaggaggataaacatgggagactccactccaaactccattaccttcaccacctgcctattcagcaaatgaagaatcagagtgtgtgcatggcatctctccgaaaatcccacacagggtcttgatctttgtcctccacgttcatcatcattttcatccattattgcttactcgccttgtccttgacgttccacatttgtctccagccaacaagtattgctggtataagctttgatagtttgtaaaataaacattagctaacataaatactcttttgcctcttatcaaaaaaaaaaaatgatgcttcacaagttaacacaccttcaaattttcttaaaaaacatctatatgcaataacagaattcaaattataatgcaataatgataagaaaacatttctcctccatcaaccaaaacgtgaattaacatctatcgaaaataggtgcttcacaagttgacacacttgacacacaaaatctacaagtgtgagagcgcttgttcataacgagtttaaagaatcgcaaaacacactcatattaataataatcaatcaacttttggaaatattcaatactcttttgttgatacatgtagtcttctaagataaaataaaaacgtatacactaaacagttttttttttttttttttggggtcaataacagaatctaaaaattaaagttaaaatttaaacgataaaagtatttaattgggacgtttatcaaaatgaaacaatgcattggatcggctttaaaaagcaaccaaaaaaaaaagagctgtcatgattgatattcatcatcacaaaataatgaaaattgccttattcacgtaataacaaaaagaaaatgattttataacagtcgaatcgtacggcagatatttgttggcccctcctcttatatgatatcatagtcaacaagagaacaaagccacagagagagagagacactaaaaccctaatctcttactcactgtctctcttcttcaatcc

SEQ ID NO: 7094 - DNA, 3000 bp, Unknown
  misc_feature (1)..( 3000): cDNA_ID_1816590_gDNA_ID_1621126_Annot_ID_56366 3000 nt of promoter + ATG
ataagatttgtcggcttcgaggattgcaatattatattatttgaagcattattattagatgtgtgatcatttttgtggctttaaatgcttcccacgtcttctaaaatgaaaattcaaaggaatgttgataaaatgttttagccttttagggtctaatgactcgtgctagcattaagtattcaaaaaaaaacaaaaaaaaaggaaataattctggttatcgcagaatagtaactagtaaaacgtataaaaattaataaagacaaaactaagttgaaaaagatagagttccacaacaaacaatgacgccatcggtagctaagtaaagtcaatatctaactaattaaatagcaaaatagtagtagatgttaacgtaatcacattcgtaatattctgtaatgacgcaaactcggggatgcagcgacaaaagaaccattacctaacaaaagtaggaaactctcttgtaatttgaacaatcttccaatagtttgtccattatatttgttttttttttgtactattttattcaagaatcgaacatatttctaatttttctacatggaccaggtctcaacattatgaatcacatccgatattacgaaaaactctattaaaatgattactaactctatttttaactatttttcaaccatatagattatttacaaattcatacatatggaccgttttggtgtcttcagatacgacctatgaggagataagaaagaatcgaatcattgacaattattgtttgtgattctgcagaaactgaagagcacttcacgttctttgcacacgtgtatgtccaatatcgcacgccatattaaccgcggttccagttgcatcagaatgtgtccagagatgaaccacgtggaaaccggtttgtggaaaaccggaatcgtcataaacgcttatcggtttctgtcatgatcgtaataatcatgcacgcgtggatcaatcatctctcttagtaagttttgatgatattttgtagacgtttttctttacttttgatgaaactctctagaaaactttaaattatccacgaatatgtggagctctatgtagacgcataattgtgccgcatataaatgccgtcagcttaattttggcagttttcgttacacgaaaatggaacaaatgtaaatgatcaaataagagaggacccataacatcatatatgtgtcggcctttcgatcaccctctccacataaaacctcaaatggccatatttttttcatttatatatttcttaaatggagtaatacccattacccaaaaaagtggtcaccaagaggaattattctgttatagattccaccatcgaagctaaaagcaaatagatatattattgataaaataaaataaggatggctgctagaaatagaaacgcatgggtgttttggataatcctataatatatgtttggtaaatataatattacattttcgataacttattgtattaagttcatatttaaaaccaactcgtgctaagaaacgaataaatgccgtggagcataaatattagtaacttggtatattaaataagtgagacttacatttgtttttaaaatttggtcaagggtttacatttctcatttaaagaaatgtcataagataaactaaacaaaaattatagttgttgagattaggtagcttgaatgttaactcaaaagtttcatgctttttcattcgctcaattgcttttgttttgaatggagcaatcagaagaaaataagtttaattgttaaaacaagtcgccaacaatttttgaaccattgaaaacataaaccaatatttgaagcatttaagaaagattttttttttgaatcatggatgttgaaaactttgacttcgatcaaaggacaaaattttcaattttcaatctttatgatatcgtaaatcactttatttttgaaaagtgaatcaaaaaacatttgtcgaactctaatagcttgaactcaaaatttttcagtaatcataaaatctccagattttactgcattttttatttttacattcgaattaccttgtttaaatatgtagattatgtactttcgcttttgttttccttaaccatattgttttccttttaaaacatagatgccaaatattaagtttattttagtatcactttaaaccacatatcttaaacaatttagttacattaaattcaaacaatataatgcaagtaaatgaataaagatggggatataaaaaaaggtaaagaaaaacaaaggtaaagattgctttgactaaatatagccaaataggcaaatataattacagtccttcatcttttctctagctttagaatttgtcttcaaatatgaacataattagtatagtattttgataatcactttatagaaagcttgaattatatgaatcaacatcccacttatcaaaagccacacttttcatttcctttttcactctcactttgacattttaactttcctcataattacaaaaaaatattgtattaaatagtaattactaaaattaagaaaattcttagcatctgaagatttagttgactaatctcagacctaatctgtttcagtaaactctatatatgtaaattaaattatatctctgattataaattaaaaacaaaaaaacaaaaaacgtctctttgtatctcctcaaaagccgaaacaaaacctctctttctcacaagtaagcaacttcaaaatctggttaacccaaattacaaaaaaaacaaaaaaataaaaagtcgctctctttcttcttaaaaatctcaactttgtcgtccaaaactccaaatccagaaacccatacgcaaatatccttctacgtgtttgctcctttcacgtttttctcgaatcttctcgcatttaccaatcaaacagattctaaagttccaaactttttctttctttctcaaaccattctctgtttctcaactcttcactttccagtggtaagatttgaatcatgggtttctcaaattcttaacttttcacaaaagcccacc

SEQ ID NO: 7095 - DNA, 3000 bp, Unknown
  misc_feature (1)..( 3000): cDNA_ID_3049718_gDNA_ID_1621126_Annot_ID_56367 3000 nt of promoter + ATG
gctaatatttttgtcgtccgacttaaaactatataagcatcaatgttttggtgattacgaattagcaaaaacacaattttcaagaaggaaaaaaaaaatatttcacagtaatacattagacactcaatgacagctaactgtaaacaaaaatacaaaacacaaaacagtgtaatacaaaagaatttttatgtataaaatatgtcggttattaaatatccaaaaatgaaaatgtacttggatgttacagctatgagacaactactaagataaagaagaaaaaaaaaagggaagcttcgaaggtgggctttggctttgatacagacgtgcacagatcctttcccatgtaaaaactttgataattctgacgtgtaatttttccattggtaaaacatgttttgactttttacttacgtaagtggaaacgcattttgcaaaaaaatatcatatccctcgaaacacttatccattcacagaaacattctgatcctcgtttttagttaattcgtgtcgaactctcattggttcatatttacgagtccccacacctttagccgacgttggtgtctgtctggataaagaaagaataaataaaacgtttattttctataaaaatgttttgtttactattttcacaattttacgaaaataagagaaaatggaatttttttttttcgtgtggcggaaagtattgtagtattattttttctcttttgggggaatattatcaaagattcaagaatgtatttatttatggaaataaagaaggtgtttgctttttttgtgtgttcttttaaaatctttatataaaagaaaggtatctattgtttggttggtataaatacgcatgcgcattggctttttcgagtagaggaagagactagatagagtcgtgattttttttttcttttttaaattatcaaatggacgtgaaattatttattgaaaaataaacaaaaaaaaaaaaaaaagaagaagaaagagtctatcggatacgtcggatccaatctcccaatccgcattggctgtcgagacaacgtggatgtaaaataaggctttaagttcaagatcatttacctcaaagccactgagcctttaggttaataacgtcctaaattggctaatgtcttcttatgacatactcaaaatctatttttcttggtcgtcaaaattcaatactaatgatgtatatagatgcatggttcattcacaatatagtgtacttggttttttatgcctttccagtttcctataagtatgtatctatatagtatttgattttctaatccttcatataatcttaataaataatattgagttcaaacataagatatttctttatatatggatagagtctctagttgatcgtgtgtaggtgtttcatctttgaccagtggataacgatcagattatttaatttgaaacgttgtttccactttgtagagcttagactctatgtcactatgaaacgacttgtcaacaaagcattttgagccaaataatttaacatataacttggttaaaagacgagtttacgattattactattcttaaagttaaattatgtaatattttcagatttagttttcagtagtcacatgcttaagaacattaacatcagaatacaaccataatgattaatgagagatgtatgcaaaatatatcaactaatcatgttaaaaagggttgtaccattaattagtgatgcttatctgcttcattaagataataattaattttcaggaaaataaaactattgatttgaaattcttttacaaaatatcgatgaaattaaatcggcaataataaccaaaaatatacttttaattataaatgtgaaaaagggggacctcattatatccataaaaaccccagacaaataggtaagatacaagttgctaaatttaattaaaatcccaacaacaacaacaagattatctttaaaatacaatccatcctaaaccaaaaacaaaatttggtccaccatataaaaaaaaacatcatatgctaatatatagtttccatctaccaaactcaaaataaaagataagaagataagaagataaaaggacattaacgtaattttaatcacagcgtcccaagaaactaatccaaaacattatcgcgataaaaccgtacagagcaaaaagctactaataatattattattgaaataaaaatagatagaaaaaatagatcgttagaaaacgtgtatatatatatatatctgtgtattttgcaatatatcgtttttttttcttcgttatcgcattaatctctctctctgtatcttctcttgagtggagcgaatatccaaaagagttccgagtttctttcatccttcacgagcttatactttttcttctccattcgtttgtttttaacgatcaaaaacaacggcgaaggttagtctccggcggtttcttcgttgagatgtgacgacttttttttttgaacgtttataaagattacatattcatgtatttagatttcttttgttatgttaactgtttcattgatgttcgagttaattttaatttgactcaaacacggtaatttttttttaatcttgatctgttttgttacgtaatttttgggttgattttagcctgaaatgatgattttttttctttctagcttatgtttttcgtgaatcaatctttttcaatataaagattagtattttgttgaaattcattttttatttgattggctatgaggaatcagtttcttgaaatggaaatggtgatttgatttgatatgttcacaatatgaatgaagaagattagggttaatttatatatatgaaacaagaaagtttgtttatttaaggtaattgatatatttgttttgttgttattgccatttttaaggtattggaaataagacagaagctgttagctctgtttctccatggtgtcaagatcttgtgctaattttctagacttatcatcttgggaccttttagattttcctcaaactccacgaactcttccacgcgtc

SEQ ID NO: 7096 - DNA, 3000 bp, Unknown
  misc_feature (1)..( 3000): cDNA_ID_1816692_gDNA_ID_1621127_Annot_ID_56374 3000 nt of promoter + ATG
cagaggtcgtgtatcatcatagatcagaaggattttccttttatttttggagatttgaaaccttgatattagactttaaaagcaatccggtttggaaaagtaactttaaattgtaattttgaatctttttttctgatatattactaaggtttgcatcatagaaacagaattgttgcaaaatcacagacttgtgaattcaaactatgtatttgctgatttaaatcttctgaatttttggtgaccttgtttgtctgaactcttgaagtttaaattcaagacgtataagagagtcaaggttctgttctctgctctttttaccaaaaatcttcattttttttaaaaaaactgtgaattgtactgtaatttggatcaggtatggtcttatttcagtgtcacgtatcggatcatggtttttggaactgcagatatggactagaatgatgcaatgcagccccttagctcttggattggtcatgtaagcccttttcgtttctttatttgtgtttgatctttggtcttccctgacagctaacgtttttggagtcgagccaaaatcatttgatgatacttcaaaaccttgctacgtagagattcttttccaagtgatttgcttcgtctctgtcacaagttcttggatcatatgattcatctgatatgtggaatgtatgttttcttatcagattagtaatctttttctttacttgattggatatcactgagacacttgaaagctatctcatgtcattaggactcataaatcattgtcatccaaattgatggttgtaatgttcagagtctagctattgtaatggaaactgagatgcttgaaaccttttaaaggttgttgagcttcactaagttagtatatacactgaagattatttctctacgacagttgagaaatccaatacatgtaatatttgatcctagaaaaccgtgccaggtgtatattatttgaagtatgaatttatggatctttcttctattcgactttcagtttctttgcatactcatttggcttggagactttatgaaagaacttgctttggtaggaaagacagatgcataaaccgctttatcttggtattttcttggggtattttaaatgcaatcctcacggtgcattgccgattttatagtgtttgcggatatttcgtgagctttaggttgtaacttgccttatcatgtatgttcctttctctttttctgacagtaaccaaactagatgtactatatggtaggcatactttggtttcgtgatcaataaaattaatctggttctgcttggttagtactgaatcttttgtgttgatgatgttgtgatgtcgaaattgagatccaagtaaaccaaactataataaaagatgagtagcaatgaggctaaagcttagcagaagtaaggaaacgatgttgttttgtgtactgttgcactttttgtccagaggttggccagtgaaagctacccaagatacataaacactagatttcacaaatgctattaactaaacgataaagacattatgtgttttgttacttcaaatcattattgagtatgcaagcaagcactacactaaatactgaaacctctgttttgacttttgaaactaaccttccttatataaaacttttgcagcgagctcgtccgcttcatggcaaaatattaagctacaagaacaaaatagagaatcctttgttggattcaacattggcacatatctctcatatccgtttatatgatgctgctcctcatttgctcacagtattgtccaaaaccaagatccgtgtcataatcggattcttgcaatctgatctacaaacagaattgctgcgtcatggatcggtctcatcaacagtgccttcttcagtctcaatgttgttacctgcaattgagtctatttacagtgttcttgttgcttcaaacctccacacacatatcaaagtgtctacgcctcacggtgattcaatctttctcgatacgtttccgccatctcaagcttactgtaaccataattgaaattctgttatggttcatttccttcaggctttgtcgataaccagttccagttgtctgatgatgaatctttatccgcagaaaaactatttgtgcaagcctttaactctgtttaaagaaatggtcgatccaaacactgttgcattacaccagacgtggttgacgctatgacatcaaacaatttcagttacgagcacttccggtgagtgaagctaactggggattgttttactaaattttaggccggtttatttgcttcatgatttgccgatttggggatatgccttgttttctttatatagttactaacagaaagaaggaaaaatcttttggttcatgtgactttaaaggtggggcaatgattcacttctacaaagcgcaagtgtaaagactccttctatcgcttctttgcaatgaccaagctgataaaaaatttcgagcaccgttctgaaattagtataaaccacgatggttttgtctattgtaggtcatgaaacctgcattttaccaggaagttaacggaaaattttgtatctgaaacatgctttattattagtgatgggccttatcaactgtgccttcttcatccatcggatagcagaacaaagattgataaattatgcatgagatctctgttctctatccgatggagaacgttgggaagcctcatggagtctcccagtaagaggaagcccactcctaccttgaaattgtcttctttacaagctggagttttcttatttgcaccatttgacttatttgctaaagaaccaaaatttctaacaaaatcaccaaaaatagtgcggtgacaaaacagtaaataaatatatagacactatatgtgcttttggtgcagtgatgtatccacgttgccttcatcatcacgttgactattaaggccagcatgttgttatgactgaaatgttctatgttctttactacttgacaaatatatttatttgtttgttattattcgaatttttataatg

SEQ ID NO: 7097 - DNA, 3000 bp, Unknown
  misc_feature (1)..( 3000): cDNA_ID_1816688_gDNA_ID_1621127_Annot_ID_56375 3000 nt of promoter + ATG
cataattgcatctcaatttaggtgttgggacgatgtggtatagagtgtgaaggcattgagacgctgtgcatgaaggatctcacacttcgaagagacagtatgttttccctttcttcggcatgatgaccagagttgacaatggaatgcttttcgaaaaagttgactttggatatctgcatcaggtgcagaaaagatcattggatgggctcttagtcaccatataaagtctaatcctggtgctgatccagatgttagggttattttgtctcttgagaggtaattggcagcttgtccctgtgcatcgttgtttacttattttcaccaatgtatctgtttcagtattgagaatgaactttcgatccttgcagcttaaaatgtggaatagaactcttggaaattgaatctaagaagtctctcaaggttagcaaatcgtcttggaaattgaatttttgtttacttattttcactctggcaattccttctatcatgtaacaattgttaattttctctgttgctttcaggacattgtgacagaaaatacgtttgaaataagtgatattattccgcccagtgaaattggtgttacattcgatgacattggggcacttgagaatgtcaaagacactttaaaggaactggttatgcttccttttcaatggcctgaacttttctgcaaggggcaattaacaaaggtggttgtcttatccgcatttggttttaggaaattcccatattgtttcactatgtcctgcctcgaattgatgacagatctgtgaaggaccttttatttgtgtgtaccagtatacatgttcataagttttgtgaagtaatgacgatattagtaatactagctgataatttggctttcctcaaaaaatttatctcctataatttagatgttaacgttatggattggtggcttcctaatcagtctgctcctgtacttctctacacagccttgtaacggaattctcttatttggaccttctggaactggaaagaccatgcttgcaaaggcagtggcaacggaagctggtgctaacctcatcaacatgtcaatgtcaagggtaacagaatatccttgaaaagttggactctaccaatttatacacggaatctcttgttcaaacttgtgttcttctcaatattgcagtggtttagtgagggtgagaaatatgtcaaagctgtcttttcgttggctagtaaaatttccccaagcattatctttttggacgaggtaattcctcatggtcaattcgtgggcgaatcttgcttgtagtcagagcattgactgtcttacaatattttactgtcttgtaggtggaaagcatgctacatcggtacaggctgaagacgaaaaatgagttcataataaattgggacggtctgaggacaaatgaaaaggaacgtgttctggttcttgcagccacaaatagaccttttgaccttgacgaggctgtcattagaaggttgcctcataggtaatttatatatagcttccttgttggactaagctttctgtcaaattgacatgtcgtaacaagtttttggtattggcttctgcaggttgatggtgggactaccagatgctcgtagtagatcaaagatattgaaggtgatactttcaaaagaagacttgtcccctgatttcgatattgatgaggttgctagtatgacaaatggatattctggaaacgatcttaaggtaaaattcctagtaattccttttaaccttttgctatggtctgacgaaatgataagtaatgctcatatatatccatgttacatgctcttttggtgcgtgcagaatctatgtgttactgctgcccgccgtcgaatcatagagatagtggagaaggaaaaaagtgtaagtagtctttgtgttaaaccaagaaaactaactttatgctgcctaaaactagtctatagaataaaaatatgcttatgatgagatatattatggtaggagcgagatgctgctgtggctgaaggcagagttcctccagctggaagtggaggttctgatctccgagttttaaaaatggaggatttcagaaacgcactcgagctggtatgatttttgcttgtgagctttcttttctcaaatctgtctctggctcagagaactgtataactgttgtcgatgttgttgaatcaggtgagtatgagcatctcatcaaagtctgtcaacatgacagcgcttcgacaatggaacgaagactacggggaaggtggatccagaaggaatgaatcattcagccagtacgtgtaggattgagtctacttcagaagcagaatgtgttgtatataatatgttcacgtgaatagatagatagtcataaaacagtataaactataaaggtatagtgagttctgacagaataacaggttttagtcggagttttgatacaaacctgtcaggttcggtcactggtagtttcaaatgacttatattcttgtcgtagtcacatttcaacaatttgttttagcttaaatagttaataacggttcacatttcaactaaaccagtcaggttcggtctctagttccaaatgttttttcccttttcgatcaatcggacgatctttgctttgaaagcatagaaacacttgaagaaatcaagaaccgtatccaaatgaagcttcatgtatctgatgacgactttcccaagtggaagttgcgttcatgtgaccatgtcaatggatgttgtttataatcgcttccagtaaatcgaacgagtcgactaaaccgaattatattgatcatccggtttgttttgattgaatttgagcgacacgcagttcagctccagaacttgaattcggcaagcagtaacaccgatgtataacggaggcgaggcttcttcccacacagacacagaggatataggaaactgcgaagcgaaaaagcttcgtggctctaaaggttagagctttattcaatttctcgaattgaatcagatttagcacactgtgagttatttgcattgtctttgtaatg

SEQ ID NO: 7098 - DNA, 3000 bp, Unknown
  misc_feature (1)..( 3000): cDNA_ID_3049777_gDNA_ID_1621127_Annot_ID_56380 3000 nt of promoter + ATG
agtgtagagcaacgaaagttaaggaactattttatgggggtggctaatttaaataccaataatatttgggccatagtgtagagaaacgaaaattaggggagattattagttcatgatccagagtctccagactctttcttctacggaggccatttgaaaatgtatggatctcgtttaatgaaaatgggccataaacttgatgactttatttgttgccctagaaatttactaaaggttttaaaatttaaatggtgtcaatttagaacaaggtctactagataggcaaattttaccatattaattcctaaatcgacatatgaaaaaatcgtaaataaaagatgttcatatatatattgcctaataaattgaaaattcggtgatatgctattttacataatagtattgaaatcacttaatatattctcaactattcttagtgggtaatgcataaatcttctatcaaaatgatgtgatgttcataaatttgcaacttgagaatatgatcctttcattactcaaggatccagctcacaccacatatattattcttgtatacaatgtggaccatggtcctaacattttaacataacacttatgaaaataaaaagaatatgctatgtacaaagaacccaacttcatatccaatatcaaaatttgtgtaaaataacccaattagtttatttggtatataattctcttgagatcaatttatagtcacaggcactctaaaaaattgaaacccaagagggtcagattaattgattaaaccgttctaaatcgaagttaaaccaattatgtttctgagtaaattatttttcctaaacaaaaatgaaccgagatgataaaatgaacccacaacataaatttaagttctcttgaatatcaaaaaaacacaacaaaaaattcaaagcggatatatacagttttctttcataattcaataaaccgataaaccacaaagagaaacaaaacaataccaaataactagaacacatttatgatttctttgttaaaatttgagtttaaatttaatagtatatatgtgtgtaagttgaagaaaacaaattataaagatcatacatatgacaagaaaagagttagatagagtgatttttaatgaaactaaaataataagtatcctttgttggaccccaaaggtcagcaagtgagcttcaccacaagtattatattccaaagaaaagcattcccctcacacgaatctaaatataatcttatgcaaaagtagccaccaacaccaaaatatcataatcaaacttttgggagacttatgaattactatttcatggaattattaacatatagagcatgcatacggaccatataaaataaatttaaaagtagtttcaccactagttgtgcatgtttaaagggtttaagtggttctcataaaagatccaaatcttgtttccttttacattttgcaagtgtgcctttatcctcatgcatcattatatacaagctttgttataatctcagaaggttacatcttacaataataatattaaaaaaatcgagcaaactcaagtgaagtgttacgtatagtatacactatactaacaagtcgctttatattcattttaaaatcaaaatcccagcaattcttatgatagttttcttagattatattattactcgcatattattcgattaacatatgtgaagctttattttgcaaaatgataagctatctagctacctcaatatatattcgatttgtaatatattgttatctcaaattcttggtcgtctgagttacgtatgcttttaattttagctacccgaatatttaaaaaattaaatacatgaatgtataatatacacatctattttattttatttttacgacaacaaaatcacatattaaaatacgtatatatgaaatacttgagtcttgatcaatgacagttttgttttgtttttaaagggtacaatgacagtttcaacatctagtgtttttgttagttaaaagttttaacatagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaaatg

SEQ ID NO: 7099 - DNA, 3000 bp, Unknown
  misc_feature (1)..( 3000): cDNA_ID_1816662_gDNA_ID_1621127_Annot_ID_56382 3000 nt of promoter + ATG
gttcctcgtaatttagaaattctccgaccattaagttcgtcggaaacaaaatgttttcttgtagaatcccctgttctcactttccacacagaattttttcgagcaatttaagttagcaacttcatgaagttctttaaacctagagataacgtttttttacactcgagaatttcctgaatatggtaaattcaaatgacaaaatcttataaattgatagaaatctacaacaacaaaagggcgcccggtccaagtttcttgtaccaaagctattgacacaagttctaataaaaaatcctacaaaagacaaaatatggaaatatttattgatatttgatttacacataagactttaaacctttgcggggtatcgggtagccaactctttttataatgttgaaaattaaaatgaagaaatagaaagtcacaatctctaaattatttgttttgtcatacaaaagagattaatgtgactttgtagagaatatttatacgtacatataagcctaagcatgatcacttacgctttataatgtttcaaggctttgcaccactcccaccgttgctaccatcttcactcacctttgcattgatgacaaatctcgtttcaaagtttttagtagtaaaaagaacttcgctttgtacgttggtaccgactcccataacggaaacactaggttttccagtgttgttagtggcaagagttgcttcaccttcacgtagaggagctggtcttaaaacgccattaagaggagctttggtgccaatagtggctccactttctttgatgggagaaactcctacaatgacaccaataacaggagttttagtgccattagtggatccgccttctgttacatgagacggagcaactcctctaatgccaccactaagaggagctttggtgccatttgtggctccaccagtaacattgttagtagagtttccaattggctgttttttattcatgagtttggtattattggccattcctccgatcttacgtgctccaacattaccactcaaagctgcaatgaataccaccacaagtaacttgatgatattcatcgtttttggctctaatttttttttataatctaagataatattttgtttgtgtagctttgagattgtgttcctaatatcattcccacatgtatataaataatgtgtattttgtacttacttagagagaaatacatagatgtgaagagagttttatacgttttaataatcattcattatcttatagtgacaaataatgactcttcttcgcttcattgaaatttcagagatgcaatgtccacaagaatcatgcacacttgagccgtttaacgtgtgttgattcagatggatgactatgcgaaagtatagctacaaaatcacctaacagtcaaaatttaaaataattttccaacataaatgtttcgtatcgtggaaagtataactttcttttaaaacaaagacggtgattgcattaactcgtaccaaatcaataccatgggcaacttagagcatgtccaacggttaaggccctaaaaatttctaaaaagacaaaaaaatagattttattttaatagttataatctatttttttaatacagatagaccagtaataaaaatacatgtgttattttgtttgtgagctcgtcccttacttacgggttttaagagtttctctctcatgttcctactaacttttgattattttttactttttttattgttagggcctcacctaaaagcctccggttggggatggtctttaatgcattaactttcaaatcaatatgggattgcattcactttctttttgggtcttcaaaaagttcaaaaacctcaagtaatttccctacttaaattatccttaaaatctgaaaaaagagattaatcaacttcttaaattcttcttatggttttggtttacttttactttttttggcatatgatttatttattaacattgaaaataaaataaaaacaacttaaaaagttgggtttaagtttttttttgagctttaacacttgaagaatgaaatcataagacttttaagttataaaatcgaatatggacttaaatatatccggatatccgttatccggttcaaattctcggattattcgtatctatatctttattcggactatccgtcgttttactatctgcatatgttggccggctatccgtttgtttggataaaaatccgtggtaaaatatattaacctcatgcgtactttggtctactaataattagactataaatattattctaattttttggtgtgttattattggagttgtctcctaccaaacaaaaatgcgaaaagagtcaattttgaattttgatcattttgataaaaagtaaaagaatcgttttattaaatatttttaaatgatctttttttttcaaaatcaatcaaacccgttatatctagatatctattaaccggcctaaattctaggattatttgtatccgtcgtttaactattcgtatatctggccggctatccgtttgtttggttcaaaaaccggatacggatatccacggtttaaatagattaacctcatgcctacctacttttggtattctaataattagactattctaattttctggtgtgctattgttggagttgtctcctaaaaaaaatgcaaagaagagtcaattttgatcatttaaaaatatttaataaaaacaattcctttagtttaattggtatactgggccatcaatgggaccgaccaccaagagttgtgcaagcaatcggattatttagcgtttttgatgagttccagtaatctatttgcttttctcaatagctttaaaatggtgaattcgaatgaagaagacgaaaggagaattcttgacgttgaagaatctcttcttacacaggtttcgacttaaatctatcaatttgcgtttgccaatttctctccatttatttaccccttgacatctttctaattatagctatactttcaatttttagaatccactatg

SEQ ID NO: 7100 - DNA, 853 bp, Unknown
  misc_feature (1)..( 853): cDNA_ID_2124745_gDNA_ID_1621127_Annot_ID_172362 3000 nt of promoter + ATG
ttcaattagaagagatgggcgattgaactaaatcaaaactaagaccaaaccgatttactcaattatttttgttgtttttaaaatcgtgttgagaaaactccatatcaatgacgagatagaaatcaaactaaaaatgacaaaaatatatgtttttcctccccaattctaatttacatttagactttaaatagttagcagcacatgatttgattacatatttttattatttggattttcttttctattgaaccaaaatatttcgatccaaatattggataaaattttggtttcaattaggttaatattttgttttcatttataaaattataaatcataaatcaaaaacttaaatgcccatctctacctaattacaataacaaggggaaatatctaatggccggttatccgacctattgataagctatttttatttaagctttcaatgcttgttatttgtttgcacaaatgcgtttgtctccgttcgatgggtatatttcacaaaactagtttatctaacaagttacaatggtttctttttaaatgtgattttttttattttacaatgttttcccatgtaaacttaaacacatagattgaaaactagtgaggtcttatgcaaaatattactcgccgtgcgctttattgtaatcggcctcaaaaataaaacatctttaagtactcaggtggtgctagtgtactcactttgtcaccacccatattcgaactcgcatgttgcgtgttgttgacaaaaaaaagaatctaggttgcattgtggtactttagggtaaatatgacttgtgtagaagtgttgaatcatcgatttacccaatccggtcaagattgaagacccatg

SEQ ID NO: 7101 - DNA, 3000 bp, Unknown
  misc_feature (1)..( 3000): cDNA_ID_3049760_gDNA_ID_1621127_Annot_ID_172360 3000 nt of promoter + ATG
aagataaccgcactatattcaacattaaactaaagagatataatctttaatattccctggcaagatggaagtatgacatcttggaattgaagaatttgtgtgctcaaagggacttttatgagaaagcaagagtctcattttcctccatgtagaaagacttgacacctttcataaacttgattatagagaaatgaataaaggtgttgtcctcttcttcaatagccatgtgaacttgagagttcttattttccgtgagtggctactagtggttaggcactcttatatgagtcttgggttgggaacttccttcaaatgcagggtgttgggaggttttcatggtctcaaatatcatcaaatcaattataatcttctatgggagatgaaagataaagagaaacttgtgaattcttctttgtagttctataattcctccaaatatgctgaaaacactggccattcggttcgagaaaacattatcttcacaagatctgggcaccaatcatacacagtaaaacttcgatttcggtatgttatgtagtgaaaatagacttcttcggagattagcagcttccatggttgacggctctcatggttgaacctaatcaagtatatgttgaacaaaatatttatgtaaaattagatttataaaagtttcataagttatgtttgacatttatatggattcatcccaataaaagttatgaaacacacaacccacccacatatatgtataaagaatgagaagagtaacctttttttttatgagatgtatcttgttcttttcttctttcaaaaacttgtttcacaccaaaatcctttgcatatctctttttctaaactttttttttccaaacaacttgattctatatagtacataacagaattggagatagggtttttgtgtcaccatcataaaaagactaaaaggacctttaggataatatggaatttatactttttactgaaaaggaagaattggaatcttcttaaaaccaaacgtcccgctctttctgttattacatatttgttgacacaaaaaaaaatgatcaatttccaatcaaaagtttttattttcttatgtattaattagtttacttgtttactcgtaagtttgccgattttggctcgtgaattgatatttagtaaatctttataaccgtgcaagattccaaagttgtttaaatatatatggaaaccaagcaaatcgggacttccgagtgccatctgaaagtctagtcaagatctgagttccattgtctcagagtgtattttcttccacattaatctgattaatatgaggcaaattaaaatttgacggatggtagagagttccattacatatagagccatccatcgtggtttctcgtgaatatgttgcgtgtaagaataattagtttgccgatacaagggttacggaggacatagttattgtctaattagatttcatttgtaacatgattatatcaaatatatctgattatgtaaaaaaaactatttatattaatctagtttagtagacaagattcatcgattacttcggaggtttggtcaaatgactttccctatttcatttacaaaagcgtatacgatcgctacaagcctacaagtgtaacgagagatgggcgtttcagatcctatttagctcgtggtagtcctgtggagttacacacacgaattgaagatgaaaagaggagacgagattactgtgttggtctttccatagattgttatatttgtgtttcttggagcgattggactctgtattgatatgagattactgttttggtctttttatagattgttgtattcttatggacacgaatcaaactttattatttattcaaacttttgttttcaataattttttcgttcaataataattttagtcaaaattaataaatttcattttaataatttttttttaaatttttttactgttatatatatatatatctcagctctgtttgtctttggttcttttgcacatccagtcttttctgttacccaacattaacgatctctttggaaagtttggtgggaggtcctttggaacatttaggccgtttagggcattggcttctttattttccttagcaaactctgttttacactttattatggtttgttaccttttgatgtggtttattttatggagagtttacacttttctctagattatgtttccaatatttattttttgttctcggacttagcttccctcgtttgggctttagactctggaaatatctctgttttccgccggcttatgtttgtatctcatgtatctcttcaagtttcttataaatataaccagatgacaaaaaaatatatatatatatctcagctccccgtttctgctgtagctcctttcaactactcctcccttctccacttatcaatcaggcccctttaaaagataattttcacgcctaaaccatcttttaaaacatcgagtaactaaccaaaataaattgattaataacatatgcattctagttgaagttaaaaaatactactatctctattttagtcttaaaaactaacaaacataaaaaaaaaaatgaagttagtgtgttccgatgaaacagaccaaaacactgtaaaagaaaaaaaatgaaacataccaaaacaaatgcgtttaccgcattaacttcctaagaaacgtcttaataaaagactcacactcttaatccccctagtcaaaccattcaatgatcttttaattctcttttgtagtattaatttgattccctaattaaaacaaaaaacgttacacgtggacaaagacacggtgtcgtttttcatcagattcaacgtcttccttggtgacttgccttcttcttcttctacgtctctcacatgtcaaatccttacgatttcgatttctcctgaaaatctcaatttcaacaaaacccttaagatttttcgattttggattcccaattctcccggagttctgatgcagatcgccggagataagtaatctcgagtttactaatg

SEQ ID NO: 7102 - DNA, 3000 bp, Unknown
  misc_feature (1)..( 3000): cDNA_ID_2992345_gDNA_ID_1621127_Annot_ID_172357 3000 nt of promoter + ATG
gagaaaagtgccaaaaaggtcagaagaaaagaaaatgagattttttgtaaccttattaatacaattagtttaacgtgattagagagagatttgaaaaggtaaaaaagtcaaagctaatgactcggtcgttccggtagacagtcaaccgatctacacatctcttttgtcaatacgtgggagccctttaaggcttttatcactattattcttattataacatgataaaataaaataaacatgatctctctttctttctgtctatttgtttctcttatttctacgtgtgtggactcaaactaaaatttagtttttattatcttctcgaattttaaattataaggtcatgccaaataaggtgacacgtttcttcactatctagttattttagtcatttgacatagcatatcagtttttttttgtttttttcgttggtggttttaatcatcaaactttggcgatgaaaacataaaaaggaaatcaacagtaaaacaaatatcaaatataattatgatactataaatttgtaacattactatatgaacaacataactaattcaccaaccaaattttttttttctttctaataaggtttattatgggcaacacatgttatcacgataaatataatatagactatttggatatgtgttattagttgtattctttttctttcttatttttttttatttttatttttttctatattttcattaactattattttataaggtaaaaatataaatattaaaatacattcgtctgctaaaattatccaatgtaatattgcaattcaaaattaattgtttcagaaaataatctcagtagaatgcgctcttataaccgcatgtagccaaccaatgagcgattccaatgattagtaacactaaatctcttcgacttttctaaatttgttgaacctgtttcgatttctttatccggtttgtatagtaccattttttggttatccttcaacaaatttaacaaaaaaaataaaaaaattgcatttacattatgtagtagtctaataaaatataattatagataatagaaaagtcaatagttctaatatgataacaacaaaagaaaatgtatactttaaaatctgaaaattaccattcttttatttgttatcccaaacataagccatgtactataattaggttattgtaatttattataaaaaaaaaagaaagaatattcctgtacttcatgatttctttttgtaacgaagtacataaaattttcaaatcacatgtggtaaccatgatttaacaaaaaattaagtcggtgacaagcaacgaaacataaataatcgactttgtcaagatatgtataaaaatcgactttgtatttagagaacaaggtcttcattatttttcttttttaacattagagaaagagaactaaaggtctacttcaagaaaacaagaaactaggtgcttagctttaataatatatcaaagaaaaatgggtcaaaaaataaattattacatgagtggggcccggccggccacggaagtaagacctaacgaccagcgcaaccggtcaccagtcaagactattagaagccgggccgtcaaaatcgttgactcggtttttgtttccaactgtttttgtattttgttaaaaataaattaatactaataaataagctgaaaaaaaagaaaagagaaaaggtataatcacgtggaacgcgccgcagtaaacggagcggtggatcaaacttttcgtccgtttgatcaaacagaagagaactagtcaatgctctttcttcatatcacaatttaatagtctcaagacgattacgccacataaccattttctcgtgatttcgacatcaaaatttaataaaaggaactgattgattggtcatcatgttacaagtgtcaaatgagctaatccgttttacagtggcatagtttacgatcaatttacaaatttttggttttataacatacttgtagttaaaactatttataagctatttatagtgagttagcttataaaaccctattcttttatctaaaattatgttttgactcgtttcatgataaaattttatccttttcatcggaataaaaaactttattatttatttggcaaaataattggtgtaaaaattatgtatatgttaataacaaaaaatattaatctgattcataatcttaaaaaagaaaaatttcttgaaataaactttagacattgtaaataaaaaaacattatttttatataatgggatgtttatatgtaattttttataaaaaaataaaagttgtttactagtaatccgattggctttaactatcgtcgccaaaagaataatgtagaactgactttgaggtaaaactaaaagaaatttgtaagataatagtcacattaaatgctaaaattaatacatactgatatatcgtataaaatttatgaaaactacaccttaacctgaatcatacactgtaataaaaaaaacaaattatatataaaccctaaaaactaatcataaatcccaaacggtgtactctctattagctttgaaaggattgcccaattgtttgttaaaaatttctaataatagtacaatgttttgtttcatttttccttttcgtcaacctgttacccaatagcaaatgaagtttttatgtgtgtgtgtgtgtgtgaatttccatgaaaatgaaacgggcttagaatcccggtgtattatgggtcgggtcgtaaccgggcaatgacgcaggatctgacgtaaaactcccaagaatttttttaaaaagtctccggaaaataaaatcaaagttcattaacttaaaaagaaaaaacaaaatcggtccacgtcccaaaccctttttataggagagtcttatgttctggcagaagacttcacagactctttcttaatctctctctctttcaaccaaacccctaaacaaaaaaaaaatacattttctgatctctctaaaaatctttctccttcgttaatctcgtgatctctttctttttctatatatg

SEQ ID NO: 7103 - DNA, 3000 bp, Unknown
  misc_feature (1)..( 3000): cDNA_ID_3049763_gDNA_ID_1621127_Annot_ID_172356 3000 nt of promoter + ATG
gtttagtatagtatatagaatattaattgaattaaatgaagaaaatgcaaagtcatggacttataaagccgccgtttattatctaccatttctattttggaagttataagttattcatatggtttgcgtgaggtcgagagacgagaagagagacttctctacgacttttgaaaagagagtcgttgagtcacatgtctgcatgtggtcatacttgttttaacctatccgtcttctttaggactcttcctaaatcaatacattttaaatggttgttacaatatggttggtaaaagaatataagtctattggtaatactaatatatagttgtcacgttgattaatagcagtcgtttttattcagtatggttgcgcgtggccactatttaattaaagatctaatcactcttgaaagtaatcaaaattttggcaaaatttggattatcaaatgctgaattttataagaagtttgagatagacgaaaattggatctataatatgccagactaataaatgttggtctaaaccttactacgaaacgattaggtttagctgaactacatgaatgataaatctgttatcgaatataatttatagaaaaatattgtataatattacgactttcattttatgataatggttattggttcctagtatggctttgtgatgaacgatcatttgcatcatcgtaacttgcttgtgtgatttaggttggactgaatactaaaagacacatgttaacgatatcattggggcacaattgattggcaaggatctaactggattgactgctatagacaacataatcgttggaattggtgagaacccaaatgtgcatgttattcttgtttgtctctttattttaaaacatcaagagccattattcaaaccttgaaatctaattatgatcaaacagcttgcaacaagaaaaagaaaagtagattttgaaatgccaacaagaatacggtaattttgaatgtcattgaacaacttttggggataaaatttcataccaaataacaaattaaaatctgatgcaaagacgtgactaattaaagttttcatagctagctaggcagtcagagcaaaatatcaaaatcataaaatggacataagaaaggaagagaccaagaaattacttcatggttctttttgcccctcttctttagccttcgagacttctcatcttcttaaacaaaataatcatgtttaaacaatcacaaaagaacataaactggttattttgaaaattttgatggctcaagaactttgggaactgttccgaaatgatttaataagtacgtggtgatgaaattgagtatattaaaacatctatctgcacagcaagaaagacaaacaactagaaaaatattttaaatgaagcaccaccatcttaacactaagcttaggttaggtgctttcgttttttttttccatttttgagcttaacttatagcatgtcaaaattctcatttgatggttgtttttgtttgtaattgttcagattctcatttacgtatgtgtaattgctcaaatccttatttttggagcattattgcgacactatgtcaatcatatacctgagactcatgtggacatatgatattatcgagttaaatatgggtattgtttataaattgtatgatatatgtagttcatatgattattatttttgttaggatcatgtgttcctgatgagattgttatattgattattgcatgcatggttaatttcaggtttgtggcaaacgtttatgaaacccttatccaaatagaatgagcttttaaggcccatgaaaaactatccaaacatgattttttttgtcccttttcttcaaccatgttattttttctcacaaaatttgaaaatctattttggaatctaaaaactatttcaaattttggaaattctaaaattgtctaattaaacagttataaaaaatccgaaagagcaagtaaattaagctcgagtgtagcaacttaccaacaaaacttagtgggtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaatg

SEQ ID NO: 7104 - DNA, 3000 bp, Unknown
  misc_feature (1)..( 3000): cDNA_ID_3049771_gDNA_ID_1621127_Annot_ID_172352 3000 nt of promoter + ATG
cattagaccattttcaatggttgtctctatttgttaggaaaaaaaattaaaatctctattttagagataaataaagacaaaaatagagtatagaaataataataaagatgggttggagatgttttaagcggcttttttgtagcttgcaggttccaatctaagtgagaacgacttttttttgttgggtaaaaaaaaattaaaaaaattgttttcacttgattgagacctgtgaagcttaggattttgattggtagcacatttccaaatttgaattgttttgttggagaccaataagaaagaaacgaatctgttgaaagttgaaacatacaaatttaatagatatataattgaaatatttgtttacaacttgtttgacaaatatagattgtttaccatcgttcatttaccaaatggatattttgaggaaaatatctttcttttgggaatcatcttactaaaataaaaaaaaatctaatcgtatgtctttgcttataatttctttttcatctttttgtcaaccaacgacattaaacttgtttttaaggttaattataaagattttctaaatataacaattgtatatagtatacaattgtatgtaaaaaaaaacaattgtatagccgtcgtgacgtagtaaaaagggatattaggatcacataaattctttatataaggaatctttacgtaaggcaacattattatctcctctcccttattgagaagggctcatggtcaacgttggttatagtcttatagatgaaatggggatctaagacgacaacccagaatccgaagacagttcaggaatctaggcgacattagtataccacaatctgtgtgcagacactggcgaagcacagacagttgaagtattaaaacaatttttaaatcgtttcgctgcaaattatccaggtttatttaaattatataagctatatttcatttagtactttgtatgaattataaggaactaatacttaaagttataaatcagctgaaagaatttatgatgatataagcaattgaaatggtttgatgtttattcatgaagcttgaagaagaattttcgcttcatcaaaagaaaaaaaaagtgttgatgtcgaaagaaaaaagaaaaagatgttgatatgtatatatgtactgtacaagttattgaacttaccaaaagtttctgaatgtccaacactaacttgtgttttgtacttttgatttctctgccttatgcttatgtacatgaattcttttttttataggttagcacaacatagagcaaaataagctctatttcatcgatataccgagatggaaatacctagtcaagaaattcacatcatgattgataacacaatatcgaggcgcaaagagagaaagactaacctcgcagatgccgaacccattgtcctgatgtctgttttgagtagtctccatgcgggatatttcagaataagcctttctctatgtagccaagcattgttgtggaagattatggtgcatttgcatagcgaactcccgtctatggcgtattatctcctgtggtacctagcacttgcaacacaagtatcactctgttttttgtatgccttcaagtgtatttttctctttgacatggtgaaggaagagttctcgcactatattggagtgaactatctttacgctccatccatttcatgtcttctattgcttcaatcagctcctatgatagaaccacacagcgttttatatcagacactattctggatctttgctgttccagtcttgactttagacacaaagctttatggtcaatggttcacaacagagaaaaggtttttatcgataatggcaaacccggcaagccaagtatcggtaatcgcaaacctagtggctgcgcggggagcagcagagatgggttggaaagagtgtgctctatgcttattctcacttggaatggttcactatttggtcatctttgttacactttatcaacgcttaccaggcggaaacaatttcccaaccacgctaagaccggttttcttcttgtttttcgctgcacccgccacagcaagtctagcttggaactctatttgtggaaactttgatactatagccaagatgttattcttcctttcactcttcatcttcatatctctggtaagtttacatctttacgatacaccaagaaaccgaaaaccgacatttttacattctttttcttatacattttcaggtttgtaggccaaatcttttgaagaagtcgataaaaagattcaatgtcgcatggtgggcttactcgtttcctatcacatttctcgctttaaactcggttcagtacgcgcaagaggtgaaagaccatgtcgcttcggtcttgatgtttatcttctcatccatgtcagttttgatattcatcagtgtgatgttactgacagcagcaaatagcaaaagattacttagacgtgatcatgtcctctggtcttctactggtccaaaagacaaataaacatcgtgtatggcgaaacttgtaaaccaaagctaattacccataaaataatgtatgtaaaagtagttacaaaactagctggataaaaaatttcagttggaagatcaaccaactacagactactatgtaatacaatttgtagaaatttctactctaattactatctgacctgatatcaaacccggttcaaatactataaaaccggaaatgctgaattgaaccgagttattaccggtttaaacacagtaaaatcaaaattcacctgactgtgagaatcaactgatcaattccattccactgactgattcttccaaatctcaggagtcaggcctcagaggctaatttggtttacaatagacacattttactatctgaattgaaccaaatgatttccggttcaaacatggtaaaccgaagaatgtccattacatcatcatctgaaccaaatttacctgactctaattttcaaagctagaggcttttttagtttttgatcgctgcaaatttcgccggcgacgacgatg

SEQ ID NO: 7105 - DNA, 3000 bp, Unknown
  misc_feature (1)..( 3000): cDNA_ID_1816651_gDNA_ID_1621127_Annot_ID_172351 3000 nt of promoter + ATG
tcaggagtcaggcctcagaggctaatttggtttacaatagacacattttactatctgaattgaaccaaatgatttccggttcaaacatggtaaaccgaagaatgtccattacatcatcatctgaaccaaatttacctgactctaattttcaaagctagaggcttttttagtttttgatcgctgcaaatttcgccggcgacgacgatgatccgatcacgaagtgtcttgttaattttcaggaaggtgttgtatcaatcgtcttgtcttaagtgtttattatgtgcaaactctttctctacttcagtttcgtcaagcttgggttttcgagcgacgaacaaagagttaaaccagatgataagatcggggtatatcgccgaagctagagatatttttgagaaactggaagcgaggaacacagtgacatggaatacgatgataagcgggtatgtgaaaaggcgtgaaatgaatcaagcacggaaactgttcgacgtaatgcctaagagagatgttgtgacttggaacacgatgatttcggggtatgtttcatgtggtgggattaggtttcttgaggaagcaaggaagctgtttgatgaaatgccttcaagggattctttttcatggaacactatgattagtggttatgcgaagaatcggaggataggtgaagcgttgttgttatttgagaaaatgcctgagagaaatgcagtgtcatggagtgctatgatcactgggttttgtcagaacggtgaagtggatagcgcggttgtgttgtttcggaaaatgcctgtgaaggattcgtctcctctatgtgcacttgtggctggtcttattaaaaacgagagactttcagaagctgcgtgggttttgggtcagtatgggagtttagtttcaggaagggaagatttggtgtatgcttataacactttgattgttggatatggacagagaggacaagtagaagcagctcgatgtctgtttgatcagattcctgatctctgtggtgatgatcatggtggagagtttagagagaggttctgtaaaaatgttgtgtcatggaattctatgatcaaagcttacttgaaagtgggtgatgtggtctctgcaaggttgctatttgatcagatgaaagaccgcgatacaatttcttggaacacaatgattgatggatacgtacatgtttccaggatggaagatgcttttgctctgttttcggaaatgccgaaccgtgatgcacattcgtggaacatgatggtctcgggttatgctagtgttggcaatgtagagcttgctcgccactactttgaaaaaacacctgagaaacatacagtctcgtggaactcgataatagcagcttatgagaaaaacaaggactacaaagaagctgttgatttgtttatccggatgaacattgaaggagagaagcctgacccacatactttaacttctcttctcagtgcatctaccgggcttgtgaatctgcgtttaggaatgcagatgcaccaaatcgttgtcaagactgtgatccccgatgttccagtccacaatgcccttatcactatgtattcaagatgcggtgaaataatggagtcgaggagaatcttcgatgaaatgaaactcaaaagagaagtaatcacatggaatgcaatgataggaggatatgcatttcatggtaatgcctcagaggccttgaatctgttcgggtcgatgaaaagcaacgggatatatccttctcacataacattcgtctcagttctgaacgcttgtgctcacgcgggacttgttgatgaggctaaagcacagtttgtgtccatgatgagtgtgtacaagatcgagccgcagatggaacattattcttccctggtcaacgttaccagtggacaagggcagtttgaagaggccatgtatatcataacgagtatgccttttgagccagacaaaacggtatggggtgcattattggatgcttgtaggatatataacaatgtagggcttgcacatgttgcagctgaagcaatgtcgagactcgaaccagagagctcaacaccttatgtactgttatataacatgtatgcggatatgggactatgggacgaagcttctcaagtgagaatgaacatggagagtaaaagaatcaagaaggaaagaggatccagttgggttgactcctcaacgtaaaaagcagcctttatttatgtttacttaaacataaaaattgatttgggatcagaattgagatagaaattgataaggtactcttgaaagttctctcttttctcaattctcttcatcatatttggactcatattccaacgacatcgttttgggaatccccatgattcttgtttgcttctatctgtttttcttttccagtgcccaaaaataaaataaaaagaatctttgtctacattgattgaaaatttgatgtttttctttttgcagccattcaaaatattggtggcttcaaattcacctcttacacttgtagcttgtgcttcatccaattctttgcagcgattaaaacacacaaaaagtttgcatatgaattgctgactctgaatttctcaaaaaggtaagcctttttttgttcatatcttgctttttaatctcagatgtatttaaatgatcgtaagtatctgtgaattggtccagtatgattaagagattcttgacactttccaaagatcagaggttttgattttcttcttgagctaatacaaattttctgatcgcaatattagctaatctccaaatccaaatcatttgaatttgttttcttttttgccacttatggatatctctaaggactaagaatgaattgagagatgaaattagggtttcaactttcaatttgaacagggaagctgattttttttttctagaacatcaatgtatcttagactcttacacatcttaattcctaatatagttgtgttattcaaagaaaaaagcttctctcttatgcagataagggcattgcttcattgatatggttaagaaatg

SEQ ID NO: 7106 - DNA, 3000 bp, Unknown; identical to SEQ ID NO: 7098
  misc_feature (1)..( 3000): cDNA_ID_3049777_gDNA_ID_1621127_Annot_ID_172341 3000 nt of promoter + ATG

SEQ ID NO: 7107 - DNA, 3000 bp, Unknown; identical to SEQ ID NO: 7105
  misc_feature (1)..( 3000): cDNA_ID_1816651_gDNA_ID_1621127_Annot_ID_56386 3000 nt of promoter + ATG

SEQ ID NO: 7108 - DNA, 3000 bp, Unknown; identical to SEQ ID NO: 7103
  misc_feature (1)..( 3000): cDNA_ID_1816644_gDNA_ID_1621127_Annot_ID_56390 3000 nt of promoter + ATG

SEQ ID NO: 7109 - DNA, 3000 bp, Unknown
  misc_feature (1)..( 3000): cDNA_ID_1816790_gDNA_ID_1621128_Annot_ID_56392 3000 nt of promoter + ATG
cctttgtagttttgtgcttgacatgcattgttccttttgcaggttacaagcatcaagttcgttggtgacactgatcttgtgttaactgcttcatccgacaaggtaagctaaggttatgtgtacaagctcctttgaggattgcatgattttatggagtagtagtgaagagattaacttctcatttcttaacactctgcagacagtccgcatctggggatgttccgaggatgggaactatacctctagacatacactgaaagatcattctgccgaggtaaggatgtaactgaagaacttctacaggctacagtctcatacagttttacgttttatttatttttggtctgtttaacgtaaaagcaatgatgtggttttcaggtgcgagctgtaactgtccacgcaacgaataaatactttgtgtcagcatcacttgacagtacatggtgcttctatgatctgtcctccggtttatgccttgctcaggtctccaaaattttaatccacacctgatacctgttatccagtttcagatttcttcttttatgctaatataacaatgaaacatttaccttctttattgtaatgtgaattagactcgttagaataaatgtttctgccatgcgtctttctcattattgttgttattcaggtgacagatgcttccgaaaacgacgtgaattacacggctgctgcttttcatcctgatggtctcattcttggaactggtaccgctcaatctattgttaagatttgggatgtaaaaagtcaggtaaaaactctttgaccttccttgctcatcaactgttgtcacttgtaagtttgttctcacttcactctcatctctatctctgtcgtttgataggcaaatgtggcaaagtttggtggacacaatggagaaatcacctctatatcattctctgaaaacggttatttccttgcggtgggtacattgactgattgacctaaactaagtagaaagaaggatagcaccaggttccttttgactgaccaatatttactattctttaaattgtacagactgctgcactggatggtgttaggttgtgggacttgcgcaagttaaagaacttccgaacctttgactttccagatgcaaactcgggtattcaactacctgagcactcttactagtctattttgttgagtgagttttcatttcttaaggcctgaatgagctttttttgtgcagtggagtttgaccatagcggatcttatcttggcattgctgcttcagatataaggtgaggtctactttgatacacaatgttgggaattaattgatataggagctcactttgataacgagatattgaaagatagttgtgcaaactcaattaacctgctatcaccagaaatgcagtttgggtatatgtatacgtttcttctgcaaatcatactaatcgaaaacttgtgcttcaatgttgtagagtattccaagcagctagtgtaaaagcagaatggaacccaatcaagactcttcccgatctgtccggtacaggtaaatgctacatgttaagcttttgaagtcactgctcttccttgttttattgagtctatcattcagacattgtaactacataaatgtgcaggtaaagcaacaagtgttaagtttggactcgactccaaatacatagcagtcggttcaatggaccgtaatctcaggatatttggtttacctgatgatgacaatactgaagattcagcacaagattcatgaagagatatctcaaaagtctcatcatcaagagtagctatatcctcaattctcgcgatttttgttgtatctttacagttctgttggtactttcctgatggcccctctcacaatcacatatacacacctgagctctctccctttctttctcagtcaacaattttcctgtaacaacatcgtaccttaaggatctgcagttgatctttctctctttgatctgaaagagtccacataaaacaaagttagctgctcactataaaagcaaatgaagaacaggcatgtaaatgatcttcttcatcattcaaatcagtaggacctaaacggcaacaattaaaaaacttgtgttatatagaaagggtcatgaatcttgaagacaatgaaatgaagacaaaaagattgtgatggtggtcatagaaattagaaaaccctgagacagacagagattttgactgtactgtggtcaaaacacacacttcacaatcttcccattcccccaccaatctcagattccttttcacttcctccaactctttctctctctctggccttttttttttttttttttcctatttatagctcatctttagtaattccgttattggttaaatttcctaaacatgtttttggtatcaacaatcaagtaagtgcaagaaagtttgtatctttctctaaacccaatttccaaagtaaccaactactaaaccagaatgttacacaaagtaagtcactaaatgactttaaaaacaagattagactttaaactagattagagacatacttatttggaataagattcaaaggtcactagtagctagtaggtggtaaaaaggaagctaaacaacaaataaactcttattaaaatctttcaatcaataaatatttattgtaatttgctgcagtaaatcaaacattgtacagtttcagaactgaatggctcagaagcgttaaaaggaaaaagagactctctctctctctctctctcccctaatctcctctcacatggtcatcaaaagccaaagccaaagccaaaaaaaacaaagaacccagaaacctagaagacagaaacaaaaatcaaagctttactgagccaccaagcaaccaattacatcaactctaaaacccataaaaccaacacaaagattccatctttcaatatctctacaatgagaaagccaatgctttgattttttcccccaatctttcttccaagatacctcaaagcaaaaagagaccacaagaagcaaaagagtctacatacaaaaatg

SEQ ID NO: 7110 - DNA, 3000 bp, Unknown
  misc_feature (1)..( 3000): cDNA_ID_1816786_gDNA_ID_1621128_Annot_ID_56393 3000 nt of promoter + ATG
attgtgacgatttgtggttggctagcgagaaggtacgtaactacgtatgaacaccgtacaaaagagttagcactaaaaagtttgctttactaattatcgtttcagacttttggaatatgaactgaattgtatctagaataaccagaaacagaaaagaaagtaaaaggaatgaagcaatttgacaaaagataaaatcgaataactaagaaaattaagaaaacgatgttacctacaaaatacaaagatttcagaaaataattttattccttgcgaataaatcatagatatatacatgcaaaattttcaggaaaaaaaggttcatgcttttaatcatttaagcaatgtatgatagaaaagaggaaacccaaagaagagaaaccattcaagggcataaaaacagattcgaggacaaacaataaacattgcacggattattacgtaccatggagagctgctcatgagacgaaattacgtcctgcgacatgtttatgtgttctttatggtctccaaattgtgaatgattttccgggaatgaatccagagagaaaattccccaggaaaagggaaagattattgaaggaggcttcttgaatgtggtagtggagctagtgatgtctgaacaagaaaatctaaagaattaaaatactggaacaaaagagataataattaatcaaacagaacagaataaaaatctgtttaaagacagagaagagaaagaaatttcttacaggtttcttctggagaaactaatgaaggttatggaagttatcgtaaccaatttatttatacttatggtttaaatgtgtatctatatgtgtatgtatgcaaaatgtaataagaaaaatgccagcgtggcaattgacgttaaacgcgctggtcctggagtttcttattctcgtgacgtggcgtgtaacgattggaataattagttgacgtggagaaaatagtcccacctaagtgatgacttggttgaccggtaaaggagtttgacccaattctttttgtcgcgatgatttttgactttctgactgaaacttgtgctaaattaagccttctatttatagaatttggcttttctattttatttttagcaatttaatttttcattttctatttatttacttggttgggttttttaaatgctggtaagaagtggaaaagaagagaaggagaaaaagagaccaggtcagtgaaaattttgaaaataagagataaagatcgtactaagtcaaatgtatttattttatggaaatttcgaggggaaaaaaaatgttacgtgatgcttagttaaattcggaaactacaaatttcatatcaagatggtttctctcgataaaaattcgttacagtgatagttttagcataccatgcttcgagttgtcgttttctatatatgttgttttccttacaaccataaccaaataatgaactgatcatacaaatgaaaagatacttttatagatcggaatatatatcgacttagataacgtaaataaaggtacaccaatgtgatttatagattatatagtcatcaacaccatatatgaaactttaacaaaaaaacaccatatatgaaactacaattttttacgaacatggtcttacctttattttatctttttttttcgtataaagaattcccaaactatgaaaaaatgtcagctaggtgaataatctaactttcatggactattactcagctaagttcaaaatatcccttcacttcaaaacttctaaaaacaactttcattgactatacgcattaattaattactattgtaattacgacgatttttttttcgttctcctctagctttttttagtttatttgttttggtcatggttgggaacgggacatcatcacatcacttatcaacattctatttggtccccaactctatgaagcattatttgaaatcattagcatgactatctaagttttttttctcctgatatttatccaaaattttatttcattcaaattgtttaacaatatgtacatatactatatgtattatataaaatacatatcaccactcaggcaattttttaaacttatatacagtatgtgataaaataaacatggtcatacgtttaagaattggaaattaatgaggttgcaagaaatcatttaacgagaacagaatgaagagaaagaaaaaaatagcaacttggtggcaaaaggaaaaagaaacagcttgagatcaaagctgatttgatgaatcgatactttggagatatatatgagcatcttcggcaaaagctttggcctttgagtgcagtgttacacacacgcattttccaaacgagatgatttaagttttgcagagctatcacaaatatattataataccaaactctcagacaatattatataaatcggaagtctaattttttttaataaaaaatgaaaatatagtatgaccaatgatttgttcatataaggttcttttttcggctatgttaattgttgagaaatgagaatactaaatatgctttttatgagaatactacttttcggctatgactaatttttgttcataaagaacacatctatcgtacgtgcaaatagaatggcccgtacatcgttgtcctaccttatactttaaaagaatttgtaatcagaaaaaataaaagaaaagaatgacaaaaaaaagggtaagaattatactttcgagtttcttttctcagacagaaagaatgaacgaacatacatagtttaactaatgggcttcagaaaaaagcctaattagttataaatcaaggtctcgttaaaaggcccatttgtttaacaagaaatctctaacttgttgtcctaagcttaaacaatttttgcatctctctctctttccgtcttcatcgtcctcccggcttctgcgattttgtttagtagcgccggaccggagtagttaaaaccctagcccagtctatttaaagattcaccgagtagtcttctagtcctgcgtatacttcttcttcttcgtttatacttagaagatg

SEQ ID NO: 7111 - DNA, 3000 bp, Unknown
  misc_feature (1)..( 3000): cDNA_ID_1816783_gDNA_ID_1621128_Annot_ID_56394 3000 nt of promoter + ATG
cattagttaaactatgtatgttcgttcattctttctgtctgagaaaagaaactcgaaagtataattcttacccttttttttgtcattcttttcttttattttttctgattacaaattcttttaaagtataaggtaggacaacgatgtacgggccattctatttgcacgtacgatagatgtgttctttatgaacaaaaattagtcatagccgaaaagtagtattctcataaaaagcatatttagtattctcatttctcaacaattaacatagccgaaaaaagaaccttatatgaacaaatcattggtcatactatattttcattttttattaaaaaaaattagacttccgatttatataatattgtctgagagtttggtattataatatatttgtgatagctctgcaaaacttaaatcatctcgtttggaaaatgcgtgtgtgtaacactgcactcaaaggccaaagcttttgccgaagatgctcatatatatctccaaagtatcgattcatcaaatcagctttgatctcaagctgtttctttttccttttgccaccaagttgctatttttttctttctcttcattctgttctcgttaaatgatttcttgcaacctcattaatttccaattcttaaacgtatgaccatgtttattttatcacatactgtatataagtttaaaaaattgcctgagtggtgatatgtattttatataatacatatagtatatgtacatattgttaaacaatttgaatgaaataaaattttggataaatatcaggagaaaaaaaacttagatagtcatgctaatgatttcaaataatgcttcatagagttggggaccaaatagaatgttgataagtgatgtgatgatgtcccgttcccaaccatgaccaaaacaaataaactaaaaaaagctagaggagaacgaaaaaaaaatcgtcgtaattacaatagtaattaattaatgcgtatagtcaatgaaagttgtttttagaagttttgaagtgaagggatattttgaacttagctgagtaatagtccatgaaagttagattattcacctagctgacattttttcatagtttgggaattctttatacgaaaaaaaaagataaaataaaggtaagaccatgttcgtaaaaaattgtagtttcatatatggtgtttttttgttaaagtttcatatatggtgttgatgactatataatctataaatcacattggtgtacctttatttacgttatctaagtcgatatatattccgatctataaaagtatcttttcatttgtatgatcagttcattatttggttatggttgtaaggaaaacaacatatatagaaaacgacaactcgaagcatggtatgctaaaactatcactgtaacgaatttttatcgagagaaaccatcttgatatgaaatttgtagtttccgaatttaactaagcatcacgtaacattttttttcccctcgaaatttccataaaataaatacatttgacttagtacgatctttatctcttattttcaaaattttcactgacctggtctctttttctccttctcttcttttccacttcttaccagcatttaaaaaacccaaccaagtaaataaatagaaaatgaaaaattaaattgctaaaaataaaatagaaaagccaaattctataaatagaaggcttaatttagcacaagtttcagtcagaaagtcaaaaatcatcgcgacaaaaagaattgggtcaaactcctttaccggtcaaccaagtcatcacttaggtgggactattttctccacgtcaactaattattccaatcgttacacgccacgtcacgagaataagaaactccaggaccagcgcgtttaacgtcaattgccacgctggcatttttcttattacattttgcatacatacacatatagatacacatttaaaccataagtataaataaattggttacgataacttccataaccttcattagtttctccagaagaaacctgtaagaaatttctttctcttctctgtctttaaacagatttttattctgttctgtttgattaattattatctcttttgttccagtattttaattctttagattttcttgttcagacatcactagctccactaccacattcaagaagcctccttcaataatctttcccttttcctggggaattttctctctggattcattcccggaaaatcattcacaatttggagaccataaagaacacataaacatgtcgcaggacgtaatttcgtctcatgagcagctctccatggtacgtaataatccgtgcaatgtttattgtttgtcctcgaatctgtttttatgcccttgaatggtttctcttctttgggtttcctcttttctatcatacattgcttaaatgattaaaagcatgaacctttttttcctgaaaattttgcatgtatatatctatgatttattcgcaaggaataaaattattttctgaaatctttgtattttgtaggtaacatcgttttcttaattttcttagttattcgattttatcttttgtcaaattgcttcattccttttactttcttttctgtttctggttattctagatacaattcagttcatattccaaaagtctgaaacgataattagtaaagcaaactttttagtgctaactcttttgtacggtgttcatacgtagttacgtaccttctcgctagccaaccacaaatcgtcacaatacttaatcagatagaatagaacagtttatcagaattcataagatgctacatctcttcttttagtaattccagtaattaaaatttgaacttttatttatactttcgaatagaatcacacgaatttttattagaaatatataatgagtgtatcaaaagcaatgattcttgctcttacctcggcctttatttgttgttaaaaaatcagatgttagtttaaattagggaacgttttggttctaaagaaacgcaagaatccaaaaactttcctgtt

SEQ ID NO: 7112 - DNA, 3000 bp, Unknown
  misc_feature (1)..( 3000): cDNA_ID_1816779_gDNA_ID_1621128_Annot_ID_56395 3000 nt of promoter + ATG
agccggttctcccgcagttagggacggagataaccggtttagacgacccgagtttcaacaaagtcggaaaactctcggcagagcagagaaaagagaagattcataggtatatgaagaagaggaacgagaggaatttcagcaagaaaatcaaggtctttgtgcttaaccatcataaccggattaaaccagtggttatccatataccgatttgttcacatgttttttttgttatattttgttgtagtatgcatgtaggaagacgttggcagatagtcgtccaagagttagaggaagatttgcaaagaatgatgaatttggtgaaccaaatagacaagcctgttcaagccatcatgaagatgatgatgatgatgtaagattaatcttgtttgattacaattagaaaacagattagtttttgtttgatataataaagcgtttctaaacgggggtgtggtttgcaggtgggggtaaaggaagaagaacagttagttgattcttcggacatattttcacacataagtggtgtgaactctttcaaatgcaattatccaatccagtcttggatttgagttggattacttacttggtcttatgatttacaaaaataaaacaaaaatagtattgttatagaggtctgtaatttgtatatttattagtacattttttggccatgactcatagtttgtcgaataagtagaacataagaaaagagagagatgaataatgggtgtaggcaggtaatcatgaataaaattgtagtgagtgagaggggttgtttatgttacatagaacattacaaaattttgtagatatatattatatggtatgataattatgatgtctattaatgtatttgatgggtgttgtataaataataatcatttgaacattataaataagcagttgtgttcaagtttgtcactaatttttagtatacgtggttcaaaatttgaaataaataatagtgtattatataaacttactaatacaccttctagatattaatttgaattttagtgaaataattgaatattatttacgtaatgtttatttccagcgtgcttggcatttcaaattttaaattgcatagaaaatacttagcaagaagcaacaaaaaaaaggcaagcaatagtgtctcgatccaatctcacgccaaaggtccaacgacaatcatacttttgtcattttatgttggttggtttattgattcctcgtcgtcagacgttttagaatttaatattattagaactattattggatttttgtgacaaattataagttgtttttggttcttctttcggattttctttgaaaatctttataaaaacaaattaattacgtttcacacttttatatctggattgagcacttgtatatatattataggaatatagttgaaataacacacatctacataattgtgaactataaacgaattatagtttcaagaggttttataaaagagtgtatgtagttgaccatgacccatccctaaaggtacgccatgttagatgttccaatttttctgttttattattatttatgtctaacagcaaaaaagtattgacaataaactcgtaacagaaaaatgatgttgatgataataattaaacaacatatcaatttattactagttcacaaacagaaaatgtatgcataccataaatatgagtacatgcaaacaatttagatgatgtataaacgagtagccctttagtttctacgttacagtctaagttttgtttttctttgagaatttaatattgcgtcgattaatactcggtacctacttgttagttttatacgaccagtacttgcgagttaaaaaaacatacatattaacaaaggttaccgcccattggaaataaacatgcatattaaaacccacaagattcacaatcatccattcaactgatctttcacatttccagtataagaaaacactatgaggattgtaacatcatagttattacgatataaatattgagtgacgaattagaatgataattaaattatttgatttaattttaagtagttaaagatgtttaacaagatattacattatatccaccaatcatataattaaattcatgtatattgttgtgaaaatgttgaccgcatctttataagatgcagaaactgcggtcaaaattaaaataaaaagaagttaattaacagatagtgagatgagtgtgttgtttgatccaccgaacacacacgcacctcccactaaaagccaattaaccaaaagttgtgaaaacaagacttaagtggaagactgaaacaaaatcaaaataatataataaaagtggatacaacgcgttaaggtttgtacaagtacacatatctttgatcattctcatatgttttgttgcttcaaagctttgcccactttgttcgtactcatttgattccttaggagagaagagggaaatttgtttatgctttaaatttggtgagactgacgaaagaatgagcaataatccacaaggaggattttcatcttagtcgacaatatttcgttgaatccaggtaaaaagcattgccatgattttaattttttctttccttcaaaatagtattgtagggaataataactatcaaactgaattatgtgatcgaaaattttaactgtcgttaattgaggttgaagatgcatacaaattctgatcactgcatgttatttttgcaggttttttttggtttcattttaaaaagctttgtaaataataacacataatttacaggtttgtaccaaataagctctgttttagctttgggtttcaaattctgttttacggttgttgtttgtttccaatatttgatgcatttggttttgagaatgtaatctggcaaatgctttactactaactttgataagaatctgtaaacctgtccttacactagcatagtttttaagtcaacttattatgctgtcataatctgtaaaacagaggattttttcttgatcaggaattcctgtggcatttggcaatagag

SEQ ID NO: 7113 - DNA, 3000 bp, Unknown
  misc_feature (1)..( 3000): cDNA_ID_1816771_gDNA_ID_1621128_Annot_ID_56397 3000 nt of promoter + ATG
tggtgataataaccgatggtgatgatctctgaaacaaccgtaattgatcggagcgaaatcacatcatcatcgtttcgtgattgaatgagaagttacaaacgttgcactgtaagcaccttacacattttaactaattaagctttttcactattgtaatgtgttcataacattataacaacagaacagaaaagaacttagaaaaaattgtcaaaatagccaaatcatttgaatgtcagatacatattgtcagaaaataaaaatatcttgctaccaaaattctcaaatttgtatctagacatatccatcaaatacaagcaattgattgatctgatcattagacaatggcattggcagcactagcaatccttggccaaagatcagcacactctttcccaataggaccagtaattgcagaacctttcatttctcccttggggttgacaatgactccagcattatctgtgcaacaaaaaaacacagaatcaatacttgctttcatacacaatcactaacaatgatcaatttaaggattatatagagtccatatggagcagatgcaagcgttcaagcaataaagcatctgtaacgaaggacacaattaaattttccagacttgtacgagcatcaacaccctctaaacgtgtcggtggatacttgacttaagcctggtgatatcaatcacataaactgacaaaaatcatagaatcagtaatactaaaacaatgggaatgtagagttcaaatggagcagatgcaagcgtttgagcataatagtatctgtaacgatagaacacatttaggtgtaccagattttgttttgtatttatacaccctctttatgtttcggtggatacatgacacaattctggaaatgtaataatctaaatctggcataactagaccatatactatctattcataagctagatgaccaatagaacaaatcaagctattgataattcggagtccaagtagtgtaacggtattaaacacacactaaatagtgttggtgaacaaattacgaatcctattagggttttaagagagaaagtaagtaatctaaccttcgaagtacatgaaaacaccatcctttcggcgccatggtttgcgttgcctaacgatgacggcaggaagaacctttttcctgagatcaggcttaccctttttgacggtggccatcaccatgtctccgacgcaagcagaaggtaatcgattaagacgacctttgatacctttcacggaaatgatgtagagattcttagcaccggtgttatcggcacagttcaccgtcgccgccaccggaagacccagtgacatcctgaatttgttaccagaggtacctccacgccctaatcgaaaaaaatccaaatcaacaacgattaaaacgaggttcgaaaagctgaataaacacatattgatgaactgaaaatgtaacagatctaacaactgagatagaggaaaagtgcgaacctcgcttcgacattgttgacggcttgaaggaagaagaaacgatttcggtttaatatatagtgacgcattcttcttgtagggtttcagtaggcttaaaaaatggaagaagaaacgatttcgttttttagcccaagttcaaagtatattaggcccataaaagcccaagcagagttttaaattaaatcagacgcgtcttatcactatttggagagtcccacatcggaaaggtgagagagtttgccaagggaaactttagtatatatagacttcactctccatattctcgaaccacgcagccatgtggtgagcacatagcgaactattctttcgccttttactaaagaataccgtgtgctctccacgctaagtggcatacgcctatttttggagggttcccactttactgtgggtcccaacatctctcagtttaatttttggtctcgaagtatctgagaatcctttgtggcaactctaactgttagacaattaaatctataacccggttattaaaccgtatatacccagttaaaatgcaaacagttatttaaaatatcctctattagagtctttgtgttttttgcctgttgatggatatatgaacgagtttgctatctagaatcgatagaataagctttgaggttatataagatatttggattggtttctggtgaatccattatttgtacaagtttcatggtcgtaagttgtaataactgtatttcttcataatcttctgttatagttgttttcatagaactcaatttgattagcaatatttgtcgaatcctaaaatctgaaattgcttgaggattatgagattccatatttctcaaagttaaaagataactgaaagaatcaatgatcaggtcctgaccagtgccacttgattgatatatagttgaccttaattgaaagtttgaaacaaatcccatcataagatcataaaaaatatagttatccagttaacaattaaaggacaccgtttaagtaactgctgcagacagaattgagattaagtattgacccgaatcttatcttcttttctccggatacatcaactacaacaacaaccaggtgcaaaagtatgttgagtaacaagtttcccaacaatgttttatgctggattctgttgtcaacaaaagtgaggttggattttgtttttctctctcaaaagattgtgtatatggaagagaatacatatggaatttacgaaaaacaagagattcggcttggcaaaagttacttggaataggagatttgctaattatggttaagttttcatgaggcttcctcattttactcacatcctctctccttccttagcacagagaaatttgttgtcgcctagctttttccaagttgtctctcgtcttcctccacctcctcatttttctctgtttttttgttcgttgtctctcatttttcccttattaaaaacacataactccttctctctcctcacttctcggacatctgatttcttaaacccgtatccgtctggtttctatttccttcttgcctcccctccgtg

SEQ ID NO: 7114 - DNA, 3000 bp, Unknown
  misc_feature (1)..( 3000): cDNA_ID_1816768_gDNA_ID_1621128_Annot_ID_56398 3000 nt of promoter + ATG
cagagtgagacaaaagccatcgacactagcaaaaactcagacataatgccgacattatgtaaccttgtcgcctccttgtcatggcgcaacgctactccaacaaccgatatatgccattgggctgatggatacccacttaacatccatctctatgtggcgcttttgcagtcgatatttgacatacgtgatgagaccttggttcttgatgaaatcgatgagcttttagaactgatgaagaagacatggataatgttggggatcacacgagctatacataacttgtgtttcacttgggttctgtttcatcagtacattgtgacatcacagatggagccagacttgcttggtgcctctcacgccatgttggctgaagttgccaatgacgccaagaagtctgatcgcgaggctctttacgtgaagctcttgacctcgacattggcctctatgcaaggatggactgaaaaaaggtatttctttttgccttgtaaatggacttgatcacacaaaactgaatctgattgtgaatgtgtgattataggttgttgagctatcatgattattttcaacgagggaacgtgggattgatcgagaatcttctgccattagcgttgtcttcttctaagatcttgggggaggacgtgacaatctctcaaatgaatggtctagagaaaggtgatgtgaaattggtggattcttcaggggatcgcgtcgattactatataagagcatctattaaaaacgccttctcaaaggtaatagaaaacatgaaggccgaaatcgaagaaacagaggaaggagaagaagaagcggcaactatgttgcttcggctagctaaggagacagaggatcttgctttgcgcgagagcgagtgttttagcccgatacttaagagatggcacttggttgcagctggagtcgcctcggtttcgcttcaccaatgttatggttccatcttgatgcagtacttagctggtcgatcgacaatcactaaagagactgttgaagttctgcaaactgcggggaagctcgaaaaggttcttgtgcagatggtggcagagaattcagatgaatgtgaagatggcggtaaaggccttgttagagagatggttccgtatgaagtcgattcgattatcttacgactactaaggcaatggattgaagagaagttacaaacagttcaagaatgtttgagcagagcaaaagaagctgaagtatgtttattaaagctttacttgcagttcaagtatacaaaatgtatcatctatacactcaatatttttttctgtagacatggaacccgaaatcaaaatcagaaccctatgcacaatctgctggagagttgatgaagctagcgaatgatgcaatcgaggagttctttgagatccctattgggattacagaggatcttgttcatgatcttgctgaaggattagaaaaactcttccaagaatacaccacattcgtagcatcttgtggtaagtgaaaggatacaaatttctcatttcatacaaaccattggttactaattggtgattgttttgttttttgtcaggttcaaaacagagttacattcctacgcttcctccacttacaagatgtaaccgagactcaaagttcgtgaagctttggaagaaagccacgccatgtgctgcctcgggagaagaacttaaccaaatgggtgaagccccaggtggcaaccacccgcgtccttccactagccgaggaacccaacgcctctacattcgtctcaacactttacatttcctaagctcacaacttcactctctcaacaaatccctctcactcaacccgagggtcctccccgcgacgcgaaaacgctgccgcgaacggaccaaatcatcgtcttatttcgaattcactcaagcaggaatcgaatctgcatgccaacatgtctctgaggttgcagcttaccggttaatcttcctagactcatactctgtattctacgaaagcctataccccggagatgtcgcgaacgggaggatcaaacccgcgttgcgaatcttgaaacagaacttaacgttaatgaccgcgattcttgcggacaaagcgcaagcattggcgatgaaagaagtcatgaaggcttcattcgaagtcgttttgacggttcttctcgcgggaggacattcccgagttttctgtcgaacagatcacgatttgatcgaggaagatttcgagagtttgaagaaggtttattgcacttgcggcgaaggactaatcccagaggaagtggtggatagagaggcagagacagttgaaggagtgattcagcttatgggccaaccaacagaacaacttatggaagactttagcatcgtgacatgcgagtcaagcggaatgggtttggttgggacaggacaaaaacttccaatgcctccaacgactggacgatggaacaggtcggatccaaacacgattttgcgagttctttgctatagagacgatcgtgtggctaatcagtttttgaaaaaatcgtttcaattgggtaaacgaagatgacacaaaagagaaatagtcaaaagaatgtcatctcgctaagacgtgatctgttgtatattttgagattaagatgttacagaaccaaaaaaaattgcttgttcattagataaatgagaaaaatcttgaaaatgtaatgtttttggtttatacattaaacccggtttagagacaaccgagagcgtgtcacccatgatctaacgacatcgtattgtcgattcgatgccatcaatcgtataacttgaccttccgttccctctctccaacctatcgtcgctcgtaagcttctctcagttcttcttccgcctatattcaattagggttttgaaatttgtgttaaagttcggatttttggagtagtagcttgtgtttggttctctgaaattgactagaattcatcaatgcttcaagtcctgtgacgaaattttatctcgattctgattgattacatcacaaaagtaaacatttttcgatgattagtga

SEQ ID NO: 7115 - DNA, 3000 bp, Unknown
  misc_feature (1)..( 3000): cDNA_ID_1816759_gDNA_ID_1621128_Annot_ID_56401 3000 nt of promoter + ATG
ataatgacaatgtcactagcccctaatgatgttcatcagaaccaaatccagtttgcgttagaaagaggaatccctgcttatcttggtgttttaggtaccaaaaggcttccttacccgagcagatcattcgagtttgctcattgttctcgatgtaggattgattggcttcaaagagacggacttcttcttcttgagctcgatcgggtactaagaccgggaggttatttcgcgtattcgtctcctgaagcttacgcacaagatgaagagaatttgaaaatctggaaggagatgagtgctcttgttgaaagaatgtgttggagaattgccgttaaaagaaaccaaactgtggtttggcagaaaccgttgagtaatgactgttacttggagagagagcccgggacacagcctcctctctgtcgctcagatgctgatcctgatgcggttgcgggtgtttcaatggaagcttgcatcactccttactccaagcgtaagtatttgcttcttttttctgttccgttggttattttgagttttgaggaattaggaccagatcttttgttttgtatgccatatgtcacagtcatgctttgttttttttaaatacagatgaccataaaaccaagggaagtgggttagctccttggccagctaggttgacttcttctcctccccgtcttgcggatttcggttattcaaccgacatgtttgagaaggacacggtactataactgccatcttttcgcaaccattgatcttacttaatcatcattcttccacagatttattgaaaaagcacattgctttgcttatcttctttgtttacaggaactttggaaacaacaagtggacagttactggaatctgatgtcatcgaaagtcaaatcaaacactgtgaggaacataatggacatgaaagctcacatgggttctttcgcagctgctcttaaagacaaagatgtgtgggtgatgaacgttgtctctcccgacggtcccaacactctaaaactgatctacgaccgtggtttaatcggaacaaatcataactggtacacacccgaaacctgaaaatcgaaaacattctctcacttgtcacactagttcatattttcaccattctttttttttgtttccggttttaatttaggtgtgaggctttctctacatatcctcgaacatacgatctgttgcacgcgtggtctatattttcagacattaaaagcaaaggatgcagtgcagaggatctactaatcgagatggatcggattcttagacctacgggattcgttatcatcagagataagcagagtgttgttgagtcaatcaagaagtatttgcaggctttgcattgggagactgtggcatcagagaaggtaaatacaagttcagaactcgaccaagacagtgaagatggtgagaacaatgtcgttttcattgtccagaagaaactttggctcaccagtgaaagccttagggacagcgagtaaaaaacatatcaaaagcaaagagagagaaattgttttatcccacaaagtttttatatagttttattttgatttttgtagttgatttgtacgacataaagcattattatataaaatactaaaattattcattgtttcttactttcttgaaatattctttaatttttctgtttcgatgtttcttatgtattatgactgatcttatcttaagtcttacctctttttagcatttacgttttcaactctttaggatatgtcgtattatgtgttggctataatgtgtttggttagaatgttaactttggtgtcggcataatatgtttaattattgaagaaaaagtaaaacagattataaatttaaaaagcatagacttttggataatttcataattaatagaagaagataactattgacaaattcaatttagatgttgattagttcaacaaaaaataaacttagacattagtttgttctcaaaatgagaaaaggatcaatattattgatttatttctatgaccatttaaagaatgtttacaaatgtggttatctatttgattaactatttttttttttttgaataattgggaaaactgtgaaattttaataaatgccgacaaaaagtaagaaaaacaaattattctctatatagtatatactattttaaaatatagatggtacagaagtaaaaggcatccaattcgaaagtttaatatgtaatttatacaagaatttaatataactaatgatgggacctattgtttttatttgttgttgtattattatatggtgacttgactaagatgttttcttctaataataatgccaaatgaaaaaaagataaggtaaagcttaatttacataaattagcatgtgggaagagacttcacagtttatacaaataagtacgcaactattagtagttgttgacctttttgtctaattcaacaagataagcctctcttctacttttgtgaaattttccgtaatcaaatccgtaatcagatttccccatcaatcgataattttctctcgccgcgttttctatttttctcgctcttcccttttaattttcatcccattttcttgaaggagatttctaattattctgtgatctaaagtctgaagctttgtttggttgcatctcgatgatgatgatgatgatggttgattgtaaatgggtagtttcggtttggttgtagcagaagctaagtttgtcaagttaataagagtattttagttttttttttgttaaatcgatttgtgggttcatcatcctacgatcgaaagtttccatctttgataatttgagattctggggatttttactagaatttctagttttttttttggtttgttgatttcgtagctagaagaaatcgatctaggtgtgtatatatatatctattcaatcgaattttagtgaatcgattggcgatcttggtgagagtaatttcagagagatcaaggttactagagcaccaataaaaacacttatttggattgggagatagaaaaatg

SEQ ID NO: 7116 - DNA, 3000 bp, Unknown
  misc_feature (1)..( 3000): cDNA_ID_1816751_gDNA_ID_1621128_Annot_ID_56403 3000 nt of promoter + ATG
acggtggttcatgaactcgattctggtcatgcccacttttgtagaatccattaaatatctaaagtctatatggcttaaaggtgagaacttgattctcattagtcattaccaagtagaatctataatcaaaatccactgcttttactttacaaaaggaaaaaggtaaagataaaaaagttctctcaaactttgaatcctcgtataccccttattaatggaccattgcctacggtttatgattcgatttcggatagtcgtaaaatagaagcaatctaagttttttggatgtatattttggtgtcaacttggtgtttggttataaaatatttgggtgaagaaaaatagaagtaaaattaaaataatccacattagaatttcagtttaatctagtgatttggttttggtatgaatctgcaagagtagcatttctttttgcaattgcaacacaataacaccattcctcacaaatcacaattgcacaaacccattatcgaagagctcatcaattttgggctaattgctaaagcagaaaaaaataatcgcaaaagataaccatgcaactgccaattttcttcttttcatgggtaaaccaaatcagacacattgaaaaaaacgatatcctggtttagaaacagaccagggacaatactcatcaaagagaccaaagaggttataaaacagtgtttggagatctttcaaacacacttcttattcggacaaagccctgaaaggctttaactgatctcacaccttatagatgaaaattttgctccagaagggtttaagagaggcatgagtacgccaagtccttctcttccttgagctcctctgcagtcaaatccatcttcttccttgatacttcatcaatcggaaggcctaaccaaacaaaatacacattagggtctgcagaatctaggatttcataattgatgagcatttgagtttgtaagtgcgtcatatttaccttggacaatactccagtctccattgcgacaagttacagggaaggagtagataagtcctgatggaacgctgtaagagccatcggagtatactcccatggaaacgaacgtaccctgacaatttgaatcaaagaaagaactcatattagattaactgttacaaaaaaacagcactgcaaataacggggaagagttttattatgaacctctggagttccaaggacccagtcacggatgtggtcacaagcagagctagcagcagagagcgcactagacaacttcctcgccttgatgattgcagctccacgttgttgaactgtagagataaattctccgtccaacctacagaatgagcaatatatttaagtgaaactagattttgcttccagagaagagaaagggtcttaagttctatggcatgttatacataccatgcatcgtccttgacgagctcacggacaggcttctctccagacgaggtctgcactttagcatggttgacatctgggtactgtgaggatgagtggtttccccagatgatcacgttcttaacatcagacactggcacgctcaacctctcagagatctgtcccaaagccctgttgtggtcaagccttgtcaaacaagagatgttcttttcagggattgatggtgcaaattccttgaggatcaatgcgttggtgtttgccgggttggccacaacaagaacctgaaaaaaaaaagacaaaacgagagcgaatgtgtgagcaagagagtcgtaaactagaacccaatagagaacacaaagcatctgttacactccaatgaacagagaagattggatgcagtggcttcatttaacttaaaaagcaaacagatcgtatcaccttgcagttaggagcggcatgcttctccaaggcagcagcctgagacttgtagatggaaacattcttggacatcacatccttcctctccataccttctttcctcgggaaaccaccaaccataacagcaacattgactccagtacatccctcaacggcatcagttgtagcaacaacacctgataataatacacatcaaatattcatcttctcctttcccacttatacaaaacaacttatgacacggaatgcaaatatccacagcaaaacaaaacccttaactacctttaagaagagggaaagcagcatcgatcaactccatcttaacaccgttcaaagcttcagcagctggaggaatatccaacatgtggaggataacaggttggtcagcaccaagcatgataccccttgcaatcataggtacaagagcatatccgatttgtcctgcataatcacaatcaatagttactttcagtagctgaggagatctaaagtcacaacttaaactctatccaactatataaacaacggtttctaaatcagagttcgatccatgaaataacttttactaaaattagatatgcgaccaactcaatcaatcgttggtcagcgttgaatccaacggaacaagagttgacctatatttcattgatctatggaacaaccagatactatgcagagatctgactagattcagcaagcgattcactagccagagatctagaagttacacgatctaatcggatatagatgaaagttatacctgcagctccagtaacgagcacacgaactggttctttcgccatcggatctagatcggagattatcgccggaaaacggatcgaatttgggatattcgacttttgagagagcgtagagtcagcttttgtctgaccgtgaagctcactcttgcgtatttatcgaagatatcgaaggatgtaccgccacgtcatctaatataatcatattatctcgaagaaataaatcgaaatctgagattagacctatcatattaggaaaacaagatattattcaatatatatttttgactctaatgggcctcttacattaggcccaaatcgtttagcccagagtattcaaatacgtgaatcaaaacagtagataatggtggcgataaggcgagaagaaccacgtccacgacaacctccggtatg

SEQ ID NO: 7117 - DNA, 3000 bp, Unknown
  misc_feature (1)..( 3000): cDNA_ID_1012835_gDNA_ID_1621128_Annot_ID_56404 3000 nt of promoter + ATG
gctgcgttttgccgccggatctgatgaagaaagagagagggacaagaagagacgagagtttttaaagtttccatttacatcttttggattatgtttttaacgatatcggaggctgtgtgtattactatatatagagaagctttctttaccgttgagaaaaagtagtaacggatagtttctgaattttgaagtaagttaccgtttctaagttaccgttcccgttctgacatctcaacggttaaatcacagttaccttgtccgcaacacgtgttacaattaaaaaagttttattcttgctgggctgtcgagaccggcccaaacccatcaatttgttttttaatttttacatgtccgatatgaggcttaaaggataaactggatttgatttaaggtccattatatagatcaataaaagcgttcaaacgttatgcgcaactgtggtacgtcattacatgggagttctgtatatccgtcatatcaaaacaactgtaagaaagcaaatcaagctatatataacttatggactttcaccgtgagctcacaaactcatgagaaaccttcttttctttcaaacgaaagaagggtctttgaacctcttgaaaacggcgtcaatgtctgccataacttcctgcgaaaacggccgctccgtcatcagaaaagcatcaatgtcttctttaagttgttttaccgatgtggccccgatgatcgtgctcgtcacaaagggcctgtcacgtacaaacccgagtgctaactcaaccggagttaaaccgtacttcttcgccacctcaacgtattgtatggttgcttcctgaaatcagaacaaagataaaattgacctcaaaacacttttacgaatatggctttacaactagattcgagctaatactgtttcttaaattgttttacgacataagaagaagtaagcatagttggatcaagaagaaaccttggctagtgatcccttgtaacgttccatatatcctgggaaaagattcagccttgcattttttgtagcttcttggtctgtagccaagtatttcccagacaacgagccgcctccaagaggggaataagcaagcaagccaacattgcaattttttgggtggcatacttctaccagatcaactgtggttttaacccaaaacaaaagagtttagaacatgctcctccgacacacttgctctcaaggtattctagaaagatttaccttcataccgacatctaactagcaagctgtaaccattctggatgctcacaatctttggtagtccttcgagttttgctgtgttaacaaactccgtcactccgtatgaagtttcattcgagacaccgatatagcgaacctgttgcagaattcgaggaacacttcaaaactctgtgtttgaggttatataactcaatataacatctgatttttaaggagtagcactacctttccttcaactatgagatcctgaaaggctcttagttgctcagcgaatggcacactaggtctccatttcgacgtttcatagtaaaaatcaccgaagagtggtacgtatcgatctggcctggactgaaaaaaagatcagtgtcatgattttctgacatttgatgatgaaaaacgaaatattttgcgcatgaaatagaaagacacttgctcaaacaatgtagaatatgagttaagacataaagcaaaaataaggcgatgttaccagtgtatttgaagcaagtcaatgtaatcagttccaaggcgcttaagacttttctcaacactttctttgatattagcagcatctacacgcagaatctcaccactgtcccttatgtaagctgacctttctgagtacccacatactttagttgccaaaactatctgtatacagaaacaatgaacatcaatatcaatttttataacttcgattaggttttgctgatatcatatacattcgtgaccaatatgcatccaaagtatgataaatggttgataccttgtcacgttgctgagacttcaaccagctactgatataaagatccgttttaccttgcgtctccttcttcatcggtatgggatactggaaataaacaatgatacttgaaaatttaccacagactaagcagattccagaaagctaaacacaacagtgctaaattcaccagaattatatataaagtataaaacattcacataaacacttgcaatcaaattcaccaggcaagaagagaaagatgaacaatgaagataaaaactcacagcttcagcagtgtcaatgcaattgatgccctcttcaattgcataactcagcatctcatgagattctttctcagtattttgctccccaaatgtcatctgaaattccaaatttcatcaaaacttcaaaattgaacaatggactacaattgcaggagataaagagagattgttcttacagtgcccatagtaacttcgctgatgttgagatcggaatctcctaatttcctatactccatagcattcttcgtcgacgctttcgccgaaactctcaatattctcctccgagcattcggcgatagagtaacacggcggcgcgtgaatgccaaacgaaagactcctcgaatgttactgctgctgaccaccggagtgaccgttgagtaggtgacgtaagatgacgccataccggaggttgtcgtggacgtggttcttctcgccttatcgccaccattatctactgttttgattcacgtatttgaatactctgggctaaacgatttgggcctaatgtaagaggcccattagagtcaaaaatatatattgaataatatcttgttttcctaatatgataggtctaatctcagatttcgatttatttcttcgagataatatgattatattagatgacgtggcggtacatccttcgatatcttcgataaatacgcaagagtgagcttcacggtcagacaaaagctgactctacgctctctcaaaagtcgaatatcccaaattcgatccgttttccggcgataatctccgatctagatccg

SEQ ID NO: 7118 - DNA, 3000 bp, Unknown
  misc_feature (1)..( 3000): cDNA_ID_1816720_gDNA_ID_1621128_Annot_ID_56413 3000 nt of promoter + ATG
aatccaaaatttaccaaagaatattaaaaaaatcaattaccaacatagaaaattacaaaatatcgaaaatttcttaactcttgtccttttatctatttggtcttcaaaaatcaaaattctgttggtggcagtttttttcccaaacaaaccattgttgcagtcagttgtatgtttggcattgttcgtaacttttgttaatatttcaataaatattaattgtgttataaaaagcaaaagaatgataaagacgatatgaactttagaccaaggagataatataacttttttttccctataccaactttagactaaccaacaccttgattacctatttattttcttgagagattttgtgtgccacatataatggaaagaatcatattctagtttaaaacaaaaagcaatatgtctttgaataattaattaatctcctattataattatcacaaaaataattagcggtttaggttctctagaaataacctttattcaaaactgaagtcagatacgacaaatttattgatgtgatatcatattattttacgcatattaaccttgtccgttggatttgtaaagttgtaacggttggaacggatttgcaagacaatttttaaccatgtatatgattttttttacaaatagtaattgcatgtttgaggtatccgataagcttattggacagcataaacctgaatattaaaaaaataggtttgaagtaaaataattatatctattttacaacaagaaaaaaatgaaacttaacgaatctaactaacggttctaattcataaccccagaaaaaccttctcggaccaatttttaaaaatcactgaaaaaaataatatgatccaacaaaagaaaacggcttaaatcccaaaatcatataaaaactaattgataaaatacaaaatgtggctaattctagaatcctacaatagataaggaaccaaaagttgtaaggaagaatgacaaaggtaatgcttggagacatcagaagctcttctgaagcctacctgcctttgtgtgtggaggagaagagaagaactctaagcagctttaggcttgggagtcctcttcttcagaatcctcttggagctcgttgttgaattcttcattccgatgaaaaatagcaatgccccgagaagcgcaacactctgtgataaaacattgattcaaaagaatgagaatcatagaagaaggttcagaagagccataaaggaatatactttattcagactaggttcagctcgaagaacatggcaagagcaagccaaaacgaataaatgaagaaaggtgtatagacaaacctgcaagaattcagtcaatagaagagagaattggcggtcctcgggtccatagttgtagaaatcatataaaatgggactgacaaccaccaagtagacagcctaataagaaacaaagaattgaaatccaaagtcaatacaacaacttaactttttgaatacttaaacaaaagtgaagaaatcctaaccagaagataggcaccaaagatgttgccgataacaaagagtaagcctcctaggcctttcagagcaacaatagcccacacgacttgtttcacctttcaaaattagttttccaagtcagacgcaacatatatatatagacagcataagagacatgaagacaaggaatcaacgcaatgggcatacctctaagttgggcaatgatactcccaatatggaagagagatgtgctttggtcagatcaagctttggagctaactctttagctgctggaccaccgtcagttccaaagtcattgaacctaataagaattccagagaagcatagttcggatttcgtaagataatcgacaaggggatacttataaagcctctacacatatgactagtaaactttcaagcaaacagagatgtgtatacaaacaatttagagagctaaatggtgtttttcaggatggaattggactagcagaacctagaaaccaatccaccgtatctcacttcaccatatatcagacacaaatagtgaagaaacagactcttggtcatctaagtagatagagatcatatgaacaacagagctattaaaaggctcaagatcagagataccacagtctcttggaagctaactctattttaaaagccttaaagagaggttctcaatcaaatcggatctagcaagataaaatcaagcaagggattatttagacaagccctagatttaaccctagatgtcgcttagaccaaatcaaacagtttagcggaagattctcaatcaaatcggatctagcaagatagaagttcatcgaagaagatgtcgaaccctaatccaataaccggagaaacgagagaagagatggagggaataaagaagaaaagactcacatttgccaagcggagaggatgaataaagaagcgaagagaactcttccaagaaaagagaagaaacccattttctctatgtctccttgtgtcgttctaggtcgcaggtggtctgatttgtcgtcggagagacggatcctttctcggtgttagcttaaacttcggttcctctgcttttgtctttttttttttcagagagaaaaaagattaatttatataattaaccaattaaaggtggaaaagaaaagctaaaccgaattgaaccgaagtatctaaattaaaatttaaaccgaatttttatcatttttaaaactcaaccaagaagaagatgaaaaggcaccgtcatgctgacataagttccagtcccaatcaacaaaaccggacatacgtttttgatcaagctagagcagaatcaattgatcaagaaccaaactaaaccagcagcaaaacaggacgtacgtttttcaaccatacaattctcaaattgtcgtttctatcttgtcttctctcaccacaagaatgcaaaaacataaatccatttttcttgataaccttcttcttcttctttttgtatatgtatgaagcagctttttgtgaatgaatcttcgaaataggttaaagaaacaaaaatg

SEQ ID NO: 7119 - DNA, 3000 bp, Unknown
  misc_feature (1)..( 3000): cDNA_ID_1816716_gDNA_ID_1621128_Annot_ID_56416 3000 nt of promoter + ATG
aaatctttctcttacttagttttgcaaaattatcacattaaatgttttacaagataagttggtgtagtagttgttttgcgagtgtgagttcggtttatcttggtatagtataacatcatccggtttactaaggctttaagttgttgggctgtttagtgttcaaacatttgattaaaccgattaaaaagctactatacattaacagccaagggtcgaagaataaacaagacagtgaatttttaaagctgtcgtctgatccacagataggtgaaagtttgatttcgttattaattagtgggaaacaaatggagatttgctgaaacgtactctcgataacagttcatattcaagactcaagagaatctcgtatattctaaggaagacgtacctaaacagaaagttggtcccaaaaaacgagagaaggaatgaaagatcaaggatacatgttttatatacatgaaaaatactaaattttaaaagaagtattaaacgtttttataatgtcaccggaaagaagatgtaaatgtattgatcaaatcatctgactataaaagtaattcaaatcaccatttttttaaatcaatttgaatatttgatgaatttccgtatataaacaatcagtcccgctcttgctgtataaatgaaacgtctatcaaacattagctagtcttgtactggattgcctttacagacaaaagattatactgtatatgtatgtggtctcatgcaaaaaaagtaaaaatgattctgtgtacatctgttttgatttgcatatatattggcttaagtggcaaaggtgcatgcactatttctatttctttgataaaagttttatgatgcatgcattcttaccagtgatttctttaaaaggagaagacatttgttttgtaatagtgacgagaatgtagacagaaaaggaaaggaatcagcacgtgttcatcgctcgacacgtggccaataatagcattggattcagaaaaaaagaaaaagaaaaaagcgaaaaaacctgtataacaggaaaaaaatacaatctgcaccagccgggaatcgaacccgggtctgtaccgtggcagggtactattctaccactagaccactggttatttatttaaaagatttatattggtataaaaccttgaccataaaatgttcctagtgcatccactaagatcaaattcatattaataaacaaaaacataaaattcaaaccgatatagcaagattgctgttagttttgtcttctaaatctgataagtgttcgttattgtcgaggttatgtagctagtttatatattacttgtactaaatttcaatagggcaatcaaaatatacggattttcatgtgtatatatttttctaaatttgcggtttacaaagaaaagttagtggttgatcatattgatttcttgaaagggaaatattaccaataaaatgataaaattgccaagaaaaattagtagtacgatcgataatttagtgatattgggatccaaagagatgatcatgcacttagttaagactccattttctgataagagttaagtggcggtagacccacaaagaaatttgattcggtattgttattattgagtagaaaaacaaagatggagtgtttaactaaatcatgtctaataagtagcaaggtaggtcaatataacgttttacaaacgaaaaatagcattgcatatttaattatctaccaaatatcttaagtcagtcgaataaactaactcattatgttatcaaatcagccgcaaattgtgccgtttaagtcaatactatttttaacttagatatttagtgagtagacttcatacttgcatagtctagtagttatcattgtttaatgcaattttttggttttaatgtaaacttatactactatttggtcatgtaatctcactttctaaaaaaccaatgtaatcatccataatagaaataaaacatttatttaatataattaactaatttttaaacattaaaaagaatagatttatttttatacataaaataatagaaatataaatatatatatatattattataggttgtttattgtaatccaaaagcagaataaaatttgggataggtattaagagtcataaatcttgaaaatagagtcattaattaataaagctgaaaaggaaagattaaaaaaagaagaagaatcctctaaaattgaatttggtaagagtccacgtaggtcaagaagaagaagaagaagatgtcgtgctcgtgttgtgttccaaacgaaaagcgtctatgttctcttcatgtaccgtttctgggtcccacccccctttccttcttcactctccccccaattcctccctctctctctctctctctctctctctctcaccaaaacgtaaatctactctctctatcgcagcagacacagaaaaagagagagcgagagactctgctcacacacatatttacttccctaacttgtctctctctctacacattctggtgagtttcgtaagattcaacaatcgtttagacttcttcttcttcttcttctacagcttttacgttttctggaaaagagatttttggctgatcactacgttgcaggtatatgatttctcaaatgtgagatgggtttgatgttccttttcgctatttctcatctgattttgaattttctgcggattttgtgaggaatcggtagattttgatgtttgttcttgtgggtggttcataacttcatacatttaggggattaaaagaaaattaatttacaaattcggtccttgttgtgaaaaagatttataatctaaaagacattaactttactctctccttgaacaagttttgaattttgaatctttttctgattttgattttcactatgttcataggtaattgcacaattctgggtatacaaaatccaaacgttacgcatattgaattgaaaaatctcgattttgagttctgggtatgaataaaaatctcacctttttaattaattcttactcagggaaacagtaatcg

SEQ ID NO: 7120 - DNA, 3000 bp, Unknown
  misc_feature (1)..( 3000): cDNA_ID_1816712_gDNA_ID_1621128_Annot_ID_56417 3000 nt of promoter + ATG
caatgtgccttcaccttacaattgggtggtctgcgagtttatagccttcattgttctctgcggcatgacccatttgctcgctggtttcacctacgggcctcactggccttgggtcatgacagctgtcactgtcttcaagatgctgactggtatcgtctctttcctcacggcactctcgttagtcactctcttaccattgcttcttaaggctaaggttcgtgagtttatgttgagtaagaagaccagagagcttgatcgtgaggttgggatcattatgaagcagactgagacgagtttgcatgttcgtatgctcactaccaagattaggacgtctcttgatcgacacaccattctatacactacgcttgtggagttgtccaagactctggggctcaagaactgtgcggtttggatcccgaatgagatcaagacggagatgaatcttactcatgagttaagaccgaggattgatgatgagaatgagaatgagcattttggtggttatgctgggttctcgataccgattagtgagtctgatgttgtgaggattaagagaagcgaagaggtgaatatgttgagccctggttctgtgcttgcctcagtgactagccgagggaagtcaggtcctacggttgggataagagtccctatgcttcgggtttgtaactttaaaggcgggacaccagaggcgattcacatgtgttatgcgatattggtgtgtgtgcttccattgagacagccgcaggcttggacttatcaagagcttgagattgttaaggtggtggctgatcaagtggcggttgcaatctctcacgccgtgattcttgaagaatctcagcttatgagagagaaactcgctgaacagaaccgagcgcttcaggttgcgagggagaacgcactgagagctaatcaagccaaggctgcgttcgagcagatgatgagcgatgcaatgaggtgtcctgtgcggtccattctcgggttgcttcctttgatacttcaggatgggaagttacccgagaaccagactgttatcgttgatgcaatgaggagaaccagcgagttacttgtacagcttgtaaacaatgccggagatataaacaatgggacaatccgcgctgcagagactcattatttcagtttgcattcggttgtgaaagagtcagcttgcgtggcgaggtgtttatgcatggcaaatggttttggtttctcagctgaagtttatagagcattgcctgactacgtcgtaggtgatgatagaaaggtctttcaagcgattttgcatatgcttggggttctaatgaatcgaaagatcaaagggaatgtgactttctgggtttttccggaaagcgggaactcagacgtatcagagaggaaagatattcaagaagcggtttggcgacattgctattcgaaagaatacatggaagttagattcggattcgaggtaactgctgaaggtgaagagagtagtagtagtagtagtggtagtaacctggaggaggaggaagagaatccgagtctcaacgcttgccaaaacattgtaaaggttggtcatttgtgttttgtatgtaaatgtgctaatgacttggtttaacacttttatcttgttttgtgacagtatatgcaagggaatattcgggttgttgaggacggtctaggtttggtgaaaagcgtctcagttgttttccggtttcaactccggcgatcgatgatgtcgagaggcggtggatattctggagaaacgtttagaacctcaactcctccgtctactagccactgatcattgacgtcaggaagggggggaggggaatgtagtgcaaaagaaagatttaaggggtggaatctgagaatttgtaaaaacagtaggggctttaatgagattaacagagagagtactaaaacgttgtcgttcggttgtaaaaacctgaaagttaactaggttttaacctatcgtgtaggcaaaaggtatgatgcagacttgttgtaacttgctggtgataacagaattcaaagtaaaaaaatgtgtcggaggatgttccttacggatttgtgatttacaagcctaccaactcctttgtcaaatattgtgacgttttagatgaagcttataaatttattgatttctgatccagaaaccgtatacaacttgtatccacaatatgtatccaggtacatattaacttcgaccttttaattaacttttgtttttaaaaggtttatgtgattttttttttttaacattgaggtgattcgtgcgacctctctttctctctatttatctctctttcttttcctccgtcgtcttttttggtttgttctctctctgtagaatctcataggagctgccattagcccattcaacgaattagcttctctttgctctttcttccaccatctcaggttcgcttcgatctacaaccaataagcttcttctatatctcctcctttgttcttcggattttgcgaggctttatgttccgattacagtctttcattttgataccacaccgattttgattttccccgatcgttgatttcatctgggctttgttttgttttccgatgtctttgatgaaattatgaggtttctctggatattttagctgattgaaatgatatattgcttcgccgccctctaatttttcggctgatttttttttgtttgtttgtaattttaccaatctaattttgaaaattggaaattagggtttattgcccatcgattatctgatgtgggttttaaagggtttcgattttttagccatgaattcgttatactcacggataaaatctagaaatgattgcggattggtatagtttgagagagccagatcgttgaatatctttgtccatttcaaatcatgacttggcatattgttttctgggtatacataattgtggggattacagaattcaaaatctaatttatttgctccaatcgttaattgctgatagttgaaggagagagagagctttgacgaaacaatttcatactgggga

SEQ ID NO: 7121 - DNA, 3000 bp, Unknown
  misc_feature (1)..( 3000): cDNA_ID_1008621_gDNA_ID_1621128_Annot_ID_56418 3000 nt of promoter + ATG
ttgtttttgttcttcgatgcaaatctaggatggcaatgatggagaagaggtcaacaaggaagccgatgagcgtgatgagagacgtttaactgaattgggtagacgaactgtggagatatttattctttcccatatcttcaggtaacaatgtgtaatatgtttctatacggtatgccattgtgttcttccttgatgtgcttacatatattacttccatatctctgagaactgcagcactaaaatcgaagttgcacatcaagaagctatcgcgctaaaaaggcaggaagaacttattcgtgaggaagaggaagcgtggttggcagaaaccgaacagagggccaaaagaggagcagccgagcgagagaagaaatctaagaagaaacaggtgtgagactttcttctccttctgcttgtcctgtacaacttgttggatgctgatcggagtttctttggttcttgaatatttataggcgaaacagaaacggaacaaaaataaagggaaggacaaaaggaaggaagaaaaggtgagttttgcaacacatgcaaaggatctcgaggaaaaccaaaaccaaaaccaaaacgatgaggaagaaaaggattctgtcacggagaaagcacaatcttcagctgaaaagcctgatactcttggagatgtgtccgacatatctgattctgtggatggttcggctgacattcttcagcctgatttagaagatagggatagtagttctgttctttgggatactgatgccttggaaattcatcctccatcatcagaagggagcagtagaggaagaggcatttcgatatctacacccaatggaattacagaaggaaagagtcattccactatggatgatagttcttcaacttgttctaatgattctatccgatcgggggtaaccaatgggtcctaccaagggaattccttgaatttccgaaaccagaagtcgccgaacaagtaagtttgtttcggctgtcctttgtttcttgtcagtcctgaatccttagtgatacgctttgtgacttgcagaggaaagaaccaacaagtgaaagcaatgactgatgcccacagtttagcgagtgaaacagatgatcaaccctcaacacttggaacagaccccaagggtcagaattattcttccgaggcaagcaacgttggtgaatctgattgggttgttgtctcccacatccaggagccagagggttctcgaaatcgtattcctgttgggagggttcgtcattcatgcttttaatgttttgaaattagaagatcgctgattgaattattggtttcgtgcaaagaggtccagaatttcacaatttagttgtccctttttcaaattcattttgcaggaacgcaaaacggttcaatccattgtgaactcggtcgacatggatcgacctaaagagaaaagcactgctgtactttcttctcccagaaatgttgccaagaatccttcaccattaactcagacaaaaccggagaaaaagagcatttcaaccgcagacggtattccaaacaggaaagtactggcaactggaccaccttcatcaagccaagtagtgcttccttcagatattcagtcgcaaactgttggtctcagagctgatatgcaaaaactctctgctccaaaacaaccaccagcaacaactatatcaaggccttccagtgctccaataatccctgcgatgcgaccctccccaatcaccgtctcttcctcagttcaaacaacaacatcccttcctcgttcggttagctcagctggtcgtctaggtccagatccatccctacacaaccaacaaacatacactcctcaatcctataaaaacgctatagtcggtaactctcttggttcatcatcatctagtttcaaccaccacccaagctctcatggagttgtcccgaccacattgccatcatcatcttactcgcaagcaccaacatcatcttatcagtcaagcttcccttacagtcaagatgggctcttgtggacaggaagaagtcccagttctgtaaacatgggcatgtacaacaacacttactcacccgccgttactagcaacagatcgctgaaccacatggacgttcagatagcgcagcaacaagcacaaagcatgatgacggatgagttccctcacctagacatcatcaatgatctgctggaagacgaacagtgcagcaacatggtgtataacggaagcatattcaatccacaaccgcaagtgttcaacgggcagtactcatcataccatggtgagttattgtctggtggcaggaccaggagtttcggagaggaaggattgcattacatggcacgtggaccatatggtacagacggaatgatgccgagacagtggcaaatgacgaacatggacttgtcgttgccagcaatgaggagcaatggaatggaagatggaacatcatcagcagctaattaccatcacagttactttggtttggacgcttcgaatccaagttttacgtctggtattaatggctacaccgagttcaggccatcgaatggtcattgatcagcaaatggagagaggggatttgtaatgtttttattttttttaaaaaggaaaaaaaatcatgaatatacaatttgtgtaaagagagttgtcttcttgtcatcctctacgtttcaaatggtttttttttttttaaatatagtataagatagttttcgcatagaaaaactcttccctgaaagtccctgaatagtttttataaataaattatactcctctttatctttaatcaaaagaaactgaaatctgtctaatataaaatgtgtgtgtgtgtgtgtttttttgtctaatttatttttttctttctttgtctaatttgattagatcacttctttatttgaatgagtaaaaactagaaaaaaatgtgagccatttaaatctgattcatatcaaaaaattttcgatttaaaaaaaaaaccctcaaaaggtgttgatacggaaaaagaaaagggaaagaagaagaga

SEQ ID NO: 7122 - DNA, 3000 bp, Unknown; identical to SEQ ID NO: 7116
  misc_feature (1)..( 3000): cDNA_ID_2105637_gDNA_ID_1621128_Annot_ID_172384 3000 nt of promoter + ATG

SEQ ID NO: 7123 - DNA, 3000 bp, Unknown; identical to SEQ ID NO: 7115
  misc_feature (1)..( 3000): cDNA_ID_2126339_gDNA_ID_1621128_Annot_ID_172381 3000 nt of promoter + ATG

SEQ ID NO: 7124 - DNA, 3000 bp, Unknown; identical to SEQ ID NO: 7114
  misc_feature (1)..( 3000): cDNA_ID_1816768_gDNA_ID_1621128_Annot_ID_172378 3000 nt of promoter + ATG

SEQ ID NO: 7125 - DNA, 3000 bp, Unknown; identical to SEQ ID NO: 7113
  misc_feature (1)..( 3000): cDNA_ID_1816771_gDNA_ID_1621128_Annot_ID_172377 3000 nt of promoter + ATG

SEQ ID NO: 7126 - DNA, 3000 bp, Unknown
  misc_feature (1)..( 3000): cDNA_ID_1567547_gDNA_ID_1621128_Annot_ID_172376 3000 nt of promoter + ATG
caatcccacgttccctcgttgaaaataatcatgatagctcaacaacctataatcacacattcacaatcagattcagttttgtgtgatcaagtccatttacaaggcaaaaagaaataccttttttcagtccatccttgcatagaggccaatgtcgaggtcaagagcttcacgtaaagagcctcgcgatcagacttcttggcgtcattggcaacttcagccaacatggcgtgagaggcaccaagcaagtctggctccatctgtgatgtcacaatgtactgatgaaacagaacccaagtgaaacacaagttatgtatagctcgtgtgatccccaacattatccatgtcttcttcatcagttctaaaagctcatcgatttcatcaagaaccaaggtctcatcacgtatgtcaaatatcgactgcaaaagcgccacatagagatggatgttaagtgggtatccatcagcccaatggcatatatcggttgttggagtagcgttgcgccatgacaaggaggcgacaaggttacataatgtcggcattatgtctgagtttttgctagtgtcgatggcttttgtctcactctggcggatgatttctcggagacgcattgcaaagttgttggtcttctctagagggattgatgggtgaatgagaagaccagcttcaaggactttgagttgccgtctttgccaaatttgatactcatgtacatcaccaaactccgatggtttcacgtgacggagaagctctaacggaaggattattgtctctgctcgcctaccggtctaaaaaataacagttataaacattttattaattaatcaagaaacagagtttcattcacaatttaaaaacagagcaacttacttggccaacaagcgtcctcattagggttttccgtagccgagtgtcactctgttctgtcaccttcatttgctgcctcatgatttctgcagaggttaacggtcgtcgaggccgagcaggcgggactgtaaaaaacccagccccagggctaaagtgtcctgaaccacttcctatgcttccattattacctggggatgaaggagctgagacggcccctacaactgtccctactgtcgacattcgcctagaaggagatcgtttaagcatctttaaccctagcgcccgttttactcggcttgttggtgttgtcaacacttcttttcttcctaaagacccgaatccagagccgttagatgatccagatcctcctcctcctcctattccatccccttgatggtcaccagcattgtgcttggagtagaatgtgagagcatttctacctccaaatccaggtgatgatcgacatgcggcgaaaaagatctcatacgcggtttcacggatttcatcccgatcaagaccatcaagcttcccgaatggccaaagaagatcggtatcaggacaaacctcaaagccaaccatgtcgaaaaaggactccctccgagaatgacgaaccatcacggaggggaggcaagaaggaaatagaaaccagacggatacgggtttaagaaatcagatgtccgagaagtgaggagagagaaggagttatgtgtttttaataagggaaaaatgagagacaacgaacaaaaaaacagagaaaaatgaggaggtggaggaagacgagagacaacttggaaaaagctaggcgacaacaaatttctctgtgctaaggaaggagagaggatgtgagtaaaatgaggaagcctcatgaaaacttaaccataattagcaaatctcctattccaagtaacttttgccaagccgaatctcttgtttttcgtaaattccatatgtattctcttccatatacacaatcttttgagagagaaaaacaaaatccaacctcacttttgttgacaacagaatccagcataaaacattgttgggaaacttgttactcaacatacttttgcacctggttgttgttgtagttgatgtatccggagaaaagaagataagattcgggtcaatacttaatctcaattctgtctgcagcagttacttaaacggtgtcctttaattgttaactggataactatattttttatgatcttatgatgggatttgtttcaaactttcaattaaggtcaactatatatcaatcaagtggcactggtcaggacctgatcattgattctttcagttatcttttaactttgagaaatatggaatctcataatcctcaagcaatttcagattttaggattcgacaaatattgctaatcaaattgagttctatgaaaacaactataacagaagattatgaagaaatacagttattacaacttacgaccatgaaacttgtacaaataatggattcaccagaaaccaatccaaatatcttatataacctcaaagcttattctatcgattctagatagcaaactcgttcatatatccatcaacaggcaaaaaacacaaagactctaatagaggatattttaaataactgtttgcattttaactgggtatatacggtttaataaccgggttatagatttaattgtctaacagttagagttgccacaaaggattctcagatacttcgagaccaaaaattaaactgagagatgttgggacccacagtaaagtgggaaccctccaaaaataggcgtatgccacttagcgtggagagcacacggtattctttagtaaaaggcgaaagaatagttcgctatgtgctcaccacatggctgcgtggttcgagaatatggagagtgaagtctatatatactaaagtttcccttggcaaactctctcacctttccgatgtgggactctccaaatagtgataagacgcgtctgatttaatttaaaactctgcttgggcttttatgggcctaatatactttgaacttgggctaaaaaacgaaatcgtttcttcttccattttttaagcctactgaaaccctacaagaagaatgcgtcactatatattaaaccgaaatcgtttcttcttccttcaagccgtcaacaatg

SEQ ID NO: 7127 - DNA, 3000 bp, Unknown; identical to SEQ ID NO: 7112
  misc_feature (1)..( 3000): cDNA_ID_1816779_gDNA_ID_1621128_Annot_ID_172375 3000 nt of promoter + ATG

SEQ ID NO: 7128 - DNA, 3000 bp, Unknown; identical to SEQ ID NO: 7111
  misc_feature (1)..( 3000): cDNA_ID_3049838_gDNA_ID_1621128_Annot_ID_172374 3000 nt of promoter + ATG

SEQ ID NO: 7129 - DNA, 3000 bp, Unknown; identical to SEQ ID NO: 7110
  misc_feature (1)..( 3000): cDNA_ID_3049843_gDNA_ID_1621128_Annot_ID_172372 3000 nt of promoter + ATG

SEQ ID NO: 7130 - DNA, 3000 bp, Unknown
  misc_feature (1)..( 3000): cDNA_ID_1816706_gDNA_ID_1621128_Annot_ID_172410 3000 nt of promoter + ATG
ctctttgtccaaataattccataatattttgacaaggaaaacattttaaactcatacaaatactttgaagataatattatttatcaaaagttcaaaactatcactgtatcacatattgacgcaaaagttttttttttttttttaacgttctataataacctaaagagtgtcaaacattgactaatatttgaagtttttctaatgcaaactaaaaaagaaaaaagaaaaagaaaagaagaaacagatccctcaaattaatgaggaaaccccgaggttggtttacgaacccaagttgagtaaaataaaagattagtagtaatatgtggataagaaaattgtaaagttggctttatggttaaagaaaatgggaaaaaaatagtggtggttagattgaagtggtccagatacgccgtcaaagcaaaataaaactccaaaatgtagcggcccagcccatttaattactcctataaagatggtccaattgcaaatgaaaatgtgttaaaatttcggaaagcattatttctactacgaaggaatttaactaacttaataaagaaaatattctaaactttggaccacaccaattattatacaatgtgttgatttctattgtaaatcatttatatcaacaaaagagtcataagtacactctaatttcgttggttaagtgctaaaaatcttgcgcggtttagctttcggattagattttataaagagtgctataatcaaccagcgattctgtgatcagatgtgggacctgcatcttctgtcattggttacacgtgtacggttgatacggtggcttgagatcttctactgctctgtagggcaagcaaatatttgagtgacatgtgttatgattaatcatgtcggcaaatacaattacgaacgaattatcatcattatcttcacttctttggctaaattgctaatggatattggaggaatttattaggttttaatccgacatataagagtatatacaaaagaaaaatattaatttttcaaattttattttagaaaaagtttcatgaaatattttgcgttaactgctactatagtaaattcgtgattgttacttaatggtctaatttatcctttaaaaaaccaaaacaaatcatttttgtgtgattagttgttgtagctaagacattgtcattttattttcagtataagttactaaattcgtttatatatataattaaattgcaaagtatgctacagtatgacatataatgagtgcagaaaaataaaagatgatgccataatactatagtgaatgagaaaagcctgcggatattcatgcctaataaaagtctttaactccttatggataagatatatatgggaatacaaaacatttaatttatatttattttttatcttacgttccactgacggattataaataaattttttaggaaaaactttatatttgtttgtgtgtgcaaactttatattacatatattagtcatcaaatgcttctatatattgtgaccaattcacaaataatgatataaatatatatatattcccatcagtttttcttggtataaatacaattaattcaattcaaacttatgacctgttctgtcaagaaaacgaatctagtaatttatgactgaaccaagaagagaatgtttctcaccgtacagaagaaatcaatgcgtgatgagtactgagtagctgttagcagtcacctctaattgtatgaatttattttgttgaaatatgttcgttaatcgttagtacttgttgaaagtcactacgtacgtatatatgtagataaaaaaaaaaaaaaaattcttttaggattattgttacacgtataatgtaaagttataacataagttcttaacaactctttgcatagtaccgattcggacttcgatttcgaaagccatgcatgagaaaaccaaaaaatggagccaaaacttagatccggttcaattcgagtaggttatgtcaaagacgtaaacatctacaataggagctccatataagtagaatacaaccaatgccacgctgtaacataaacaaagacagcgagaatctgttaaagatctctcaggttccaaaacaaaactacaagaccccattatgatgttactgacatttaactaaagccttgtgctagttgatccttaaggaagatgtcctgtcgtgatgctcagttttatttcaaattcatatatacgtgtgtgtgtgtgtgtggtgatcatgattaataggttagagacagagagacaaaagttgtgggctttaacaaaccccagtaaagaacaataagtaattttgtcacgtaggctctgtttttggctcttcaacacccaaagtacctgttttttgaagatgtgagacataaattattacttatgatctcaagtcaataaactcatcaaatctgaactacccacaatccaaacattgaacactagctacctttacatatagagttaattaaccatccatctattgagaaaacgagtaaaatatgtattcggttgttgttcttggtaagaaaagattatgagcttacgatccgaaatttcttggttgtgataagttattaatgggagatagagagaggtgatatgcccatatggcataccacatgtggtgggggattcgaagatttgatctggaccgtctatcacaagaaagaaagatgaaaatattttgtttttgggtttggacagatgggagaaaaagaaagtgtccccacaaatgtccccaagaagatgggacacacttttgcctcaaagttgctgttactgctaccgacaagcttagctttttttcctttgtccttaattcagaaaacagtttcttctctctctaccagtatctatctttattctcctttaacttgtataaaacactcagcttcctcgaagcctctcatcttcatcatcagcagcttctctatatctctcctctctttcaaggataataaccaaaagcttttctttttatcttctcctgcaattcttgaagaa

SEQ ID NO: 7131 - DNA, 3000 bp, Unknown
  misc_feature (1)..( 3000): cDNA_ID_2993590_gDNA_ID_1621128_Annot_ID_172409 3000 nt of promoter + ATG
tctttcttttctatattattttaagttgtacagaaaaaatgaaccattttgtggtggagaacaaggttcaatagttcaatacatattatgtgtttagaactaagcaacataatatagatgtaaatatgtaacttatacttagtaatgtacatatcaaaaattttaaaaatatgactattacacactttaaactaaatatgactcgaacaaaagtaaaataatagaatggagaactgaaatatacttttctattaggttctttaaattctagccaattgatcgttttaacccatatacatatataagactgtagagcaagtgttgacgtaaagtaatttgtttgagtctcaaaagagttgttgctttcacatacaatcacattttacattttagtcaatgtaaacttattatttggttgtggatcgtttcaattgcatgcatgcagcaatgcatgtcatttggctgcattccttaaatgcgagaagtatattccaacaactaatgtaaatgagaaaactataaaaaaaaaattgaagatggacacaaatgaaccagtactattgatttatttttctgtgtggtagaatgttgagagttgtggccttgtattgtccacatgaaagtacacctggtcctcacacgttcttatcttgcaagttcataattaacacacatatatacctttgaaaataactcattaatttcgacaccatgcatataaaatacatgattagacctatatataattttcccaaaaaatgaaaaatatatataatcaagtgaaaaagcattaccaaaattacacatcaaattaagatggtctctatcgtgtgacaaagaaaatgtggtctccatatgtatccttgagaatactgatgatatatggatttggttgcattggttcaatctcattaaagtttcgcatacaatccatttatgtgtgcgggcgcatttttttgtaatcatgtaggctggaccgagaatttatattattcactggtttacaatttcatgtgaattccatagtgatcagtagatatatatattgatcagacaaagtagatacacattgataaaacacgacaaaatgatgtgatatataagacaaagtgacccaaaattcgattgaaaaatttggggtacgttgatttgaaaactcatgagagttttttgggatagaaacaaaaggagagaaaagggttaaagaggaggatgtagacaaggcaaggaacaaaagtagggtttaagatgttttcgcccctgaattttatttgatgtaacttgtccctttatcatctccatgtttttcttcttctcattaatttaaattttggctttggaatttatggtgatgttaattgtaccctctcttcctttggattttgatgccactcatgtcccctctcatagattttattagggtaggaatatgcctttttccctctttattttcatatttattgaatttacgttggttaattatggttagtacgcttggtgttatttaaacgtcccgtattcacagtttacgcctaactgattactttgaactaaaaccagtgtctagtagatcactaaagtcgaattttgaacgaaagtttgaaaattcgcaaaagcgccgtgaaaatacaattccaaaacatatcatttttgtttttggaagcgtgattgatgaaataaaaacaaaatatgttttggaagtgcgacagaatttgtttttttgtttagaaatgcgataatatagacaaattaatagaaaatgtaatacaaatttaggtgctttcataactacaaaaaaaaaaaaaaactaccctattgttgaaaactttcatactacaagaataacacaagcaatataaaagaagaaaaataattttcaataatcaaaaacagacattatattttagtagtcaatttaatctgtaaatatctgtaaagaaaattaatcaccaattttattgttaactacaaagtggtgtttataatattgcaatttatagtttgttaactacaaagtataaacattaaagagtaatgatgcgtttttatgtgtctagatacacatttcgctgtacgtgtttataggtgagtttttaatcaataaatattgaagatgtaccgtatgctttattttgtattggcatgagaataattatatacaagagggctgcgcttttattgtgggatgaataattgaatcatgtggatgtgatatgcataattggaaggttccggcgaagaatcttacggggaaaaataatcaaaatcatgaatatatattcattagttaataattatatttagaagtcaaaaagcataatatagttatattaataataatgtacatctctattgtaacactctcatatgagatgtctgcgacctcgccactcaaaagaatatatatttataaactatacgttgatatagtttttaagaccatatggtatatacatatatttagttagataccccatatcaattaatcggttcatcaccacttaattcacttggttgcttcgaatgtgtttcataattcacttgtaattttaaaatctttccttcacttgtgctttcgcttgtaatctcaaaatgttatatatctcttttaacgggagaaaaacgattaaagacggattaaaatatatatccattttgtatagtcaaatgcaataatatatacataatctacaagataaatcataagaaagattcaataacagtaatagagtaataacagtgattactgattagtctaaaagactaaaactcgaggatgatgacttaatcaaagggcttagattcatccacgtgtctaaaacccgtttaatcaaagatctcttaaatacgacatacacatgcagctacctcctagacagagatataatacagactcatctcactttgtattatttgagtgtttttataaaaccatttttccatcttcctcatcaccttcccaagaagaagaacaccaaagaagaagaaaggttaataatg

SEQ ID NO: 7132 - DNA, 3000 bp, Unknown
  misc_feature (1)..( 3000): cDNA_ID_1808541_gDNA_ID_1621128_Annot_ID_172406 3000 nt of promoter + ATG
agaagagttactatttcttgggttaatatgccaaaaaaaataaaaatatgtataggtaagcattaatgttttggtgataagagatttcaaaatggggtatgtacacgtactctttatccataaaatcataaatgctagaagacctttccacaacaacaaaaaatgagccctttgtaattattttatccaaacataattttggaacaattttgtgtaatcatatatatgttaaaaatgcagcaaggcagctcggatttgaggatccaaatgaatacccacaactatgcaaattagcaaatggatatttgttgaaaacaaaagggtatgatgagaatgtggatgagtatttggagaatgaagctgagcgtgattctctctatgttcatctccttgaagaatttgatagatgcattctcacttatttttctttcaattggacccaatcttccaacctcatctctcaggtactttgatttcaatcaaattcagtatatttttatttggtagtctgataggtgaagtaggctatttactacaaccattagcgatctccaataatgtgtatgaataataaatattatcctataacacaaaatgacaggctttaagcgatgagtcggatcagaaagttccaaaactcaaggatttcgtgatggcagcaacaaggtgattgattgttccatatccatgactttatatatgcatacctatagttacatacatataaattgcgttacccgtaatcgtcgttgcgtaatgattccaactaactgtaccaagcgtaacatataatgtagaactgactattaatctataactattaacaaacattgtagaactaattaatggctttgttaataatgtaggaaacagaggtttgagagagtaacaaaagatctcaaggtgaaaagggtaatttcgacattagtagaagagatgagagtcattgggagcggaagcagtgagccacactgtacggaagtaatgtctccggtggctcataacaaacgaagtcccgtccttctccttatgggcggaggaatgggcgcaggaaagagcaccgtcctcaaagatatcttcctagagtataactcttttttcttgtatttctttaacatatggtggttataagcctacttaatctttctttaaataaccagaaataatattttgtaggtcgttttggtcggaggcacaggccgacgcggtggttatagaggcagacgcgtttaaggagacggatgtaatttatagagctcttagctctagaggtcaccacgatgatatgcttcaaactgctgaattggtacgttgttcttagttctagctagccatcctcgattgtgtatatatatttggctttaacatgctacatttctggttatttccttatatatattttaggttcatcaatcatcaacggatgctgcatcgtccttactagtaacagcattgaacgacggacgtgatgtgataatggatggaacattgtcatgggagccattcgtcgaacaaatgatcgaaatggcaagaaacgtccacaaacaaaaatatcgaatgggcgaaggctacaaggtgtccgaagaggggacgataaccgaaaaatattgggaagaagaagaagaagaaacgaaagaaaatggcaaacaacaaaatctgaaaccttacagaatcgagctggtcggtgtggtttgtgacgcttatcttgccgtagcaagaggcatacggtaaagattcatcaagttttcacattttcgaaaatattttgtagtctttgttactcgttgttagctgctattatcatgctaatcgtaaccaaattttgtttttttataggagagctctaatggtgaagagagcagtgagagtgaaaccacaattgaattcacacaagagatttgctaatgcattcccaaagtattgtgagcttgttgataacgctaggctttattgcaccaatgctgttggtggtcctccaagggtaaattagtcaaaagtcaatatcaaatctattacgatgtcgtttttgggagagatactgatgtgtgtgttttaattggttggtggagcagcttatagcgtggaaagacggaaatagtaagcttctggtggatccagaggatattgattgtctaaaacgggtcagcagtctcaacccggatgcagaatccatttacgagctttatccggatccaagccaattaagcaaacccggttctgtttggaatgatgttgtgttagttccatcgaggcccaaggtccagaaggaacttagcgatgcaatcaggagaatcgaaaaggcccaaccaaaaaattgatgatatttgtgaactagacctttgaaattatcttcttcctgaatttgtcatttgtttccgtcagctttttggttaaataagttaataaaatggtttttgttgtgagttgacatagctagtggaattgagacccatagtcattggtcacgcacatcaaccaagaacaaattgcagtcgataaactaatattttgataacagttacgacttgatcctatcgtatataacttcgatttaacaaacacaagtcgtaatttctaaaaaacaattaactcaatttgtttgaaaataaaagtttcctttttcttcgtaacaagtgaagtcaaatgtttttcactcgtatctcttacaacgttttgatgagatgataagagaagagtgggcccacatatttgcttaacaatacacgttttagggttacgtgtcactaatgttattgggttcatttaatctgggcttaaaagaggcgtgtatcatgttgtaatattcccatttgggctttcatataatgaagttgggccgacaaaaaaaaaaaggactagggttcccaagtatcccactatatataattttagtcgaagaaaattcttttatttttctcttgcaaagacctctcagcagccaacgacagttatcaaagcttaagccgttttagggttttatccttttgctgagatccaatc

SEQ ID NO: 7133 - DNA, 3000 bp, Unknown
  misc_feature (1)..( 3000): cDNA_ID_2126383_gDNA_ID_1621128_Annot_ID_172405 3000 nt of promoter + ATG
cactcctcaatcctataaaaacgctatagtcggtaactctcttggttcatcatcatctagtttcaaccaccacccaagctctcatggagttgtcccgaccacattgccatcatcatcttactcgcaagcaccaacatcatcttatcagtcaagcttcccttacagtcaagatgggctcttgtggacaggaagaagtcccagttctgtaaacatgggcatgtacaacaacacttactcacccgccgttactagcaacagatcgctgaaccacatggacgttcagatagcgcagcaacaagcacaaagcatgatgacggatgagttccctcacctagacatcatcaatgatctgctggaagacgaacagtgcagcaacatggtgtataacggaagcatattcaatccacaaccgcaagtgttcaacgggcagtactcatcataccatggtgagttattgtctggtggcaggaccaggagtttcggagaggaaggattgcattacatggcacgtggaccatatggtacagacggaatgatgccgagacagtggcaaatgacgaacatggacttgtcgttgccagcaatgaggagcaatggaatggaagatggaacatcatcagcagctaattaccatcacagttactttggtttggacgcttcgaatccaagttttacgtctggtattaatggctacaccgagttcaggccatcgaatggtcattgatcagcaaatggagagaggggatttgtaatgtttttattttttttaaaaaggaaaaaaaatcatgaatatacaatttgtgtaaagagagttgtcttcttgtcatcctctacgtttcaaatggtttttttttttttaaatatagtataagatagttttcgcatagaaaaactcttccctgaaagtccctgaatagtttttataaataaattatactcctctttatctttaatcaaaagaaactgaaatctgtctaatataaaatgtgtgtgtgtgtgtgtttttttgtctaatttatttttttctttctttgtctaatttgattagatcacttctttatttgaatgagtaaaaactagaaaaaaatgtgagccatttaaatctgattcatatcaaaaaattttcgatttaaaaaaaaaaccctcaaaaggtgttgatacggaaaaagaaaagggaaagaagaagagaatggatctagaatcggtgaaaaagtatctggaaggagatgaagacgaaaaggccaaggaaccaatggtggcgaaattaccacacagattcctcgaacgattcgtaaccaatggtcttaaagtggatctcatcgaacctggccgtatcgtctgctccatgaaaatccctcctcatctcctggtaacaaccacatgaacaacaaatccctaatttcgagaaaaaaagaatccctaatgacttttgtgaatttgttgaggaaagaacgcagggaaattcttacacggaggagcaacggcgacgctggtggatttgataggatcagcagtgatctacacagccggagcttcacattccggagtttcagtggagatcaatgtttcataccttgatgctgcttttctcgatgtaacttcctttccttctttcttaaatttattagatgtctttctttgcaaaattgattgacatatatataaaaaaaaacacaggaagagatagagatagaatcaaaggcattgcgtgttggtaaagctgtagcagtagtgagtgtggagctgaggaagaagacgactggtaagattattgctcaaggtcgtcataccaagtactttgctcctcgttccaacctttgatcgttcaaccaacctttcttcttttttacattcaataaacaacatcaaggtgtttttagtctttgtcccatttgcttcttattattattgatactaataaaactacattactatatgtttttctaataatacaaacaaccttactttttctctatatgtgtttacctcgatgttgaactaagctttttttttaatatacagatagatcctgtttaaaaaatttggcttatatatttgttactgtgaatatgatgatcatttcaaggtgatgatgcatttgtaaagtattgatgaggtttgtggtggtaacttattagaattgtttatgtttcactatttttagtttcgcattatgattactttaagttttgatacaaagttggtaccatccaattatttcaatcaagttgttcattcctgccttttcttttactgttttctcacatccaacagatatgtagatcttctgttactacttttgttaatgtatgtgaagcaaaattcaaattaacatagacacatgaattcattaatcaaatttaatcagtgttcatgtatattatcaaactttgtagctcttatttgaaccaaaattcatgtatttttatcatcaaaatactccctttctttcttcttaaacttttatcaaatatatgagccacacgagtatatgacctttgattcaaaagaaaaggggaatagaatactgaacaaaggaaaatgacgcaggtgatgtgatcagttttgtcgaaaaagaatattagttgagatatgttggtttcatacttttgatctttttttgttagtttatgttattactgtatctattagacgatgaattacattatgcatagataaacaattaaatcactagtcattttggcaatcatactttgaaaaaccaccccatccgcaataagtcaagtcatcattaaattaccacatcatgcatgatatcaaatttcatataatattaatatctagtagtagctagtagtactatataataaacattaaataaatcccactagatgcattcttaagagaaatcttccaagaaaaattcagacatattagatgagaaaagaaaaatccaaactagaaatcaatgttgtgttgagttagtgcttaccctcgcagtctcaatctccttcccaaaaagacttttcaaaccaaaga

SEQ ID NO: 7134 - DNA, 3000 bp, Unknown; identical to SEQ ID NO: 7121
  misc_feature (1)..( 3000): cDNA_ID_1008621_gDNA_ID_1621128_Annot_ID_172404 3000 nt of promoter + ATG

SEQ ID NO: 7135 - DNA, 3000 bp, Unknown; identical to SEQ ID NO: 7119
  misc_feature (1)..( 3000): cDNA_ID_1816716_gDNA_ID_1621128_Annot_ID_172402 3000 nt of promoter + ATG

SEQ ID NO: 7136 - DNA, 3000 bp, Unknown; identical to SEQ ID NO: 7118
  misc_feature (1)..( 3000): cDNA_ID_1816720_gDNA_ID_1621128_Annot_ID_172397 3000 nt of promoter + ATG

SEQ ID NO: 7137 - DNA, 3000 bp, Unknown; identical to SEQ ID NO: 7117
  misc_feature (1)..( 3000): cDNA_ID_1012835_gDNA_ID_1621128_Annot_ID_172385 3000 nt of promoter + ATG

SEQ ID NO: 7138 - DNA, 3000 bp, Unknown
  misc_feature (1)..( 3000): cDNA_ID_1816790_gDNA_ID_1621128_Annot_ID_172371 3000 nt of promoter + ATG
cttctcatttcttaacactctgcagacagtccgcatctggggatgttccgaggatgggaactatacctctagacatacactgaaagatcattctgccgaggtaaggatgtaactgaagaacttctacaggctacagtctcatacagttttacgttttatttatttttggtctgtttaacgtaaaagcaatgatgtggttttcaggtgcgagctgtaactgtccacgcaacgaataaatactttgtgtcagcatcacttgacagtacatggtgcttctatgatctgtcctccggtttatgccttgctcaggtctccaaaattttaatccacacctgatacctgttatccagtttcagatttcttcttttatgctaatataacaatgaaacatttaccttctttattgtaatgtgaattagactcgttagaataaatgtttctgccatgcgtctttctcattattgttgttattcaggtgacagatgcttccgaaaacgacgtgaattacacggctgctgcttttcatcctgatggtctcattcttggaactggtaccgctcaatctattgttaagatttgggatgtaaaaagtcaggtaaaaactctttgaccttccttgctcatcaactgttgtcacttgtaagtttgttctcacttcactctcatctctatctctgtcgtttgataggcaaatgtggcaaagtttggtggacacaatggagaaatcacctctatatcattctctgaaaacggttatttccttgcggtgggtacattgactgattgacctaaactaagtagaaagaaggatagcaccaggttccttttgactgaccaatatttactattctttaaattgtacagactgctgcactggatggtgttaggttgtgggacttgcgcaagttaaagaacttccgaacctttgactttccagatgcaaactcgggtattcaactacctgagcactcttactagtctattttgttgagtgagttttcatttcttaaggcctgaatgagctttttttgtgcagtggagtttgaccatagcggatcttatcttggcattgctgcttcagatataaggtgaggtctactttgatacacaatgttgggaattaattgatataggagctcactttgataacgagatattgaaagatagttgtgcaaactcaattaacctgctatcaccagaaatgcagtttgggtatatgtatacgtttcttctgcaaatcatactaatcgaaaacttgtgcttcaatgttgtagagtattccaagcagctagtgtaaaagcagaatggaacccaatcaagactcttcccgatctgtccggtacaggtaaatgctacatgttaagcttttgaagtcactgctcttccttgttttattgagtctatcattcagacattgtaactacataaatgtgcaggtaaagcaacaagtgttaagtttggactcgactccaaatacatagcagtcggttcaatggaccgtaatctcaggatatttggtttacctgatgatgacaatactgaagattcagcacaagattcatgaagagatatctcaaaagtctcatcatcaagagtagctatatcctcaattctcgcgatttttgttgtatctttacagttctgttggtactttcctgatggcccctctcacaatcacatatacacacctgagctctctccctttctttctcagtcaacaattttcctgtaacaacatcgtaccttaaggatctgcagttgatctttctctctttgatctgaaagagtccacataaaacaaagttagctgctcactataaaagcaaatgaagaacaggcatgtaaatgatcttcttcatcattcaaatcagtaggacctaaacggcaacaattaaaaaacttgtgttatatagaaagggtcatgaatcttgaagacaatgaaatgaagacaaaaagattgtgatggtggtcatagaaattagaaaaccctgagacagacagagattttgactgtactgtggtcaaaacacacacttcacaatcttcccattcccccaccaatctcagattccttttcacttcctccaactctttctctctctctggccttttttttttttttttttcctatttatagctcatctttagtaattccgttattggttaaatttcctaaacatgtttttggtatcaacaatcaagtaagtgcaagaaagtttgtatctttctctaaacccaatttccaaagtaaccaactactaaaccagaatgttacacaaagtaagtcactaaatgactttaaaaacaagattagactttaaactagattagagacatacttatttggaataagattcaaaggtcactagtagctagtaggtggtaaaaaggaagctaaacaacaaataaactcttattaaaatctttcaatcaataaatatttattgtaatttgctgcagtaaatcaaacattgtacagtttcagaactgaatggctcagaagcgttaaaaggaaaaagagactctctctctctctctctctcccctaatctcctctcacatggtcatcaaaagccaaagccaaagccaaaaaaaacaaagaacccagaaacctagaagacagaaacaaaaatcaaagctttactgagccaccaagcaaccaattacatcaactctaaaacccataaaaccaacacaaagattccatctttcaatatctctacaatgagaaagccaatgctttgattttttcccccaatctttcttccaagatacctcaaagcaaaaagagaccacaagaagcaaaagagtctacatacaaaaatgggtctttcaatctcattcctcagcatcatcatgatgatgtgtctactgtttccagatctcaatgtcgtagtaaaatctgctacaacggaatacacaaccttaatctacaaaggatgtgcaagacaacaattctcagatccatctggtttatactcacaagctctctctgctatg

SEQ ID NO: 7139 - DNA, 3000 bp, Unknown
  misc_feature (1)..( 3000): cDNA_ID_2126383_gDNA_ID_1621128_Annot_ID_56419 3000 nt of promoter + ATG
atgacggatgagttccctcacctagacatcatcaatgatctgctggaagacgaacagtgcagcaacatggtgtataacggaagcatattcaatccacaaccgcaagtgttcaacgggcagtactcatcataccatggtgagttattgtctggtggcaggaccaggagtttcggagaggaaggattgcattacatggcacgtggaccatatggtacagacggaatgatgccgagacagtggcaaatgacgaacatggacttgtcgttgccagcaatgaggagcaatggaatggaagatggaacatcatcagcagctaattaccatcacagttactttggtttggacgcttcgaatccaagttttacgtctggtattaatggctacaccgagttcaggccatcgaatggtcattgatcagcaaatggagagaggggatttgtaatgtttttattttttttaaaaaggaaaaaaaatcatgaatatacaatttgtgtaaagagagttgtcttcttgtcatcctctacgtttcaaatggtttttttttttttaaatatagtataagatagttttcgcatagaaaaactcttccctgaaagtccctgaatagtttttataaataaattatactcctctttatctttaatcaaaagaaactgaaatctgtctaatataaaatgtgtgtgtgtgtgtgtttttttgtctaatttatttttttctttctttgtctaatttgattagatcacttctttatttgaatgagtaaaaactagaaaaaaatgtgagccatttaaatctgattcatatcaaaaaattttcgatttaaaaaaaaaaccctcaaaaggtgttgatacggaaaaagaaaagggaaagaagaagagaatggatctagaatcggtgaaaaagtatctggaaggagatgaagacgaaaaggccaaggaaccaatggtggcgaaattaccacacagattcctcgaacgattcgtaaccaatggtcttaaagtggatctcatcgaacctggccgtatcgtctgctccatgaaaatccctcctcatctcctggtaacaaccacatgaacaacaaatccctaatttcgagaaaaaaagaatccctaatgacttttgtgaatttgttgaggaaagaacgcagggaaattcttacacggaggagcaacggcgacgctggtggatttgataggatcagcagtgatctacacagccggagcttcacattccggagtttcagtggagatcaatgtttcataccttgatgctgcttttctcgatgtaacttcctttccttctttcttaaatttattagatgtctttctttgcaaaattgattgacatatatataaaaaaaaacacaggaagagatagagatagaatcaaaggcattgcgtgttggtaaagctgtagcagtagtgagtgtggagctgaggaagaagacgactggtaagattattgctcaaggtcgtcataccaagtactttgctcctcgttccaacctttgatcgttcaaccaacctttcttcttttttacattcaataaacaacatcaaggtgtttttagtctttgtcccatttgcttcttattattattgatactaataaaactacattactatatgtttttctaataatacaaacaaccttactttttctctatatgtgtttacctcgatgttgaactaagctttttttttaatatacagatagatcctgtttaaaaaatttggcttatatatttgttactgtgaatatgatgatcatttcaaggtgatgatgcatttgtaaagtattgatgaggtttgtggtggtaacttattagaattgtttatgtttcactatttttagtttcgcattatgattactttaagttttgatacaaagttggtaccatccaattatttcaatcaagttgttcattcctgccttttcttttactgttttctcacatccaacagatatgtagatcttctgttactacttttgttaatgtatgtgaagcaaaattcaaattaacatagacacatgaattcattaatcaaatttaatcagtgttcatgtatattatcaaactttgtagctcttatttgaaccaaaattcatgtatttttatcatcaaaatactccctttctttcttcttaaacttttatcaaatatatgagccacacgagtatatgacctttgattcaaaagaaaaggggaatagaatactgaacaaaggaaaatgacgcaggtgatgtgatcagttttgtcgaaaaagaatattagttgagatatgttggtttcatacttttgatctttttttgttagtttatgttattactgtatctattagacgatgaattacattatgcatagataaacaattaaatcactagtcattttggcaatcatactttgaaaaaccaccccatccgcaataagtcaagtcatcattaaattaccacatcatgcatgatatcaaatttcatataatattaatatctagtagtagctagtagtactatataataaacattaaataaatcccactagatgcattcttaagagaaatcttccaagaaaaattcagacatattagatgagaaaagaaaaatccaaactagaaatcaatgttgtgttgagttagtgcttaccctcgcagtctcaatctccttcccaaaaagacttttcaaaccaaagaatggtgaaacccttaggaggtaatggtcttcctctctgcatctctctcttcgtttaccagtaaacaaacaacaaaaacgtatttgaaataataaatactattgttttttatttctttttctctctctctctctctcttattgagttttgttgatttctttgctatagaaggaacaagagatgtctctaatgttggttgtaaatcagttgatctcctcctagcttctcttggtggtcttgccgccgctgtagcagctgcttacgccggagaattactccttcgacgccggaaacttgatcaaggtgcttcc

SEQ ID NO: 7140 - DNA, 3000 bp, Unknown; identical to SEQ ID NO: 7132
  misc_feature (1)..( 3000): cDNA_ID_1808541_gDNA_ID_1621128_Annot_ID_56420 3000 nt of promoter + ATG

SEQ ID NO: 7141 - DNA, 3000 bp, Unknown; identical to SEQ ID NO: 7131
  misc_feature (1)..( 3000): cDNA_ID_2993590_gDNA_ID_1621128_Annot_ID_56422 3000 nt of promoter + ATG

SEQ ID NO: 7142 - DNA, 3000 bp, Unknown; identical to SEQ ID NO: 7130
  misc_feature (1)..( 3000): cDNA_ID_1816706_gDNA_ID_1621128_Annot_ID_56423 3000 nt of promoter + ATG

SEQ ID NO: 7143 - DNA, 3000 bp, Unknown
  misc_feature (1)..( 3000): cDNA_ID_1816838_gDNA_ID_1621129_Annot_ID_56424 3000 nt of promoter + ATG
cgttgcgtttcataaaaattgtaaacagctttccaacagacttttttttcttaataggctttaaagcccaacgtcataactgtctttattaaacatgataaacggtagcataaaatctagacgaaaaatcaacattgttagacatgtaaatcatatgttaatagatttttgattattgggtacagaatttgtggttgttatagctacatgcatttatatatgtagtactattcaacttttcttgttgttacatgatttctatacgcttgattcgcattaatcacacttgttctattcatttgttccttgtttagctatcaccattcgatctcgtatatgtacccaacccaagtactgagtaactatttttataaatttatccaagtacgagtgaatcaagtatttatttttttagaccaacttttattctctacatatacttgaatcttgggatacgtataatataaaccaaccctctttagattttaggattgtatttttgtgcatacacagaaatctgagcatagacaaatggatagaaaccacatttgctttatttctatagagtttggacattttttggctatgattttgtaaaattgttgtgtgctccgtgttagcgtttgccgaatgtgacactaattttgatcgaacaaacaaaaaactgaacataaattaattaatttgcacacatgtttaacatctataaaaaaattaaaaaaaattgcacacataaatatagacaaatgtttggaataagtaaaacatgaatccaagtgttattaaaatcagtattttgttactacaattgcaccaacaaaattgtatgttcaaaaatttagcgcagtacgaatcattaataacttgtccctaactactaactatattcagatgtatgcctaacttgtaaatgttactcatggttgagtagttgaatgttgaagagcttacgttataattaaatgctcgctttgattgatgcaaacaatttcttcactataataagcgaaaataatagaaataataaagatggaaaactaacaattaatagtagaactatatatatatatatccacatataaattctttttttttttgaggggtggtttaaaactagctatttagctggatgctcggctattcggatttgtgtaaaatacttctaaatattgagcaataggtaaatatagtgaatatttaaccatgacaaacaataaaacacacacacatcagaggaaacttgggaatgaacgtgaacaataaaaaaaaaattaataatgataataatagtgggcatagagatggttcttcaacgaattatttcttgcccaagtagcaccgtttggttagaaattcttcgacatttatagttcaattaaaaattactactccataattttgggtgacttaccacacaatctttccacaaatcttcgacacgcaattcacaacagtatcatagtttattatcacactttagtaatttatgccaaacctcactacgcaagcaaactatgattcattagatgtgtggacaattacgacgacagcaaaaaaataatatgtgtggacacacaatgacaaactcacattgaactatcttgaaataaatttatactaaatcgtagcgaatatataatcagtaaatagaagttaaactgaagatcataatcaactaaaatgaatatcgtaatcaaattgatgataataatgatttcagacacaataatggtgacggtgttgatgatgaaaaggatctgtggcataacaactgattgaattcaatgcatcttcatgggttttattccgttagctttatctttcacgtctttatattctttaaactttgttatgttattgacatttaaattcatttgtatgcatgttatgaagagatcgtataactacaaaaatataaaggtaaatctttcattttaaaaagaaaatgtttctatacgtgtaaataattagtaaataacacatatttcctcctgcgcgtagcagttcaacaaactctcttcttcgcgtagctagaagctgcaataacataaagaaatgatatatttataaattatgtgaaaatgaaaaaaaatattagtccgcaatatccacgtatcattatgcgccacgtaaacaaagtggacccagaataacccttgtttccagtagaaggaatcaatcagtggcaagaaagaaaataatgaatttcattaaatcgccactctcgagccatcaaagtatcaaacaattgattggagttagttgtatccttcgcctacaaatttttccttactctgttttataagtatataatagttccactaaaatcattttggatacaacctcaatagatctcagcgtattgtttcctgtatgttcaatgaatccatcctccatgcaatctggagactggagtataaaataacacgtatggtatggtatttatttctcatagctagttccttaacagttggaagaatttatacatgacccggccctttaaaacctatccctactacaagacatttgggttactttccatcgacttttgaatgtgcatcaggcatgaaaatcctttaattatgcatattttataatcaatgcttaaattactataaacacaaaaattgtagtgatatattagaaagataatttaaattgttacattgaaaagataataaaaaattataaatagacatctgatataaaaatggatgaagtatagcatattaaaaaaacatatgtttttggtcaaaacagaatcaatgcatagttagctcaccgctacaacaataaccatagggactacgtaccatccataactacattttcttaaattgcatcctctttctaaaattttgcctataaattcacaataacacttcaactttttaggccataagttatctctttctctacaataagcaataaatctcacctcccttttttttttttttgtctcgctacttttgattatcatttaaaaccaaaaaacctacc

SEQ ID NO: 7144 - DNA, 3000 bp, Unknown
  misc_feature (1)..( 3000): cDNA_ID_1816834_gDNA_ID_1621129_Annot_ID_56425 3000 nt of promoter + ATG
agaaatccattcctctgttttactaacccttaagatgaagtccttatagtttcatattaatgatctatgctttaatattttttgatggacagttgatgcccatcctggagacgctgtataacgcttcaaagagaacatcatctaatcaaatatacatgatgctaattgtacttctcatacttagtcaggattcatctttcaattcaagcattcacaagatggtacgtgctatttccaatcatagggttgaaacgatttttctcaacttcagtattgtttctgattatgtgtcatttgaatagatactgccaagcgtgccatggtacaaggagcatctccttcatcagacgtctcttggttccttaatggtcattattctcataagaacagtgcagcataacctttctaaacttcgggtatggctttagattcatatcttagcaatgaaaatgtttttttcagacaaattcgttttagtttggcagtttgggtaggtgctaggtgcagctttataagagtgatgtcacgttaaaatcttagccagatatcaaaataacttttgtgacaaattctgtttcttgggctgttacaggatgtgtatctgcagactacttgccttgctacgttggctaacatggcacctcatgcccatcatttaagtgcatatgcctcacagaggcttgtcagccttttctacatgctttctcgaaagtatgcaattagttcctcgtctttttatgacttcataaatctgtttttgtacatattcctgtataacggatcatgaattgtttaacacaggtataacaagttatcggacttaacaggtgataagctccaaagtatcaaaataaacttgtccggagaggatgttggcgtttcagaagatctggtatgacatagttagttcaagcacaagaatatttcatgtgatcgttgctattccttgatttctggtacacttttttacatgtatcttggcaactgcaggcagcagagttgcagatctttactgatttcctgagacttgtcctagatatattaaatgcaattttgacgtacgcattgccgagaaatcctgaggtatcacttatttttctcagcagcatgaatcgcaaaaatcttttctagttttgcctgctctgattcttggtttctgcagattgtctatgcgattatgcaccgacaagaagtgttccaacctttcaagaatcatccacggttccatgaactggtggaaaatatatatacagtatgctgcataggctttactcgtttgatctttgtagctacgacttcctcttaaaattcagaaagaacagagtttctgattgatctatttgtttctcacttgcctaactgatcaaatataggtcttagactttttcaacagccgcatggattctcaaagatcagatcgagaatggtcagtgcagaaagttcttcaattcatcatcaacaattgccggtcttggcgaggtgaaggcatgaaggtaagcaacctctacacatatccatcactgaaatatttgaatcctttcccggtagctatagttgttaaaagctcttatctttcttccacttttctttttgttaccgcagatgtttactcagcttcacttctcatatgaacaagagagccacccggaagagttttttattccatatgtttggcaactagctttttcccgatggtaaccaacctaatataaacaaacttatctctttcttctatactacttgtcatcacgatgttgtaacaaagaacaccgctcacattcctctctcacgtttctttttgttcgcagtggattcggttttaacccagacgccatcaacttattcccagtgccacacccagttgaagtaagtacctaattccatccaaaagttagcctttgactgaatctcgtactttctgcgttttgcgtttgcatgaggaaacattgcaattgatgttatggattcactagagttaatacacaaccaacgcaaacacaagtacacaacaatcactagggttagatcgttccttgtaagttttggaagtggcacttgaattgatccttccaacggaatatgtgcagaaagagatagaagacgaaagaggagaagaatcagaagggaaagcgaaggtacaagagttgaacgaacagagaatcgtcttcgacccataaatatttttcgatataggagagcttggattggggccgtatgtgtatatatttatacggtttagggttcaaataagaaaaaaataccaaaaagacgttaattactttatccaatttatatgtttttttaacaatgtagctttcagtctatagattttatttcaatccattaataggtatcctctcttgtgtaataacgaattgagcttatggagtcttaaaccaaatattttccataacctcggaaaagttaaccttgcgaaagttaaaatgatcttacaaagtatacaaccttcacatctaagaaactaaatcaataacccgcttaatcccacgactatacctaaaagaatttccattatttatagaggaaaacccaaattacagaaagttactattctcaagaatttcttttttttttaactctttccttaagcgcgtgaaaggatttaagatgagtttgtaaagaagacatttttacaaatttcagatacgtttgtaatatatcggttatacgtcttgtcgagaatctagggtttctctctctatctctctctctccttccatggatttgtagcgcctccctttctccatctctccatagcttctgggctcgattcttcttctcgggcttcttaaccatgttcaattaaacttcgaattctcgtcctcaccttacagatctcggtgagaatttccgcctgtttaacctaattatccactttcaaaacctttgaattttctccgattcgatttctcggagatccagtggaggtctctgattcgttgcggtacttcaacggaagctattgggtgcattaaaatg

SEQ ID NO: 7145 - DNA, 3000 bp, Unknown
  misc_feature (1)..( 3000): cDNA_ID_1816830_gDNA_ID_1621129_Annot_ID_56426 3000 nt of promoter + ATG
gagcttgcggttccctgaaatcaaaactccaactcttttaatcttgagttagatgcaaaagtttgattctttaatacacccaagaaaattcaacagcttgtgtgaagtcaagggtacttcatcaaattcttaaagcacattgcaaaactaaacataataagtggtttagagaaagaacctgcacaaagtttgtcccttttctttcgagctagatatgaaccaaactttccgaagagagggagattcaaactgaacaaagattccatcatttggtccgagtttccatttccttgagcctacacctttccacacctgtgagacatcgtttaaccgtcagtccatatatacaaaccagaaagaacaagcttagaaaaagacagatttgattcacctgtgggtaggatatactactctttggtgttactaagcaagcagccttggaaaatgactcttctgcgtattgcctcagatacgtaaagcagttactgtgcgtgtccggagactgaaaagcctgaagtagggaaacaaagtagttttatcagacaaaaaaaagatttttgataagattcaagttggatgcccttaataccttatcgatgttgacagctggtgcgtacttgtctgtttgtgttttctctttgtcaagaaggaaatagactctagtatcgactttagatgtctcgtgccacgacttcacagctgtttccatagtctcaacaataaaagaaaacatctctttccaacactcttcagttccatagttttcagactgcatgtgttaaattcagaatctgagttggaacaatcaaatataagcaacgaggaaggcttagactgattctctggaatttcacaagaagagaaaaagaggactaaccatttcagatttaaaactttcaagatgcttggccatgtcaacattagatcttaaattctcaagttcttgagctctctgtttctccttctgcaactgaccgagcctcttgatctttctagaaacttctgtgctctgtgggttgtactgcagagccatttcaaatgcagccaaagcctgagatacaatcatcacagttttaactaccatggaatagctttgtgatagaaaaaatttagatggaaccaaaataagagaaacatatacatcttcgtatttttccatggcttcaagcacacaacctttcctgaagtacccctgaagaagatagatcagaaaaaccatcgtttacgtaaagacacacacagatactttatgttattgatgatgaaaccgaaagcacaaaaaaacattgtcatgtattgattttaccttctcccactgagggttgagtttaatggtagtctcagcatctgctaaggccttgctaagcttaactagactcaaaaatgcagcagctcggttactgcaccggataaacaaaaagctttattacactttaaaaatctactcacattaacacataacactgttccaattcacagaaccttaaaaccaaaaacctcaacttttagtattctaaatcacaattgatcttcccaaatataacaaaaatgttgtaatactattattcaagttaaaagcctaatttgtctccacctaaacaatctcattttctaaacatatcgcaagagaacaaaatcagatctttctgagaaatcagctcaaatagaatgaaacccaacaatcagattcgaaagactgtagaagacaagtaaaaggaaacctgtaaagagtagcgttagaaggatcgagcttgatggcttgagtatagagagctgcggctttaagaaagttgccagctttgaagaactcatttcctttttcctttagagatttctctgcttctccaccattcgttgccttgcctgctttctcggccattatttctagaggtttgtaagaaagccaaagaacatgaatcccccaagtgtgatttgcttttctattttagggtttacagagggacaagagacttccacttctgctctgttcctcttttagttttttctctaaatattattactttttgttcatcatttgagttctctcacttgtgcatatatttttaattaaacataactaagaatattgaacatatggaaaagcccaataacgattaagtttgaactaataccttgagcaatttcagttctagaatcattgaagaaatgaaaagcccaagaaaataaatgggcctcaaatttgtaaatacagtaaaaaagattcggccacatcccactccaccgacaaccgacggttcaaagacggtagtagctagcatcaatttgactccatttcgtttgaattatcccaaatccattatctctgtttttattccacgtagactagtaaataataatttcatttctctagtagaatagaacaagtcatctgttaacttcaaaaaaaaagtcaagatttggtttgaggttaatctatacagaaaatattatataagctcttgtaaaagagaaaacgtaagaacccataaagtattcgaatcatatttatgagagtttggtgggaattaatttggtagcacgtagcctgtatttttcaaaattaggaaaacacttatttaacttcattaattacaagtgctgatggaatgaataatcaaaaattgtcacatttagtcgctaaattatttgtatcaaaaaatcaatttggaaataaacttacgcaggaataatagttttccaacattaaaagaaaaagattataatataaataaacaaataaaataacgcgtcctctcttttttttttttgctcaaaagtctaaacccttggtatcgaagcatttggtttaacagtttgaatcttcaattaatctcagatttagatcgagagagaccaaattgagagcaagatctttgcattgttcatctcttgctttgtaatgccgttgttcttcatcgtaaccgactcggtggacgcgatcaattgactcgttctcttttggatccttgttgactcggcgagcttggcttaggagacatg

SEQ ID NO: 7146 - DNA, 3000 bp, Unknown
  misc_feature (1)..( 3000): cDNA_ID_3049861_gDNA_ID_1621129_Annot_ID_172434 3000 nt of promoter + ATG
ggagaagaagaagaagaagaagcttcgagttctttggagggagagggacagataccggttatttcctctcgttaaccgaataccggtttaatactattgtcccggtttgatctcaatagctatcatgagcctcgattgtgtgtatatgagagagtattatgggcccaaatttaacacacatgagatttttttttttaaagtgaaatttctgagtcgaataataaattccagtgacagtgagactgagacaccggagtctaaaggaaaggtgagagcgggggacaatgtaagaaaaaggtcggtgagaaataaaacgacaagtgatagaacttttcttagtaccatagttgaatttaaggtggtgggccattcaatgggcctaacttggcccgtacaatctgtaacatcatttagtattgaattcacattcaccaatcaccaatcaccttaccaaaatagtgcgataggaattaaattgtgtttggcttggtatttgttaaatcatcaatagacaataatagtttgataagacttacaacaactgaatatttataactcgcaattagccctgttaacattccaggcagtgcctgcgtttaagcaacaatacagaggcttcttttaggtcatatgtcaacacctaaaacaaatagataacatgtgagagaaatgtgttaggtatattacactatgattagttcttttgttaaaggaccacgcaccactatcattatccacgttacacacggtttgaacttaaagaagatcgcatgttccactatcttttttgttgttgtttgtcctcctcaattgaacaatttgcatacgtaagcgacatttggttcatatacagtgttcatgaactgagcaacatatatactgtttttttttcatctaagaaaagctacctttttgaaatttgtatttatgcaaacgaaagataatggaaagtgagctggcatggaccgaaagtggtacaaaaaaagtttgaacaaagccattactataccaaacaaacgcaaatgacaaaaactacgcagcattaacaactatattacaattgtcattatttatgtataacattataatacactatcaaggcttctagattgttacatcatctccttaattcttccaagttacatcatcatatatagttgaaattaatttctattattcgtgagaatataagttgattggaagaaggaagattcagtctatatatatatttgaaatactatatgtggaagaacgtagaattccctattgcgaactagaaatgtgttgacgtaccgtgtataaccaaatgtaatatattaatcaaaggacatattaacgtacacattttttactgcatagtcagcaataattgacatttaatcatacatgtattagaaaatggtatgccacgtaagacgcattaccttgcatgaatggcatgtgtagtaagtcgtcatccgcatattgtccaaacaaacaaacaaataaacacatacgggcaagaattaaaaaaaaatcatcttttgttggtcttatatagttgcttatctgaatagtctcacactctctcacttgagagcaagagtgcatgtaattatactatagtattagtacatacgaacaatttggtggtgagtataagtttggatctttggactatatataaagtcattaatttcatactcttacgctattcttttatatcttttaatcaagttgacacatttgtctcattgttttggtgcagagatgatagattggttttctttcttttatatatatgtattgaaacgataacgtgtatgtctccactttctacaaatgaattttaaaaagctcaatgtgtatacataggaattgataaaccagtgattatatagtattttgtaatatactgacacctatacagttttattttagtaatatttgtagccttgtagacaatacataatactcatcacgtcacgtgtagaatattccatggaccgtataaggttcctcctccattgtatcccacaattaattagacacagcttagattagcaaaatggtaatttctttcgtttgagttatgattggcgatttcgtataaaacgaatcgagagaataaaaacgtaaaagaatcggaatatgattcattgcttaccatggttaagtttaatgataagtgcttttattgataacatatatggtcaaataatacaataatttgatcataaagagtaaagacaattgaaaaatgaaatcaccaaaaaagtcagatcacatacagacacattgacgcatcgacgtcaagcatcgtgagcgcacaaagagcttacggctttattattaacacacacactaagcaaaacagtaagtccacgagaaagcatccaaaaagcccaaaggaaccacctttattttttattttattttaggcaaaggaagctcctttattaaattcccaatcttcttccactactttgcacaatctttaatcgatccaaccaataaattttgcattttttttcgttggcgaatgaaggattagagagaaacagaagaaattgttaatttttttcttgttgattttaattaaagagaagagagatctctcttctcgattgctctcaagaacccaagtgacgtctggtttcagctgatttgtttcttctcattctctatcttcttctctgggaaatatcgattttgatctattaagagctggtgagagccaaagtttcctttttgtttgtttgtttgtttgtttgttgtttgtatttttgtatctctgtgatcgcttctacgtgttgggtcatgcagagaaactcattttgttttgatttgcaatgtgtcaattccactttgaaatataagattcatcgcctctctctcctttgttttttttcttcttctgcagctacgagctttgggatgtggtgagatgcttgttctatctcgaacaatccgccggttgttgattttaaacaaactctctatcacaaatctttcccgatc

SEQ ID NO: 7147 - DNA, 3000 bp, Unknown
  misc_feature (1)..( 3000): cDNA_ID_3049865_gDNA_ID_1621129_Annot_ID_172433 3000 nt of promoter + ATG
catctcaccacatcccaaagctcgtagctgcagaagaagaaaaaaaacaaaggagagagaggcgatgaatcttatatttcaaagtggaattgacacattgcaaatcaaaacaaaatgagtttctctgcatgacccaacacgtagaagcgatcacagagatacaaaaatacaaacaacaaacaaacaaacaaacaaacaaaaaggaaactttggctctcaccagctcttaatagatcaaaatcgatatttcccagagaagaagatagagaatgagaagaaacaaatcagctgaaaccagacgtcacttgggttcttgagagcaatcgagaagagagatctctcttctctttaattaaaatcaacaagaaaaaaattaacaatttcttctgtttctctctaatccttcattcgccaacgaaaaaaaatgcaaaatttattggttggatcgattaaagattgtgcaaagtagtggaagaagattgggaatttaataaaggagcttcctttgcctaaaataaaataaaaaataaaggtggttcctttgggctttttggatgctttctcgtggacttactgttttgcttagtgtgtgtgttaataataaagccgtaagctctttgtgcgctcacgatgcttgacgtcgatgcgtcaatgtgtctgtatgtgatctgacttttttggtgatttcatttttcaattgtctttactctttatgatcaaattattgtattatttgaccatatatgttatcaataaaagcacttatcattaaacttaaccatggtaagcaatgaatcatattccgattcttttacgtttttattctctcgattcgttttatacgaaatcgccaatcataactcaaacgaaagaaattaccattttgctaatctaagctgtgtctaattaattgtgggatacaatggaggaggaaccttatacggtccatggaatattctacacgtgacgtgatgagtattatgtattgtctacaaggctacaaatattactaaaataaaactgtataggtgtcagtatattacaaaatactatataatcactggtttatcaattcctatgtatacacattgagctttttaaaattcatttgtagaaagtggagacatacacgttatcgtttcaatacatatatataaaagaaagaaaaccaatctatcatctctgcaccaaaacaatgagacaaatgtgtcaacttgattaaaagatataaaagaatagcgtaagagtatgaaattaatgactttatatatagtccaaagatccaaacttatactcaccaccaaattgttcgtatgtactaatactatagtataattacatgcactcttgctctcaagtgagagagtgtgagactattcagataagcaactatataagaccaacaaaagatgatttttttttaattcttgcccgtatgtgtttatttgtttgtttgtttggacaatatgcggatgacgacttactacacatgccattcatgcaaggtaatgcgtcttacgtggcataccattttctaatacatgtatgattaaatgtcaattattgctgactatgcagtaaaaaatgtgtacgttaatatgtcctttgattaatatattacatttggttatacacggtacgtcaacacatttctagttcgcaatagggaattctacgttcttccacatatagtatttcaaatatatatatagactgaatcttccttcttccaatcaacttatattctcacgaataatagaaattaatttcaactatatatgatgatgtaacttggaagaattaaggagatgatgtaacaatctagaagccttgatagtgtattataatgttatacataaataatgacaattgtaatatagttgttaatgctgcgtagtttttgtcatttgcgtttgtttggtatagtaatggctttgttcaaactttttttgtaccactttcggtccatgccagctcactttccattatctttcgtttgcataaatacaaatttcaaaaaggtagcttttcttagatgaaaaaaaaacagtatatatgttgctcagttcatgaacactgtatatgaaccaaatgtcgcttacgtatgcaaattgttcaattgaggaggacaaacaacaacaaaaaagatagtggaacatgcgatcttctttaagttcaaaccgtgtgtaacgtggataatgatagtggtgcgtggtcctttaacaaaagaactaatcatagtgtaatatacctaacacatttctctcacatgttatctatttgttttaggtgttgacatatgacctaaaagaagcctctgtattgttgcttaaacgcaggcactgcctggaatgttaacagggctaattgcgagttataaatattcagttgttgtaagtcttatcaaactattattgtctattgatgatttaacaaataccaagccaaacacaatttaattcctatcgcactattttggtaaggtgattggtgattggtgaatgtgaattcaatactaaatgatgttacagattgtacgggccaagttaggcccattgaatggcccaccaccttaaattcaactatggtactaagaaaagttctatcacttgtcgttttatttctcaccgacctttttcttacattgtcccccgctctcacctttcctttagactccggtgtctcagtctcactgtcactggaatttattattcgactcagaaatttcactttaaaaaaaaaaatctcatgtgtgttaaatttgggcccataatactctctcatatacacacaatcgaggctcatgatagctattgagatcaaaccgggacaatagtattaaaccggtattcggttaacgagaggaaataaccggtatctgtccctctccctccaaagaactcgaagcttcttcttcttcttcttctcctgcttctgtcgtcgtctaggttaatcgaatatttcactatttgctttctatctttctgctgcgaatcaatg

SEQ ID NO: 7148 - DNA, 3000 bp, Unknown
  misc_feature (1)..( 3000): cDNA_ID_2993617_gDNA_ID_1621129_Annot_ID_172429 3000 nt of promoter + ATG
ccacccataacaacttccttgtttggaagaatggccttggtattttaactttctgtgttagtagggctttttgacggatcttttactttgaatcttaactatcctttcccttattgtttaaccagagcttccgctcatcaccaaaccttgctgctgcggctgaagctgctgctcttgcggtgatccgcccagtggaggcaaaatacccggctctgcttttcaagcaacagcttgcagcatatgtggagaaaatatttgggatgattagggataacttgaagaaagagctctcagctttaatatctatgtgcattcaggtttcattgacttctctctttgcagctatatatttttgtcctgactttacgttgttgtatcctaatgctgtgaccactcgcttgttgcgttgcaccttgataataaatgtgttttactattgtaacaagtcctgttctgtcaaaactttgaacttcaggcaccgagaatttcaaaaggagggatacaaagatctgctagatctcttggaaaagattctcctgctattcactggcagagcattattgatggtctcaattcgctgcttgccatattgaaagataattatgtaaggaaatagtaaaagttccatgacattattctgttttcaaatcctcaaattctcatatgtttcatggtgtacaggttcctttggtactcatccagaagatacacactcaaactttctcgttcgtcaatgtgcaactatttaacaggtaaataatacttgagaattacatctaatggtttctacacaccttatcatcgatactcgtcaaagtacaaaccttcctatggttgatatttctcaaattcctatggaagatataagccaagatcactagtgttttcttacttggttttttccttaacatcttacaatagccttctactgcgtaaagagtgttgtacattcagcaatggagaatttgtaaagtctgggcttgcagagctagaattgtggtgcggccaagtcaatgaagtaagttcctacctcacgttttccttccggaaaaagtttctttcggctcattatatcattctttgattttgcagtatgctgggccatcttgggatgaactgaaacacatcagacaagctgttgggttcctggtatgttttactcttgtttaatactaacttgtggaactcttgtttcttgaatcttcaaaaacgaatacttctcctctcgtaacttatcaggttatccaccagaagtacagagtatcatacgatgatatagtacatgatctttgcccggtaaagctccttcttagtttctagaaacacgtttttgcctagactccatacttaatggctttcttgtttcactttattacagatccttagtgtccaacaactttaccggatatgcacattatactgggacgactgctataacacccgaagtgtgtctcaagaggtaatatcgagcatgcgtgcgctcatgacagaagaatccaacgatgccgacagcaattccttcttgttggatgataattccaggtaactcgaatcatttcttaaagattaatatcagtagtagaaactaaaaccggtttattgttcgcagcattcccttctcaatagacgagatttcgaattcgatgcacgaaaaagactttgcgagtgtcaaaccggccaaagagctactggaaaacccagaattcgtattcttgcactagtgagaagctcggattctaaaaaagctcttcctctgtttctttttagtctgagtgggggaggggtgccttcttgaaccaaaaggaaagaagattacaaaagtgtaaatttttacttcttgtggggttgtttctttcttgcaaaacctctgtgatttctctctcaccaattcattcatttatttatttgaccccatttcaaagttttttctccattttagacccaagattattatctggtttttttttttcacggctcaagttctacacgatgaagatcctttgttgttgttgtacagaattaatctacttaatttgttataaacttgccccaactcttttcagtgatttttttttaaaaaatttgggactcaatcaaactccattacacctggtgatattggtttaaaaccaacgtttctgacttcaacagccgagattcaaagacttcaaaaccttccaaaaaaaaacaaattcataactggttcggaaagataaattgacaaacccgagagagatagaggaacacgaacgcttatagtcgatcgcaaataggcctttcacttgaggtgtctgtctcaagttcgaattctaaaagttttatggttttttttgtttaactgtgttttatgttgggccaaattgttttttgcttttaggcattaaatttagtcgggccggccctgcacataaaattaatatgatgaaatgttttgggtttgatactttgattcatagaaaaagtaaattagtctctactgatagtaatttaattaaatactagtatttcattattttgtaagaaattttagaaagggaaaaaaaaaaaaggttacgcgaaggaaaccaaaaaccctttagggacttggatagaaaaaaaaaaaccattttgtgcatcttcttcaagctgcgccgctttctcactcttttttatctctcaaatttgaccttctccgttgttctttcgcatcgctcaggttcgtttcgatctcgaattacatctcctacggattcaatatttgttcaacctaattgttcccatttctatcgcacgaagattagttcggggaatctaatcgtaatcataatgtttttttagattgcgaatcgaaattattgtgatatttaggtaacggagctcaggtatagaatctgtgtgtcgacttgattagggcagatgtagaaaaacctgagaagtagtctttttcagattaactagggttagggttctgatttgatgctcggttttaagcaggagcagaagcttcaatctttgataatg

SEQ ID NO: 7149 - DNA, 3000 bp, Unknown
  misc_feature (1)..( 3000): cDNA_ID_2128719_gDNA_ID_1621129_Annot_ID_172426 3000 nt of promoter + ATG
agaggagcaagacggcgccctcatcagctaaaaacctacattgccagattgcgttattacacagtagcatagaaagcattgaattaagaatttgatacaggatgcatctctatcaatacaaaaataaattattgtagagaaaaagctcaagaaaatataacttacatgccgagagtatcaaatagtgaagcaaatggtatccgaacatgtggaccagcagggtgggcatttccctccacatctgagcggtcaactgcaatcagagtaatagtttagataaacacatcgaattcttcttattcagaataatgaagaaaaaaaaatctcacattcaacatctctagcatttgctagagccttgctaaaagtattgtcagaggaaaatacatggactttagaaactgattctgaggtcgcactgtcatcacttttatccgtcatagactcatcactcatgatagacttgtgatagttaattaggataagtaaaacatgcaggctgcactccgctagtggatttttagatccgccactgttacttacaagatagttcaaaggcaagagcactaaacttgctgtatatgcaacagaaaagttttcatgagtacatggactgtttcatgtagctagttaggaaaacataattgaacggaaagtcggaaaggcaatagaaaaagatcaacatttacaagttagtacaataatacatcatatatgaagtaatatacgaacacctaccagctgcagaaccaactctctctaaaatgccttgtgaatctccatcagaatacatataggattttgcatttggaggagtacggtgtcgggaaatataattaagtagcaaccttctgactactagagaaactagagacttttcctgaaaatcgttgaaccaaaggaaatggcggaaattgatatgaggtaatatctatgctaaagacaaagaaaaaagtaattaatttggttacctgagtcattgctgcatcaataaaagggttcgcatctgttggtccatgtgaaggtccagagagaagctgtgtcgacattgtaacaagcatgaagttgagaagttcctgatgtagaacatacgagttgggacttgccaaataaatgatgaaaatcaggagaatgaaacatctaatactgaaacatataaggaataggtgatatagagaatcagcattggcatacctcacttcatttgatccaatgaagctcagaacactatgcatgacaaaattttggatgtcttgatctgccatcaaaacactcttaattagccagcttagaaataccttaacgctggaaataactattatgagagtcattacccattacaaatccatgtggaactggttcactttcgtccagagaaagatgcaactcctgaagactgtcactttttccattctcaatcaaatactttaaaaagacggatgaaatatatgttgcattaacagctttcttatagagagaagactgatcatctgaagcttgaagaagctcttgcaaacaccaggacagatgaatcaatagttttgcaaggtgcctagtgtagccattactttgtgctgaaacaaaaaaagaaaataagatcatcctcctactttcactaggtcatcatcaacattcaatttcattagctcaaagtgaattcgacaacacatcctttacaatttcaacactaaccgaaaagttcacaggcttgttgaacccgatcactaggccagcgagaactcaacggaagctcaagtagcttgttccagaaatcagacgctaaaggaaacgatttctccccaacaaaagtggcaatgaggtactcggccaccgaaacatcatcaccaccggtttttcgcggcgttgaaggcacacctcccatgtctcctaagccaagctcgccgagtcaacaaggatccaaaagagaacgagtcaattgatcgcgtccaccgagtcggttacgatgaagaacaacggcattacaaagcaagagatgaacaatgcaaagatcttgctctcaatttggtctctctcgatctaaatctgagattaattgaagattcaaactgttaaaccaaatgcttcgataccaagggtttagacttttgagcaaaaaaaaaaaagagaggacgcgttattttatttgtttatttatattataatctttttcttttaatgttggaaaactattattcctgcgtaagtttatttccaaattgattttttgatacaaataatttagcgactaaatgtgacaatttttgattattcattccatcagcacttgtaattaatgaagttaaataagtgttttcctaattttgaaaaatacaggctacgtgctaccaaattaattcccaccaaactctcataaatatgattcgaatactttatgggttcttacgttttctcttttacaagagcttatataatattttctgtatagattaacctcaaaccaaatcttgactttttttttgaagttaacagatgacttgttctattctactagagaaatgaaattattatttactagtctacgtggaataaaaacagagataatggatttgggataattcaaacgaaatggagtcaaattgatgctagctactaccgtctttgaaccgtcggttgtcggtggagtgggatgtggccgaatcttttttactgtatttacaaatttgaggcccatttattttcttgggcttttcatttcttcaatgattctagaactgaaattgctcaaggtattagttcaaacttaatcgttattgggcttttccatatgttcaatattcttagttatgtttaattaaaaatatatgcacaagtgagagaactcaaatgatgaacaaaaagtaataatatttagagaaaaaactaaaagaggaacagagcagaagtggaagtctcttgtccctctgtaaaccctaaaatagaaaagcaaatcacacttgggggattcatgttctttggctttcttacaaacctctagaaata

SEQ ID NO: 7150 - DNA, 3000 bp, Unknown; identical to SEQ ID NO: 7145
  misc_feature (1)..( 3000): cDNA_ID_2128715_gDNA_ID_1621129_Annot_ID_172425 3000 nt of promoter + ATG

SEQ ID NO: 7151 - DNA, 3000 bp, Unknown; identical to SEQ ID NO: 7144
  misc_feature (1)..( 3000): cDNA_ID_3049877_gDNA_ID_1621129_Annot_ID_172424 3000 nt of promoter + ATG

SEQ ID NO: 7152 - DNA, 3000 bp, Unknown; identical to SEQ ID NO: 7143
  misc_feature (1)..( 3000): cDNA_ID_1816838_gDNA_ID_1621129_Annot_ID_172423 3000 nt of promoter + ATG

SEQ ID NO: 7153 - DNA, 3000 bp, Unknown
  misc_feature (1)..( 3000): cDNA_ID_1715200_gDNA_ID_1621129_Annot_ID_172422 3000 nt of promoter + ATG
aacttatggcctaaaaagttgaagtgttattgtgaatttataggcaaaattttagaaagaggatgcaatttaagaaaatgtagttatggatggtacgtagtccctatggttattgttgtagcggtgagctaactatgcattgattctgttttgaccaaaaacatatgtttttttaatatgctatacttcatccatttttatatcagatgtctatttataattttttattatcttttcaatgtaacaatttaaattatctttctaatatatcactacaatttttgtgtttatagtaatttaagcattgattataaaatatgcataattaaaggattttcatgcctgatgcacattcaaaagtcgatggaaagtaacccaaatgtcttgtagtagggataggttttaaagggccgggtcatgtataaattcttccaactgttaaggaactagctatgagaaataaataccataccatacgtgttattttatactccagtctccagattgcatggaggatggattcattgaacatacaggaaacaatacgctgagatctattgaggttgtatccaaaatgattttagtggaactattatatacttataaaacagagtaaggaaaaatttgtaggcgaaggatacaactaactccaatcaattgtttgatactttgatggctcgagagtggcgatttaatgaaattcattattttctttcttgccactgattgattccttctactggaaacaagggttattctgggtccactttgtttacgtggcgcataatgatacgtggatattgcggactaatattttttttcattttcacataatttataaatatatcatttctttatgttattgcagcttctagctacgcgaagaagagagtttgttgaactgctacgcgcaggaggaaatatgtgttatttactaattatttacacgtatagaaacattttctttttaaaatgaaagatttacctttatatttttgtagttatacgatctcttcataacatgcatacaaatgaatttaaatgtcaataacataacaaagtttaaagaatataaagacgtgaaagataaagctaacggaataaaacccatgaagatgcattgaattcaatcagttgttatgccacagatccttttcatcatcaacaccgtcaccattattgtgtctgaaatcattattatcatcaatttgattacgatattcattttagttgattatgatcttcagtttaacttctatttactgattatatattcgctacgatttagtataaatttatttcaagatagttcaatgtgagtttgtcattgtgtgtccacacatattatttttttgctgtcgtcgtaattgtccacacatctaatgaatcatagtttgcttgcgtagtgaggtttggcataaattactaaagtgtgataataaactatgatactgttgtgaattgcgtgtcgaagatttgtggaaagattgtgtggtaagtcacccaaaattatggagtagtaatttttaattgaactataaatgtcgaagaatttctaaccaaacggtgctacttgggcaagaaataattcgttgaagaaccatctctatgcccactattattatcattattaattttttttttattgttcacgttcattcccaagtttcctctgatgtgtgtgtgttttattgtttgtcatggttaaatattcactatatttacctattgctcaatatttagaagtattttacacaaatccgaatagccgagcatccagctaaatagctagttttaaaccacccctcaaaaaaaaaaagaatttatatgtggatatatatatatatagttctactattaattgttagttttccatctttattatttctattattttcgcttattatagtgaagaaattgtttgcatcaatcaaagcgagcatttaattataacgtaagctcttcaacattcaactactcaaccatgagtaacatttacaagttaggcatacatctgaatatagttagtagttagggacaagttattaatgattcgtactgcgctaaatttttgaacatacaattttgttggtgcaattgtagtaacaaaatactgattttaataacacttggattcatgttttacttattccaaacatttgtctatatttatgtgtgcaattttttttaatttttttatagatgttaaacatgtgtgcaaattaattaatttatgttcagttttttgtttgttcgatcaaaattagtgtcacattcggcaaacgctaacacggagcacacaacaattttacaaaatcatagccaaaaaatgtccaaactctatagaaataaagcaaatgtggtttctatccatttgtctatgctcagatttctgtgtatgcacaaaaatacaatcctaaaatctaaagagggttggtttatattatacgtatcccaagattcaagtatatgtagagaataaaagttggtctaaaaaaataaatacttgattcactcgtacttggataaatttataaaaatagttactcagtacttgggttgggtacatatacgagatcgaatggtgatagctaaacaaggaacaaatgaatagaacaagtgtgattaatgcgaatcaagcgtatagaaatcatgtaacaacaagaaaagttgaatagtactacatatataaatgcatgtagctataacaaccacaaattctgtacccaataatcaaaaatctattaacatatgatttacatgtctaacaatgttgatttttcgtctagattttatgctaccgtttatcatgtttaataaagacagttatgacgttgggctttaaagcctattaagaaaaaaaagtctgttggaaagctgtttacaatttttatgaaacgcaacgttttaacgtttgtgagaaacgcagcgttttagaaacttaaaacctgtcttttgttggtgactgcacacggtttggtcatcatcacttcggcgatg

SEQ ID NO: 7154 - DNA, 3000 bp, Unknown; identical to SEQ ID NO: 5042
  misc_feature (1)..( 3000): cDNA_ID_3049857_gDNA_ID_1621129_Annot_ID_172437 3000 nt of promoter + ATG

SEQ ID NO: 7155 - DNA, 3000 bp, Unknown; identical to SEQ ID NO: 7149
  misc_feature (1)..( 3000): cDNA_ID_1816826_gDNA_ID_1621129_Annot_ID_56427 3000 nt of promoter + ATG

SEQ ID NO: 7156 - DNA, 3000 bp, Unknown; identical to SEQ ID NO: 7148
  misc_feature (1)..( 3000): cDNA_ID_2993617_gDNA_ID_1621129_Annot_ID_56429 3000 nt of promoter + ATG

SEQ ID NO: 7157 - DNA, 3000 bp, Unknown
  misc_feature (1)..( 3000): cDNA_ID_1816818_gDNA_ID_1621129_Annot_ID_56430 3000 nt of promoter + ATG
ttctactgttagaagaacgcttctcgttgtatacgttgatttctagggctttgtgtctgaggtcgttgacgtcaataacgtggaagacgagcttctcgttccagattgggttcaagtctttgggtttgaccttagtccggagacgttggttctcgaactgcacttccacaaaaggtgacgaagaatcttcgccatcttttggcatgagattgtgggcccctactatctccaccacgagcctctcattgccagtgccggttttagcttcagtcattaccggttagaaacaaagagataacaacaccaatggagaagattaaaagcacaagacaagtgaaaagacagtgactagagagagaaagatagagttatagagtctttgtgtatgcagcagacattaacaagagagggcgtgccaaggagagaatctggattttgtattttcttacaatattaaactacgtctcagatatttctcaattttaacttttaaaagatttttttatcatgacagttttgaataatgaataataggttgagtttgtaaattagcaacaacaaaaaaaaatatacgaacgatagcttttcaataaatagaagagaacataaaggaagggaacttcggagaaagggacataacagcctcgagcttcacgcacctggtcgcgcgtggatttaacaacgtgtctcaaccaatggaatggctctgctctgtacttaccgtctgctttttgctttcctcctgatccagtaggacccattttatttcctctgtacaattaaaaacgaaagagacatctataaacgtggtattcacgcgcgcttagactaacgcgtgaggaataatgaaaagaacaggctcaaccttcgtggcgggtcaaacctcaaaggtctatagaacaacaattttgtctcaaaagagtattcgtcagacctcagaaaacatttattgtactataatattagtaattcttgtattttgatattctttagctttagttttcaggataagtggggatttttataaaaatttgtaattataaaccatagattttatttttccccaataaaaatattacaatgtactgatgtagtgattagtgagtaaattaatactccctttgctttccacgagcagagcttagaaaaggttttggacttgagtttgcaggtctgtccttgtccttgtgtacataacgttcttcttgcttttttagagttcccaaaaaaccaataatatatcggcatttatttcatttgttacacttgtattttcatttttggtttcatgggttgtatgtcttgcttctttctttaattttctttttttctttaattttgttctgcagactttgtgcatgccagtgttaaataacaaaatcaaaacaataataataatacaaacttcgtccttgtaatgactgccgcgtggcatccagttcatagtcctcgtaaatcccacttgtgccttgtgagacctctggctctcatcacacaactcaaaaattcaaaatacgtaaacaactgtcatgttgaatcacgatgtttaagttttacttaccaacactacacgatttaccttttattttctaaccgtacgagctaaacgcacataaatattctttagtttgtctcgggcaacgtatattatattttgttccacaaaaacgataggattctagttagataaaaagtttcatcccaagttaaagtgaccgtatatggacttgacgttaaagcccaatatattgtgacaaaagaaaaactcaacactgataaaaggggcccatatattattgtctgcgagggaaccttactaagtcatatgctacatggggatgatagttgatgattgtctgcgagggaatctggatactatatgttttaaattaaagaattgtgattttacatataatgagcacctgttgtatcaaaaaaatcaatcaacatgtctcactaaaaaaaacaaaaaaactgttatatgagttgtatattattactactgattttaaaaagaacaaataattagataattgattttttttgttatgtaagaaatcggacaaaattagtttttccgcgtccgaaatacaagctcgtaataacaaagaaaagacaggggtaatttggggatgtaattgtcataattcaacgtctacttatgatgctgtcattttaattaaagtaaatattttctccaaaaacaaatcccaaaggtgggggaggtaagggaagagggaagcacgaaagccaaaataaaacgaaacttttttttataatctgagaaagtttgcgacattacaacaatcagaagaatcaacgcgtttcggttttgctaattccctttatttttctgggcattgaatctggtttcttgaagcattctcgtatacgcattgtcggtgtatttgtcggtgtattggaaggcttagttacaaagaagaagttcaatgttgctctgatttcagctagatccagagaataagcaaaataacattgagtttcttattcgttaaacaataatggtaaaggtttctttcattcatgggtttttcatgttttttttttcgtgattgcatttaaattcgtttcgttttatgatgatggatagggtttatgttttgatttatttcctcgtgtgatgtcgtttttgattgaatctgagttttgtaattgagtcattgatgatgagttttgagtttggcgattgtgattttttttttcaatctttgagctgtttcgagtcatggcatcgttgagtccctgtacgacagagatttgacttcaattcagacgtgtctgatagagtttggtgcttagtcctataacttgtctgattctctatttagctactagtggttacagagacgtgtaggtacattgctacggtttcaaattaccttaaaagccgaaattctatatgctatttgaacctaaatgcaagtttcttgattgcacattaggagatgcaatcttcgaagctttgagtttgttgtaatg

SEQ ID NO: 7158 - DNA, 3000 bp, Unknown
  misc_feature (1)..( 3000): cDNA_ID_1807894_gDNA_ID_1621129_Annot_ID_56432 3000 nt of promoter + ATG
ttactaaaaaggtgagttcaaattccagtaatccagagtggaatcaagtatttgtcttttccaaagaaagaattcaatcatccgtagttgagcttttcgttaaagaaggtaataaagatgagtatacgggtagagtcttgtttgatttaagcgagatcccaacccgcgttcctccggatagtccgttagctccgcaatggtacaagatagagaatagaaacggcggtagaggtaatggagagcttatggtttcggtgtggttcgggactcaagctgatgaggcttttgcggaggcgtggcattcaaaggctggaaatgttcacatcgaggaactctcatcgatcaaatcaaaggtttacttgtctcctaagctatggtatcttaggatatcagtgattgaggctcaagatgttgcaattatggacaagggatcaagtctcatgaggtttccagagctttcggcgaagcttcaagtagggagtcagatactgagaactgcaatcgcatctgcaatccccacaaagagcttttcaaatccttattggaatgaggatttgatgtttgtagttgcagagccgtttgaggattgcgttacagttgttgtagaggatcgtcttaatggtggtgcaataggaggacaaaacgatgtggctgttgggagggttcagattccgatttccgctgttgaaagacgaacaggagatacactggttggttcaagatggtttagcctagataacggcaacaataacaaccggtttggttctaggattcatcttagattgtcattagacggtggctaccatgttttggatgaggcaacaatgtataacagtgatgttagaccgactgcgaaagagctttggaaaccgcaagtagggcttttagagattgggattcttagtgcaactggtttgatgcctatgaaggttagggacgggaaatgcggtggaatcgcggactcgtactgcgtggctaagtatgggcctaaatgggtcagaacaagaactgttgtggacagtctttgtcctaagtggaacgagcagtacacttgggaagtgtatgacccgtgcacagttgttaccgtcggtgtattcgataatgcacgtgttaatgaaaataacaactcgcgggatgtgcggattggaaaggttaggattaggttgtctacgctagagacaggacgggtttacacgcattcgtatccattgattgtgttgcatccctctggagtaaagaaaacaggtgagcttcatttagcggttagattatcttgcggtaacgctgttaacatgcttcatatgtatgcgttaccattgcttccaaagatgcattatactcagccgttaggcgtccatatgcttgaacgtttgcggtatcaaacgctaaacgcggttgcggccaggctgagtagagctgagccaccattgggtcgtgaggttgtggaatatatgctagatcatgatttccatgtttggagtatgagaaggagcaaagctaattttttccgactggttaacgtgatttccggtttggtcgcggttgctaagttggttgaagttatgagaagttggagtaaaccggtttactcgacggtttttgttttggctttcttgtttatggttctgtttccggagcttctattgccgtgtttgcttctttacacggctgcggttggcgtttggcgtttcaggcggcggtctagatatccaccgcacatggacgcgcgtatctctcacgcagaaactgtgtttcccgatgaacttgatgaagagtttgacacatttccgacaagcagaggatttgatgttgtgagaatgagatacgatcgagttaggagcatcgccgggagggttcagacagtggttggtgacatggcaagtcagggagagagggtacaagctttgctaagctggcgtgatccacgtgctacgtttctcttcttgatgttctgtttattggcggcagttggattttacactgtgccggttaagttgacagtagctatttccggtttgtattatctgagacctcctcggtttaggaggaaacttccgtcgcgagggcttagcttctttagacggttgccgtctagagccgatagcttgctctagaacatgtcaagagtgtatttaactatttatcgtcttcttagattactagggactttagtttttggtacgatttattggttgtatgtatttattatgttttcggttaggttaacaaccggtgtttgaacacatgaatgaaagaccgaaccggttaaggcattgtaccgaacctgttgtgttaatgattaggatgctttgctgttcattacaaaagtttgctaactgcttgtagttttttcgtttttggtccccgcgtgatgaacttgttaagtgtgtaaaacaaattacacataagacataactcaattaatatacccctactgattcattaaatttaagaatttgccaacattgtatgaattgcgattcaatcctccttcgtgtccatgataagatatattacgaattattatagcaactaatttttcagataaatctcaaatattatttggatcaatcgaggaattatcaaaaattcaaaattatatattaggattacaaatagggttacagtgttctataagtttttatcagggtaaaaatatgaaataaagaaaatataagggtatgtttaaaattatgaagattgtgtttagataatcaagaacagggcatttccaattagagagaaaaaaaggagatccttttaatgtatcgcagaccatcctcagctatggcctcctgtttttccttttaggtatcttcgtagctcttcaccgtaaataatcccgacccatctagaggacggagccgccggcgaggaaattcaggcagattagatcggcgatttggccttgttttcaacgaagatcgtcttgttagggtttcgtccgcatctatggattctctgtcaaatggggtattgatatgaatttcggctttcgtg

SEQ ID NO: 7159 - DNA, 3000 bp, Unknown; identical to SEQ ID NO: 7147
  misc_feature (1)..( 3000): cDNA_ID_1816810_gDNA_ID_1621129_Annot_ID_56433 3000 nt of promoter + ATG

SEQ ID NO: 7160 - DNA, 3000 bp, Unknown
  misc_feature (1)..( 3000): cDNA_ID_1816806_gDNA_ID_1621129_Annot_ID_56434 3000 nt of promoter + ATG
gtgtttggcttggtatttgttaaatcatcaatagacaataatagtttgataagacttacaacaactgaatatttataactcgcaattagccctgttaacattccaggcagtgcctgcgtttaagcaacaatacagaggcttcttttaggtcatatgtcaacacctaaaacaaatagataacatgtgagagaaatgtgttaggtatattacactatgattagttcttttgttaaaggaccacgcaccactatcattatccacgttacacacggtttgaacttaaagaagatcgcatgttccactatcttttttgttgttgtttgtcctcctcaattgaacaatttgcatacgtaagcgacatttggttcatatacagtgttcatgaactgagcaacatatatactgtttttttttcatctaagaaaagctacctttttgaaatttgtatttatgcaaacgaaagataatggaaagtgagctggcatggaccgaaagtggtacaaaaaaagtttgaacaaagccattactataccaaacaaacgcaaatgacaaaaactacgcagcattaacaactatattacaattgtcattatttatgtataacattataatacactatcaaggcttctagattgttacatcatctccttaattcttccaagttacatcatcatatatagttgaaattaatttctattattcgtgagaatataagttgattggaagaaggaagattcagtctatatatatatttgaaatactatatgtggaagaacgtagaattccctattgcgaactagaaatgtgttgacgtaccgtgtataaccaaatgtaatatattaatcaaaggacatattaacgtacacattttttactgcatagtcagcaataattgacatttaatcatacatgtattagaaaatggtatgccacgtaagacgcattaccttgcatgaatggcatgtgtagtaagtcgtcatccgcatattgtccaaacaaacaaacaaataaacacatacgggcaagaattaaaaaaaaatcatcttttgttggtcttatatagttgcttatctgaatagtctcacactctctcacttgagagcaagagtgcatgtaattatactatagtattagtacatacgaacaatttggtggtgagtataagtttggatctttggactatatataaagtcattaatttcatactcttacgctattcttttatatcttttaatcaagttgacacatttgtctcattgttttggtgcagagatgatagattggttttctttcttttatatatatgtattgaaacgataacgtgtatgtctccactttctacaaatgaattttaaaaagctcaatgtgtatacataggaattgataaaccagtgattatatagtattttgtaatatactgacacctatacagttttattttagtaatatttgtagccttgtagacaatacataatactcatcacgtcacgtgtagaatattccatggaccgtataaggttcctcctccattgtatcccacaattaattagacacagcttagattagcaaaatggtaatttctttcgtttgagttatgattggcgatttcgtataaaacgaatcgagagaataaaaacgtaaaagaatcggaatatgattcattgcttaccatggttaagtttaatgataagtgcttttattgataacatatatggtcaaataatacaataatttgatcataaagagtaaagacaattgaaaaatgaaatcaccaaaaaagtcagatcacatacagacacattgacgcatcgacgtcaagcatcgtgagcgcacaaagagcttacggctttattattaacacacacactaagcaaaacagtaagtccacgagaaagcatccaaaaagcccaaaggaaccacctttattttttattttattttaggcaaaggaagctcctttattaaattcccaatcttcttccactactttgcacaatctttaatcgatccaaccaataaattttgcattttttttcgttggcgaatgaaggattagagagaaacagaagaaattgttaatttttttcttgttgattttaattaaagagaagagagatctctcttctcgattgctctcaagaacccaagtgacgtctggtttcagctgatttgtttcttctcattctctatcttcttctctgggaaatatcgattttgatctattaagagctggtgagagccaaagtttcctttttgtttgtttgtttgtttgtttgttgtttgtatttttgtatctctgtgatcgcttctacgtgttgggtcatgcagagaaactcattttgttttgatttgcaatgtgtcaattccactttgaaatataagattcatcgcctctctctcctttgttttttttcttcttctgcagctacgagctttgggatgtggtgagatgcttgttctatctcgaacaatccgccggttgttgattttaaacaaactctctatcacaaatctttcccgatcatggattttattgagatctcgttgatctttcgagagcatttgccactactggaactatgttcggtcatcatcaacctcctactctttcttgtctttctatttgctgtctccgcgaggcagattctcgtctgcgtgagaagaggcagagataggctctctaaggacgatacggtttcagcttctaatcttagcttggaaagagaggttaaccatgttagtgttgggtttgggtttaatctgtctttgctctgttgcttatatgtgttaggcgtccaagttttggtgttagtatatgatggggttaaggttagaagagaagtcagtgactggtttgttctttgctttccagcttctcagagtttagcttggtttgtccttagcttcttagttcttcatttgaaatacaagtcttcagagaagctacccttcttggtgaggatatggtggttcctggcgttttcgatttgcctctgtact

SEQ ID NO: 7161 - DNA, 3000 bp, Unknown; identical to SEQ ID NO: 5042
  misc_feature (1)..( 3000): cDNA_ID_1816798_gDNA_ID_1621129_Annot_ID_56437 3000 nt of promoter + ATG

SEQ ID NO: 7162 - DNA, 3000 bp, Unknown
  misc_feature (1)..( 3000): cDNA_ID_1840625_gDNA_ID_1621130_Annot_ID_56444 3000 nt of promoter + ATG
caatataaagaaccaaagagatccttacgtcttagaaatcgcgtcaaagatcatctgcccttctgcggtaacaccaaaaccaatcttctcgacgttactgcataatacattaatcaaaatcagtgataaaatcgaaacaatcatagagattttcacaacaaattgcaaaaactatcacctaatagcatgattctctttctctatgagtccatcaagattaaccaaagtatttttagcgagacgttccttaaccctccccagattcttcatctccgttatgtaattcacattcaccatccgtaaggatttcgaatccagaggtttaggcttcgtgccttcttgtaaaatcactaatccgtcaaggaatacgcgaaaacaaacacaagaagatgaaatcaagaaggcgaagtagcagagataagaatctacgagctgcgagtagcgatttcgaaaaaggatatcgaaaacggcgaagttgggttcagaatcataagccaagacgatgccattgaactgatctccggtggtcagcttgacagcgtataccttccccacctcgaatttctcgtcctctcctccgctgtctactttagccaccgtagcacttgctggtttcatggcggcgaacgaactctccggcggtttctaaatcgcggttttgaaaaagtgacggttgcaaaatatcttggtttatggcgcgtggacaattaataacaaactgtaaccgtaaatgggcttctgttcagagctatataggcccatataaacctatcctgggtcgtcactatttaagctattaccaggcgtaatttattaatatagcccaattagagtttagaccagcttactcttgactcttgagctttgcatataagttttttttttttttacagaaatttcaattattttcacaaagtatatacaatactattcttatccactggtagaccttttgttacttaataagatgtttatgctagatttatttttattttacttttattttattttattttatttttatgtctttttgttaactgcttatgatgctagatattaagaggaaaatgaagtgatccagctggcataaattaaactaatcattttatattttgtcaaaagagaaattattggaagctggtgagctactacatcaccattatctcctgtcactacttttaattttcaaatcctgagtgtcagtctttgaatgttggttctaaatctttactagatttgttttttcttttcataataatatttaaatttaaataacaattaactgaaatcgcagtgggatgatttgaatcttggtcatctgacaatttgtttttttaccacgaatttggaaaaattaagtttaatgttttgaccattaattttattgatgattttattaggcaaagatgattggtttgggtaacaatttgaatgatcagaaagaggagggcacatggaagaatggaatggaccgaagttaacggagatgaagacaacaagtcgaaacactcatcgcaaaacaaaactatataacacatctttcatcacatgttgtttgagtctatcttccacatgcgttctacacataatgtttgtgtccactttatattattgacatttaacagctattaattatgatgtagtggacaattactatctcaaaattcttgttttactagcagctagattattaaaattagtgatttatatgtaagtttttgatccacatttttttttcagtattgaaattgatatatatgtgtagactagcatttcactgttatatttacccatacttgatcataattaggtcaagtgtactattcagtacaaactgcatgcgtcgtgaatctgtgaaatcttattttgaactacaaatacaaatgtatcttttattgctctaaaagtttttaccgtctagtaaaatgattacatgttggtgggtaaaatgaatcatctctgcgttgactatgccatgaaatcattgatgccgtacaacaggcatcactgtttctatcataaaaattgtgtaaaagtgtcaaactttactaacgtcactcatctaacagttaaaaaaagatgtgtgaagtgtctaaaactttactaacttcatttaacagtgatttaattattcctcatgagacataaataaatattcgaatgattaagacttcacttcagataacgcttaagaaaagtcttttgaactacgttgcttacgtgtcaccatctaattataggatattaggattaattaacttaatcaaaccacatcgcggcatctgtgtacactgacaattataccctgacacgagcaaagccagaaagaatgtcatcgacgcacattatccaaggctaatttcgtcatttaccatattcagactaaagccatcagcgtctgtacaatttcagactggcggccactcactgaacaaagacaacttccttctccaccacaaactaataaatttgtattgataatttgatataatcttaatatattttagcaaccaaatgatgatactatgatagtccaaacatattaataaatctccttaacaaacttttaaaacctcattaacgaaaagtgaacagaatcttgagtaaaaaaaaataaaaaaaaaatcgtgcatatattcatatgcggtggacaattatttagaatttctctacgcaacaaaaaaaaagtaaagaaaacctacttacaactccggaaaattatttatatatttttcatgtggaaaatattgtaaattaagcacaaataatagcattgacatagacaaataataaagattttgagtaaaatatacctccatggtccaaaaaggaccaaaaccattgaaccactcgtctcgtctcttccacataaaacaagaacaacaaccaaaaaacgatgtgacatatacttagaaacaagctccatatcaataatcaaaaacacgaaagccaaaataaaagagagaaaaagaagataagttgttctatgttcctgaaatg

SEQ ID NO: 7163 - DNA, 3000 bp, Unknown
  misc_feature (1)..( 3000): cDNA_ID_1807177_gDNA_ID_1621130_Annot_ID_172475 3000 nt of promoter + ATG
agcctgaagactcgtcaattcttcccaaagagtttgagtacgagtatgatacgatgacaaatccagattgccttgacgaagagagtgaatctgttgacgcagcttgtaaagtcgagggaggctagatttgtgaaatcgagtatagagatctttccagattgcagcggctgtgggaaaatacaagatgcttgtatagatctcctttgatacactattcagaagccaagacttaaccatactgttacaacgacgccagattttgcaataaggatcatcatcatcaggttttggaatagatccatccacaaatccaagcttattcttagcttcaatgctagtagtcatagctataatccaggttccatagttgtttccatctaacagttctggagctaggactaaaccaggatgatcggagctaacaagatgataaggactatgactattatcaggagaatccgatacctcaaagtgacgcgatgagctatattgagctggttgatgaatcgcagcatgaatcgaggatcctggagctctcgctgatgaaccagaagactgctcatgaatcttcggtgaagcaatgacaggaagatccggtgaactactccgacgaacactctttccatttcgtttacctatggagaatcgaaacagctaaccaaagagactgaatcgcaaaggagacgaaaggaaaacgtgtagaagagagaagaagaacaatgagaagatgaacaaactccggtgagattccggtgagattccggtgagatctaatcggagaagtttgttacgggactgagatcgagatattttgctctgataccatattagtaaaacaatctcattctcattaattagcaaaagagtacaattgggggtttatatacaaactgacattggcctaaaccataagcctctaaaccaaaattaagattggtttataaaataccaacctttacagactctatatgaaatctatactaaccaaactaagtttatatacaacaatctaagttatatacattaataaatacaaaccttcacctaagaaaatatctttaacccgacataaatttgttactacggacatgtttttgtttaattggagaaagatatatgattgtgtatggtgtctattgattgattgtcacagaagtataggcattttctgttattggcaaactaagaaagaaaagacattttccactagttatgtaatgcatcttcgaaatacccaacggaccaaacctgctcatcctttccgtttttgatattatataacaatattttatatcttttaatcgctaaaaacgaatattatataaatgtattggatgtccaaaaaaaaaaatgtgaatggaggctttcatatgctatatcactatcaaccaatcacagaacatctttgacagaaggttacctatgcacgtacactacacatacgatgctctttgtttatatctttgcttatagtttatcgatgctaaccactgtaagaattaagtaaagttaatgccaatttaacattaagttaaaattactgtaaaaagtaaattagataggctgccttttaaaaaaattgttgaattataaccatatttgcttttcaaacatgcatgtcccaagtaacagaacaaacaaaaaaaagaagaagtttggcgtaatgctcctataccatgggttagtgctctcaagcgggtcatgtgtacaccaacaatatcaatttttgggtgtttgcttttaactgaaaaagtaaacgcatcgaatctttattatgatttcgatgaataatgataaaatttgggacaatttcaattcaagtgaggaaaacgtgtctgtgccttcttggtaaatctaacactgaaatttgacacgcagttgcttctatagtcagtaattccaataaagcatctaaaattgcatttgaatatttaatcatagtcgtccctatcaataattgtcaccaacaaagataaagggtaaataagaaacatataatgaaaattgaatggtcgtagttttatatgttagttggaaccaaagattcttcaatctatcatccactcagagctacgtggacagtcgatattttgggttatataaaaaaaaacaaaattgtactataagacaaaagaaaacagtattaaaaaaaaaaaaatcaataacaagattatatcttatcccaatgaacaaaatgaaaatttagttattttgaataatgttacaggttttaattaaattatactatatcacaaacagcaagagtcagatacatcgaacggtccagctttcctcctttatttttttctggctatcgttttgatgcaaagttgtttcgttaatcgtgaaaattaaaaagctacagcaatcttctccgaaacttcatacactcgccgacaagagaaacttcatccactcggatttctcgtaacttgcagcactaaacatttcatgaaactattcacaaaagtccacgaaccttgcaattggccacaaaatttaaaatacttatatacgtaacgacaacctatccatatttttctttctaacgatccaaaactggccacgcttcgactccatggtgatattaactagggaagtggctaatggcaaacaagtgcttagaagtggtaaattcaaataataaccgtcgattatttctttctaaccgttattgaggttaccaattaaaaaaagtgatcacaaactaggtcaatgaaaagggagattttttgttttctttgggccaatgaaaatagaaactaagatggacaaaagaaaatattataattggacaaaacagagtcatttgagatttaaaacagagaagtaataaaggtcaaatgtttttgtggtgagctctcaaaaacagacataaaaaaaagaagcagaatcattcccatttataacaaacctaaacctctcttttcttcttctctttacctttttcattccaaaatctctctctctctctctctctttctctggctcgggaagaag

SEQ ID NO: 7164 - DNA, 3000 bp, Unknown
  misc_feature (1)..( 3000): cDNA_ID_1816858_gDNA_ID_1621130_Annot_ID_172472 3000 nt of promoter + ATG
attaccagagtgatccatatttcattcataatgaccaaaaaggaatactaaaaaacatgagttatatggataataattatgcctaaaatgtccctgttttcctttgcagaaaaaataatattacagaaacgtcattactatttaattccagcatggcaataaaatcacatttatttacaaaactgccattgtcgtttttggtgaatatgtggctcttgttgcaacagatttgttttcgatcacagattttttggtcaaccacagattgtttacaacagacttgttttgtaccacagactttactggattaagttacgacagatttttattttttcgcagatttgtttatcgtgacagatttgttttatatagtctccacagatttttctaaaatttcaaaatttagaatgttgaaaccaaatctgtcactgatttattttccataccgcaaatttttccttatggtagcagcagattttctatttgtaaccaaaaatctgttgtgttataacagatttgttaacccaaaaaaatgttatatagtcatgacagagttgttttgtgtaatcacagatttaattaacttgttaacaaatctggtgttttataacagatttttgttaaaaaataaaattactagacagtcccatagtgataacagatttatttttagtgataacagttttgtttttcagtgttaaaacataacagattttctcatatcaatgttatggccgatttatttatgactagaataaactttttagtaataatagactttttgttagcagatttgtttttaaaatttcgaatttttttgttacatgagatttattaactagccctcaagtaaaaattttccggtttgattgtaggttaaatccggtttgattcaattttttttttttttgaaaaagaaattttcataacgtcacgacagacttttattaatgtcggcagatttttacataatattgtcatatttgaattttaatgaattttattagtcataataaattctccaagggttttcataaccgttttttttcttcttctattcctaccatcaaatcaattatttgtgaattgatacatgtcaaaatattattggtaagctaaaacaagtcaatttataatatgcaatatcaaaattaaattgtttttttttagtatttttaaaatcaaaaacgaaatatgtgaagaagattcttctttatctaaattttgttcaaaattattatttaaaaaaaagtttgttctcacggattttcgtttttgttttaattatgtaatataggttttggttttcttttttatccacgatttcctttttgattttataattctgttgaaaaataatttggttttgctgatttgtcaaaattttattggtggagtgacttgtgctttaaaatataaaagatttgttttattttttattttttgttttaatttgattacaattaatcattaaggttatttcgtctttttaccaaagatatggcttactacagtttttgaaaccaaacgtgtgtcatttaagttatttatgttaagagttgagtcaatctaagcaaatcttactaaaaaaatttattgccataaatacaaaataaaaatctgggaacaacaatgaatatgagaaatttgttcatcggtaaaacctatgtaactgcagcgcgtacattagaaatcatggatctcaagaacatatcatagaacctacgtataaattacaataagcgtcgatctcaataacatttcatagaaccataagtttactttattaatttatattgtacggataattcgaaattacttttcataagagtaaaggcattccaaaacctgaaaaaaaaaaacagtttttaggtcctttaaaagaatttataagtaagaatttataagtatatcttattgtaaagcacgcgaatatctttctcttggagtttaattcgacatacattacttaaaaagtatatacactatatacatattcatgtacgtgtggtgtgtgagggaaagaaagataattaatatatatgttgggatacgagatcaagtacgagaaaagattaaggtgttgattagttgcttctaattgtcatcttcatgactagaccatactttggtatacacaactggttacttttagtttgagatgcggcggtacgaaaaaaattaaacaaattaatgtgtgtttcaaaatattaattatagaattcaacactgttttcttagttgatctctctaatgctacaaaatattctgaagattataatataaggtgctactaaattatccatggtatgattcgtatatccaacattttttctgtattatttagaatttttaacaattaatactttctccctaaacaaagtttataaaaatttcactcaagtttcactattgaacgaattggtaaacaaaaataaatgttttggctatttaaaaaaaaaaattggtgcggtaaagaatggtaaaattgtagcgaggtgataatagaaagttgttaagaaacatctcaaattacagcatcttggccgataataaaactaatatactatgtttgatcatcatatgatttatttttcgttctagcctgcttctttgattcgtagccaaacaagctggagcactcccaaagtcccgagtcttaacgttttatggcccattaacgatctaaagcccaacataaagaacctatttctatcctttgagaagttttctctgtccgacgattcatagccaattaacgctaagattactatttgatttaatctaaaatatctttagcgaaaagaaagttatttaccaaaatctaaaaatttatatgtaattatcgaaatctttttaaaaaatttgatatgtaattatcgaaatcttcttataagaacaatataccaactcttttctttaataaccctaacaaaaaaaagatacataaatctggtgcatatacacatctctctatccgtctctctctgggtttcaatg

SEQ ID NO: 7165 - DNA, 3000 bp, Unknown
  misc_feature (1)..( 3000): cDNA_ID_3049921_gDNA_ID_1621130_Annot_ID_172466 3000 nt of promoter + ATG
aatggtggcttttggaaacttgtgataggtttttgccagctgtgaactcgatggaaacagctggatgatgttttgtcttgaaagtttgtatgggctcgataaaaggagatcgacggctgagactaaacgatgagaagccttttgagtttttgattggtttgatcaaaccctactttctcacgtgcaccacacgcttgtttttggatcagtaaatttcttaaaagtaaatggattggtaaccacaaataatttagatttctagattttaacagattgttatctaaatatcgggaaaaagtgaatctaaaaggtatttttattttgtgttgatcttttatcaaaaaaaaaaaagagtacattgttatgtttaacatttttgttgttggaataacgagtaagaagcgtgtctcactacgaatattctcgtgtgtggtgccacttaataatgttttgttttcgttattgtcgacgttttgtagtgttgagtgtgcgactagcgccactcaataacattatcacaaatatattcatttgcactttagacttaaatccatttcgttagtgttgccgcgtgcagtgtataatcgtttgattcgaatacgtaacgatgaaatctacttatatgtttttatacggagaatacatctccttttatttgtgtatgtgatggaaaatattctgtaatatttaatttaagataacgtcgccatgtttagtgtgactgtgtgagttaactaatgttaggtttcaactgggtctatcggctaccaaatactactaaggtcacaaaggaataaagaaccaaccttgttatgattacttgagttctttgcatttactattagcactacaatttgtccgccatgttcatgccaaaatccccaaccaaacaaattagaagcatgtaaacacttccatctatgtgtttattatttcttaaaattatgaacaaatatagtaaaaaaaaagatgaagatattagtagtaatagatcaagcaaattaaattgaagttaggtggtggaacaatgatgtcgttttggatacggacggagaaggtagatagagagagtcatagagatgcttttctctttattcgatttggtattataaaagtgtttgtttgggtatgaagatattacgatttacgaatttcaaaactatgctttgcgtggcgagtacaacacgggtttattgagttttgtcttcacctctccacttgctttagatttttactacattccgacagctaagtagaagacaaacaaagacagttgtagtaataagcagagctctttgcctttgcttcttgtttctgatgttatcctaactttgaggcaaaccaattttatgcttcattttgttctaaaattagactttcacaaaacaaatatattttcatttttcataggaccaaaaacgtcctcatttatctgtttgttgtctgtgggtaagaaaacaacatttggagacaatagttttcccttcaattaaagaatcgacgttttgataacaatcccgaaaagttgccaaaaatggaatcgagaaactgaaacaaaaaggctttacatttgaattgagttgagaaaactaaaatgacaggagcaagttttagttgcactgtcttggatttattgaaccggattctcctgcatgagtttgcggttataatgaatgttagagaggagatatgtgatggggaataatcgcgactatagtttatggaaagtgttgccctcagttcctttctatgctccaaaagactgcgaattgcaaagaggaaatgcatatctcaggagttgagtggaggaacatatccaagtgcatgtagtccaaaggatatgaagaagaaatgtaagttaactcaagctccgaaacctttttacgtagatatttgtgaaaagctcagatggatccggaacagggctctcctgaaacaaaataaataacgcatagactaagttttggtggtgattggtacacaattgtagttagagatgtaaaaatctcgctttctttatcttggctttagctacataaacctctataaattaatattattgaaaccatgatattttattaattttttttaaaataattttaattcataaaattttagaaagaaatcaattgagacaattttatcgaaatacaattagcgttttggatgttataaattttgtagtttcggatttgaaattttaataattagaagactttgttttcgaaaataaattagacaataaaattacaaacaatatacgtgaattcattttgataggtgaattcagataaacaaactatatacataaattcaaaaatttaattaataatctcaattatcgtatttaatagctagaatattatcaaaatgaaaatgatgcatatttaaaaattaaatacttacaaaaaatcttgactgtttttatgacatagttatagaatatatagtctttgccaaaaaaaaaaaaaggttatagattatactacaacactttaatttaaaaacacattagaccagttattttattcaatacaagtttgagatgggttgtaaggaattttaatcctttcactaaaagcataccttagtatatcaatatgcaaatttatataattattaatgagaaacacgtattacataggaattctaaaaaaaatcttattatcttgtcaaattttattctaatccaatttgagagctaaattttttattaatttataatattattaatttatggaatattaatttacggagtttctattgtagtcaaacaaataataaatcttgtatataacgttgaacttgacctgacacttacgaggaatctttcttgttttcaatgataattgattacatgtttttcgtttgtttaatttattataaaatattaatgatagataaaatgacctatatgtagacatgaagatccatattttacgggatctaaacgcctataagttttgtccttccacagtccaatagaagttcaaaaagaaa

SEQ ID NO: 7166 - DNA, 3000 bp, Unknown
  misc_feature (1)..( 3000): cDNA_ID_2990311_gDNA_ID_1621130_Annot_ID_172464 3000 nt of promoter + ATG
aaacttctctcttaagccaaataaaagagagacttgtccttcttctgcttcatcttcttgctttcttcacttctttaactctttgagttatttatttccagaagcttcatagtttctggaaaatgctaatccactagcggaataaaagacagatctttaatccactttagaaaccgcgttttctgaaaatgcggttgcgttttccgatgaaatctgccgttttagcgtttgctatctttctggtgtttattccactgttttccgtcggtatacggatgattccgggaagactcaccgccgtatccgccaccgtcggaaatggctttgatctggggtcgttcgtggaagctccggagtacagaaacggcaaggagtgcgtgtctcaatcgttgaacagagaaaacttcgtgtcgtcttgcgacgcttcgttagttcatgtagctatgacgcttgactcggagtacttacgtggctcaatcgcagccgtacattcaatgctccgccacgcgtcgtgtccagaaaacgtcttcttccatctcatcgctgcagagtttgacccggcgagtccacgcgttctgagtcaactcgtccgatctactttcccgtcgctaaacttcaaagtctacattttccgggaagatacggtgatcaaccttatctcttcttcaatcagacaagctttagagaatccattgaactatgctcggaactacctcggagatattcttgatccatgcgtagacagagtcatttacctagactcggacatcatcgtcgtcgatgacataacaaagctttggaacacgagtttgacagggtcaagaatcatcggagctccggagtattgtcacgctaacttcacaaagtacttcacttcaggtttctggtccgacccggctttacccggtttcttctcgggtcgaaagccttgttatttcaacacgggtgtgatggtgatggatctagttagatggagagaaggaaactacagagaaaagcttgaaacttggatgcagatacagaagaagaagagaatctacgatttgggttctttgcctccgtttcttcttgtcttcgcagggaacgttgaagcaattgatcataggtggaaccaacatggtttaggaggagacaatgtacgaggaagttgtaggtctttgcataaaggaccagtgagtttgttgcattggagtggtaaaggtaagccatgggtgagacttgatgagaagagaccgtgtccgttggatcatttatgggaaccgtatgatttatatgagcataagattgaaagagctaaagatcagtctttgttcgggttctcttctttgtctgagttaacagaagattcaagctttttctgaagagtttgtgtaagtcaacaacattctttttacttgttattgtagttttgggttattacaaatacattgttgaggatttattttttgactgttggttgtgtaaaaattgacttgtgtgagagaagagtttgtagaagctattgatgaggactagttagaagaattctttgtttggaatttgtattttgttgtgttctttccctaaatggttatgttgatctcaattttctgtatttagagtcttttcaagaatatgcagcgagtgtgttgttagcatgaaataaaccccaagtttgttaaactatgtcattgtagattacatataagattacatcttagaatggttagaagttacttgctatggtaaagaaaagagttatttgaatctgtccgcaatgatgaagcagtgtgagataaatgaagaagaatggagacattaaaggcttggctcctcggaaacataagttttcaaactggacacacaattgtaagtatgtaactgttcacatatttaagtctgctccatagtcaaacttcaaagttcaaagaactcatcttcttttttttttgggtcaagacataaaataactcatcttaaacggcaagatttgggctgttagtgggctggattgggttgacctgttaagtaatacgatgtacgtattcctcgtttctaaatgctttttgaaaacgataatgaaaatgttaaatcacacattagaaatttgtgaaaaggatgtccgtacctgcattggtttaatgtttgtatatgacattcatatagtaaaagaatgtgaaagtaccttcgactttgattgttatcaatatcgactatttttaactatcaacattagtcagttaaactagttaataatcgcttttgtccccgcctaatagtttagttagtacaacactttcttacttaccatcttccgacaaaggtcccactgtctcttgtcttcattctcatccttgtatctgatctgatctcttcttcttctttttcttcctctctctctcactcaaatctgtaattgggatttttcgacccaaaattaacaactccttataagttttcttgataggtcctctttgtgtttttttcctcacaaagtttccaactttgaaatgtatttgtgaatcttcacttgttactactttttgtgtccatcattattttggaagtaacacaattgtgtgggctatcttcactttttcaggtaatcttacaagattgccactagattctcttttttgtttttctttttggaattgtaatgataacttttcttagtgtcaatcattgatgagtgtttggctctctctctttgcttattcaattattgaagctcactctcaattagttatatttttttaagaagaatctgagtttgctcaccaagaggttgaaaaatgctgaagttgaaagtgtctattaattactaaaccaagattatatgtgtttttcctctctttactacaattattctgctttacagtgaagctactattggatgctaaaaaattggtatagttttagctcaaatccaagttgattctggctttgttcaagtttgaaagtgataagaattttctttggttttgtgtggattaggattctttctggtgagcattaatg

SEQ ID NO: 7167 - DNA, 3000 bp, Unknown
  misc_feature (1)..( 3000): cDNA_ID_1816890_gDNA_ID_1621130_Annot_ID_172460 3000 nt of promoter + ATG
aacagaacaacgagaacatgatagcaacctcagagaggatacagttcctcaaaaagcagaagagttacagagtgaaacataccaagataatgtatacgaagttcatcacttatttggggagtcaaatttcccatcccaatggcttgaactgcatgatatatcgtaagtggctgaaataaaagcaagctctacgagtcaaaaaaaagaaaacctcaagcattctaatcatacttgaaatcacattactcatcagaaaaactgttattacccagtggagaagtagagctacaggtgaatctagaggtaactttctccactcgaaataatccttccaagtacatagctgtttagttattggagataaaggccctgtgtaatccaaaatcagaactctatagaaacaaactctttcagtaaaaccataaacagagaagtgaaaatgaagtataccacgacatggacaagaagagctcggcaaatgccacccttcaatattaaaactgtcagaaaaagatagtagtcagctcaaccaacaatagcttcaaaccaaaacgtgattctcattaagtaaagagaaaaaataagcaatgaaacctatcaaaagccaaagctccacagttacactcatacatccacattccaacacgatgtaatcccctcttgatgaagaacgagcacctagtctcatgtttttgactaacctaaagaacgaataaaccaaaaacttaaactttgagctgaatttttactaaccaaaaggcatttgattcctcactatcattcaaagtgatgattaacctgaattgtagcttcttctgtaaatgtaaatggaaaatcatttaaaagatcaacacgacgcatttgctcttctaatctctcacattcttccttgtgatagctccaatgcgaaatctacaaacaaaataaagatcaacaaattcaacaaggaacatcctaatttgcttatccacctaactacaagcgaccgatcaaatcatcactgtgaagaagaagaaggcttaagagagagttaaagcagaagttaaaacctgatgagagacggagcaataagctacagcaccacactgaccacacctccgcgtcggtggaccaacacaccgcgtcgcaaaaccacgcgcggcacactccatccgccgtcgacgaccaagacaaccgccgtttcttctcgggacgaaaaaagtattaaagaatctcggtaactcttaaggcccatttttctaatcataaggcccaatgttttcttatcgtaaagcccaattagttcttatcgtaagccacaattttgtttatcgcaaggcccattttgttctcatattaacaatgttaacctagaaaaagtattttgaacaaagaaaaaaaacccctataaaaagtattaaaaaggactgatacaataatgtatataaatatcctaaaagatcttaattttgtaaatttattgttgtatattctaaacccgcaatattagaatgatgatttagtaaacaagaaagacaaaataaataattaattttagctagaaaagatgaaataaacactcatgatttaagccatacaaatcgaagccccttgggttcagcatttctcaccaagtaaataccatcacctctggaaacccatttacgtacttgaccacatcttttattagcggctcctctgtatgctctccatatgttatacacactatgatgccttaagatttattcacgacgatttaatcagatacgcttatggattgccaaagatgatgccatctacttagagaaaaacaatggaaagcgagaacgcatgtataattggaataaaaattaatatggttttcatatatctaaaaaattggacatttgaagccttaataaattatactatgtaaaaatacttgtttatgaatgtaaattataataaattacgatttaattagggaaatattgactatatatttcacccaaatattgaatgtaaattttattttccaatacttttgcacatttaagaaattttcggatgtatttcctaaagaatattaccttttttgttttttaaaccatgcctttttgttttacacgttcataaatgcatgttccatacgcattaccataatttaatttgaacttaattttctctaggaatggtgatgatccactaccactatcattgatttcattccatattcctttgaccgactgaaattacgttggaaatagtatattttgatgaataatttatttactcggaaaaaagaggtcaagttattaatagtaagtacatatacattatcaattaagaattcaattgagttttaaggaaaatcctattaatttgtttggtattcggtatttgttagttctaaggaattgaatttcccgattatacatcattataacgttctcaagttccaaacttgcaacccacattttgtcgatattctcaaatgtgaattcattcaatttcccatagaaaacataaatttgcacttaaagttaacaattgaaatcgtatctaaatgggaatgtttttggcttttagtgttagacttccaaagcgtcaaaaatatttctagaaagagcacaaaaaataagcaacgccactacttttggacaaagtcaacgataacacacatcaaccgcaccagctccataaaagtccatctcacgaaaacgattctagtcaaactacctaaaacacccttatatttacatacaacccaatcccactaacaagggtattttcgtcaatcacaaaatttatcaccgacccgggaagaagaagaagaacagatcaactaatttctgctttcaactccacattaaaccaaaacctccaaaaagaatcatttatttaaattatcttcccgttttaagttcctgagatttttgggaattgtaaatttgaagaaaattaaacaaagacgtgttttcatttttttttttgtttcctttattgatctctctctatctctctaaatgagctaaatcgtta

SEQ ID NO: 7168 - DNA, 3000 bp, Unknown
  misc_feature (1)..( 3000): cDNA_ID_2990290_gDNA_ID_1621130_Annot_ID_172458 3000 nt of promoter + ATG
aagaatgtgagagattagaagagcaaatgcgtcgtgttgatcttttaaatgattttccatttacatttacagaagaagctacaattcaggttaatcatcactttgaatgatagtgaggaatcaaatgccttttggttagtaaaaattcagctcaaagtttaagtttttggtttattcgttctttaggttagtcaaaaacatgagactaggtgctcgttcttcatcaagaggggattacatcgtgttggaatgtggatgtatgagtgtaactgtggagctttggcttttgataggtttcattgcttattttttctctttacttaatgagaatcacgttttggtttgaagctattgttggttgagctgactactatctttttctgacagttttaatattgaagggtggcatttgccgagctcttcttgtccatgtcgtggtatacttcattttcacttctctgtttatggttttactgaaagagtttgtttctatagagttctgattttggattacacagggcctttatctccaataactaaacagctatgtacttggaaggattatttcgagtggagaaagttacctctagattcacctgtagctctacttctccactgggtaataacagtttttctgatgagtaatgtgatttcaagtatgattagaatgcttgaggttttcttttttttgactcgtagagcttgcttttatttcagccacttacgatatatcatgcagttcaagccattgggatgggaaatttgactccccaaataagtgatgaacttcgtatacattatcttggtatgtttcactctgtaactcttctgctttttgaggaactgtatcctctctgaggttgctatcatgttctcgttgttctgttaggcagtttttgttaattgcctccacttcctttatattagtttagtcccttaatattggcaaaagaatcatcagaaccactatggtgtaaaattctgatatatgatttgctgatagtttgagcttctgaagggcctcagaaggaacttgggcaacttggtgtttttgctgagctgcaagcgctcttccctggtctgcgcatttatgtagatttgattggacctgacgttccacaacatatgtgagtcctgcattccacaatctatttgattactttgtataacactagttctattttagttaggaagagtaaagatatgtttttccttttaatcactcttctttagagttctttaagctattcagtgacaacattatagctggattttctttgtatgtgttgaactattgacataatttgatggatcgttctctatttgctttctcgatgaacagggatggagaaatgatctccctttgcagatattccccttgcatgggaaaagaatgtgaatgtaaaaattcaagcaaaattctcaattccgggagcaaacctgctttggtttcggctgtgtcattacagctccgtagagggttttaccatgatcgttacaatgacataacaaaggtacccctttctactagtctaggggcaaaacaatgatttactatactgttcttatatgtaatgtccattttcgtggaccttgaattgtttgtttcctaaaagatgtaataatttctgattgaccatctcggcaggattcatttcctccacacatagtgattgctccaaacgcaggcatcgctgcatatccaagctggttgccaactattgtacgtttttccagtagctaatgtcacatccaatagttcccaggatacacagagagagcatatgtttgttattcattcatgtgttggtgtgaataatttcaggaactgataaaggagatacaagtcccagcagtattctctgattactgtgaagaagcttgtcatctggctgcttgttgcattaaaaccatcacaggacaacctctatcatcacctgtaagtctaaattataggttcattgtcctatttaactatttcaagtctatgtttattgatatgtgggttcctcctgcatatagtcaggcttatgtctcatcaaaactgtatacgtagaatagagagtcgacacatatactatataatgaagttgaaggagacaaaaacatctcttttttcttcatctttggggccacacaaaacagacacactattgtccacttctccaatcaacctttgttggaaaatgatgttttgcagataaattcttatatatttcttcagaatcatattgatatgaatgtaacgatgtatctttgaaatgcagattgagttgaatccatttagacagccaatggcagtagaggagagtactctgtttatcccttgctactcaaactgtttcatcttcgcaatgtaaaaattctccaacattattgatcaactcaatggttcactgttatggtctggatcgacgatagagatactgttccggtgtatggaccaacattatctatacaatgaatgtagaaaatgtcacatcattttgttattggttgttgtagttatttatgtggataggaccatcaagtgcatacatacaatcattgtagtcttaggtgaatattatgctatatatcatatagcattagtcatttcaagtgaaactttgcaattatctttgtcagatgtcatgagcaattgaacaatgaaccaaactgaaccagatggtaaaatccggttcttggagatattcattcacaaaccaagtttgtgtctacgtggaagatgaaaccaaagcaaagaatcttcaaacttcttgtttctaagaaaagtctaaaaccagtttggtcgatttcttccacatccaaaactaactcaatattttatctcccccaaagtccaattttccaaaaaatccaaaacacacagagagaaaaaaaactgaaacatcccaaatggatcatcatcttcaaccataacaacacgaaacccttcttctccaaaatccccaaaaccttgaaacaaagtctcaaaatttcacttcgtggatccgaatg

SEQ ID NO: 7169 - DNA, 3000 bp, Unknown
  misc_feature (1)..( 3000): cDNA_ID_2024838_gDNA_ID_1621130_Annot_ID_172456 3000 nt of promoter + ATG
gacaaaagacacgcaaacgattccaacgacctctcacccgccaacacaaaacgcaaacgcagacctcgatttatatatcttatatttaaaaccatcttctaaacggctttacctgttttttagctttaatctctcttctctctctcaaattctctcctaaaatcctaaatattaccttctccatttgtttcttttcttcttttttgggtggctacctataatccgaaaaccaccatgaggttttgtgttttcgggtttttatcgcttttcttgattgtttctcctgcctccgcctggttcttccctaactccaccgcggtaccaccgtctctacgtaacactacacgtgttttctgggacgctttctccaatttcaccggttgtcaccacggccaaaacgttgatggtctctaccgtatcaaaaaatacttccaacgttttggttacatccctgaaacgttttcgggaaatttcaccgatgattttgatgatatcctcaaagccgctgtcgaattgtatcagacgaatttcaatcttaacgttaccggtgagcttgatgcgcttaccattcaacacatcgtgatcccgcgttgcggtaatcctgacgtggtcaacggtacttcgttgatgcatggcgggagaagaaagaccttcgaggtcaacttctcccgcacgcatttgcacgcggttaaacgctacacgttattcccaggcgagccacggtggccgagaaaccgccgtgacttgacctacgcgttcgacccgaaaaacccgttgacggaagaggtcaagagcgtgttctcacgcgcttttggtcgttggtctgacgtcaccgcgttaaacttcactctttccgagtctttctcgacgtctgacatcacaatcggattctacaccggcgaccatggtgacggagagcctttcgacggcgttttgggaacattagctcacgctttctctcctcccagcgggaaattccacctagacgcagatgagaactgggtggtctccggagacctagacagtttcctctccgtaactgctgcggttgatcttgaatcagtggcggttcacgagatcggtcatcttctaggtttaggacattcttcagttgaggaatccatcatgtatccaacgatcacgacagggaaacgtaaggttgacttaaccaatgatgacgtggaaggaatccaatacttgtacggtgcaaaccctaacttcaacggcacaacatctccaccgtcgaccactaaacaccagcgagacactggtggcttcagtgccgcctggagaatcgacggttcatcgagatcaacaattgttagtctcttgttgtcaaccgtcggattggtcttgtggttcttaccgtagataaagttttttttttcttacttcaattcttttagtttgatttacctcatatcttattctttttttattaaaggatggggatatatatacacacatatttagacattggttccttttctacagtttttgatttcacatatactacttgtatataaattactttatgtcctatacctatgtttgatttcgtgttatacattttcttagctttctttacccaaacattttagcgcgttcttgtgtgtgaacccttgaagcttgggtgtccttaacttatcatagatattccatcttttgtgtgacgtctctcgatccatattgttacgatcgactcatcaatcatccactggaaatttcaaagaatataatgaccttagtagtctagttgaagagtctccatcgattcagctctgtttcatcacctatgtgcttgaatctgttgagagtgatcttagtgcggcaacaagttaacaattgttcatcactttaggatctattaccttcaatcctctattatcgtctaaaaaaactctgttttatattggagataattctcttggattttttgatatttttccctcgtatgattgcaaattagaactttgactctcttcttggacaaacgggatggatccctctccttatcatcgtcccttgttgattaccacttcataaaaatatttgttggatattagtcggaatatatctatgtagaaaacttgttaaactaaaacatttctgacggttttttcgatgaactgtttaccaatttccggcaatatatttttgagaaagtttaaatgttcacaaactgcaagtgtataaatcaaaaaaaaaatgaggaaacgaagatgggtggaattgttggatttggatatatagtgaatgtttatcagatagtgaatgtttagtcaagttataggacttatccggtgataggacacataaacccacaaacaaacttgtgctcttttttaccatttaagttcatcatacattttgagctttgttaaatttacggttctaaaatcaattttttggactactttatatatcgataagttaatacctatatattttaataatatataacagtctcatttttattaaattttttattattattatacgcttcgatttaatttcccaaaaaaggacatgataattataaaagaactatggggtcaaacgtgaaaataatgaaaaatccaaacctatctcgtaaaatttgcgtagcgattgatgagagcatgtgaagaagccactagatgagtcaggtctctttggtttggcactgcgcagcactttcaaagcccaagcaagagtccgtcgtcacgaacgtcttcttcgtctccaccgattcttcacgtattttaatacttttccgatttgtttttttttttcccgttttgaatctcatcggaattttcccccggaatcttatggtatattctattataccttttttacaggaacctgtttactctctttctgtgatttttgagtagattcggcttcgtacgattagggtttgaaggaggtgattgtggtgtctttcgttgtttgtggttttatatcactgtaagttagaattggctccagttgattttcctagggttttcacaaatg

SEQ ID NO: 7170 - DNA, 3000 bp, Unknown
  misc_feature (1)..( 3000): cDNA_ID_2044232_gDNA_ID_1621130_Annot_ID_172454 3000 nt of promoter + ATG
gaatagtgacatttttcacatacactgtgcacacagtaactaaagatcattgctttctcatttccactttggtcttggttgaagtaattttatttagtttctgaaggttgaattgtttggaaaaaaaaaaaatgatctccaaaacatgttattttgcatggattgaaaaaagcatataaccatagcaaaatagctgttaatataaaaatgtatggttttgagtttcttttgactataatttatagctcagttttcacaatctccataatattgatcacaatctccacaatcaaactttttattattagagtgtatagttaagcaaaatcccaaaaataaaaaacctagctaggaaaatattcctctaaattaatattacacactagttctaaacaatctgatacgagttgccatcgagatttgcacacgaaaaatgttcaaagggacccttttttcatctttaatctttttggactttggtcggcgttggctgattatgactcgctataccacgatttctgtcccttgttacaaataattctattagctagtctcgattctcttttttctttcttcttttgtttaagtaacctccttatctttcttgtttagtggaatacaggctccgatcaaattcagtcacatgtcatcatttctctaagatatatgtttccacgtcaacaattaatttcagttagtttgtttttatgtgtttatataatacgtaataaatacataaactataatttaaacaagatgaggatttaaaccagcccctagtaataatctaacattaaaacaaaaagtaataacataacaacgatacaaaaaaaaaaaaaatataattacaaattttggtattaaaattattttttctatacattaaatatggaaaaaatatttctcataaaaatatatgtaaatatgtaaaaattcaatcatccttatatattatgttaatttcctttagagtttaaggaaatagttttcgatggttcatgtatttctcattttatatcatattatcacttcgtcaaaactatataaaaagttaaatggtacgaaaataattcgtacttaaaacacataataatgggacatacaccacatatcaccaaaaatattaataataatgggacatgcatagaaggaaaaaaaacataaaaactgaggactgttttgatgaaaacaagaagaagcctaaaatggaattcgtaggatattacattgaaaaatatgactgtaataaatttaagaggatatcacttcaaacacttagttaaaaaccgactatagtacatcctattctttgactttatctagttatatttagtatttacatttgtataccgtctatatatgcccaaaacatgtgaaactatttttaatatagaagtgaagatgtgtccccaataattaatgaatcacatatacgtttttcaacctaaatgtgaattatttcgttaattttgggaaatcaagtttttttctgtttccaaagcatatcttataaactcactttttgttttgataatatataggcacctatttgcgaacaaatttttattatgtacacagtacactcaaaagctttatgtagttattatcattgttatagtgcctaagttgctgcttatctaactatccactaagttttttagtttggtctatatcttagctattaactttagtcgagatcatttaactactatggcggcttgacagactgaggctattctttaatgaaaaactctataatgtaaaattctttttcttagtcatatagaattatagatatctatcgtggtttcaaactttcaatctatatagtatataagtgtataagtgacattatctaaacatgtttatatcctcaaagttgtaaagttactaaacttccgaaaagatgatagaaatagcaaccagaaaaactatattgtattgacttttgactgactttagaactcaatagtgtaggccaactcaacctaacattaaatatttatgaagactaattaacaacaatcatagggagcctattaaaatgttaaagtcttgcgcatgtttgactatataatactaacgtatagttgcatttatttcaatgatataaatattttatatctcattgtactacttaagttatagattgattattcgttggtgatatttaagaccaaatcctaagacgacatatatatgtaagtgtaacccaaaaaaatctaaaagtcataaaccgtatgattataagtatatataagatacgtattatactacagaaacacacacatgtgtaacggaccaacatggatgaagaaatggtcccattgagaagaagagatctaatgacttcaaatcaagaatggtccattttccaaaatagacacgtaaatatatacaaagcttaatccccatccctctattgggtctacacacagcctagcatttttgtattttctgctctgtttttatttttttttaactttacaaattactttttaattcttattatcttcagcttttgttctgtctttttttttattttcctgataaattctcacaacttccattcatgactcgagctgggtcctttgatttgtcacagctaatcaaaacagtattagcacaaaaaagtgtatatcaatatgaccatgaagttcataaaaacatgggacctttgaaagatgttgtctcacatattcatacatatttcaataaaatccattacgtacgattccatataaattattggtcagtcatgctaaatgtaagcaagcaaacatatcatttatggtgttacatcaagttatgacagagtatgattgaggccagaaagtaacttatgggtctaatggatcgtattccaaagtaatgggctttttattaaggccgtaagaggcccatttatgtgatttctttgaagtcgctttgtttgcaagttgcgactactcagtttcttctccggcgaagaagaggataacgaaaagaaaacacatagct

SEQ ID NO: 7171 - DNA, 3000 bp, Unknown
  misc_feature (1)..( 3000): cDNA_ID_3049893_gDNA_ID_1621130_Annot_ID_172480 3000 nt of promoter + ATG
acaaacactttgtttcttttaactaactcagattcggtgagacatatcacagaagctcgcaaaaggctgtctgctagctttattcagtctttacgtttaacaatctatttttaattattcactataagatggcttcttttaaaaactttcttttttcctttatggaagctttagccctttgaacactcccttttttttcttagttatataggtaacccacttatgatcacagttaattccatgtagatcgtattaaagtagtctattgactaaatcactaaaatatcaattaatgaattaatgttgtatgatttgttatcgtttatacgaaagtaaagaaaaacaagaaaacatgacttggattaagtaactctatgttctgtcttaatacaggagagcagggaattcaagacgaccaccaggaagagcataagtacggttaaagcttgggtaagaagcagaaagagagagagaagtataattgttggcaaattaatataggtcttgtattgctgctagattctcttttcctttcatttgggatcgaatcttttaaatatgcgcaaaatatttgtgaccctacaattctgttttttttttttttaaatgtttgttttgttcctatagtgaagaaatattgagctagttaggggaggttttaaaaaaatgaagacactgattattaaaaggatttcaagaaagaaaagaagtatacgtacatgcaatgcaatcctgttttctcacgcattgcacgacttatattgggattatttctaatttgatccatcatcaaataacgtttagatgctttatttccttactcacattgtttattgggtacttgcactaaatgatcattaacatttattaagttaggtaaataattgtgtactccttttatgtgcaaaaacacaaaatgggtactattttattactaacatgctttcttatcaaatagcagtaccctatgttgttctaaataacatgctaattcaattcagatttggcagacaaaataacatggtattttagagagagcgcgcacaagtgtgtttttttaaaacaaatgaaaacatcataattacgtacctgattgacccttgtgtatatattcacgattagaaattgtagattaccaaaacactcgcacaaaatggttctatatatagacaatatatgattcttatcacatgttttgaatgaaaaaaaaagaattaagatggattttttttttgtaaagaacaattgtactttgaaagagtcttatccaatcattaaaaaaaatgtcgaatccattatttattgatgtattctgaaagcatatattcttccaaaggggcaaataaaagagatgtcgacaaagattggatacataagatattaataatttataaatgcaatggcatatatatatgatataatttgagctctaaatgccgaaatttgaaaaggagaatgtgtgtaatggttcttacaaataaaggagaccacaatgcttctttgtgttatgcttttttcccatcttttattcttttgttcttttgtggggttaactctaccactactcattttctcgctcttttttcacttattttccatatatttctaatttctaaattaattttactaatcttgaaatacaaaaaactattagacttagcttactaatttactacaccaccaacatacacactacgcaacatatgctaatatgtattaaaatgaaaagaacaaaaaatgagaaccggtattacaatttatcgtagtgtatgactagttatgagatgagaaggttcttgaaaaaagaattactaaccaaataatgtagattaattatttgcaaataaagaaaagcaagaatatatagcaaaatcatgagtttacggttcggctctataaaatcttctacaaccatccacgataaacttgatacatgaaatgtcttcttccattaaaacatgagttccacatataaaatggtttacaagtaactctcgaacatatgtgcatggtaaagcaaatatataataccattattttttctgtcttaattaagcaaaattaaacatatatataatatatgatccctacatgttcacttttaaagttcacaatttcaagagtttgaatatctttaatttgaattattaccaaacgcattagacagactaaacagagacataataatcaatcaacttctttttgtcttttttttttttttttttttgggcttccagtcttcataatcaaaagtaactgaagaccagtcttaaagctggaacatttgaactaaacatatacgactgctcctatcgctctagaaattttaattaacaattattcatagttacttaattacaaagacaacaataaaggtgaacgaataaattaaaggaaaattatgaaaatagtttaatttgtatgaaacttttcatccgcataccaaatgtcatatactcttatcttacatttttctcttgggacatatttttggagcgaacactttcgcatgtacgataaggttcagtggtctgagcttcgactacgttaaaatgatgattagggtttactaatttggaattaggagttacatttaaggttaaaagtttatgagtttcaagtttcaacgaagctttaaagtttaaacgatggttaaagttttatgattatggtgggctatgttatagttctttcaatttcgttgggccaaatgggctaaacgattaacgaccctatgaatgggcctgaaaaaatgaaagccacgtgtcagacccccacaatggactttgactcggtgcggctgccggagagaataattaattatcaactccgatgaaaagaaaacaaatacaaagttccaacaaaaatcgaaattcacaatttctcttcttctaaatccatggagtgatgatgatgatagatagattgaatccaaacacaaaccggatccgagattaaaaacaatccggattgtttatatttactttagatcggagaaag

SEQ ID NO: 7172 - DNA, 3000 bp, Unknown
  misc_feature (1)..( 3000): cDNA_ID_4255167_gDNA_ID_1621130_Annot_ID_172478 3000 nt of promoter + ATG
ctgcggttcgtttaacggtaaaaacttaacgatcattgtaactgctggcgttattggagctgttggttcattgtgtgttggatttgggatgttttggtggttctttattagagataggaggaagatgaataactacggttatggcgccggaaaatgtaaggatgatagtgattggattggtttgttgagatcacataagcttgtgcaagttactctgtttcagaaacctattgtgaagatcaaattggttgatttgattgaagctacgaacggttttgattccgggaatatcgttgtttcgtcgagaagtggtgtctcgtacaaagctgatttgcctgatgggtctacattggaggttaagaggcttagtagttgttgtgagcttagtgagaaacagtttaggtctgagattaacaagttaggtcagatcaggcatccgaatttggttccgcttctcgggttttgcgttgtggaagacgagatattgttggtgtataagcatatggctaatgggacgttgtattctcagctgcagcaatgggatattgattggccaactcgggttagagtcgctgttggagcggctagagggctagcttggttgcaccatggatgtcaaccgttgtatatgcatcaatatatcagctcaaatgtgattcttcttgacgaagatttcgatgctcgtgttattgattacggtttggggaagttagtgagttctcaagactctaaagatagctcgtttagtaacggcaagtttggttacgttgcgcctgagtattcgagcactatggttgcgtctttgagtggagatgtgtatgggtttgggattgtgcttcttgagattgttacaggacaaaagcctgttttgattaacaacggtgaagaagggtttaaggagagtttagtggagtgggtgagtaagcatttgagtaatggtagaagcaaagatgctattgatagaaggatttttggtaaaggatatgatgatgagataatgcaagttttgagaattgcgtgtagttgcgttgtatcgaggcctaaagaaagaccgttgatgatccaagtttatgaatctttgaagaatttgggagatcaacatggtttcttctctgagtatagcgatgagtttccactcatctttaacaaacaagaacacttaaaatgaatgaaaaggttttattactttcgtactccaatttgataccacttacttatctaccgttctcacttttaaccgcatttttttgtttttttctgttttgtttttgtgtgctgtataattctgtacatcatgtgatgcatccaatgaaaatgagaagaattgttttatatagatcaaactttgaagattctgattcaaaaagtctatcaagtgttagtgtttctatgagattctagttgtagttgttatcgaacgatttgaaattcgatttcaagcgaaaagacattatccaacgatgtttctgtttcttctaatgattctatggataattataatcttttctgataggagaaaaaattaatgtttcccaagtcgctaatgaaaaatttgataaaattttataagataataggataatattttttgaaaatctttgtgtaaatatatagtcccttaatatttaaattgataatcatataaattacatatatataaattgatatattaatgtactttatgcttttagtgtgtgtttttaattaaaattaaattttttgttacagcttatctctaatttttattgtataaaaaaattattatgttgtgtttttaaaatattgaatcgtaatatactttataaatatgatagcattagtttgaaaaacttggtttggagtgaaacattctctatagtttttaaattttgaatatatctcatttttgcgtgttctaaaaaatagaatatatatcattttcattttaatagttttatttttaagaaaaaaaatacgacaaatgaagtcaaaagagtatgtagaactgaattcatctaaagagtttgtatttttttttttaatttacatctatcgtttgtataagtgaattcatctaaaagatttgtaatttattatcaaaagatggttttcctaaatattaaaattttacaatatatcaaaactataaaaaaatgataacatgcacaacactaattttgtttagataaaaatttcttaattcatcttttaataaaaatttaacaattaattcttttaaaaattattaaataatagtagataaactaataatactataaattaataaaatatcacatgatctcaacatttttattttatagaggttttactgtatatggaaataagaaaggtaaaatattagtagaaaatttggaaagaatgaaacaaagtagaaaaactggaaactagatatatgtatattaaaattttggcatgcatgatattacattatacatttttataatcacattttttcaattctctgtatagtaaattttccgtaaatctcagtaattaacttttatttctatgtatctagttatatatacacgctctttgtttattttctctgtcaacagtaaaaacaacacacaagataagaagctaagttaagatctttgaataagaagaaagaagtatgtcgaaaattttgctcctcataggacttgctctccttgtaatccttgcaattgctgttatgggatacttaataatgaagcgtggtcaagaatagaagccggatgtttaatttaacggttatgtagtttttttttttttcttctttctccttagagtgttggggtgaaactataaaactttttgattttctatttgtgttgctccatattgttatcagtggatagaagtaggaatgatttctagctatttcatgtgtgtttgtgtcataatcacctaagaattatgattttttctaaatcttatggatgtcatctgacccccttaccctccatgtaaatcttaatgactaactttgaaaacaaaattttatacaataagata

SEQ ID NO: 7173 - DNA, 3000 bp, Unknown
  misc_feature (1)..( 3000): cDNA_ID_1808030_gDNA_ID_1621130_Annot_ID_172452 3000 nt of promoter + ATG
ttcaaatttcagtttcttgacttcattaatgttaatataaataaacatatactgcatgataaaaatgttaatttaactgtaaatgtgaatgcaaatctgaatgtaagccatatgttttaaatattgtctacctaaacagagaaatgaattagtagcccaacctagccataacaaataaataatgaagaaggtcttcttccgccgaagataccaaaaatatattatcttctatttcaaaaagtatcccatttgtttctaatttctatggtacaatgtagttgttgaattgtaattttctcaatgttaatttcgttatctacgtaagcattgtcaactatttacatagtacatacaagtgatagttatatattagctcttccataatttttaattcttatcaatatgaaaatattgacaaatttatacaaatctgcatagaaaacacatacaaaacaaatatgaaacaatgttaaaaaaaaaaaaaaatatgaaacattttttctaatacacctgaaaactaaaataaggggtaaatatattagaggtaagcgaaaaatctactacaatctaaaccgagatcatcccaatggtataattaaagtctaaaatctaaatcgaaggagcaaagtattttgtaaggcacacgtgaaagaaagtaactacgggagtgattaataaaaacgggccaatgatttaacacttttatggcataattaaaccaagaagggaccaaataaatatgacatattgatacaaaaaggaatgtgaagaaaatctccggttctacgaaaaggacttccactactctttcccacacgctccagaccactgtttgctttcctctgattaaccaatctcaattaaactactaatttataattcaagataattagataaccaatcttaaaatttggaatcttcttccctcacttgatattacaaaaaaaaaactgatttatcatacggttaattcaagaaaacagcaaaaaaattgcactataatgcaaaacatcaattaattacattcgattaaaaaatcatcattgaatctaaaatggcctcaaatctattgagcatttgtcatgtgcctaaaatggttcaggagttttacatctaatcacataaaaagcaaacaataaccaaaaaaattgcattttagcaaatcaaatacttatatatatacgtatgattaagcgtcatgactttaaaacctctgtaaaattttgatttatttttcgatgcttttattttttaaccaatagtaataaagtccaaatcttaaatacgaaaaaatgtttctttctaagcgaccaacaaaatggtccaaatcacagaaaatgttccataatccaggcccattaagctaatcaccaagtaatacattacacgtcaccaattaatacattacacgtacggccttctctcttcacgagtaatatgcaaacaaacgtacattagctgtaatgtactcactcatgcaacgtcttaacctgccacgtattacgtaattacaccactccttgttcctaacctacgcatttcactttagcgcatgttagtcaaaaaacacaaacataaactacaaataaaaaaactcaaaacaaaacccaatgaacgaacggaccagccccgtctcgattgatggaacagtgacaacagtcccgttttctcgggcataacggaaacggtaaccgtctctctgtttcatttgcaacaacaccatttttataaataaaaacacatttaaataaaaaattattaaaacctcaaaaaatctctgtttcttgtttatatatccaaacaaatgaatgtgttaaaccttcactcttctctccacacaaaattcaaaaacctcacatttcacttctctcttctcgcttcttctagatctcaccggtttatctagctccggtttgattcatctccggttatggggagagaatgaggagttaccgttttagtgattatctacacatgtctgtttcattctctaacgatatggatttgttttgtggagaagactccggtgtgttttccggtgagtcaacggttgatttctcgtcttccgaggttgattcatggcctggtgattctatcgcttgttttatcgaagacgagcgtcacttcgttcctggacatgattatctctctagatttcaaactcgatctctcgatgcttccgctagagaagattccgtcgcatggattctcaaggcgagcctattcactttttttctctacctctcatttttttcaatgctaaaatacgccgccggagagtgtgtagacgctaaaatacgctgatcgaatcgttacatgcagagaatctttttttttacagtagtgtggtattgtttggtttacaggtacaagcgtattataactttcagcctttaacggcgtacctcgccgttaactatatggatcggtttctttacgctcgtcgattaccggtaaatgttttaaaaacgtcaacgttagttaattctattgtctctgtttttttattatattgatatgacaaataacaaccccaaaaagtcagttttatttccctttttttttttcaatggatcgatttgtttattgacttttcttcagaaaaaaatgaaaacgactaaaaatttattagagcaaaaaattataatcggtatagaataatttagtagaaattaatcttatattggaatgtacgtaaacgatagaacaggagcgggctggggaactttttttcgttttttaattattttattgaaatttatattttcgataaaaaattacattgacgtttacataataatagtatacttttgcagtaaactttccacttcatatatcggctttattgaaaactttgtaatcatagtgttaaaacgctcctactactatataatattttaaattaattttgtaattaaacttaatagagtatatagtaatcaatgattatattaatcagctttaatttctgtaaaataggaaacgagtggttggccaatg

SEQ ID NO: 7174 - DNA, 3000 bp, Unknown
  misc_feature (1)..( 3000): cDNA_ID_1808030_gDNA_ID_1621130_Annot_ID_56446 3000 nt of promoter + ATG
tttgggattttgcttaactatacactctaataataaaaagtttgattgtggagattgtgatcaatattatggagattgtgaaaactgagctataaattatagtcaaaagaaactcaaaaccatacatttttatattaacagctattttgctatggttatatgcttttttcaatccatgcaaaataacatgttttggagatcattttttttttttccaaacaattcaaccttcagaaactaaataaaattacttcaaccaagaccaaagtggaaatgagaaagcaatgatctttagttactgtgtgcacagtgtatgtgaaaaatgtcactattcatcactcatcatgcaagtgcttgttgatatgtttgattagagactgaaaaatgtgaaaaagttacaattcatgttgttatacataaaattggagtctggcgaaaaaatcgatcaatgatcagtgtatgaatattatataggcctcattatcattccattgaaattggtagcttcaatgatctgagttcaccgatttttcaatgttttgattattcattttcaagttctcctttaaaaagaggattctagaaatgtttcctaaaactaactcaatgtagagaaaaaaaacatatattgctgaaaatgactcgacccacttgttaactattcattatatttctagtaactcaacatggactcatgatcatcattgtatataacaaaaaaaaatgcattattatgattacatatgcaagagtatatcaatagggtccgagttgactatgctacaggagaacgaaaaaaaacatttcttaacgagtagtatcaattaatgtgacgatgatagtataagatcatgtctagtgatatcatacgtaccatataattagatctgaaataaccattcaacaacgatcattgactataaggcaatagctcccatgaatcgtcttgattttctttaagaaaataagacattaacaaaaatgacgaaccctaccacgagaatgtagtcagtctgataaattgttgtaggttgggaggtgcatattttccctcctttcaaatttcagtttcttgacttcattaatgttaatataaataaacatatactgcatgataaaaatgttaatttaactgtaaatgtgaatgcaaatctgaatgtaagccatatgttttaaatattgtctacctaaacagagaaatgaattagtagcccaacctagccataacaaataaataatgaagaaggtcttcttccgccgaagataccaaaaatatattatcttctatttcaaaaagtatcccatttgtttctaatttctatggtacaatgtagttgttgaattgtaattttctcaatgttaatttcgttatctacgtaagcattgtcaactatttacatagtacatacaagtgatagttatatattagctcttccataatttttaattcttatcaatatgaaaatattgacaaatttatacaaatctgcatagaaaacacatacaaaacaaatatgaaacaatgttaaaaaaaaaaaaaaatatgaaacattttttctaatacacctgaaaactaaaataaggggtaaatatattagaggtaagcgaaaaatctactacaatctaaaccgagatcatcccaatggtataattaaagtctaaaatctaaatcgaaggagcaaagtattttgtaaggcacacgtgaaagaaagtaactacgggagtgattaataaaaacgggccaatgatttaacacttttatggcataattaaaccaagaagggaccaaataaatatgacatattgatacaaaaaggaatgtgaagaaaatctccggttctacgaaaaggacttccactactctttcccacacgctccagaccactgtttgctttcctctgattaaccaatctcaattaaactactaatttataattcaagataattagataaccaatcttaaaatttggaatcttcttccctcacttgatattacaaaaaaaaaactgatttatcatacggttaattcaagaaaacagcaaaaaaattgcactataatgcaaaacatcaattaattacattcgattaaaaaatcatcattgaatctaaaatggcctcaaatctattgagcatttgtcatgtgcctaaaatggttcaggagttttacatctaatcacataaaaagcaaacaataaccaaaaaaattgcattttagcaaatcaaatacttatatatatacgtatgattaagcgtcatgactttaaaacctctgtaaaattttgatttatttttcgatgcttttattttttaaccaatagtaataaagtccaaatcttaaatacgaaaaaatgtttctttctaagcgaccaacaaaatggtccaaatcacagaaaatgttccataatccaggcccattaagctaatcaccaagtaatacattacacgtcaccaattaatacattacacgtacggccttctctcttcacgagtaatatgcaaacaaacgtacattagctgtaatgtactcactcatgcaacgtcttaacctgccacgtattacgtaattacaccactccttgttcctaacctacgcatttcactttagcgcatgttagtcaaaaaacacaaacataaactacaaataaaaaaactcaaaacaaaacccaatgaacgaacggaccagccccgtctcgattgatggaacagtgacaacagtcccgttttctcgggcataacggaaacggtaaccgtctctctgtttcatttgcaacaacaccatttttataaataaaaacacatttaaataaaaaattattaaaacctcaaaaaatctctgtttcttgtttatatatccaaacaaatgaatgtgttaaaccttcactcttctctccacacaaaattcaaaaacctcacatttcacttctctcttctcgcttcttctagatctcaccggtttatctagctccggtttgattcatctccggttatggggagagaatg

SEQ ID NO: 7175 - DNA, 3000 bp, Unknown; identical to SEQ ID NO: 7170
  misc_feature (1)..( 3000): cDNA_ID_1816909_gDNA_ID_1621130_Annot_ID_56447 3000 nt of promoter + ATG

SEQ ID NO: 7176 - DNA, 3000 bp, Unknown; identical to SEQ ID NO: 7168
  misc_feature (1)..( 3000): cDNA_ID_1816898_gDNA_ID_1621130_Annot_ID_56451 3000 nt of promoter + ATG

SEQ ID NO: 7177 - DNA, 3000 bp, Unknown; identical to SEQ ID NO: 7167
  misc_feature (1)..( 3000): cDNA_ID_1816890_gDNA_ID_1621130_Annot_ID_56453 3000 nt of promoter + ATG

SEQ ID NO: 7178 - DNA, 3000 bp, Unknown
  misc_feature (1)..( 3000): cDNA_ID_1816878_gDNA_ID_1621130_Annot_ID_56456 3000 nt of promoter + ATG
cgcgttttctgaaaatgcggttgcgttttccgatgaaatctgccgttttagcgtttgctatctttctggtgtttattccactgttttccgtcggtatacggatgattccgggaagactcaccgccgtatccgccaccgtcggaaatggctttgatctggggtcgttcgtggaagctccggagtacagaaacggcaaggagtgcgtgtctcaatcgttgaacagagaaaacttcgtgtcgtcttgcgacgcttcgttagttcatgtagctatgacgcttgactcggagtacttacgtggctcaatcgcagccgtacattcaatgctccgccacgcgtcgtgtccagaaaacgtcttcttccatctcatcgctgcagagtttgacccggcgagtccacgcgttctgagtcaactcgtccgatctactttcccgtcgctaaacttcaaagtctacattttccgggaagatacggtgatcaaccttatctcttcttcaatcagacaagctttagagaatccattgaactatgctcggaactacctcggagatattcttgatccatgcgtagacagagtcatttacctagactcggacatcatcgtcgtcgatgacataacaaagctttggaacacgagtttgacagggtcaagaatcatcggagctccggagtattgtcacgctaacttcacaaagtacttcacttcaggtttctggtccgacccggctttacccggtttcttctcgggtcgaaagccttgttatttcaacacgggtgtgatggtgatggatctagttagatggagagaaggaaactacagagaaaagcttgaaacttggatgcagatacagaagaagaagagaatctacgatttgggttctttgcctccgtttcttcttgtcttcgcagggaacgttgaagcaattgatcataggtggaaccaacatggtttaggaggagacaatgtacgaggaagttgtaggtctttgcataaaggaccagtgagtttgttgcattggagtggtaaaggtaagccatgggtgagacttgatgagaagagaccgtgtccgttggatcatttatgggaaccgtatgatttatatgagcataagattgaaagagctaaagatcagtctttgttcgggttctcttctttgtctgagttaacagaagattcaagctttttctgaagagtttgtgtaagtcaacaacattctttttacttgttattgtagttttgggttattacaaatacattgttgaggatttattttttgactgttggttgtgtaaaaattgacttgtgtgagagaagagtttgtagaagctattgatgaggactagttagaagaattctttgtttggaatttgtattttgttgtgttctttccctaaatggttatgttgatctcaattttctgtatttagagtcttttcaagaatatgcagcgagtgtgttgttagcatgaaataaaccccaagtttgttaaactatgtcattgtagattacatataagattacatcttagaatggttagaagttacttgctatggtaaagaaaagagttatttgaatctgtccgcaatgatgaagcagtgtgagataaatgaagaagaatggagacattaaaggcttggctcctcggaaacataagttttcaaactggacacacaattgtaagtatgtaactgttcacatatttaagtctgctccatagtcaaacttcaaagttcaaagaactcatcttcttttttttttgggtcaagacataaaataactcatcttaaacggcaagatttgggctgttagtgggctggattgggttgacctgttaagtaatacgatgtacgtattcctcgtttctaaatgctttttgaaaacgataatgaaaatgttaaatcacacattagaaatttgtgaaaaggatgtccgtacctgcattggtttaatgtttgtatatgacattcatatagtaaaagaatgtgaaagtaccttcgactttgattgttatcaatatcgactatttttaactatcaacattagtcagttaaactagttaataatcgcttttgtccccgcctaatagtttagttagtacaacactttcttacttaccatcttccgacaaaggtcccactgtctcttgtcttcattctcatccttgtatctgatctgatctcttcttcttctttttcttcctctctctctcactcaaatctgtaattgggatttttcgacccaaaattaacaactccttataagttttcttgataggtcctctttgtgtttttttcctcacaaagtttccaactttgaaatgtatttgtgaatcttcacttgttactactttttgtgtccatcattattttggaagtaacacaattgtgtgggctatcttcactttttcaggtaatcttacaagattgccactagattctcttttttgtttttctttttggaattgtaatgataacttttcttagtgtcaatcattgatgagtgtttggctctctctctttgcttattcaattattgaagctcactctcaattagttatatttttttaagaagaatctgagtttgctcaccaagaggttgaaaaatgctgaagttgaaagtgtctattaattactaaaccaagattatatgtgtttttcctctctttactacaattattctgctttacagtgaagctactattggatgctaaaaaattggtatagttttagctcaaatccaagttgattctggctttgttcaagtttgaaagtgataagaattttctttggttttgtgtggattaggattctttctggtgagcattaatggtggatatggaagttggtattgccagtggtgaagataaggtaatacccatttgtctactccaacgtcattttgatgtgtttgtgcctaattattgacattactgtcaatgtcctatgatctgttttgcatttgtgtggtttcttgatttgtcatagttagttaggtgttatatg

SEQ ID NO: 7179 - DNA, 3000 bp, Unknown
  misc_feature (1)..( 3000): cDNA_ID_1816870_gDNA_ID_1621130_Annot_ID_56459 3000 nt of promoter + ATG
atgctgcttccttgtaacggtgctgatgcaaagaagataacttgtttcatccatacgcttgttagtctgggagtctcttaccattttgaggaaaagattgttgagttcctgaaggacgctttcgagaatatcgaggacatgatcatcgattgcaaggaagatgatctctacacggtttctattatattccgggttttcagattatatggtcattacataactccaggtgaggatctttcatctttattacggaactaactgacttggttggtttatgctccgttccgttgtttttaagtggatgtgtgatgtgaacattttgaacatgtttcagagttgcatataactatttcatactacttttttttcttaatatttcatacttgcatgtgtgtagatatattcaacaggtttaaaggagacgatggaaattttaagaaatgtctgaatgatgatgtaagaggtatgctaagcttctatgaagcgtcacactttgggacaacgacagaagatatccttgaagaagcaatgagtttcacacaaaaacacttggagttatttttggtaggcgagaaagccaaacattatccacacatcaccaagctcatacaagctgctctttatatacctcagaatttcaatttggaaatattggtggcaagggaatatattgacttctacgaactagagactgatcacaatgaaatgttactaaagttggccaaactcaactttaggttcctccagctgcaatacattcaagatctgaaaacactaaccacgtatgtatattcatttatatagatgcttcatatatatgtatattttctgaaagttttatcgattaggtgtatgtatgcagatggtggaaggagctagatttagtatctaagataccagtttacttcagagagagattggcagagccttatttctgggcgactgggatttattacgagccacaatattcagctgcacgaatcatgctggccaaatccatcattttagtggacattgtggacaacacttttgatgtatatggtactattgatgaagttaagagcctcgttcaagccattgaaaggtacgaactatatacgatcatttgttaggtgctttgtaatcacactcatggtataaacgaaaaacgaaaaaagttacaaagtggaatgaatttaaaggattaaaaagtcatatttaaaggatataaaagctcaacatctaggtctctttatattgttggaatgttggtgttctatttaattataaatcattagatgtgatccctaataattgtatggatccaatattaagtaaaggtgggactccgacgccgtagatgtcctaccggactatctcaaagtcgtcttcagaacaacgtttgacttgtttaaagaactcgaagaatatgtgagctctgaagcaagatcttttactatgcaatacgcgtatgagcaggtactgtttcttcatctatttcttaaatctaagccaaattattgcatctataaaaatagttactatacaactaatgttttaaaatgtctccaaacaacaccattctcttatatgagtaaaacaataaggagagcatttggatgttggaaatgttcattttctacgtggtatttttttcctagatcatttagctccacaaattcagccaaaaaataaaatatatatctctatattaaacgaagaattgaaggttatatatagttcgtatttaatataatgttttgcagctaaggatactcatgaaaggatacctgcaagaagccgaatggtcaaatagagggcacctgccaagccatgaagaatacatagaggtcggggtagcttcgaccgcaggtgaagtgctgctagcaatgaccttcatccctatgggagatgctgcaggagtcggagtttatgaatggctgaggtcaagaccaaaactgacccatgctctttttgtgaaatctcgtctcagagatgatattgctacctataaggtaacagaagtcctatatatatatatatatatatatatatatatatatatatatgtatattttaaatgcaaattataaaaataaaatgctaataaatcttatcgtatagtatttcacgtcataaactactttttagttatttgattgataattttgacatgatcgaaatatatgatgaatttgcatcaggaggagatgaagagaggagatgtttgtaatgggatcaactgttatacgaagcaacacaaagtaagtgaggaagaagcgtgtattgagtttgagaaaaagactaatcacatgtctaaggtcatgaacgaagagttcttgaaggcagccaaatttataccgcttcatattctaaggcctgttttgaattacggacgcttagcagatgtgtgctataagtatggagatgggtacaccttcgctggagagaagatcaaagattatatcacctctttgtatgtcgatctcatcactctttaagagtcttcagagtttgggatcacgtgaatggccaagccaaatttgtatccgcagccgcaacccaaaaataagttgtttcagtttaagttgtctttgttttcttggttgttagtctgtcttgaaaaccatcttttaatcagtaataaagcttgtcattagactatcaaaactaacaataatccgaataacaatctatgaatacgtagttaacacttatagtagtgggatttggctttctctgcagatgtgcaattatctatttttttattagcaccgataagaaaaaaaaaatattaattttttctttgttattcgcttagttaataatattaaaacgggcattcttcgaaatatattgtgtacgtaagtgacatcaagcgggtcaataggaacttttcgtagaaaataatccgtttttacatcagacaaaaaaatattcatttatctgagaaaataataattaattgggtgtaatatccaaaagccaaaaaaaaatcaaatcttgaaatgccctgaaaac

SEQ ID NO: 7180 - DNA, 3000 bp, Unknown
  misc_feature (1)..( 3000): cDNA_ID_1816866_gDNA_ID_1621130_Annot_ID_56460 3000 nt of promoter + ATG
ttattttactttatttgtctaaatttcttttctaatacagttacaaacttttatatttttatcttaaatatttcaaaacttttagattttatacatggtgaaatctgatgatttaattgatatttgttgcaatcacgagagttagcaagtttgagattattgttttgaaataagatatggaggataaatttattttaaaaaagagagagaaaaatgaaaaaataagaaaatacttaattattgttttgaaatactttaattaattaaaaacaactatatctttaactaaattttaataacatatcatataattaagtataggttaaagttcattttcttaaaaattatctttccttaacaactatatctttattaaactgtctcatcttccttttgcactccaaaatagtttcctcgtttctcttcaatcaatcacttagaatggcagacgaagaactatctataggagtgcggatcttcgtttcttttctcatagcctttggtatttgtggtctggttttgttgatgataaaagacaattctggcaaaatcccggtgccgaaaatagagttagcttcaatggatttcacggtgcaaaatattacaatgactcgtcttaatgcaaaatgggatttgtcgataaggatccctgatgatcttcctggtaagtatatatgtcttcaaggagaccttgaagcttccttgctttacaagaatgtcactcttgctacctcatccccacaaaagtaatgaatctatttcctactattttttaaacccgttttaaattccttaattcgttcgtattttcaaaactaattgaatcttgtatatgatcagatactacaatctcaaatacttcaatcctcagcttcttaagatttcagctaatgtttccgaagtagatattggcggtttgattggaaaaaatattattaacgatgtcaaagagaggaaagaagtacacttcggatcgcgattttctctcacggattgtagagaaaaaacgacaggagttatgagttatgagtgtgacgaagccaccttgcggttcgagccaagctctgagatgaaggcgacaatgtttggggaccatccaaactgcatcaatgtttgaccaaagtccatgtcatcaccatgccagttcattgttatattttggcgtcaatgttaatttgactcggagagtggggaaacataaacgagagaagttgggtcgtgtaggtacataatgggccgacaataacaaacgctaaaactaaaatgtgtgaaaatgccaatatttgggcccaaaagataagaaaactggaaaggaagtaaaagtgtacgtaggattaattaaaaagatagtgtaaaacaaagggggcattcggagaattgaactccggacctctcgcaccctaagcgagaatcataccactagaccaaatgcccaatttgattgaagcttcactttgttgttagataaccatattctatgtcaccaaaaattatccacatctacatagtcatcttaagtttacctacctatcaaaattcaaaagagtattagcaaagtccgactgacaaactaaatttgaaccgacacgagagaaatgattttttcattggaattatttgattcttagaagttgaaaacttactttaaactagaaaaattacaaatcacaaaaccaccttaaagaaccaaacgacttaaatgatccataatcatatctacgatctaccaatatagcctatacatgaaataaaacagttcaataaataaataaaacaaaactggcaaaatgctttctagatcataaaaagcctcgaatttactaattgtagcacatgacattgatagttaaattctcctaacattcctattatacccacaccatcacccaaaaataacaaaatcaccgaactacacaaacccgaattgcaaggtcccaaaataaccaaaatccaatcctctagctctgctgcgccctaatcccccaattaacctcaccggctataaccggttactctacctataagcaacctagcaacggctgtctctaagttgtatttcatatttttttcaattctttattttccatcatcgatatatgtttctctaccgttttttatttatttattattcttattattattatttttatttttttatattaatcatttgactgttgtttcctctaccgtatttactacatttttaatattaataaacttttttttaatatgtttcataataataaataatatatggtgatggaaaaggtaaaaaataacagggaaaacttttttctggtaattaagtaaaaaatgggcttaatgaatagtaaaatagttattacaccaaatcatataatataaacaataaattaaattacaattaaggcagaagtaaaaaaaattaaaaaacctttgagaagtctcatcttctcatcttcaccataaatatgattttaacttatgtcttatttctttttagttctgtctgcaaagaatttggtttaaagtcttgtctttgtggtgtgtttccgtgtgcggtaaggaggaagcttgtgcttgtagacttgtgtctctgcaaaattcggtaactctctctacgatcatcttttacttttttcgaagcgttttttttttttgtgtttcttaattcttatcttgaagcgccgtaatgtgaattaatctgaagattaagttcttaagatcgattttttctgcttcattgtttcttaaactcttttctcgattttgctttgattgttctctacttgctagatctactgctttagtttgagattgcttgcagagttcaatattttatttggattgtttcttgatttaagattcaaaaggatttatttttattttcaatcgaattgcccaaattcaaagactttagtttggtgaattgagtttgcttggagatgcacagtgatctaatttgcggctaaattttttggtttctgtggttaatgaagctctggcaaaatataaaccatg

SEQ ID NO: 7181 - DNA, 3000 bp, Unknown; identical to SEQ ID NO: 7164
  misc_feature (1)..( 3000): cDNA_ID_1816858_gDNA_ID_1621130_Annot_ID_56463 3000 nt of promoter + ATG

SEQ ID NO: 7182 - DNA, 3000 bp, Unknown; identical to SEQ ID NO: 7163
  misc_feature (1)..( 3000): cDNA_ID_1807177_gDNA_ID_1621130_Annot_ID_56465 3000 nt of promoter + ATG

SEQ ID NO: 7183 - DNA, 3000 bp, Unknown
  misc_feature (1)..( 3000): cDNA_ID_1816850_gDNA_ID_1621130_Annot_ID_56466 3000 nt of promoter + ATG
aagtggtaaattcaaataataaccgtcgattatttctttctaaccgttattgaggttaccaattaaaaaaagtgatcacaaactaggtcaatgaaaagggagattttttgttttctttgggccaatgaaaatagaaactaagatggacaaaagaaaatattataattggacaaaacagagtcatttgagatttaaaacagagaagtaataaaggtcaaatgtttttgtggtgagctctcaaaaacagacataaaaaaaagaagcagaatcattcccatttataacaaacctaaacctctcttttcttcttctctttacctttttcattccaaaatctctctctctctctctctctttctctggctcgggaagaagatgtcacgtagttgctcacagtgtggaaacaacggccacaactctcgcacatgtccgacggacataactaccaccggtgacaacaacgacaaaggcggcggggagaaagccatcatgctttttggcgtccgcgtcacggaagcttcatcatcttgttttagaaaaagtgttagtatgaacaatctctctcaattcgatcaaactcctgatcccaacccaaccgatgacggtggttacgcttcagacgacgtcgttcacgcctccggtagaaaccgtgaacgcaaacgaggttaataaaataacctttcttctctctttcccaaatctcatctctgtttttgtttcttgtttttgaaactttcttgcaaatttggaatttaggaactccatggacagaggaagaacatagattgtttcttactggattgcataaagttggaaaaggtgattggagaggaatctctagaaactttgttaaaactcgaacacctactcaggtagcgagtcatgctcagaaatattttctccggcggactaatcagaatcgtcgtcgtcgtagatcaagcctcttcgatatcactcccgattcggtaacgtttcattctttaaaatctataattaaaatcaagaatctgtaagattatactaacacataaggttcgatatgtcaacagtttataggatcatcaaaagaagagaatcagttacagactccattggagctaatccgtccagttccgattcctattccgattccaccgtcgcggaagatggctgatttgaatcttaacaagaaaaaaactccagcgacaacggagatgtttccgctgtcgctgaatttgcagaggccgtcttcgtcgacatcgtcatcgtccaatgaacagaaggcacgtggctcacgtgcctcctcggggttcgaggcgatgtcgagtaatggagatagtataatgggagtggcttgatgaagaagataatgttttaattaatttatattgtataagataagatctggatgatgattaatttgaaatttgagaattaggctaattagatactttgatcagaatcaagtgagtttttaagtttgaattagtgtgtacatgtttttttgctctttttgggggaaacgacttgtcgtttttgttgttgtatgatgtaaaacaacaggtagtctctgtgttgttttggtcaagacttgatcagattcagaagtgaagacgacttcaagcttaagatagtttagatgtgtcttttgaaaagtttaaacagaatggttattgggttaaggttaagtgtatctcatatgctttttctatctttttttttggtaagacttttccagtaatttgccgttttcttcggggtgtgtgttgttgataatgtcacattcatgaaccaaacacagttatattactttagtaacagtttttttttgtttttttgtttgtcgtttgacgtcattttgttttatttatgttattacatacatggatataatttatgaaactgccaagaaaacaaagaatataatttgttgaattgttattggcctaccaactatatcagcaagattcgaatctatactttgttaaaatgtctcaatgtaggactggactggagataaatataaagtaatatatagggtaaagtttctaagtcttgtatagcatgatttttattagggaatagaattctaatttcatgatgtaattcaaacaactgaaatggaaaattgtttaaaactagctaaacttgtacagttgtactatttagagcccaaagtgataactgttttatggcttttatccatgcaaaagaaaaacatcaaaataaagtgatgtccatcacatacatcttaaataaagtaataatgggcctagctaaggtatagcccatgggcttattcgctgatctaaccaaagtgtcgctaattttcttccttgtttttttaacgcaaattttcttccatgtcaattatgtctttttaatcaaaaattcctccacaccaaaaaagaacgtaaaaactaaaaatagaacaaattcaactacactcagataatcgaattgctatgtccaatatccaaaacatttcaagccatttagtgctctcactaaacatattttaacaaaatatgaaataacattcccaaaattgcgatcaaaaggctagaaacatcttcaacaattatgacagtcctaaaccaacagttcaaacacgttttatatctgtttggccaaattaaacgaatataacataaaaatacgattgatcttagacaattactaaagtttctaaataataatctatactttcacaaaacaagaaatacaaattgattcttgcgcagaaagtgctttggtacctactttttttaccacctttccttttcaattgagacatcaacacattcactaaaacaaactctcaaactgctctaaacgacaccgtttagttacagataactttacttgtatttaaagtcaccaaaagtttgaatttttatttgtgccttccacaaagctttaagcttaaacacagtcaatggccgtccttccgccataaaaggacaaaaaaaaagcttccctcttttcacaaaaccctaaagaaacaaaaaaaaaaccatc

SEQ ID NO: 7184 - DNA, 3000 bp, Unknown; identical to SEQ ID NO: 7171
  misc_feature (1)..( 3000): cDNA_ID_1807746_gDNA_ID_1621130_Annot_ID_56469 3000 nt of promoter + ATG

SEQ ID NO: 7185 - DNA, 3000 bp, Unknown
  misc_feature (1)..( 3000): cDNA_ID_1816968_gDNA_ID_1621131_Annot_ID_56470 3000 nt of promoter + ATG
atccaaaggtgagcaatcaaccctactttagcaaatcccagtttattccttttttatcaattaattattatagccctctttaatcttctttgtggggattcaaaaatagaggaacatacatgttgtggccttgaatgggaactccaagcaatgagagttgcaacatattgcaagccgagtatgttagcaaagctacatatttgatcgaaactaccaaaatttcgaattcggcacaaaaatcttactctacttgaaggtaatctttcacaaaatttgttcatataatcattgttcttggttaaaatgttacacaatcttcttaatatgtcttcttttgtgtctttagtattgctgaaataacaaaattattctcacaagtaaaatacatcgttggaaattagtgtcaaggtatgtgtcttttttatttagacctttgagcatgaacgaactaattttttcacacatacagcttcatcgatttctttacaattatgactctacttcagtattggtaatcctctcactttttttattaatcaatctaagattctgtaacaattttaatttgtttgaaaagccacgaagtgatcaatatgttttgtttaaacacttccgtttcggattcatgtctagttttataaatctatgctcttgatgctagtcccaactaggaagatcgattggttctggagctgataccctggtttggaatgcaccatggatctctctctcatcatccgtaaccccaatgggtcctcctactcaagagacacaactcatgactgttaaggacttaatatgtcctatttccaagtcttggaatagagaaaagattgcaacttacctccctcaataccaatcagagatctttcagttcagaccaagtaggtttgttgctagggataaatttatctggcttcccacgaaatctggtgattatagcaccaaaacaggctactacgcagctaagactttgcggaatcttcatacacaagttccacctcaacctgtgacctcaattggaactcagagatatggaaaaagaaatgctccccgaaaattaagtttctcttattgaaagtattgaagaatgctttacccctaggtgccaacttgaaagctcgaggcatcaaccctacaactgcttgcccacattgtagtgcagaggaatcaggtcttcatctgtttttcctttgtctatttgctgcacagatctgggagcaagccccattcaaaaataccctttcgaccttcacttttaccaatcttcagatgggttttgaagcggctaaacatctgatttgcttaccactggtggaaattggctcaaaccctcttttcccctggattatttggacaatctggacctgcagaaacaagaaaatatttgagtagaaacatctatctagtcgggatgtcatatctcaagcaatttcggctgcaaaagaatggttattggctcagcctttacctcagggacaccagactctgctttcaagaccaattgtgccggaatttgaatcggatgcaatcttgtgtttcacagatgcagcgtggcgagaggattcacatgatgcgggattgggatggatttttgtagataactcaaatcactctgagatccaggatcacgcagtggcgagagaggtatcttcccctttaatggcgaaggcgatcgctctcttctctgccatccaacaggcgtcaaatcgaggattcaaaaaacttgttgtagcttctgactcgcagcagcttgtcgaagcaatcgtgggggagcttcatccaaaggagcttcaagggattctacatgacatcctttttatctctctcagtttcgctgatattagctttcattttgtcaagagagaaaacaatcgtaaggcagatgcagctgctaaagctgctttactcgcaatcaattctgtaccggtttaacatttaatgaaaaccagaattttcgacaaaaaaaaaaatgctcttgatgctctgttttctttacttatattctaaaataaacatttctaattattacatggtaaaaatgtgactacaaaacatcgaaggtacattgaaacatatattcacttgatgtttttcttctaccttgagaggattccaactctaagtacacttcaggacttagacaatcaccacatcaacaaattgtatacaagaattactctttcattgggaaataaaaacaaagcatgatatggtgggaaaaaaaactgtatataaagactttgcggaaaaactgtattgaagaagacttgaactctgcaaaagggagagatattatcgtattgtgcataaggaaccaaccgaattgtgtttataatgctaatttattaagaccattatggtcaaatataaacagtgtcgataacttaatatgtttcaatgctcatattaataaaaacataaaaaaaaaaacaatctcaaataacaattaactgtattgagtaaacaatataatttttaattaaagaaacactagtagtcaataatactctttcttcccacgtgttgaaatatccaaatattagttgttcatatagtaatattttttataaagaaaagacctaaaccaaaatcgaaatcaaaatcgtattgaagcaaaaattctgagtttactaaaaaaaaactccggtttattaaaaattctggtttagatttttttttttttctaattttgtcatgactttgtaagattttttttttttgcttaattgctttgttcctacgagcaataacccagtacccagcagcaaccacaacctcttcttcttcttcaatatctccctcaaataacagattccattaccgctgcataaatatctcttcagtaaagaaacatcattgattcaattcccagaaacatcaacctctcacctgtttccaatttgtcggcaacaacaacaaatttctattctgggttctgtgaatttcgtagggagagaaatagagatagagagagagagagcttctgggtatttttta

SEQ ID NO: 7186 - DNA, 3000 bp, Unknown
  misc_feature (1)..( 3000): cDNA_ID_1816966_gDNA_ID_1621131_Annot_ID_56471 3000 nt of promoter + ATG
acttatttttggatggtatgtatgtaagttaaatttctagaaacaaacttcttcatgccctcgtttcatgaaaccaaaggtgttatctcacgtcccgtctcctccccggttaggatatttcttttcttttcttttgttatattactatttacgcactcgtgccggtttaaagcaatcggtcaagacaataggacgacacataagttttcatttcgattaaaaaaaaaaaaacataaatccaaaagaaaaagagggtaacaaatgatggtttaaagcaatcgttcgcaagaagagaagttgaaaccgctcggtgccaaatgaatgtatggctccgtaactaagttctccacttcattagttctacaaaaggttatgtcatgcataacatttcatgaaaaaagaagaaagatattaggaaagtgtaaagctttgcttttagattttgtttacctcatcttgttgattatggcctttagattgttcacctgcaagacaaaagaaaaagtatataataaagcattcatttaatacaaagtactattataaagttttaaagagatgttgtgtctcgtgtattgtttaattacttacctccttcctctagatcagaggtccataaagtgaggttatctctgagaagttgcatgataagtgtgctgtccttgtatgaatcttcgttaagactgtcaagctcagcgattgcttcatcaaacgctcgctttgccaaatgacatgctctaagggattcaagaaattttcaaaacatgtttataacttggatgtagtttagcctgataggttacttgctcttaacggacaatacctttccggagaattcaagatctcgtagtagaagacagaaaagttgagagccaagccgagtcttattggatgtgttgtagacaattccgtgctagcagaactcgttgcagcctatatttaaacagaaatatcagctttctttcctagctattcagctaattgatcaagagaaaatatgacaaacatacttcatacgccttgagtgataggtccgcagcttcctcgcgatcagcaccggacttaaattcagccaagtatctgaaataatctcctttcctaacaacaacaaacaaaataatcaaaaaccaattcaagtgtgtgtcatatactttcttgttttgattttaagtttttaattcaagaatgagactaacattttgtagtagaagacggtggattctcccgaagttgcgaatgggacaagatgcttatcgatgacagccaaaatatcgtaacaaatcttggagagttcttcttcaacttttgtcctgtaatccttaatcctcttggcattttgttcgtttcctttcgattcttctttctgctcgatcgaagaaaggatcctccacgatgctctcctagcaccaatcacatttttgtaaccaacagataaaagattcctctcttcaatggtgagctctacatcaagagctgcaactttcttcattgcttcaaccatctctatttacaagaacaacacaataaagcatattactcatcaaatcaactccaaataaaacaaaagtaaattttttgaatttgacttatatcataaagtacaacaatcccatttttttagttaccaaactatgaggtatatcaagaaatttacattttaaacctttttcatcgcgtaaataataatcgaataatctccgattttacgcaaggaaacaaagaaaaactatatagagattccaataatccaaagtcgttcacaaactctttatttacttgatttctaagtaaccattttttacagtcaatacattttcagacaaaagtatgaaaggacagatctaacagagttttaagagattacttagaaatttcaaacataaaagaaacaagtacggtcttttgtttaccatcgtatctctcagcttgctcgttgagtttcgccaagtacacttgcttcgctctctcgttctccatagcttctcctttctctcttctctctcgaattgagacttttgttctgatcaaaaactgctgtcacgatataaaaagaattttggcggtttggtttaagacaggagaagcaaatcaacggctgagattaagtctctagatagtggagagcctcaaatagtgataacaacgaatctcaaccgttggatttagatgtttggtgtgccccatgcttctttgttttttcattggttataataataactaggggttcaatccggataaaccgatctgatctgaaccgaattattcaatccaaaaacggaaccacactttcaatgaattgtttttaatataattttcctttgtaccttatacaatgattttttttaaaaaaaaaatcacatatgtctgttaaaaaagttattaatgtttaattatgcatatattattttctacactaactaataacaattcataatatttaaatattttcacatatttttttttggaatttacaatttctaaaataataatgaatgcattaaaaaaatagaacatttatttttcgtggaacaaaaaaaccattaattgttgacaaaaaaaagtcattaatctccaaagaataaatggaatatatataaaaaaccgaacaaaatttaaaccaaactgaagaataatagtcagatcttaaatcaaaatttcgttgaaataaggatttaacaaaatcaaaatcaaaattcaaccaaattatctattttagtttgataccattatttatataaaccaaaaaatctataacacaaaaaccaaaccgaatctaaaccgaaatacggagtcgaataacacttgtacccactcttaaaaccgtctcaatgaaccagagactgtctcgtttctcccgccaattgataataccatgaaattagggtttacgaagcttttaatcgtctctccttcccaatttcttccaggtaaaaatctctctaaaacattgaaattcatcgattcatgtgtttaatttgacgcgaatttgatttcagaatg

SEQ ID NO: 7187 - DNA, 3000 bp, Unknown
  misc_feature (1)..( 3000): cDNA_ID_1816958_gDNA_ID_1621131_Annot_ID_56473 3000 nt of promoter + ATG
accagacatacttgcagcttctcactggaattcctgttcagtagctttcaaggcggcaaatggccagatcttccacatctccttaatcaccaagcccatctacatccaactctttccaggatacatgatcaaagcaaagtatataggtctgaactccctggaaaagatttcatacttggagttgatgtccttcatagccttaagaaagtatcttggaatccaaaaagacttaagcacaagaaccaactgctaccatggactaatgtctcccatctctaccccatggaatatgaaattctatcaaagacgagattatcaaggcttcttgtgctacttcacattcagagttcctcaccaaattttcatcacctttatgaaagaatccggactttttcatatcattacccttcaagaagaatgaggatgtcatccaacaaaagcaagccttccaggaatgaatccaaaccactataatcttgctctcgaagaagtcgaccaactccaaagagaagacctcattgagaagaccacctccccatgggcatgtgaaaccttctatgttaacaaaagagctgaacaagtacgaggaaaactgaggttagttatcaactaccatccgctcaaccatttccttgcagacaacaagtttcctctaccaaagcgagaatttctattccatctaaaaacctctcaaattaattacaaactctaacaatcgagaatgggaaaaatgtcaaaaaaagcacgaactttcaaatttgggaagaaaaaacataaactttcaaaatgccattaaaatcgtaaagttttgtttgacttttgattaaatagtcaagtttcgttgactttgccatttcgggcatctcgttaagtttccgttaacaaaaaaatcacagaattaacactccgttaccattttctgttaaaagtgaaacgacgtcgttttgaaattctaaataaaagaaaaaagtaaacccacaaggattcgaacctatggtcttttgcctttcaaagaatcattaaaccactgagccacgagaacatattaacaaaatgaaaaacacatatatatataagatataaatatacaattaattaaaaataaccaaacaaagatctatattaatgcatttaatttaaattattctttcttaaattatataaaaaaagaaacatatgaaatagagaaaatgaaatatattgcctaaataaatggtttcttatattgtttccatctaattatgaacatcacatttaattatttgaagatggaatgattatattttatgtttatcttatatatatatatatatatatatattacaagttaatttatcgaatagatatgtttttataattaaaaatatttataaaattaaattgaataaaattctatgtgcatgtataaattaatcctatatttatttgagaaggattgtataaattttagcctattttctaatttcataagtttcaatttttttcataaaataaaatgaagaaaaaataaattttcagataaaaattcaatgcatttagaagaaatctctatatgtaaaattaaaaatatgatatttcgaaatgtatatttatggtatgtatatttaatatttgtacatatttggttatttttaattaattgcatacgtatatgttatatagatccgtttgcaatctgtactagaataatatcgtggccccaatggttgagtgcatctgaggaaaacaatacgtatctggatcgacgtcgttattttattttagattttcgtggactcacaatcgttattttattttagattttcaaacgacgtcgtttcgtctgtaacagaacatattaaacggaaaattaacgctgtattttttttgttaacggaaacttaacgacatgtctaaaatggcgaagtcaacgaaactttactattttattaaaagtcaaacaaaactttacgattttagtggcatttttgaagttcatgttttgttcatcccaaatttgaaagtttatgtttttttgacatttttcccgttctatatttcacaagttatttttaattagttttgtgtatatatataaatatttcagtttacaataatatcaaaacgttatcgtagcatatttggttgagcgcttgtaataattctggagagtcatgagtttgattccttcttggcacatattgtgtaatatattttcattttgaaacgacatcgtttcgcttctaacggaaaatgttaacgaaaagttaactccgttgttttgttgttaacgaaaacttaacgacatgtccaaaatagcaaagtcaacgaaacttaattattttatcaaaagtcaaacgaaactttatgattttagtggcatttcgaaagttcacgtttttttatcccaaatttgaaagttcatgatttttttgagaatgctaattaatgatttcaagagttttctttaattgagaatgacgtcgtttagcaaatgaatggatacataacatgtctgattactctcttaaaccagttaacaatatttaaatcatattgaaaacaagaggacaaagccagagcgactctgcttttaagacacggcaaaaaagtcaaccaacgaacccaataacaaggaaagagatttgtttttcatttctaatggaaaaaaaacagcaaaaattgaagtctactcgtcgtagtagtcgtcgtcttccactaattccgtggtttttttatcgaagacttttgaataaagtacatttgcagagtctgtcaataaccctttcttcacggtattgctctcaagccgcgtactggtaggctccaaaattatcccttctttatggtttttggaacctgggttctccgattttgaggtaatccttatgtgggttctttctgatttcgtgttttgttttattaaaaggacttctatgtttttttgggggtttctgaaaagttcggtttttgcaggttgttgaaatctttgagtagatttttgtggaacatctgactctc

SEQ ID NO: 7188 - DNA, 3000 bp, Unknown
  misc_feature (1)..( 3000): cDNA_ID_1816954_gDNA_ID_1621131_Annot_ID_56474 3000 nt of promoter + ATG
gatcaattacaattttcttgggtagttttataccaataaacaagtctatacatgaccaataaacgccaatccaaagtacattgtccatttttctttgaccatttattcacttgtgtataaacaatcccatcagtaggacaatgtcagttacatagcttttataaaaaaaattaacgaagatcttatttgtattacactctcaatgaagaccattagttcacttggatacacccgtctatactaattatttgtaataggtagaagacagaaggatatgtcaattcccaaaaattactgatttttattcaatagaaattcaacaaatatacatcgattgtataacgtcataaactcacaaaagttactttgattttcatcatgtctcaacctctcgtttctttcttcatcttgactttgaattagaagtgattaatctcaggaaatcaaacaatcagaaacaatactttcaaatttacagatctgatgtggaataagattaagaactttctaattttgtagatcagagataccagagtcattaggagcagagaggcaccaaacaaaacgacgaataaggcataaagctccctccgccaccgctactaccaactacgccatcatgtcttgattagctttttaaaaacaatcatagcaaggagtcaaagcaaatatgtcggagattagaagataaagccctcgtttttgaactttgatttttcgtaaaagatttgattttggttttggaaatagaaaaataaaatcgatggagaagcgctgagaagatatgacaaagagaatgagtttgcagttaaaaagggtaaattggacaatttagtttgacaaagtgctttatcattttaaagtgtctaaatccgtacatagttttttaaaagtgtcctagaatgtaatattctttttatttattttgggtaaggatcatagaagaagaataagagaaattgagaattaaaaacataaatattaaattgagggtaaaaaagtctaagaaaaaaagaattagtagaaaaagtgtctattccctataaagtgcctcaaatggaaaaacattctctaaaagtgcctcatagtggaacattcccttcaataattagagggcaccattttttttttttcttctaaatattaaaaaaaaattagtaacacaaaaatgaaatttagaatggacctataatttttttaatgtattgttttttgtttttaactaaatctttaacaaaattatcatagaatggacctataatttggcctccttagaaaaattgaaagaaacattttaagaaaatgtagtgaagattgacaacatagttggccgagtttccggatctgcttgttaatacgataaagcaatttccaccatttttgtgagcttctctctattttttccctgtgaaactaatacacgttcatcggaaatgcttctcagtgacagagtttcttcgggagacgatgataaactcgaaaccaaatctctcggatgtttcccaattatcacttccaatatcaaaaccccgaagctatacaagataaataaactctgtttatcctcaaaacaaatagttgaaaaattattaataactaaaacatatttcgtatattttgaatacatcgacaaccaaattttctttttgaaatttatactaatattttgtatttattatattttaactttttctaaattttgaattctgttttaatttattaagaaaataacttttgttttaaatctggataaaactgtcattttcaatattaaaaataatgtttttattaaaaatggagaacaatatattttcaaatgaaaacttaaaatagggtagttttttttttcaagtttttttcatgtttttttttctaattcgttctaaaataccgaaaataacaagattgataatttttgtttcataaaagatttagatatttgaaaattagccgccgaacttttctctagtattacctttaatgtgagtggttggtttaattgcatatatagatatttaactttctcgaataacaaaaaaaaaaactcaaaatataagagaagaaaatgcaaaaatttagaaaaacataagcaaaaataaaaaaataaatataaacaaaatttgatctaattattttaataatgagtttttgagcgcactaattgttatttcatatattaacaatagatgttttgtattattgtggagatatagtatattgttggataaataaataacccagaaaaaatgtatgaaaaaaagctataataaacatgtggcaccaccgcaccgaaggtaaaccaaagccagattaatttgtctcgtctcgggttcctataacacaatgatatgataccatcgatcgtatcaagaagccttgaactattgagaccgttttgttaggaaactaggtctgcgaggaagaagaagaaattgaggtatgagggtagaacgaggaacatgacaaacagctataagaagaagtaacggagaagagtgagtcctaaggttaaatataagtgcatcacacaaaatgatgaaatttctaaatatttgtgtgttttgtataagtctttccttcattcttcatgttgtcactctaagtaatcaaaacaattattagtatgttatatgttatggtgccaaaacaaccctacagcagttggtttcggtttagttgatgcggttcagttttgaaaaagacaaaaaaaaaaaaactgaaacgaagaaaccgagaaaacgaaaaagagaataacggagagattgagagagaatcagaaagcgaaacgaaattcagtatccattgcttcaaaattcgacataacttcgaattgttgggtagttgaattgtgccactgaactcccacatccggtgaagtgaaagttactgtttttcccggcgaagccaagagaaagttactgtttttcccggcgaaaccaagagaaagttactgttttttccggcgaaatttgaacctccggcgagatagcatctttagct

SEQ ID NO: 7189 - DNA, 3000 bp, Unknown
  misc_feature (1)..( 3000): cDNA_ID_3049960_gDNA_ID_1621131_Annot_ID_172504 3000 nt of promoter + ATG
ggttcatctttatctctccctctccctcctctccaagtctacgatttccttagaaatctggaggttcgtcaccaggtaaagaatagatggtttcattaacagtataagtccatatttaaatgtcgtcctttttcacattaattaacaagaaacctaatgtttgtatatatgtacataagtgggacgttcactgccaaggaaatccagtgactgaggctgctcgttttgtcaccggacctgaccaaaagaacaacgtgacttttctccaggtaaatgtatatattactcctactaaaaccttatgattaaagtttaaattacacatttcttttgcttctttaagtttatcataactagcattacttcaaatagagatgttaaaaagttctaaaaatccatgcaacgggtcaagtttgttcagttttgctttatatttttgtggtcatgaatacgttagaatagattaaataggatcggcataaatcttgaataattaagaagtaattcacattacaaattcaatttccttggcataatggcattgctttaactatgactattgttatacattatgtagccgtcaagtgtaggggaatataagttgatgatactacaagatggcttcatagatgcattaggaggtatggtggtatacgctccaatgaatctaaacacagcatactccgccatttctggccaagtcgatccttccaccattccaattctcccttccggtttcatcatctctcgtgacagccatccttcctctagcgaggttgatggtggcagcatgacactcctcactttggcttttcagatctttgtcaccggtccgagttactatacagatcttaacctgaaagattctgccaccacagtcaataccttggttagctccgccgttcaaaggatcaaggccatgcttaactgcgaatgatggtcagtgagagtttgattaagttaccagttcgaaaatctaaactcttttggtgtttttttctttttttaaatcttgaaataagtgagaagagtattctccgtttgattctctaaggagagtcgtactttttcatgcttttcgttggttttaaactcattacaataaatttctaaggcaagggccttagttaaacaatatttatgttgttgcatgttggtatgttttttagtgatattgttgcttggacttataatttctaaaggcaagggccttacataagatgttatatattgctttaattctgtttttatttaatcataatttttatagtttcttgttttatttatataaagttagggaaaatcatattttaaaccttcaaactgacattgtgtatatatatttcactagcactatataaacctccaaattatatttactaacactctctccaaattaaattttttgtttgtacagctttaaaagatacagaacactatcgaaatactaacgaaagttacagaagagttaacatttgtcagttaaataaagaaagaaagtaaaagtgtttaaaaaaatcattatgacaacttaccataatcgttgtctaatgtttttaaaattcaatatcctcacatgaatttggggtttagagtttcttagtttgaagaagaaaaacataagtgatatgataactataagttgtttataataacaaaaagtaatttcgatgaagactgatgcaaacgcaagaatccacccaatgatcttatcaacggaagcaaaggtccgaagctttgatggttgatgaatgatgatagagatggtagatggagggtttgttgaatgaatccacaatcaacacacggttttaacaacttgaatccaaaagttattaagccagaaaatcacacaagagaagtgaatccacactcaacttgaaatgacaaaacataaagacaactctttataaaacaaacttaaagtttattgagataatttctaatatgattggtgaatacaaatgaaatcgaaagagagcttatatagaggttttagtacaacggctatatgccaaaaaaaggaaacaaatcgcaaacaataaaggaatagagccgttagaggcttgatggtgtgatcggccaaataaggcaagtggaaccttaatttgtatctagaaaacttggggaggaagatgcggtttcttggaagctttagcatcacttggaggctcttaaacatgcatacatgtagaaaagaaaagagccgttgaggtgtgctttcctgcgagtccaaaagaaaaaagaagtgagtcaacgggtcttgggtgaggtgaggtgtagcataactcgggtgggtaactttatggacggtttggagtatcttcttgattcccttagacacatcattaataagggtaatgtctctttccttatttggcaccgaataatcttgtatgaaaagtacttcagcaaatccttcggagagtccttcagcgaaaccttcagtaagtccttcagcgagtccatcacatcaaaggaaaatatgatgatgtagatgtcaaactgtcatacatgaattcaaaataaaacattctctcactacaagaaaacatatgatattccaaccgatacttccaataattgtattttgttgcaaatttctaatcgatatcctataaaattgcaacaaatattttatttattgaatatttattgcaaatttccaataaattttggttatggtaaatttgtcacaaacgtcgtaggacaattgttggaatttttcaacaaatatgatgttgttgcaaattagcaataattattaaattgttggaaattattaacaaaatcttttgttagaaactaaattttttgtgggaatttatttgtaacaagttaataacaaagtatttgttggaaaagaaaaggaaaaaaaaaaacggaaataatgaaaaaaaaccggaaaaccccaaaaaaaatttaggtaaaataagattcatcttcttctacttttcttcttctccttctctcttttttttgtaaaaactattttcaatg

SEQ ID NO: 7190 - DNA, 3000 bp, Unknown
  misc_feature (1)..( 3000): cDNA_ID_1816945_gDNA_ID_1621131_Annot_ID_172502 3000 nt of promoter + ATG
aaaatatttcgttattgcagttagctaagtaagaaatgaaacatgattcaaaaccaaaaagtatttattcaaagttatgtgacatacgatagaagtaaacaaacaaactaaattattcatgagaaattaaacagtatgtaagtgcttgatgtgtttataatagatggaagcattgcaggtttggagagtttgctgcaccaaccaaacacttcaagcttcagtttttcgatccatttatttatttcaatgcgttttataaaaccatcacaaacaaacacaaatactatgtacttaatacgggaattaaatcatgtacgtgtggcatgtgttgttcttggacatcaaatacttcttggctttttattgatcgactaccatcctatatatgtataatcgattttagaagaaacatatataacatgcaaacactatactgtaaattcaattaattaaaatttgaatgtagtaaaaacatatataagtagactatgaagtatgaaccacccccgaaaatcattttttttgttacaatcatagaaattaaaaggtcgacacctcgaaaaaaaaccccctgagatatccattttgaataattgaaaacgataatagtgtgattgtgtgaatggagatattcattttgtgtaccaaatacaaaaggcaggtggtatacattgttcattgttggtacgtagaaatgatggagtaagaagaagccatgcattagatgacaaaacgatgatcgtcgccttacgtgcatgggcaaggttcttttcgtccaaccacgtaatcctttgttttgggctttcacatctttgttgaccaaacttaccattattattggacttttttgtttattactactaaatttcccaataagttcactttgatctccccattaccaactcgatataatattccgtaaatacccatttttatttgtcaatttggtaatagttaaaaaaagtttcggattaattaatatacttcgagatttttaaactcttcaaaaaaagcaaacaaagaacaaacgtccatgaaaaataagtatatttagttcctgaaataatggttcataacaacaaagaaaagtatgagttgaatgtaattataaatgtataccttgaatcttgcaacttttaaacacatgtgctcgtcgtttatactctatttattcacccaaaaataatttagcattaaaagcgaagattcaaggtacattatatgagacatttgaagtctgctgaaaattatattagacatttgaagtagatatacttttgacgtcattatatttgccgcagcaaacgatggtgcagcgagtataaactcgtccacaacatcttcaacaatgtgtttaatttattggaagagaaaagttgcaaatcatgacaaatctacattatagtgaacgacgagcacatgtgtttaatatataatgcatgctcgtttaacttggtcatatttgtacaagatatattaaaatccattcagatctgaatgctggtctttaacaaacaaagaaaaggatataaatgcttaaatgatctgcattaccataaataaatatagcttatctaatccatctacaaagaagactattttatatagatttgatttaccaaacccccagaaacaacgcattacacaagggagacacttcatggattttgtcccccccattgatcatataaatctcagtaacattttccccttgatttagaatgtttgaacaatttttttctgacccgacataaaatttatattctatatctatataaaaaaaaccacgaacgatatagctacataaactgaaaaagaatacgtatatgtggtcattgaacatactgtatatagctcaaaaacaatgtgtctatatggaattagacttcagatatttctaaatcttttcctttaatttggcttatgaaaaacttacttatctatcattagaaagctttaaagcaagtatattcagcaagacacttgtgaaagattgtagtagccatgaaaatttgcaatcaaaatgtacatacttttgatagatcatagttagaccaattcgatccggagacctggaagatactctgatttgatttccaaattgtatttaaaacatagtttaaaaccaaagacaaacactagttttaagaaaaaaaaaactttatatataaaattatatataaacactcgtcatagatcagccacaaagattttgtaattcgtctcaaagttgcctccgaaaaataatcatatcagtaatacattttatttttctatttgatctaataagtaattgcaaattttatacatgattttatcaccaatttgctacagacggaaataatgtagatattatgtggttagtcaaatggacgatggaagtaaatgtggtatatatacacattatccatttcctcttttacgcatatatactaccagaaatttgaatatcgtagtttgattaaatattgcatttgaagtcacctagatcacacacatcctaggagatgcactattcatttcgaaacactcagagaaagttgtgtagtcagacagttgtcaaacttctatctggacttaaactagtgttatcaaaagtcccatgtataaatgcataaatgctgtaatgaaattcagcagaaattctgtaaagagataaaagatatgttttcttcacaaatgtatgagatatacgtcagttcatggtacgtattggcttcgtcgctagctagaagtagattttaccgtatcaaaagaaacggtgacatagattttgtctaagaaattagttaataaaaatacccaaaaaaaaaaaaaaacattagtcaaacatattacattaaagaaagccaagtgttagggacgaagaattatcactattatatataaagttatgatcaaacttccacgaaactgtatatatataaataccaagtcctaacctcaagctttggtagtcttacaagagagataataagacaacctaatcagagagagatg

SEQ ID NO: 7191 - DNA, 3000 bp, Unknown
  misc_feature (1)..( 3000): cDNA_ID_3049964_gDNA_ID_1621131_Annot_ID_172501 3000 nt of promoter + ATG
cacacacatcctaggagatgcactattcatttcgaaacactcagagaaagttgtgtagtcagacagttgtcaaacttctatctggacttaaactagtgttatcaaaagtcccatgtataaatgcataaatgctgtaatgaaattcagcagaaattctgtaaagagataaaagatatgttttcttcacaaatgtatgagatatacgtcagttcatggtacgtattggcttcgtcgctagctagaagtagattttaccgtatcaaaagaaacggtgacatagattttgtctaagaaattagttaataaaaatacccaaaaaaaaaaaaaaacattagtcaaacatattacattaaagaaagccaagtgttagggacgaagaattatcactattatatataaagttatgatcaaacttccacgaaactgtatatatataaataccaagtcctaacctcaagctttggtagtcttacaagagagataataagacaacctaatcagagagagatggggaggtcgccttgttgcgacgagaatggtctaaagaaagggccatggactcctgaagaagatcaaaagcttattgattacattcataaacatggtcatggaagctggagagctctccccaagctcgcaggttttttcctttccctagtctcttaactcaatccatgatcattttatataaacttgtatacgtatatatggattatttgaattgtatagttttgaaacttcttgtttttcttttcagatttgaataggtgtggaaagagttgtagactgaggtggacaaattatttgagaccagacatcaaaagaggaaagttttcagccgaagaagagcaaacaatcctccatctccactccattctcgggaataagtaagtgactaaacatatattcattttttttttgttataaaactttgaatgactaatactttttttttttatcatgtatagatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgttagtcttttgtttattttttatctttaccttgttttgtattgttgagatgttattgcattgttactaaagtttacagaactaaatcaccttgttagcttagattaagcatttgtgtgtattattaatgagttgattaattgcaaattgtggttcgacactaagtaattgagtaaaagtactccatttaaaaagagcgttttttggtgagattttggtattcaaaatttattggatttgtttgtatggaaataacttttaatgataactaacaaatatggttttgtcattaacttcaggatatatcgcaaaacattccagaagcattgattgataaaaattcgcgaatatcgtttggatcaaatatatgtgttaatcgggacctaaatcccatgacttacgaagatccgtgcgttttaccgaatgactatcgatttagatccgaccagtaacccatgatccgtgtgtcaattgacagcaattttttattttacccttccatgaaatcttttgattactctttaaatgcaaaaatcataatgacatcctatataatattcaaccttttataaggttatttattttttagtgattcccaattaatagtatagtttcattcgatatttcccctttagaagacaaataagcacattttaattacgttttagatgtactagtaccttaccccatccatctagaaatcttggttcaaaccttatattaccgggtaaaaaatgcctctctttgcaactagaagaatttttctattttaaaataatcaatatgaatccaagatttttcttgttcttatataattttcatgtgtatgaatactaatccatccattttttttctttctatgcaagcatttataatcggcttttttttttgtgcaaacatagttgtattcattcagacccaaaaaaaggggttaaagattacaagcccttccactttaaagtgggacataatgaacgtacagaggaacaagctgacatggaagctaaaccaaacaaaaaagtaaacaacaagctgtggcgatagagtcatg

SEQ ID NO: 7192 - DNA, 3000 bp, Unknown; identical to SEQ ID NO: 7188
  misc_feature (1)..( 3000): cDNA_ID_3049968_gDNA_ID_1621131_Annot_ID_172497 3000 nt of promoter + ATG

SEQ ID NO: 7193 - DNA, 3000 bp, Unknown; identical to SEQ ID NO: 7187
  misc_feature (1)..( 3000): cDNA_ID_1816958_gDNA_ID_1621131_Annot_ID_172493 3000 nt of promoter + ATG

SEQ ID NO: 7194 - DNA, 3000 bp, Unknown; identical to SEQ ID NO: 7186
  misc_feature (1)..( 3000): cDNA_ID_1816966_gDNA_ID_1621131_Annot_ID_172490 3000 nt of promoter + ATG

SEQ ID NO: 7195 - DNA, 3000 bp, Unknown; identical to SEQ ID NO: 7185
  misc_feature (1)..( 3000): cDNA_ID_1816968_gDNA_ID_1621131_Annot_ID_172489 3000 nt of promoter + ATG

SEQ ID NO: 7196 - DNA, 3000 bp, Unknown; identical to SEQ ID NO: 7190
  misc_feature (1)..( 3000): cDNA_ID_1816945_gDNA_ID_1621131_Annot_ID_56478 3000 nt of promoter + ATG

SEQ ID NO: 7197 - DNA, 3000 bp, Unknown
  misc_feature (1)..( 3000): cDNA_ID_3049960_gDNA_ID_1621131_Annot_ID_56479 3000 nt of promoter + ATG
caagtctacgatttccttagaaatctggaggttcgtcaccaggtaaagaatagatggtttcattaacagtataagtccatatttaaatgtcgtcctttttcacattaattaacaagaaacctaatgtttgtatatatgtacataagtgggacgttcactgccaaggaaatccagtgactgaggctgctcgttttgtcaccggacctgaccaaaagaacaacgtgacttttctccaggtaaatgtatatattactcctactaaaaccttatgattaaagtttaaattacacatttcttttgcttctttaagtttatcataactagcattacttcaaatagagatgttaaaaagttctaaaaatccatgcaacgggtcaagtttgttcagttttgctttatatttttgtggtcatgaatacgttagaatagattaaataggatcggcataaatcttgaataattaagaagtaattcacattacaaattcaatttccttggcataatggcattgctttaactatgactattgttatacattatgtagccgtcaagtgtaggggaatataagttgatgatactacaagatggcttcatagatgcattaggaggtatggtggtatacgctccaatgaatctaaacacagcatactccgccatttctggccaagtcgatccttccaccattccaattctcccttccggtttcatcatctctcgtgacagccatccttcctctagcgaggttgatggtggcagcatgacactcctcactttggcttttcagatctttgtcaccggtccgagttactatacagatcttaacctgaaagattctgccaccacagtcaataccttggttagctccgccgttcaaaggatcaaggccatgcttaactgcgaatgatggtcagtgagagtttgattaagttaccagttcgaaaatctaaactcttttggtgtttttttctttttttaaatcttgaaataagtgagaagagtattctccgtttgattctctaaggagagtcgtactttttcatgcttttcgttggttttaaactcattacaataaatttctaaggcaagggccttagttaaacaatatttatgttgttgcatgttggtatgttttttagtgatattgttgcttggacttataatttctaaaggcaagggccttacataagatgttatatattgctttaattctgtttttatttaatcataatttttatagtttcttgttttatttatataaagttagggaaaatcatattttaaaccttcaaactgacattgtgtatatatatttcactagcactatataaacctccaaattatatttactaacactctctccaaattaaattttttgtttgtacagctttaaaagatacagaacactatcgaaatactaacgaaagttacagaagagttaacatttgtcagttaaataaagaaagaaagtaaaagtgtttaaaaaaatcattatgacaacttaccataatcgttgtctaatgtttttaaaattcaatatcctcacatgaatttggggtttagagtttcttagtttgaagaagaaaaacataagtgatatgataactataagttgtttataataacaaaaagtaatttcgatgaagactgatgcaaacgcaagaatccacccaatgatcttatcaacggaagcaaaggtccgaagctttgatggttgatgaatgatgatagagatggtagatggagggtttgttgaatgaatccacaatcaacacacggttttaacaacttgaatccaaaagttattaagccagaaaatcacacaagagaagtgaatccacactcaacttgaaatgacaaaacataaagacaactctttataaaacaaacttaaagtttattgagataatttctaatatgattggtgaatacaaatgaaatcgaaagagagcttatatagaggttttagtacaacggctatatgccaaaaaaaggaaacaaatcgcaaacaataaaggaatagagccgttagaggcttgatggtgtgatcggccaaataaggcaagtggaaccttaatttgtatctagaaaacttggggaggaagatgcggtttcttggaagctttagcatcacttggaggctcttaaacatgcatacatgtagaaaagaaaagagccgttgaggtgtgctttcctgcgagtccaaaagaaaaaagaagtgagtcaacgggtcttgggtgaggtgaggtgtagcataactcgggtgggtaactttatggacggtttggagtatcttcttgattcccttagacacatcattaataagggtaatgtctctttccttatttggcaccgaataatcttgtatgaaaagtacttcagcaaatccttcggagagtccttcagcgaaaccttcagtaagtccttcagcgagtccatcacatcaaaggaaaatatgatgatgtagatgtcaaactgtcatacatgaattcaaaataaaacattctctcactacaagaaaacatatgatattccaaccgatacttccaataattgtattttgttgcaaatttctaatcgatatcctataaaattgcaacaaatattttatttattgaatatttattgcaaatttccaataaattttggttatggtaaatttgtcacaaacgtcgtaggacaattgttggaatttttcaacaaatatgatgttgttgcaaattagcaataattattaaattgttggaaattattaacaaaatcttttgttagaaactaaattttttgtgggaatttatttgtaacaagttaataacaaagtatttgttggaaaagaaaaggaaaaaaaaaaacggaaataatgaaaaaaaaccggaaaaccccaaaaaaaatttaggtaaaataagattcatcttcttctacttttcttcttctccttctctcttttttttgtaaaaactattttcaatgacaggaccaaaaaacaaaaatcgtgagtggatg

SEQ ID NO: 7198 - DNA, 3000 bp, Unknown
  misc_feature (1)..( 3000): cDNA_ID_1816933_gDNA_ID_1621131_Annot_ID_56481 3000 nt of promoter + ATG
agatgagacaaccaccatatcgccccttcatagatgttccatcaactacaatgaccttgcgcataaatgcgtaccctttaattgatgctgcgaatgcgatgaattgatatttgaaacggcgtggaccagtaggatcatcatcatactctgtaaagcatagactgcctgggtttgcttgttgaaggagtccagcgtaagctggaataagtgcatagctaccggccatagatcccaaagacttctccattgccacctctcgagcccgccaagctttccaatatgatatactaacatgatagtcgtcaagtaggaacttcctaatcactgcagcgtttggaccacgtttaataccaagaaagcgagattgcataagctcgcctatcacttgagtggttgctaaccggtggtatctacgcctttgatcaatcgtgcatgtgtgtctctgatttgcctgccgaacttgaaagctgtcagaagtatcaaccttagatgcatatacacgccatggacaggtcttggaaatgcatttcagaaccataaacttaggagtagaacgcgcagttctgaagtgaaacttgcggttgatggcgtgtatagctatcttaatcttgcagtcagacttcgacttaaagactctgccaacaaacagcttatctccttcgtatttaacgtcaaagaaagcagagtccacacctgaaataaaaggaacatctatcagcgacatggttgtagtctgtaatataaatagtacacgattaatataaatagaatagtataaggtgtgaactctattttcccaattactccataaccaaatttgttttgcaacaagcatcaaacaaaatctatatgtagatatggaatgcaagttataccttcaccttttccatcgttaaatactggtggggcgtcccgaccaaaaagaatagggtcatcactgaaatcggataggatagtgtttaaagcttcttgtgcccgcccccaaaaaagaatgttttgacgctgaaggtcagtttctgctacagcattaccaataggagaaacatgattgccatgaggcgtgcccacagctgcccgtgaggaatctgcgccttcgatgtcagcattttccggaatggtgatagctggtggattgggtggcagtgtgaatggaacaatgagcaagtcatcatcactgtctgttgaggtatctgtcaccgttgctctgcttggaccagccttccctttcttcccaattgggtccattattcctttccctttgtcagtagggagacagtcagggcttttaaggcggatgcattcttcaggctctctaatactgattcctcctgtagggaacagctctcgcctggtacgacggtgttgttctgtctctgttgtagcagcggttggctctagtgtaggccccaacacggcactatcaagtgcaaattggtgaagttcctcctctgagtcataatctgaatcgtcactgtcctctgaattgaagttcttgtccgtaacagcaaccggagaacttggaatagtgtgttggacgacagttacacatagattgacctcctctatatgccgccgcatttgaatgaacattgtaacatcactatcttcgctgatgtattgaggtggagaaccgttgccttcatctatcgccatccactctggaaattggtatgccattttaactgtgatgcctcttccacgcaagccaagtttatctttcaccttctgagatagctcttcatacgtcatgttagttctgagtcggatgaatgacgatccttcgacagtcttaggttcaaactgccaggctagattatccaccctgacccactcgccaatcaccaacaatacttcatcttgtcctgcggtctacatggattatggaaatagttcagtattatttagaaagaacataatgaaaattaaatgtaaatatcaatcaataataacagttttccaatttaatcgttcgtagcttttaattacggaataacaaatacagcgtgaatcacgatctaatttaagtaaatactaacaagttgtttagcagatctacaatctaggtaagtggtatattcgaacgtaaaagtgagaatttttaaatggaaactttacactaggcaattaaatcacgagagactaaaaacagaaacaagaaagcgatggttttgtacctttcccttttgattccctgtatttactgctgtactattttcaccaccatccatactgttctgttttgcaggttagatctctgcgtaaaaggtatagcatttactggcaataaatagaaaacagagcatcttctgctccgatatttttggggggaatattttattcaaattaatgtaaaaatctgcaggttatgttactgatgggacaattctcaagcggtgctaggataatttttttactggcttcgaaaggagacacgtcagctggtagaaagaagctcgctcttaccctcacgcgcgtacaagaaatcacagaaacgtggcttagggagtgggttgtaacttcacatacccgtagcgtcactctctcaattccttcgtttatggtgttagttacttaatatttttatggaatatggttattgagctaattcacccatttttttatctcttttaatattcgtattctttttgtaacgttccaaatttttaatattatcctgtctgttatcaagcccataaaataagcccatggccttccacaaacccatactacaaatcattacggttcccaaagcagaagaatcaaaagattcacaaaggaaaaaaaaaaaataaccgacacgtgtcagtcactccttgacaactggataattcttagtggccctgtaaatctaaaaatttcgctgtcttcgtcactctccctaacttcctttttctggttctctctttcttctttctattttattcaaaagccaattcccaatttcccaccaaagcatcactttggcgcaatccgaagattctcgccgccgccgtcgtcatg

SEQ ID NO: 7199 - DNA, 3000 bp, Unknown
  misc_feature (1)..( 3000): cDNA_ID_1816929_gDNA_ID_1621131_Annot_ID_56482 3000 nt of promoter + ATG
ttcagcccacctaatgttttcttctgaatcttcattgtccgaggcattgatctgatcggcctcggtaacctctgctcaaggaagagggagcttggttcgtttctttctgtttgattcgtttctcgatatcccaaaatcgctggctcggttcggtctcttccgatttccggtgcggttctgcggacgggccttgtagtattgccaggcgtgtggaacacgagccgtgtggggttgagatctgttgctgctcgtcgatcctgaagatgcctcgcgccgaaacgagtagtcctgatctgtccttggaaggtagctgcttcgagttgttgtgccaaggatcgatttgtctgttcttgatcgttcaccttctgttgaagttaagttgagccatcatacttcttagttccgctagggtcgcgggaacagcggcttcaggaacgtctgtctggattggagggattgggttcccctatgcatcaactgtgttaccggagatttgattgttgaccattgtgaattgggtggttggttctgtgttccgggagtaagagaaatctcgatcccccctccttctagcgccaaattgtgagagtcaaaactcgcacagtagagtttattttaagggtttcttcaaagaacgaatctttgtgagattctcaaagaacaacagaattctcaattactgcggacgatgttcttgattgtattaatgagaaagtaatgatttgatcgtacaaatgttctagaatatgaaaataagtgtttttgtcttcaaagtcagagcgtttttgatagcatgaagttgagagcgtttttgtgcgtgtccttttgtttgtccttcgaagtgctttttatagagctcgagaatatcgcctctcgcgatattctcggaagatttctctttatctttaagttgttgaaggagattgtccttatcttccgaagattctcggaatttctgtattcggtgatatctttgaagattgtctcttccgggttttcggaaatgatgtgtttgaacttataccggctaagttcttttttgaaggttttctcgtctaacccgaggttcttccgagccgaaatttagctggcctcgggtcgtgctcgggatgctcggaccgcggtattcgaggatacgttcccgaggcgttttggagcccgcctcgggacgaattgccagattttatgtccgaggcgtttcgaggtcgggtcgggggaccatttcacgagaatgctccgaagcattctcgatatcgcctcggtatggattcttgatgcgatctccgaggtgttttgtggcccgattcgggataactcttcgatgtctcccgaggcgttgaaacatggttggctcgcttacctgggtggaatccgaccccaacaatttgtgcatctcaacgtcttatattttttgttggtatttctattttgtcacattcacaaaaatttattttgtcataaatctaaactaataaaattacaatctctttatttatagataattttgtttgtttttattcgccaaaacaattataattttaaaaaatataaatatatcttttatagtagtttttatagagaaaaagaagttaattttttttacacatgtcgacatctaattaattgactgaaccatgaaattatttataatattgaaatttgttggattcttataatattgatcttagctggattctcatgagattaaacaattcaagtttttaatgataaaacatgtattatacatatttgttgaagaaatgttaactagcattccaaaaagaaaaagaaaaattgtgttggattcaatactattactttgcacaaaaaaaaaattaaaaaggattcaatactactaataataatttttttagggaaatttgcaaatatagccaacaaaaaaattataattgcaaaactaacacttcaaccaatatgtattgaactttatgcaatattgacaaacttaacccgtgcgtgagcacacgcgcttattcttcttcttctgagttttcaatcgataacttctatgtattactctgtaaaaattcaaatagaggtgaacattcagagaagttacagtaagaaaatctgaaaattctgggctttaaaaagcgacacccgggaaagtttcgaagagcagactgcgtgtgcaatccgagtgacgattctagagtttacgaagattgaatttgtgggtttcgatttggggactgtggaggcttcgatttctggcaatcggactgcataaatcttctgcaattggaggaggagcctatctaagcatccgagtttcgtacaacacttatgttggctcttttctcaatcgagggtttttgattccgttgagagtacttgagtgagttttgttgtacgggagtagaggtgtttatatctccgtcgtctccactgtaacactcgaatttctgtggcaattggtgtcggcgaagggattcagccaaattaaggtatgaaatgccattttttggcttttgggaaaatctttttaatttgtgttgaagagcttgaatagcataaactcggatttgagtagctttaggtagggaatctgcttggttaatacgatattcatttgtagttgttatgaaggtttaggatttaactctacttcaatgtaatccatttgtgtttgttgatagtaacggaagctactcaaattggttgtatgtgttaatgacatttttagttttatttgcagtattgaatagcataaactcggatttgagtagctttagttagtgaatctttgctggttaatccgatattccactaattggtgttatgaaggtttaatatttaactcaacttctatgtaatccatttgttgttgttgatagtaacggaaagctgaggctatattggttgagtctgttaataacatatatttacatctaagatttatatattttgtatttgtgtaagtagcagcatcaaaaaagtgatacgtggacatttgtatttcagtgtatctgttccatg

SEQ ID NO: 7200 - DNA, 3000 bp, Unknown
  misc_feature (1)..( 3000): cDNA_ID_1028612_gDNA_ID_1621133_Annot_ID_56484 3000 nt of promoter + ATG
tgctttttcagcaatttttaaaattggaaaaatgttcaatatatgtgccaaaaagactttaccactaaatgttcaactcaaagaccaatgtatataagttgaccgaaacgcgtcaaagaaaatcaatcaaggcaaaattaccgtaaaacaaataaaccagaccatgtattgcctattgccagggtagactggccggtcaggatttcgaaaactggtatagtaaacaattctggacggaggcgaaacattaacaaagaactaaaaagacttgtccttgacactcgattagaaaagaaaaaaacagtctatgcgacacgtcacagagcaaaacccctatgtgagacagacagatagaaagatatgtaaagccccagctgcaaaacctgtaaatggaagtaccaaaccattctctcttctcacttgaagcacttggcgtccaagagagcctcaccttcaaatggctctgcgtcttcaatcatctggctaacacgctccttctgggcttcatctgagatatcaaccttagtccactcatacagctccatgtcgtacacctcgtccattatgaactttgggatctctggtccacggaacagccataaacccttcaccttgaacggaccctctgacccacaaatcagcatctttccaaaggagtatttacgtgccaagtccatacgctgaaggaacccaccaaccttgttgagcgtgacaaatgacaccatgttctcatcgttgtacttgtagtcacagaaccatagtgagtatccctctgggtcatacatgtcccagaatcctgcatttgagccacaatattagacatgataaaaaacaattgattccaatagctaaataattccctgatagcaaagctgaaaaactaggtagaggaagatatcaccacacacctttaatagcaacctcgcggaagttagatttggtgtttgagtaaagcctcttccaatcatctagaaccatagggcttggtggtagcaagtcaagagggttcttggctttgggctttggtgcctcttcctcttcagcaagcttaggtgcctctgctactggggcttcctttttcttaggctcttctttgggctttgcaggctgggcagctttcttggaagcaataggagggacagcttcagtctgtttgacatcacccaacactttagtgaagtttggttggttaaccacagtccagaagtacctctcaacatgaggaaattcagaggtaaatttcttggtcatgacagtagcaaatcccaagttcaagttgcagacagtgatgatatcagcaagggtaatagagtgtccgacaaggtaagtgttagacgtgagatgtgtgttcagagcatcaagtgctctcttcaacgtagagatcgcaccttcttcagccttcatttatataacaatcacggatgagactatttatatagtgaaaagaatacctagattgccatcacaaagagtgaatgaaacaaccaatgaaagtcaaaaaagcttaccggagcactgtatggcataaagcccattcttgggccgaaccacctcaagatacttgcatagatctccaatgaagagaaatcaatccattgctcaatttgtgcctgcgaaaaaacaacatgcagataaccattgagaatactaacaaatagaatgacaaacaatagaagaggtgtcaatggattagagaagagtagcccccagggaaaaaacagctacttacatattcgatcagggaggatccgttcaaagagttgtcaccattcaatcggcttactgtattgagatatcaacagatccattaaacccaaacgacaacaagcaatcaaactagacactgagagacaattaaaggagaaagttatgaatgctttaccataacgggcaattgcgttgctttcaaatactgaaccctcgggagtctcaagtacaggaacctagcaagatcaataactcttggttagctgaaaaatagacttaataatactcagtccagaaatttagcaaacaccagtgatgacaaacctttccaatagggttcatcttgaggaacgcaggggttttgttagtgacacccatctgaaagtcagagggcacatcgatctgcacaccaacgtactctgctgcaatgagtgccttctcagcacttttgtttcccttgtacgtgtgcaagacctgcaatcgtaattcatcatcagcacaataatacgtattccaaatcaataacttaacaatagagtagctacatatccaaactaacataattttaatcaatttggtgtatgaacaatcgttctataaacttagatcctaaaatttacaaatctaacgtttctacaattatatcgatacatgatgcgatcgtaacagtagacaatcatagagaactcaccaaagccattgctcagacggaattcaagcgaacttggggcttctgatatcggatctggttccaaggaaaaaaaatcaagcagtgagctcgcaattgacatgatcataaatatgaatatgagctaactggagaaaaaaagattgttcgatcgatggatcttaccagatattctgaagaatcttccgtgagagcaaatcgagagagaagaagcaaaaagttgaggcggagaaaagctataaaggagtgttgaagggatgatgatgaagaagtagggtttttaaaatctgtattgagtgtattcctctggtttggctcggttttgtttggttttatttctgatttttgtttattttccggttaagctctaattactttcccttttattagcatgtataaatgaattacatatatgtaggcttttttagtaagcccaacttgacaagaaaaggtcttcgtcgttgggcaataacaagccgagaaggttgaatagagaagatccaaggggaaagagaaattaaattatttatttatttctgtcatcttctccttttctatttcaaaatcccaaatctaaagcactcctcgagaaaagtgtaacaatg

SEQ ID NO: 7201 - DNA, 3000 bp, Unknown
  misc_feature (1)..( 3000): cDNA_ID_3050073_gDNA_ID_1621133_Annot_ID_56485 3000 nt of promoter + ATG
tcctttcaatctttcatcaacaccacacaacatgtttagttagttatgataagataaagaaaccatacatagataacatctttcaaactctttagattctcaagagtctaacctttgttaaaaataagaaaactatatgataaaaacaagggatgcaaaacaaatatattgaaaattttcttcaaacgagattattatttggcttagcttgtgccttctcgttcgtcttgctcttaccatcttctttcactggatccttcttctccaaagttacagaagacgacgctttaccatcttcttctatctcaagaggtttcgagcaccacctatcgagcaaattgcataaaaccgtcaccattattattcctgcgacgataatacaccatccccagattgggatctccatcttttttatgtatttgttttcagtgacaaagaaacaaagtaaattgtttgttgatgattacaagttgcttaaaagttgttgatattataggaggcgggaactactcgaaagacttggaaatttaccattttgacaaaaaacttgctagaaaataactaaaataaaagtaaatcattcttctaatttttttcaatttatcaactttaaaagtatatttccttttcttcataaatctcataaactagcaaaaagataatgtcataaactaatactataaaatatatattttgttttttttgttccgtcaaatatatatttttggttttgcctgtattcttgttgacttccgttttttttttcccccttttttttaattaacttcctttctttgcttttccatttcttcttgattgaaaaatgtatattgtgtgattttgtctactttatttaaattatctttgaaatcgaagaatttctgctctattaaaaattcaaactatagtctacgttggtatttgtttatttcattttatactctgcttatttttctgatactacattacaactaccactcaaaactacaattaattccctaaaaatatttttcgtttccaaaatttgttttgtgtgaacgattccgaactccacaattgatataaaaaattatctttgagttatattatcaacaacagaaaaaagaaagaaaacaaatacaacgcaagccttgaaataaagtctcatagatatttggctttttttaagtgcaacacaaacaaagcctttcaagacgatgagcaacaaggcttcttagcgtttgattcagaagtagcagccacatcaattgtttggccttccttgatgttggcatttgcagttgtctggtctgaagatatcgacttcttgctgatgatcctataaacctccgagagaatcgtctgaaaagccttttctacgtttaatgcctcgagagccgatgtctcgatgaaagataagccttctttctctgcatagctctgagcatcctctgtggcaactgctctgagatgcttcagatctgtcttgttcccaatcaacatgatcactatattggaatctgcatggtctcttagttcttttaaccacctgcttacattctcaaacgttgttggcttggtgacatcatagaccaaaagagctccaagtgcacctctgtaataggcgctagttatggctctgtatcgttcttgcccagccgtgtcccatatctgagctttcacagtccttccttccaccttagaacaaagatcataggttttttaataggttaattcagatctaatgagcagcagactctatgattagtgtgtctgcaacaacaaaattagtaacttcgcagctaaattccacaaacaacccagtaagaaaactagaaactgtgaaacaacaaccatgattcatacttcaaaagaaaatcatgttcgagatcaatttcagatgaagagattcttagatctgccttaaacaaggttttagatctgacatgtgagggagccttacactaccacgtaccagagtatcgacaaatttgggaacattatcaataaaacgcttaaattaagagataccaaagcaaaaatctcgaccaaatgaaaaaaacaggcaccacacatgtaaacatcaaaattcaaaaccaagcccaaatgttcctacacacaatgactgcttccgagtattcatacgaacacagatacggatcgaatcgaaaagcaccggatgctgcttaacttagaactaaacctagatccagcaacatttcgattacactatatactatatatatagagagagatgtgtgcgtacttggagagtacgagtagcgaattcgacaccaatggtggatttggattctaagcagaactcgttgcgagtgaatctagagaggagattagacttgccgacaccggagtctccgatcaaaaccactttaaacaagtagtcgtattcttcgtccggtcttctcgccattgttacacttttctcgaggagtgctttagatttgggattttgaaatagaaaaggagaagatgacagaaataaataaataatttaatttctctttccccttggatcttctctattcaaccttctcggcttgttattgcccaacgacgaagaccttttcttgtcaagttgggcttactaaaaaagcctacatatatgtaattcatttatacatgctaataaaagggaaagtaattagagcttaaccggaaaataaacaaaaatcagaaataaaaccaaacaaaaccgagccaaaccagaggaatacactcaatacagattttaaaaaccctacttcttcatcatcatcccttcaacactcctttatagcttttctccgcctcaactttttgcttcttctctctcgatttgctctcacggaagattcttcagaatatctggtaagatccatcgatcgaacaatctttttttctccagttagctcatattcatatttatgatcatgtcaattgcgagctcactgcttgattttttttccttggaaccagatccgatatcagaagccccaagttcgcttgaattccgtctgagca

SEQ ID NO: 7202 - DNA, 3000 bp, Unknown
  misc_feature (1)..( 3000): cDNA_ID_1028131_gDNA_ID_1621133_Annot_ID_56487 3000 nt of promoter + ATG
gcatagaaagaagggaaccctaggataaagaattaaaaaggggaacaaagatttatgctgtttcttctttatttctcattggcaaaacggcagaatcttcattaagttgcgttttattattttttccatttcttatagtagccaacttccaactacaccatttaacccggccgtttttttttgttgctaagtaataggtaaatatcctattaatgaaaattatgatttacatgaacaatagctaagatttaggatacaaacaaggaagacgatcaaggatcttgaagatagaagtaggcgcaaatgtgttgtgaattatgcagcatcttatttctttgcttccaagttgtatataaatcacggcttgagtaactagcttccttagtgtatatgtgactgcatctatcatatacagtatgtgtgtaaactgcgtttggtgtaaaatgtaattataatttatagaaaataaattaaagtagtggaacatggaaatcaccgttcagatattctaactgattcactatagacggaattcttgttttcgtccattgtttttactttttagaatttttaagtaaaataaatcatccattacatcactgaggtgacatcatcgctcaggggacatcactaactacgttcccactaaaaatataggcaaatgcaatcaagtgaatgatgatgacctttcaagagttcgtagagataaataaaataataaatatttggcatgttgaggatcaaatgaattagatgcataagaaaggtactaggtagaccaggcccggcccaatgtgttttgttgtctaaagcaaaacaaaaaaaattaagcccattaaagaatagttatattgcctcggaagggctcgaatccatcatcttcatttttttagtttacacggattggaagtaggctacaatgtccctgagggaaggtaggcccattattagtgacctgaagcccaataataatgaaaacgcaaagaaccttttaagaagaagatgacagaatctctagagaataaaaaactaaacacaaaaatagaaaatatcgaaaatgagatgagagagagaggaggagtctctcatcgtgagtagggcttttgactccctccctactttgcctacttcttcttcttcctctgtggccactctacacagtccacacctacttcaagacacctttctcatccttgagatcggcgtcagatcctccgccgcttctcctcttcactatctccggtcacaacttgtttttctctgtttttctttatctctactttatgcacaatctgactttctaagtggatttacagtgttaaagatgatggaatctggcgctggtttcgtggccatggaagagaggatctctcctggaagtttcttccagtatcctctttctggattccgtgcttctcctaatcgatccccttgtcctccctctgatcgtgaaaggtttctattttctctcttctttctcaacctttttgctatttgtgaatctgtgttagcttgattgttgtggacccgtttcttcttctggacttgttgctttagcacaacttcaagtgtgtctctttgtgattggtgggtattgttgcctttgattggatcagtgtttaaaaatgattctgtcaagtttgtattttcatgaactgcttacacagatccaaattctcgatcatactctctcacctcaacatgtcgcctttttcacaattagctcacttattattggattctatacaatgtactcttaaggattttaacaagatagctatattttatcaatgttttagaaatgaacgtactgatgtatttttagaagcttagtttacatgtgactgagtgctgattccaatgtcacccactcgattcacacgcaacatccactgaaacttaagttttttttgttcttaaccttgtgcaggtacttgactgaattattgcaagagagacaaaagttgggtccctttttgcaagttatgccaaattgctgcagactgcttaatcatggtgagctatcttattaagctatgtgattttgaatttagtatttccttagagtgtgtgcacacgaacttaagaaatttcccacgtgaacaaagccttagtgcgcatcaccctggcttttttccagttaaaggtttacagaaattgggtaaggatagttgagtaacaaaaatgtatctacatgcaactttttattctctttgttatggccttcttaatatatatatagccaatcaaagtctatgttacttttagcatttagaaacagtttttaattgcaacttattgctaaatgatcatccttgatgagttatgttatgtgaaaatgaattaagtctatgtgtttgcaaatgataatgatcgttaagcaaatgatcaccaactaatttatactaggaagcctatttgtccgtaaatatgcatatggtgattagaagcttgtttccagacttgtttacctagcttttagttgtccatcatgcccttaagggatgtgtgaaccttaaaagacaaagatgtgtttgaagttttcatcattctaacctattagaacccgagccttttgtttcattattggcattaaagataagagactgaagatgcccctgatgtataactcttacagtttcttttatacgtttgcttaactgccaacattgctgacgtctgtgcagaaatcaggagggtctctagttttcctgatcttgatagatatgagcatggcagtccatttagatcgcttggtcagccgacaaatggaaagcttgatttagagggatggtcgatgatgcaagccgaggtaagccactgctgatagttgtagtcaattaactgattcatgttgaattgtaatggtgatactaataatttttataatcaagagtgggctttaccgatattgattgcttttgctttcttcaggaaaactgtcacctccagagagcttctccatttcgcggtccttccccagtgggctggattgggatg

SEQ ID NO: 7203 - DNA, 3000 bp, Unknown
  misc_feature (1)..( 3000): cDNA_ID_3013398_gDNA_ID_1621133_Annot_ID_56490 3000 nt of promoter + ATG
tttatggaaaatttgaccaaaaaggtaaatttatggaatataatataatttataaaggtttgaaattaaattcaatattaacatttgtaacataacaattaagaaccaccttctttcgtttgcccttgtgaaaaaaaaacaaaaataaaaatcagtaaagaggaggaagtcgaggggagagggtttttggtgaagaagaatcatctctctctctctgcttcttcgcagcagcagcacgtttctttcttgctcttcgccgtgccctactaacctattattcgtctcttcagctacattctgctcgtgaaaatgacctccactgatgtttcctctggtgaattacttcttcttcttcttcttcttcttcaccatcatgtctgcattatctctaattcaacattcatgggttgttttttccgggttttaattttgaaaccagatcatgctttttcccctttcttctgttctttactcacttctttcttcttggaaattggattgcagtgttttgattagttagaatttacaagtgtatctgtcccttgtgggtttaagcgtagatctctctggcaattggcaagtttactcttttgagatgatgatttattgactcaatttgttagggaacatagaagcttggtttaaaactgtctctccccttttggataagtatagtttctttgtgaaagtcgtcagctttattcagaactcgttcactgctgttccctgttgtcgttttgagtttatttgcaatttatgctgtagtggatagcatcatcactgtttctgttttatcttttgcctcattttgaagtttttttcctgctcaggtgtttccaattgctatgttttcaaaagtcggttgcaggagtatgctcagaagtacaagctcccaacgcctgtttatgagatcgttaaagaaggcccttcacacaaatctttatttcaatcgactgtgatactggatggtgtcagatataattctttgcctggattcttcaatcgtaaggctgcagagcaatcagctgccgaggttgctctccgggaattagcaaaatccagtgagctaagccaatgtgtttcacaacctgttgtaagcacctcatctttcttatttcgctcgtgattattgttaagttcactgcaaaactattgaacctagcctaggggtttagcagcgaattgtagctttgccatctcagcagtagtccttatgcttagtttgagcgttgaaggtttaaagggaagctcatggttagtttcagagttgaaggtttaaaggggagctgtgagaatacgttagggggcattctgtatttgtctaggctcttggttggacaatgatcgagattcaagagtttaaagaatccactcattaataaagtgtcttctgtcttatcggatttatgtgtattgccaacttctagagggaagattcttaggctgtttctgtaagttattgctcttgtctaactttgaatggcttattaatgcagcacgaaacgggattatgcaagaacctacttcaagaatacgctcaaaagatgaattacgcgattccattgtatcagtgccagaaggtcgaaactcttgggagagttacacaattcacatgtactgtagagattggaggcataaagtacacaggagctgcaacaagaactaaaaaagatgctgagattagcgctgggagaactgctcttttagcgatccagtcagacactaaaaacaaccttgccaactacaacactcagcttactgtacttccttgtgagaagaagacaatacaggcagctatcccgcttaaagaaaccgtcaagactcttaaagccaggaaggctcagttcaagaagaaagctcagaaaggaaaacgcacagtagctaaaaatcctgaagatattatcatccctcctcaacctactgatcattgtcaaaacgatcagtcagagaaaattgagacaacgccaaatctggaaccttcttcatgcatgaacgggttaaaggaggcagcatttgggagtgtggagacagagaaaattgagacaacgccaaatctggaacctccttcatgcatgaacgggttaaaggaggcagcatttgggagtgtggagacagagaaaattgagacaacgccaaatctggaacctccttcatgcatgaacgggttaaaggaggcagcatttgggagtgtggagacagagaaaattgagacaacgccaaatctggaaccttcttcatgcatgaacgggttaaaggaggcagcatttgggagtgtggagacagagaaaattgagacaacgccaaatctggaacctccttcatgcatgaacgggttaaaggaggcagcatttgggagtgtggagacagagaaaattgagacaacgccaaatctggaatcttcttcatgcatgagcgggttaaaggaggcagcatttgggagtgtggagacagaagcaagccacgcataacagtgtcaagatggagtcttgtgagtttgtcatagttactatatggttacgtagccattttgtgattcctatctagtctagtagtaattcacagattgaagagaagtaatatttgagcggaaaatcaaaactaatatgattggtacaatttggtggtcgattgagtcattcgaataaagtaatgtggggttgcaaaacagaagcttcatatctacatataaatgaaaattactctcaaacttcattatttgtgggccggttataaaaacacaaacccaacagaaggtccattaccctcactcttcattatttgtgggctggttctaaaaaacaaaagtccaatagaaggttcattaccctcactcttgattatttgtgggctggttctaaaaaacagaagcccaacttgctgacccaacaggtccgtttacgaaaccctaatctcaaaacagagatataaatacactctgccttcctcatttcatttcttcggcgatctagggttttagttgtcgcacgaggaggaaaaatg

SEQ ID NO: 7204 - DNA, 3000 bp, Unknown
  misc_feature (1)..( 3000): cDNA_ID_1817060_gDNA_ID_1621133_Annot_ID_56491 3000 nt of promoter + ATG
aatactagaattagcagggaaggatcttctgctacttgtacctattgcaagcttatttgaagggggccgatttcccagagctaaagataatgcatggttaactgctagtttcgcttcagttccttgtaggccacattggctaacagaggtcgaagtgtgacacctttttcttataagcgcccacctctacaaagaaaatagtcagttgttaccaccaataacggaaaaagagtaagcaattgcaaaatgtcccatgctcgtccaagtagctaaagtattgttaagttttatcagatggaaagtatatgcgtaaaaaatacaaagatggatacaaatatcataaaacttagtcttattagtcttattagctaccttctatgattgccaaaagactattactcatatcatccaaagaatctgttgccgggattcgaacccggaaaaatggggaaaaaccccacgtccataccagactagatgacaacagatatatttctagagtaattaccaaagtggtacttcgtctgtaaagagccaccacctccaacaacacgaaagagggaaggtaatatccaccattcatcgtcaacagaatatagataatgatgcataaacaggttgtaatacaaagaacaagactataagatacactacaaaatgacttcaaagaaactaatgaaaaaagagcagtcaatattgaataagagaaatcacaacctgcgagagttgggaggcggttctctctcctctaaagtctcccttaacaatatgagcccagttcccttcaccacatcgctttacagcggcgaacagctcctcatcctcctcagcagaccatcttttccttttcctccgaaaagccatgctaataccagctgaaccatttccattcatcccctcggtagatgtaactttctgaagacagaccggaaagttgatattcatccctcttgacgaccaaggagactctgatggttcctgagaaccctcaggcaaagcataaggtatgtttatagtcaagggagcctcaactgttgaatcgtcgagtatatcagactcacttagaacatatgaagcagccatcacctgggaatacaagagaaacgaaaacttaatgatatttggataaaatgggaactctggataagcacagattgatatgcagaacaagtaaccaacacactaatcattaagaaaacagcaaggtgttatcctgaatagagcctagggacttcagattctgaaattctgtcaagggaatgaaatctatgattccgttcttactttgacatgtgcaatagcctccactgatgcttcatggctgactgcaggagaagcttccaattcgcactccatgtcactatcgtcgtcctgcacaggcaactttcgtttaaaaaatctgtaaactacaccagcgagagacactcatcgatccctaatgctaccaagaagttttagtatccactgccacatagaacataaactagtatttcatcacactcacttctagatgatactgataacacaaagtagtagtgagtttttattgaagaaaactaactaactctacaacataaacttgagtcttttacaattcatcaaaagtggaaagaggagagacagaataagtaccagaggtagagcatcatcttccacagggaggagaggatgccgataagaaagatgacgccatagcaactggtactctctagcattagtaattccggtagtggtcttcttcaccaacgcattccagtccatcttggtttcggaacaataagatatctcctgtagcattctcagtatcgtctccatatcatatctgcgtcaataaatcaaaaaccccggccacactgactaaacccaaatccactaacgttttcggaaagagaaaacaaaaaaaggagatatttttacctcagcaaaagagtggcgatgtcgccttcagtaatgattctcttcctgcgattgctactagtattattattagcaaccatcttcgtcgtatttattgcaacaattctgcagagaacaggacaaaggaatcaaatttcaccaaaacccgagggagttatagacgaaacgaaacgacagagacttacgcacgagggaatgcccaagaaaaccggtgaagacgatcggagaagaagatggtcacgactgtcgaagagcgtggagagtactcgcgtggcagaggtgtttcggaagagagaagaaaaaaaaggaacgaaaaggaaggtggtaaattcgactattattattctacgcttatcagaagcgaaaagtatgggctcaaatatttttcttttctggtaaagggatataggatcaagtgggctcaaatatgggctcaaatatttttcttttctgttaagggacataggctcaagtgggctcaaatatgggctcaaattgtttttattttttattaaacggttattatcattattgatgtttacttggagaacaaattaattatttgtgaatacaaaaactgtgtgaatataacaaagggattactagtgaataaagttagccataaaaaggttaatcaattgtggatatatacattagttaactacatatgaaatacgaaattaggctatatgtaattagttttttaattaaattaaatatttcaaagataaaaacattttgctttcatataatattcacaagtaaattatatttatggaaaatttgaccaaaaaggtaaatttatggaatataatataatttataaaggtttgaaattaaattcaatattaacatttgtaacataacaattaagaaccaccttctttcgtttgcccttgtgaaaaaaaaacaaaaataaaaatcagtaaagaggaggaagtcgaggggagagggtttttggtgaagaagaatcatctctctctctctgcttcttcgcagcagcagcacgtttctttcttgctcttcgccgtgccctactaacctattattcgtctcttcagctacattctgctcgtgaaaatg

SEQ ID NO: 7205 - DNA, 3000 bp, Unknown
  misc_feature (1)..( 3000): cDNA_ID_1817056_gDNA_ID_1621133_Annot_ID_56492 3000 nt of promoter + ATG
cagatttggcgttgtctcaattttctctgtctccacactcccaaatgctgcctcctttaacccgttcatgcatgaagaaggttccagatttggcgttgtctcaattttctctgtctccacactcccaaatgctgcctcctttaacccgttcatgcatgaaggaggttccagatttggcgttgtctcaattttctctgtctccacactcccaaatgctgcctcctttaacccgttcatgcatgaaggaggttccagatttggcgttgtctcaattttctctgtctccacactcccaaatgctgcctcctttaacccgttcatgcatgaagaaggttccagatttggcgttgtctcaattttctctgactgatcgttttgacaatgatcagtaggttgaggagggatgataatatcttcaggatttttagctactgtgcgttttcctttctgagctttcttcttgaactgagccttcctggctttaagagtcttgacggtttctttaagcgggatagctgcctgtattgtcttcttctcacaaggaagtacagtaagctgagtgttgtagttggcaaggttgtttttagtgtctgactggatcgctaaaagagcagttctcccagcgctaatctcagcatcttttttagttcttgttgcagctcctgtgtactttatgcctccaatctctacagtacatgtgaattgtgtaactctcccaagagtttcgaccttctggcactgatacaatggaatcgcgtaattcatcttttgagcgtattcttgaagtaggttcttgcataatcccgtttcgtgctgcattaataagccattcaaagttagacaagagcaataacttacagaaacagcctaagaatcttccctctagaagttggcaatacacataaatccgataagacagaagacactttattaatgagtggattctttaaactcttgaatctcgatcattgtccaaccaagagcctagacaaatacagaatgccccctaacgtattctcacagctcccctttaaaccttcaactctgaaactaaccatgagcttccctttaaaccttcaacgctcaaactaagcataaggactactgctgagatggcaaagctacaattcgctgctaaacccctaggctaggttcaatagttttgcagtgaacttaacaataatcacgagcgaaataagaaagatgaggtgcttacaacaggttgtgaaacacattggcttagctcactggattttgctaattcccggagagcaacctcggcagctgattgctctgcagccttacgattgaagaatccaggcaaagaattatatctgacaccatccagtatcacagtcgattgaaataaagatttgtgtgaagggccttctttaacgatctcataaacaggcgttgggagcttgtacttctgagcatactcctgcaaccgacttttgaaaacatagcaattggaaacacctgagcaggaaaaaaacttcaaaatgaggcaaaagataaaacagaaacagtgatgatgctatccactacagcataaattgcaaataaactcaaaacgacaacagggaacagcagtgaacgagttctgaataaagctgacgactttcacaaagaaactatacttatccaaaaggggagagacagttttaaaccaagcttctatgttccctaacaaattgagtcaataaatcatcatctcaaaagagtaaacttgccaattgccagagagatctacgcttaaacccacaagggacagatacacttgtaaattctaactaatcaaaacactgcaatccaatttccaagaagaaagaagtgagtaaagaacagaagaaaggggaaaaagcatgatctggtttcaaaattaaaacccggaaaaaacaacccatgaatgttgaattagagataatgcagacatgatggtgaagaagaagaagaagaagaagaagtaattcaccagaggaaacatcagtggaggtcattttcacgagcagaatgtagctgaagagacgaataataggttagtagggcacggcgaagagcaagaaagaaacgtgctgctgctgcgaagaagcagagagagagagatgattcttcttcaccaaaaaccctctcccctcgacttcctcctctttactgatttttatttttgtttttttttcacaagggcaaacgaaagaaggtggttcttaattgttatgttacaaatgttaatattgaatttaatttcaaacctttataaattatattatattccataaatttacctttttggtcaaattttccataaatataatttacttgtgaatattatatgaaagcaaaatgtttttatctttgaaatatttaatttaattaaaaaactaattacatatagcctaatttcgtatttcatatgtagttaactaatgtatatatccacaattgattaacctttttatggctaactttattcactagtaatccctttgttatattcacacagtttttgtattcacaaataattaatttgttctccaagtaaacatcaataatgataataaccgtttaataaaaaataaaaacaatttgagcccatatttgagcccacttgagcctatgtcccttaacagaaaagaaaaatatttgagcccatatttgagcccacttgatcctatatccctttaccagaaaagaaaaatatttgagcccatacttttcgcttctgataagcgtagaataataatagtcgaatttaccaccttccttttcgttccttttttttcttctctcttccgaaacacctctgccacgcgagtactctccacgctcttcgacagtcgtgaccatcttcttctccgatcgtcttcaccggttttcttgggcattccctcgtgcgtaagtctctgtcgtttcgtttcgtctataactccctcgggttttggtgaaatttgattcctttgtcctgttctctgcagaattgttgcaataaatacgacgaag

SEQ ID NO: 7206 - DNA, 3000 bp, Unknown
  misc_feature (1)..( 3000): cDNA_ID_1817049_gDNA_ID_1621133_Annot_ID_56494 3000 nt of promoter + ATG
aggatttggtccagttttccctcaagaagtcaaaattatttccattcatatgcagattgcttttcacttaatgctttgtctattttttaagctttaaaggcttacagtcgaatttccttattaagtttatattctcatagtgttctaaccaaatgaatcatactcataatgtagttcacaatttcccagatatcagacatccagcaaagaatatttttccttataagagcatgcaaatacatcttctaaatgaaaatgggcagaaaaaaaagtaatttttagttagcacttcataataatataagcttactcgaggtcagtattccacacagccgggtatttcacatgcagcgagtttatcttttgttgcttattaggccaattatgttcttttaccgcaatctttaactcctccatgtctggaaaccacatgaagcaatataaaaagttagaagagggaacctctatgttggaaagagtagatgcttaaaaagacagactcttcgttttgcagaaatgaaattcaataagacatctctctcttaaaactcttagccatcattaaacatgaacatacatgaagcggcaattagaaagacactatctgttcggcaaacaagcgaaatcgctaatatagatccatttaaagaattgcatgtaaagaagaattaaatatatctcactaggatatcagttcactttatattctcctttctatttaccatttttctactaaattaaaccaaaatcgaatgaaagcatgttctcgtagaatcaatagataacaaccgacaatgaaaaaaccacagtatcaggtgtctaagatgactaaccaaaaatcgtaatggtacttacaactaacaagtccgctttttacaggaagaattttatgataacctaaatggcaggtatacataccttcatggcaattttcatccttcagtagaactcgaattctgagaatgatcaatccaacctacaaaattgaccagcaaatattgtcagagtgatagaacctatgcccataaagtatccttcaaaataaaaaagtcgacataatgaataactcacattttggtaccaattgtattgaatactaactatgtcttcaactccaaattcacaagaaaatggcacttcttcattatttgcgaggaaactctttattttgatgccattgcatgaaaagattactagggatgcagcacaatgcatatccttaagtataacatactccgaagtcattataacagcggtgcttaagtcaatctgcgaagtggaaaactggaaatcattatctttttgcaaaaaagaatcattaatatcttttggcaaccacatcgttgccaaacaaattctggcagtagttttttaagccattggttaagaaactagaaaactcgttaccttttcctcatcgttgaagcaatgttcagtcatccaatctttcagcgcatataacattgaaatcaagacacggtcagacataggagatccaagcatatctataaggaaatatagagagaaggtgtagcatgtaccttcttcatcatcttctgaatcagaagcttcactcaacgcagatcgatcactcaagctttcatcaatagctgacatcatatcaatttgctcctcctgcaaatgtgaaggggttaaaaatgcaaggtaaaacttataaagtctttagcatacattaaaaacaagatagattaacatacactggatgaagaatctgaaaagggtgagtttagctggcgttgactataagatgaagtttcagcgtaaaaactatttccgcctagctggcaagagaaactctccactctatgatccacatctgtttcttctatgtcgtcttcgctattcaaaccaaacatcaatccatggttatcgtgatctatatctgtttcctttgccaggtcttcagtttttaaacctaacatcaatccctgattaacgtgctctgcatctgtttcttctaaatggtcagtggtttccaaaccaaatgtgagaatcgttctggactccttagcttctgttaccaaagtcgaatcatcttcacattgatgatcgtcagactctacagcagtagcaggctctgcacaacttggaccttccatttcttcttcctcaacacgtttttcattgcagactggcaacaattaaccatttccataagaactcactcatatatgataaaaattatttgcttctgaacaatatagtacaaatcattatagtgcctcccataaaattgtagtatcacaacagcattagtatcattatttctcacatactgcagaaacaaagcaatgttcattcaactatatacaagagtctggaaaactaaaataaacagaagaattccaaggttagcttaacttctctccgtttacaaatatctcaaccccaaaattatttttccacaactgaaactgaagcgagaatttaaatcagcatttgaagtttagagatgaatcagagtaataacttacagctttggatgcgttggcgttgcagaaccggagaattgcaaggactagggtttgtgaatttttccaataactttccagctgcagactcagcgagctcgtcctcttctttgaaatcgaatacttcaaagtttttcttcatcgctagggaaatctgaggaaaagccccaccggaaaacggagaatccaagccggagatcggcgatcagaaatcgagggggtcgagtgagggagaaggagagagagaaacgtctaaacgaaataagtcaacaacgaatgccagcgcgtctgaaactcacgcgcggacgtaagtttactctatttataatagtacgtaaataatttaatattttcattacataattcggctatggaatgacaggtatacccttttgtaagccgcgaatttaaaaatgggagacgtgaaagccatcgtcctcttgaactttccaagagttgaagaaaatcacagaaagccttagcacagagaagagagattgaagaagtc

SEQ ID NO: 7207 - DNA, 3000 bp, Unknown
  misc_feature (1)..( 3000): cDNA_ID_1010209_gDNA_ID_1621133_Annot_ID_56495 3000 nt of promoter + ATG
tttccaagagttgaagaaaatcacagaaagccttagcacagagaagagagattgaagaagtcatggatgtttcaggaagcttgaattgcgttgttgtggcggtagatggaagcgaggtgagtatggaagctctgaggtgggctctagacaacctcaagctctcttcgtcttcttccgattcatcattcgtcgtgctccacgtccagccgtcgccttctgtagccgccggcgtgagtcccggcaccatacctttcggtggtcccagttgagtctcgttactactaattttgtgattgtttaatgtatatatgatctcgaccatgtggtgtttgactctgggaattttgcgattaaggtggtcttgaggttcctgctttcactgctgcaatcgagcaacaccagaagcggatcaccgacaccatcctcgaacacgctagtcaaatttgtgctgaaaaatctgtgagtagagttatttcccttgtgtcccctgtgagaatgggatattttacctcatagtccagatctagtagtgtaattctataagttttatggattagaatatttctctttcactgatggattagaatctggagcaattacttatgtgttatctatagaagtgtatattgatttgagggtggtcattcatgaccaagttgtgatggtttactctcaggtgaatgtgaaaacacaagtggttattggggatcccaagtataaaatctgcgaagctgtagagaatttgcatgctgatcttcttgtcatgggctcccgggcttatggccgcattaagaggtaccaaactcttcttccagtactctagtatcttgctatgttgaacactgatgaaagcgctgtaaatcaaattccaggcgtttgatcttggttactatgctgaattagttgttccatatcggtttactctagtttaagattgtttcgctttcgcttgaaatggcatatagatatctactgttatttttttcaactcgtgcggtcaaataacagaagaaatgtttagttaatctttgaacttgtgtgaagacaaatctctgctcaaccaccaagtagtgcttcgaggaatctttatccctttgaaaatgtttataccatatcactgtcactgtgtgttctttagtgagttaaatcttatttagtgagcaaatgccagtgttgaatccagtttgttctttctttcaacagaatgtttctgggaagtgtaagcaactactgcaccaaccacgcccattgtcctgttgtgataatcaaaccaaaagaggattcttctgcataaagaggtaaacaagtttagcttcttgcaagtcacttcattcgatgttcaccatgcaaaagtttgttaagtcatcaatcagaacccacatgatctacttttcatatccaaaccaacctcaataaagtttactactctcttttggtacaagtagcctatgtaaccgagtatcaaaccatcttcacttctcaggatatatatgtacatatgcaaagggatatcaagaccatctgtaatcttttgaagttttgtgaagctatagaagccaagcaagaattctaccagattacttcccaaataagtggtgtgaatgtaaattaataagagctacagaaacattgattggctcagtgtatgtgttgtattcatattcgttgttttattttatacggttgagaattgaataatgttgttgcatcaaatcactatgaaggacatttacagagccaactggttgacaatgtgggctaactcaccctcgttgatatgttaattggaccgcaggcatggataagtagttgagagaaacaaagaattcgtgtaagaaaaatctgaaccgatcaatcaagcctcgcctaaaggtccaagattttcttgggacttttggcctgcccttagtgatcatttttccatattatgggccaaaaaaaaaaaattgcaatatctgctacacttaaatctttgaaacaaaacttatccaaattgcttggaatttagttggatgtagatgtaaatgtatattctactgtagcgacaaaaggtaaaagaaagattatgacaattttcaggatataaatattatgacaattgtagatgtaagtatttcagaggtctcgtgaacgaacaatgagagtaaatgacgaaagaggcatcgtcggtttgtcactgtcaacacgataagggaggctcacgagtcacggacttaaaaatattaaacactgttctttttcattagagcaccaagatttttatcttagcattgtaccaagataagtgttaaaatttaacatcaagaccctacaaaatttaaattgcgaatcttgagaaacaagacgtattatgaaatgtatagttcacttgtcccaacccaaaaataaaagaaagaagaaaccaaataacagactgttatagtttgtcctggttttggcagcacaattatttggttttgttttttttaatcactatccaaatcacacttcacttcacatgcaatattcctttaagctcttgaccgattcactggctacttcacaccacactccatgtcccctcgtgacttctctcaactctcaaaacttacctcagcataggaaatgtattcaagattttactatcccccctcaatcgaaataacaacatttattcaaaacaaaacaaaaattatcagcaagctaattaggtgttaaaactataatgaaatcagcggatatagtgaaccaagtcagaccatttttgagaaaattacgaaagaaaaatattataccattttatctcacacacatgcgaagaagatgtgtagacaatagaaaaaaaaagtttacggagtagtagtactattgccagatagaccggaccggatcccaccaattataaatcgaattcgagggacattttcgcattttcaatacctcgctggccatatataaaggccacatcacactcgaagaacattatctaaatatctctacacaatcacattagccaaaacc

SEQ ID NO: 7208 - DNA, 3000 bp, Unknown
  misc_feature (1)..( 3000): cDNA_ID_1807189_gDNA_ID_1621133_Annot_ID_56496 3000 nt of promoter + ATG
ctcacattctccatctcctcctgaaaagctgcaactttgtccgcgttcccagcaacacttgagagctcgtaagcgcttcgagtggggaaatacatgagatcattcacgcatgtgttgtgagcttctacaaaatcatcaagtgtcttgttctcatgtcccattgacacacacagaaacttcccctcctcctttatcattttgtcagcctaccaaaaatcataagcaacaaccttcattcaaaactccctagtgtataccaaattaattacagatgttgataattaaggagggattaacattcatgcaaaaattatcaatcaaacaatctagcctaaaccaagagagaactaaggattccagaagctggccaacgaattaatcaaccaaaaaacaaaacaaaagtaaactgaaattggatagatattttcatctacatacctcttggagctcattttcatcaaaatcgtcaattgcaagaacttgagaagcagaacggttggtacggttcttggctcctttcttcttctcagctttgtcatcaagcggatactttgcattatcatgctccagcaactgtagaagctcctctcttaccattttatctgcaacctcaatcggagtaggaggaacaacagaacttttgtctccatcagctgaaagcaacgagttcctaattactgccaatgaagcagctgggggtctaggaagatctctctgcaagaccttggatctcttcttaagcaatgcctgttgtcttgcttcttcctccgccttttccctcgctatcctgtctgacatgtcttcctcaattttctcttctggctcttcactttcctcaggaggaggttgtgcaactatttggtactcgttctttggctgaggaagcccagtcaaaccagagcgtaaactccttctagcttcctctcgtctctgcctctcaagttttgcactttcgtgcatgtccatgtcttcgttaatgtgaagttcatccctgaagggagtccctttgggtgtcatagaaaaagaagacccatcccttgatggcgtcaagccaattcttggagtaagaccagcaccaccaggagtcattgaaggggtcaacattggattaggcgtttgaatctccttctttctcggagtgaccccagtgaagtcagaagggtgcaactcaggattttctcctcctagcaaaggtgtctgagagtctcttaatctggccaggttttctgcttccatcataatagcatcacctttaccagcaggagttctttgaggtgtcctcatgggtgtcattccttgccttggtgtttgtgagtaatttgccaaaagtgcacgagtagcagcactgccttctgttagctcctcattctcggcaagaaggtcactggcatagcccatcttagcaatttcttctagctcgtggtctgaaatctgcggtggtggtaacatcagctttgacctcttcctaacaacttccggatcattcagcttgtttgcttgcaatatagctgctggagcatcctgtctctgagcaattttattccttgcaacatcttgtttgcgtaaatgtgcttctacatcagctcttctttttccttcaagttcttcaatggtagttggaaattttacttgatcagcaggacgatcttcatccgcagtatcataaaatcccgcaggtgccctcttttcaaaaggaatttctgcattatagtcgattccctttctctttcttttcctatgccttccatcaatcccagctgcttttagttctcttcttttttgcagagaagcaagccttctagcttcctcaagttgtttttctctagcttttcttttagccttctttcccctcgtgttagccaatctagctcttgcttcagaaagcatttctttctcatcttcgtccatgtctaccggatcaggacgagcaggctttgcttctgggttcggatcaatctcaccaggacgtaattttcgtggatcatccgctgcatcataattttcatccttagtgcatgctgcatcaaggagcttctcatacctctcaagacattgagatggtgtacgacccacaataggagcaatagttctccattgagtaggcagaagtttagcaagatgtagaagcttctcatcttcttctctggtccattcagtctacattaacatcacaaaattaaactcagttgtaattcaaaaacataagaaaaccttcgaatactccaaaactcctagcattactgcctacactttctatgaatttccagatgcaaatcaatacatatatacaactaaagcacctagtaacaagctaacaaactacctaaaaggccaaatccccaaacaaaaaaatgttcgccagatccatagttttttttcgaacactactagttaagagaaggaaaacgcgaacacgacttacctttttgatagatggatcgagccactcgtaccagcgagctttacactgtttagcagacttacgaacgagaagagacgagatccgagcccattggttcttaccatacttcatcacggcggctttgagaatctcatcttcggtgttcttccaaacacctcccttaatcataatcctcatcttcgctcaactgtttttgatccaaccgcactccaattcaaggtctctgaagctaatgctcgtggaactcggtaagaacgaagaacagaaggaagcgagagagagagtaaccctagattagggttggaaccaacgaagaagaaaagattcaatcgttcactagtccttttctttttatttgttttttctttttaatttccaaaatcataaatatcgggatacacttatgggcctaaccgactgggccaattcaatgggccgtttatttaagtgataaattaatagcaaaggtcattttgctgcgtttttatgtcatctctagccactgttgttgtctctttcctctgaatgcttagcagcgacagagctcgacgaagcagtaaaaccctagtagaataatg

SEQ ID NO: 7209 - DNA, 3000 bp, Unknown
  misc_feature (1)..( 3000): cDNA_ID_1817045_gDNA_ID_1621133_Annot_ID_56497 3000 nt of promoter + ATG
tttacgttcttcgtacgttttgatttgaagaggtgcttaatggcgcttgaccttctacatatactttgtatgaacggctatcttcactacgcataacatggcctgcagtttcatctcttgcttcagcgatgtgatttcttttctaaattagtttctcggtaattgatgatattgagtgacaagatacaaaatactaagaagaaattctaatgcgaaaagagcataagcaaattctgtgtgcaccctcgctctccatgccaatgcagagacttaaaaagactacaatcctctttggcattctttttaagggttcaaaacagatgcctcgagcagtaaatagtttacaggttccaactgttgcgcatgagttcctaaggaagtgacagaaaccgtacaggattgccagagaaaacaattgctgtgagcattctggagcagtagctacaacgattggaggggcaacagtcacgctttctattcctgtaaagacaatatgcaagagatttgtcggtcacactgaatttagctatccagatttcttgaacaaggagcaaaattaaaaagataagcaaatacctccatgggagcagagtcatttgtggccggatcaggaattatcaggccagcaggaacctgtccaaacttcaaagcctatatatccacaagccaaaaaaaaagaagactgtcaaaatcaatcaaaaacaacatcatcaggcacaaatttgatattcaaaagaaaaagcaagggacctgttcgagtctggcaatttcttctatcgtctgagaattgataattgcagcctggaacatcatggaaatgaaatacagaaattactatcaaccacacagcgttgacctacttattataaagacaacaaaacagtgaatatgtttggtcctatataatttccagtttcgcaccttgatagctaatatttgctccgctgttggcgccaccactttcggagtctctggattttctgcagtttctgacacttttttaacctcctcccgagaaacctttttaacttcctcttctgcttctttggatgaaaacaaagatgcagcttcagctctctcctgttaggaaccaataatgtcaggtaaaaggtcttgctataaccattgtaaaatttagatatacaacagtgggctaaaggataaagccaaactattatccgatccaaggctacaaggttataacacgaggaaattaaataaaaacaccacaccctacatcaagtctggtttatatttatgccctaaatacaaaaaactttaagataatcaggcaaccaagtcatcaagacccaaactatatatactttaagcaaacccttttagctaaatgttgttaatattagtgaaatttcttatttcagcatacagatataactgtgcacaagaatcttaaacaacgtaagacaaaaggcagaccaatttcttgctctcagatattctatttttcagatgatattaaggttagctcccggtgacttgtagcatataaaataacattaagttggcatctagggtaagcaaaaatgaacagttgataaagcatatgataaggtccttaccttggctttgattttaatgaaatccagtactcgaagtgattttagcttgtgaatcacataaaggcgataatttgcctttttggtgatattattatccaacaaactaaggtactgcagcttgggaatggaggcaaggggatcaatctcaaccaaattcacaagcctgttatttgtaagaaccaaagagtgaagcttcggtaggaattctgcagatgtacaaccatacgataaatacaacacaggtaaccaacaaagcaaacaatgtgtttgaattgacatttcttacaacacacagatagatgttacctccaaggttaggatttatccgggtgatacgattgttattgatgagtaaagttcctaaacggttgaggtatgggaagttttctagcttaactatctcgttatcagacagatcaatggtatcgaactggtcctgtaagcaaaccaagacaagttaattagagaacctcaaacctgcaaataatctacctaagccaaacacaaaatttatgggaggcctttcttagagaagactggctctcaaaagtaaagaatccacagtaagaaaaaggtactattacacgaagccacatatactcctaaagagctagaaaacagatactaactaagacaaaggagcaatagctacttcaacaatgtttctgtcaatgattttcaaaatacttgaatgccgaaacccaacaggcagacttaagaacatacaatacaaccgcatcaacaaattcttcagctaacagacaaagaggaaacgaaaatcgatagaaaaaagaaatacctcagtagcacccaagttttcgattacaggaatcttgttacctgcaacaaattaacccagaaaaacgaacgattaaccagagcaggtgcgtttagggttacaaaaccctagaaaatgtaatgggaaagagaagaagtgtacctcgtagatccaattctcgctccttgatagcattgaagaagtgaggacttttccagatcaaatcagccgtgagcttcaccattattctactagggttttactgcttcgtcgagctctgtcgctgctaagcattcagaggaaagagacaacaacagtggctagagatgacataaaaacgcagcaaaatgacctttgctattaatttatcacttaaataaacggcccattgaattggcccagtcggttaggcccataagtgtatcccgatatttatgattttggaaattaaaaagaaaaaacaaataaaaagaaaaggactagtgaacgattgaatcttttcttcttcgttggttccaaccctaatctagggttactctctctctcgcttccttctgttcttcgttcttaccgagttccacgagcattagcttcagagaccttgaattggagtgcggttggatcaaaaacagttgagcgaag

SEQ ID NO: 7210 - DNA, 3000 bp, Unknown
  misc_feature (1)..( 3000): cDNA_ID_1817041_gDNA_ID_1621133_Annot_ID_56498 3000 nt of promoter + ATG
tgctaaatcttttgctcgtcgttactgtcattctctgttcaatcttatcacccacacgtaagtcttttagactctttttgttattcttatcacaaaacgaatctttgaaaattgttttgtagggtttatgattatgattgataaaatggttgcagatggatacgatcctcttgatccgttcggaaaaatcattatcaaatgggatcttcttttatcatcacctggccaacaccacgtaactcttcttccttctcttgtttttttttattcctctccatattttctcgtaagttttatttctgtgtctgattataggacccgcatgagcctcagataatctggggttcctttttttgttcttgggagaatctgggtttataaaaaaaaatacttaatgatataacaaaagaaaataactaaattagtgtccgaatattaagcttgagacgaagaagttactcaaaagtttgttttgtttcctgcaaagttgattttgtcaaaatcattttctgattataaaaagcttgtaaagtttggttttcttttctcgttttttttgttctcttgacgttttatgaaatctgttatgtcttataaagtaatgtggcccttgttcaatgatgattcaaatttattatatattgttaagtttaggtttactgattttacctaaaattgaaagatactcctacattaattttgcaaacgaaaaagtaaaaactaaagcttataatgcttggaatgttgaaaatgtaatgttgcaggtacaagtaacgttagagaacatgcaagagtatcgacacgtggaaaagccagggtggaagcttagctggcattggctcaaccaagaagtgatatgggacatgaaaggagctgagacgacggagcaaggtaattgctctgcctttgcctccagcggtaaccttcctcactgctgtctcgagcgaccaaccatagtcgaccttcttcccggtgcttctctcaacgttcaagttgccaattgttgccgtggaggcgtcttgacttccatgtctcaggaccacgccaatcacgtctctgcttttcacatgacagttggaagctctcctgatggccctgaggagttcaatatgccttctaatttcgatataggggtcccgggttatagctgcgacaatgctacatccgtgtccccgactaagtttagtactgataagggccgtcgcaaaacacaagctctaggtaaccaaaattatataaattgcaatataattacaaaaagaagttgagaaatgtagaaacatgttatacataggttttttgagttatgtaacataagatatgtggtgttgagtgcagcaacatgggaggcagtgtgtgtatactcgcagtttcggtcatcaccatcgccaaaatgctgcgtttcactctctgccttctactaccaaaacattgttccttgtcctacctgtagctgcggctgctcgagttcccattgtgtcaagtaattcacttttctaaacctttcacttttttttggatatagatgtaacaacatgtataatatatactagagagcaacatttgattgatcagggatggagagttgccgccatatcttgaacagaaacatgatccagatgaggaagtatcgcctgtcgtgaagtgttcggatcatatgtgtcccatccgcatccactggcatgtgaaagtgaactatagagagtattggagggttaagatcacagcaacaaatttcaacacaatgaagaattacactaattggaacttagtggtgcttcatccaaacttgaaaagcgtccaacaagtctttagctttaactacaaatctttgacaccatatcaaaacagcatcagtaaggaaattctttaaaaaccacaccatagtctcttagattattggtctaacatcacttgttcttcgtgtggtgttatttcagatgacacagggatgttttggggagtccagttttataatgatgttttgcttcaagaaggaaagattgggaatgttcaaacagagttattgctgaagaaggatatgggaaatttcactttcagagaaggttgggctttcccaaggagaatcttgttcaatggtgatgaatgtgttatgccttctccagatgactttccaaggctgccaaaatctgctcattcctcttcgtcttcctctgctgttattagctctgtttcagtcgttttctgttttctccttcatcatcttcttctactagtttgatgagattgtttctttcatttgaacctacattgttccatgcttctttgacttttccaagaaacaaagcctctaataaagcttgcatcaaaaaggattaatatacagtattaggatttaggaagcatgttctgtgatgtccattcacatttcttgaccatttgagatttaaaagaactaagaataaggtaagatatttatggtgtatttattaaccaatacacaaagccggttcgtcatattgaaagttgaaactagttatatatggcccaccatatcaagcggtgaagttctataagtggaaaggaaaattactcttacgaagtccttgtaaaccaagtaaatgaataaggcaatagtacatgtattctaagctctaataaaatggaagtaaagcaatatttctaaattttaattgttaaaaaaagttgaatgtcgcattaaaattatcactcttgtgaaaaaaaaagaataaaagttgaatgtcgcaatgttttttttttgtttttttcctaaacatataaataacaaaatggcatgtgtcatcacaatgtaaaatctcataagaaaaataaggaaaaagaatattcggagccaataagaattttatatttacgtgagagacaagtggcccaattgacgggcccatattgcaaaaacgcctctttttaaaacccgcctcttccttcacaccaaccttcacttttctctcagatctgctttgagattctccgattgcatctcaaaaaatctcagctatg

SEQ ID NO: 7211 - DNA, 3000 bp, Unknown
  misc_feature (1)..( 3000): cDNA_ID_1817074_gDNA_ID_1621133_Annot_ID_172530 3000 nt of promoter + ATG
atccaaatccaccattggtgtcgaattcgctactcgtactctccaagtacgcacacatctctctctatatatatagtatatagtgtaatcgaaatgttgctggatctaggtttagttctaagttaagcagcatccggtgcttttcgattcgatccgtatctgtgttcgtatgaatactcggaagcagtcattgtgtgtaggaacatttgggcttggttttgaattttgatgtttacatgtgtggtgcctgtttttttcatttggtcgagatttttgctttggtatctcttaatttaagcgttttattgataatgttcccaaatttgtcgatactctggtacgtggtagtgtaaggctccctcacatgtcagatctaaaaccttgtttaaggcagatctaagaatctcttcatctgaaattgatctcgaacatgattttcttttgaagtatgaatcatggttgttgtttcacagtttctagttttcttactgggttgtttgtggaatttagctgcgaagttactaattttgttgttgcagacacactaatcatagagtctgctgctcattagatctgaattaacctattaaaaaacctatgatctttgttctaaggtggaaggaaggactgtgaaagctcagatatgggacacggctgggcaagaacgatacagagccataactagcgcctattacagaggtgcacttggagctcttttggtctatgatgtcaccaagccaacaacgtttgagaatgtaagcaggtggttaaaagaactaagagaccatgcagattccaatatagtgatcatgttgattgggaacaagacagatctgaagcatctcagagcagttgccacagaggatgctcagagctatgcagagaaagaaggcttatctttcatcgagacatcggctctcgaggcattaaacgtagaaaaggcttttcagacgattctctcggaggtttataggatcatcagcaagaagtcgatatcttcagaccagacaactgcaaatgccaacatcaaggaaggccaaacaattgatgtggctgctacttctgaatcaaacgctaagaagccttgttgctcatcgtcttgaaaggctttgtttgtgttgcacttaaaaaaagccaaatatctatgagactttatttcaaggcttgcgttgtatttgttttctttcttttttctgttgttgataatataactcaaagataattttttatatcaattgtggagttcggaatcgttcacacaaaacaaattttggaaacgaaaaatatttttagggaattaattgtagttttgagtggtagttgtaatgtagtatcagaaaaataagcagagtataaaatgaaataaacaaataccaacgtagactatagtttgaatttttaatagagcagaaattcttcgatttcaaagataatttaaataaagtagacaaaatcacacaatatacatttttcaatcaagaagaaatggaaaagcaaagaaaggaagttaattaaaaaaaagggggaaaaaaaaaacggaagtcaacaagaatacaggcaaaaccaaaaatatatatttgacggaacaaaaaaaacaaaatatatattttatagtattagtttatgacattatctttttgctagtttatgagatttatgaagaaaaggaaatatacttttaaagttgataaattgaaaaaaattagaagaatgatttacttttattttagttattttctagcaagttttttgtcaaaatggtaaatttccaagtctttcgagtagttcccgcctcctataatatcaacaacttttaagcaacttgtaatcatcaacaaacaatttactttgtttctttgtcactgaaaacaaatacataaaaaagatggagatcccaatctggggatggtgtattatcgtcgcaggaataataatggtgacggttttatgcaatttgctcgataggtggtgctcgaaacctcttgagatagaagaagatggtaaagcgtcgtcttctgtaactttggagaagaaggatccagtgaaagaagatggtaagagcaagacgaacgagaaggcacaagctaagccaaataataatctcgtttgaagaaaattttcaatatatttgttttgcatcccttgtttttatcatatagttttcttatttttaacaaaggttagactcttgagaatctaaagagtttgaaagatgttatctatgtatggtttctttatcttatcataactaactaaacatgttgtgtggtgttgatgaaagattgaaaggattaatcaatcacattctctagaaccaaagtcgagaattcttttaactattagtctcttagatttgcttccattactaatctttcaagtttgaggtgtaactcaaatttctcaacattttttttcatgcaaatctaaatttctgcaaatacaatgaaattataccattaaacaatccaccatatataatatacgacataagcatcgcacaataaaaaaccagtaacatttgaaaaggggaggagaaagaaaacatgaatattatttaacaaaaaaaaaaaaacaaaaaaagaaaaagaaattgaacgtctactagttaaaaaaaaaaaaaaaaaaaaaactttgaagtccccaaatatctgggccttttagtggatgtggcccaaattctaaatgggtttgacttggatccggttttggcgagactagttcagtttaataatcagccgtcgaatccaaagactgaagaaggtagtcttaaagaaaaaccctagaaaccattacttatctctcccactggctctgtctctgtcaaatctcggatcgatttcgcggtgggctcgattcgtgattcctcaaagttcatcatccctaaggtaattctctccccaagctggtagactcaatctaccgatttttgtgttgcacttaagaagccgatatctaaattagaggtttgcgtttttttggggtaggcactgtcacttaatg

SEQ ID NO: 7212 - DNA, 3000 bp, Unknown
  misc_feature (1)..( 3000): cDNA_ID_1817037_gDNA_ID_1621133_Annot_ID_56499 3000 nt of promoter + ATG
gcccgacgacagagacggaatcggtggcaccattcaggacggatttctgagcgttggagacgcaagaagtgaccatcctgaggcatcgctggcgaattccggtaagggaaacagtggttgaaggaatcggagagaaaagaggggaagaaggtacgagagaagaagaagaagaagaagaagaaggagacgagtattgtagagtggcgttaaggggaattgagattggcatggttgctctccctcggtgacggaggagagagatggtcggcggatataattgcacaaagctaggccgttataaatatcccagtgtacacgtggatactcacaaatttcaaatttaattaaaaaataatagccggaattatttattacactcaaagatgttttttatttgctatttaatatttatacagacagaaagagaaatttgctttgtagtctcttctgatgcctctagcaggtttagagggattagtcctttgcttattgttgttacttcttgatttgcttcaagagagcagctacagatccacaatgtgttgactcgttattgcatctctcacaacatgcctgtaacatctctatcactctctggcacctgccacccccaacaaatccacacaaaagtcttattagcatctccagtaaaactattctacagtgtattatttgaatgataacattatgtagaaaactatcatatcgaaagtgatgttgtcgttgttgttcttcaacatctcttaactgagttaatcatgatgctatttctcaaacttttcatggaactgtctaaagtaaggcatagagacatgaatgattactaaagataattctatgcacaaaacatgataaaacctggagatcctgtagtcatgtagatcaaagagtcaagagccttatgaaaaatcgttaatcaaaagaagaaaaccagattcgttttcttatagtagctcataagtgaaaccaaggtaagtacatgcaaacaaagtgacaatgcattcaatttttttccctcaagagaagccaacttttaacacaatccaaagacgaatatacaatatatagtgaggatatctataaccagcctgattttgctcatccgacaatacgaaacgacatgattcaggttctactcatccatctctgtttctcaaactaggtaagttataacactagtacctaaacttggaaatttggtcaataatctccacaccaaacctcacagttactaagaaaaaggattcttaaagccttcaaggattcatcaaatcttatgctagcaagagaaataacttagctgaaaacataatgatcgagacatgaaccctaaacccccaaaactaagatcacaacccaaatcttcaattaaatggatatccaattcactagcctcataagtcataagaaacatgaaggaatcttcaaatgcaaaaagcacttcaccatcaaaatcgatttcacggacaatcgcgatgaataatcaatctgcgggatataatgaaaggaaaaaagaaagagaaggaatcaatcacctttgaggaagaaaattgtttttggaaagacaggcttggatgtcacaagcctctttcttgcagggttctttgcttggttgcgccatttctctctcgctctcgcttcttctctgtctctctctcggcgtcaaaaagttctccgatcaccgacttgacataactttgactattcatcggcagtttgggaaacaataaaaaaccacaaccaaaccgatcaaacttaatgaaccaaaatttaaaccattttgatcttataaatcgaaccaaaccggattagagttatttctctggttcgcgcgtcttgcaccacacttcaaatgaaggatgaaatatattcattcactaatcactacttttgaataattgatagatttttttggtaagatgaataattgatagattaatattgggttttgtttttccattttaagatataaattgaaagataataaattaataatcgttgtgcttttacattgtcaataaaaactgttattttctttataacggcatattattgttaattaaatttcgtctctatgttatttattaaacgaaatgcctaaggaaggcgtgaaaagagcttatttggtgttgacgctcatgaaaaacgcatctctttctgacacattcttctctaattaaattctaatctttatttatttccccttggtcaacatgtttaattgcatatgaatcatttgtgacctctattcgtaattttatataatggttgcttagttaaaaagttttcatcaatgccataagagatagagcaagctgctcgctctagaataactgataccatacaatattattatggtcgcataatcaaataattgctatatatattcactgatgtagtgatgtccaaatctttgttaacctcaaaaattaatctgataacctagtgaaaatcaaatgattttgtttgctaatgcccctggattgaattccataaaaatacagaaaattaaaaagttacaagaagataacgtacgtgaatcattcctcaaaaataatagctggcacctactaaactaccagaaaacttgaagaattagaagagtgtacaaataaggtaaaaatgattttattttacagctaatagccttgataataaaaaataaaagtaagtcaaaaatccaaaaatagaaagaaaaagagtgaagagtgttgttgttgttgtgtacacaaatgcaaaactcttcgttgcaaacactaaacagtcactgtgtgacttctttgctttaattgtctctctatctctctctcttaacacagagaaacccgaggcgtcacacttaaaactcttgagatttttatctctctctttcttattcccaaagccaaatcaaaattcacgttttagaaaaaaatattttcatcggaatctgaaattcgacgtgactagtttattttgatcttctcgtttaatttgttcatcgtctgtgagacaaaaatg

SEQ ID NO: 7213 - DNA, 3000 bp, Unknown
  misc_feature (1)..( 3000): cDNA_ID_1817034_gDNA_ID_1621133_Annot_ID_56500 3000 nt of promoter + ATG
ggaattttctcagaaactaagcaaactgttctttgctctttcataagttttggtttttgtcccacatcgacaagtagaagagaacgtctcccaagtctgataatatataaaggaagctgggtctcactttcaaatcatacctttctcggccttttggctaagatcaagtgtagtatctgttcttatcagtttaatatctgatatgtgggccatcggcccacacgatattaactctatttttaaagggagaaagcccactaagatagcttgctatctgggctttcgcgagtcgcccatgcgttgcactactgcacgggcttggctcatcccatcaacaaatagttaaaatcattcataattagtgaatatattaatctgaaaaaatatgattggagagcataccaaatgaaagctaaaccgaaatttgattaatcgagcatccatccaaacgacaccatatttcttaaaccctctagacattggcactgagcttgagacggtgtgagatatcataaatcagtgagtgagtgagtcatgtccgataatctgaagcatcctctcgattgtacagctagtgaggaatcactcgagagactctcaaaggttgcgagaatcgagggatttagtgacgaagaatcagaggaacagcagggattggccgacttggagtccatgaacccagtaaaccctagagtgcagcgttacttggttgccattgagtacatcggaactcgtttctccggttcacaacagcaagctaaggaccgcaccgtcgtcggtgtattgcaggttgttgcgtgtctgtaatttcttatactactgctctgttccttcaagatttgcctggcattgattgatttcacagctaattatgttccatagagcgagcttaggcctagtttatattggctgacaagtttcttaggaggattcatgtgtgaattgatacatttttgcaatacattgcaggaggcttttcataagtttataggccaaccagtaaagatcttttgctcaagtcgaacggtacgagcttcttacataagtttattggccagcgagttaagaattttaggttttgttcgagcagttattacctagaacctacatatatataaatgatcaatctcttattcgtgtctgaagaaacgtttcaactagttttggattgccctttgtcactatagattcataaggaccatgctttgcagtaaattgatatctatagaaagttagtattgatgaattagatatatttcaatgaaatgctcatttctttttatggtttatgttatctgacattgatatagcgtcttttaggatgccggagtgcatgcactgtcaaatgtttgtcatgttgatgtggaacgcatcagtaaaaggaagcctggtgaagtggtatttcttttgcgccaacagctttctttttatcttgtggcttacgaatggaattatttgagtcacgtccatgttaacataaattataaatacacattgttttgaatctcatatgtcccaattgtagtctggtttatacatgaatatggttagattctgcaacgtgtattcacaaacacatgctatcttatatgcttaatgctcttgcgaactattaaggacagatacatttgcattctcacttggacgctatttttttaactgtagttaccacctcatgagcctggtgtggtccagagagcggtgaaccattttttacaggttaatatctgaattcttttcgaattgtacctattagatacaatgggttttcttctcattccatggccactcccacaaaattatcctgtaactagtgatcttaaccaaatttacttagacctgttgacaatttcgtttaagtttctccaacctgtcttttccttagtgcttactttcatctactttgacctatctactattcgttatctcattaaaatccttatgttgttattaagcagagaaaagatggtgatgttatggtgattgatgttcggtgtgtcccaagtaattatcatgccagatataaggcccaggagcgcacgtaggtattctaatttagtttcagttgttctagagattttgatgatccatatgtgtgctgatagtattgtagagtactaggttatgatttgaaagtatattcccttcaattggaaattgagaatttattcactcattgtagatacttctaccgcttgctatccgggtcagatccattatcaatccttgaaaaagaccgttgctggcatgttcctgaggagttaaatcttcgctttatgcaggttcacttactaactactgtattgtcagcttaaatatcagcactgatccaaaaaatttattttcccttaaacgaagagtccttttcacagtgagaataagagatctctaacaacatcatcaatgattggtgtacaggaagcatgcagagttcttgttggatctcatgattttagctccttcagggcagctggttgccaggtcaagtttctttgtctgtttttgtttaaatatctctttatatcatactgatacacaatcaatatgaatttttttgaatggttggatatttttccattcccattcatagaatccttgatcaatgcatctcaattgtagattggtacttggtagaccttatatatttgtttgtgtttgtgaccatgtgaccaagtatgaatgtatgttagctctagcgggttgatgtctcctgcagaatataattttgtgtaatcctgctctattttttggcaaagcttgttcatttgtagtattctcagtcacaacatatcaaattaatcttgtaaattctcgttttgttttctgtagtcaatagatgtgcaagtcaatcttggttctttaagatgcatatgtatcctttcgtctcagtgatttgtagaaatgggaagataactgtctgtatctatgaagaagtttttccatgtgtagactgatgttcttccggaaacctgataaaccttttggtgacttgttgttatg

SEQ ID NO: 7214 - DNA, 3000 bp, Unknown
  misc_feature (1)..( 3000): cDNA_ID_1817027_gDNA_ID_1621133_Annot_ID_56502 3000 nt of promoter + ATG
gcggagagacctctgacctatagataagactatataaccatgcacatgagacgaatgtctaaactcacacagcgttttgttttgttcttggtattacggttaaaacaatagaaaacactcttgttactagaaacgtttgatacaattgtgaattgtgatatgctggtactgtatcatatatgctactataactggagttggtgaataaaattcgttttaataattaattagggacctaattatttaaaaagaaaatttggcatttagagaatagtggaggcttaggtgaacttacagcaaagcaaaattcaaaagtaggaatgattttaatgtagaaaatagaagagaattggggattttgccttttgtgactcattgtcacagatcattcatgacaaaaaaaaaaaaaaaaaggccatcatgtcatgtgactgctcttcttctattcactctttagctttttcttttgcatttgctgtctttatttgaaccatttcttcttttatttctttctctttttgtaagtcctaaaggaatttctccaaccagaccgactctgtgatggatacaacaaatttggctatatttatgaaggtgcagacatgaacataagactacataactgtataattgttgttgttttcattagcaaaacacaactcaataaaaatataaccggagagtaatggtaaaatacaagaaagaatgcatctcttcttccacgaaactaatgcaggaacttctgaatgcatgctatcatataataatagaatctcgtatgcgtcgaaccatatacatacttaattaaattatatgtatatatattaatatatatagggaattgttcctgcattagtgatatgtttagattttagttgtcaagtattttataaatgtagctttaagagttttttacattttttgcttttttcgcaaattcggatcaagatatctctgatacggattaaattgtcagaacccacacgcatcgggatttgaaactaatacacatattagaaatattaaatagcacttaattagactagagtccgtaaaaataaatttgtgtgagtaatgaactttttagtcaaagttctaaattttgctgtcttccttttttgactataacttttctagcgtcgcgaatccctaaactctcattaaaaagaaaaaaaaaatcgaaagctaatggaaaaaaagaatagacctagctactggctactgtcattcatgactgctgttgttcagtttttactctatgtatatgaacaatcgccaaatttgtagctttgcgtttgcgaggtcatggaattaaacctggcgtctatatatacatgcatgcacatggttaactggtttgtatcatatggcatcaaatgacttacgtactactatctcggccttttttggttggggtttgcttgaatacataatggataattatagtcttaatattgaccgggcctttgaggcccaaaccatgaacatctgaatccaacggtgaagatttcctcctgaaaggaaaagttataagataatcttagccgtcggaagcttctctttttctgtgagggttcggtttggtcgtcgtcgcaactcccccacttgtgaattccaaagtacacttaacacatacacaacctcttcaagcggtttcccctgtttggttttacggcggctctaaacccgttttctcaggtttgcttcttatcagcccgctttctgtttccaactaatcattgatctgtttagttcttggacaattctgagtcccatatgctccgaattgtttttttcttcttcttcagaattctctgttttgtcattaagattggaactgttagtttccattgtaaactgtgttatgttttggaaactttatggtgaagtaaaagggcatgttttgacagtatttgttcatgttgagttctgtccaagtagagatattagaactcagagtttttgtctttattggaattgctcgttgagtatctcccggcgtcatgttttcccttgtaacgttaactcatgggaatgaattatccgttttgcttcagaaatcctataattctgcagaaagttgttctgttagggtccttagttctgtaatctctatcactgggaacagtttatatcttttccatttgactaaagttactaaaattgtgcatatcctgcgatttagcgttgttctttctggggagagaccataattctgactgcccttttgttttgtattattgcatcagactctaacccaaagcgtagaactttagtagttatctcttttgtggtcttttaccgaggaagtgatgaatctaaatggctgtttattgctgactaccataaacagattagttgattctccatactaacctttttcttttgttccctttcaatggttgcagtgtatcttcaaaattgataatggccactgaaaagaatactctggattgtatccttaaatgctagcgcattttttgttctgtacttctttacttgattgagtttttattaagacaatgcttttgtgattgatttcaaattccttgttatatcaattagtgtttgccccttaatattaactctagctgaggctacttttgcgcaaacagtaccagctcttgattctacaacaaagaaacaggatgaggtatttacaatcttattagccacatactcaatctgctgctagcaaagaatgcttttacataaagtttggttatcttttcagtctcctccaaagagtaccccgtctcttactgtcactgcttgtgctaatggtaagacagattattaagggtttggttcttatcaaccacctaaaataagtctgctattttcttattattcttgatagatttttaaatttctatttgcataatctgttattatggctcagtagtgaatgatctatatataggtattttcttaagtgattgttgcttgtgatgcattttgcaggatctgatgtagtatcttctcagccaaatgacaatg

SEQ ID NO: 7215 - DNA, 3000 bp, Unknown
  misc_feature (1)..( 3000): cDNA_ID_1817019_gDNA_ID_1621133_Annot_ID_56504 3000 nt of promoter + ATG
gcttttaacgaattcattcttggagtatgacatgttctcgttctctgtaggtaaaaggagaacccaatgtttcttacatctgttctagatactatcgtgctccagaactcatttttggtgccagtgaatacacaactgcaattgatatatggtccactggttgtgtgatggccgaactgcttcttggacaggttaaagcatgatttttgcattagctatatgttgttctattcattcagtttattccttgtcttactattttgtgcccttgctaatttgtcgtacagcctctgtttcctggtgagagcggagttgatcagcttgttgaaatcattaaggtagccttttattaattctttaaatttatctaaaatcatcaagtcctgataaagtgataagttcttttagaacttttgtttacgtagcagacaggtgcagattgtcaactttatatctgaatgattattaggcttaggcatcacaatttgttacgtctattgttgagttcgtattcagtatagaagaaagcagtaacctttggattgctcagtctgatttcgaggaaaccttggttttcttatttcatttgctttgatatgtcatgcaggttttaggtacaccaacaagggaagaaatcaagtgcatgaatccaaactatacagaatttaagtttccgcagataaaacctcatccatggcacaaggtatgccttctaatgttattgattatcacctaccagaataatctttaatcagtggttttgttggtgaatgcattttttcaaagaggagttctggtatttgtgatggtttggagtatgaatcattcaagagtaaatatcaaaaataaaattaatgttgtcatttcctctgctttataaaactatctgtggtagagttgaaaacaattggctaaatgattgtggctttagttctagtttgagtatttctctctggtggaaatggttttcaggattttgttctctgacattctacaacttggtggtttgcactttgcattaagctgtatctaggattttttattttcccatagtaaaaaaaggtttaattgacttcagtgataattatctccttgagcttcgcttctctctgaatccttattactgcatgaatattctatttatgctcaggtgttccaaaaacgtttgccaccagaagcagttgatcttctttgtaggttcttccaatattcccccaatttgagatgtacagctgtaagttaattcgttccgttccctccatattagcatctaatgatctaaattcattaaaaacactcttctggtgttattgtagttggaagcttgtatccatccgttatttgatgagctaagggacccaaacactcgtcttcccaatggccgaccacttcctccacttttcaactttaaaccgcaaggtacagttcccttatttttcttgttgggcctattaagagatctaacatatgtagtatgctccgttaagttgttgacatgttgcgttgtgttcatgattggtaatacatataaacatcattcagtgttagtatatgctctttgaatattgaggatgctaaataaattgaacaagtatggtgccgttgtggcctctgaaatatatgattactaagcaaaatatataaacactttgttctccatagacatgaacctgtcatccttaactttcagtacttcaaaatcatgaactgaggttttatgtgttgttgcagagctatctggcatacctcctgaaatcgtgaacaggcttgtcccagagcatgcccgtaagcagaacctcttcatggctttgcattcgtaagacgcttatcggtttttgcatctgtataagcaagctctcttgatatcaatatttggagcagccagttttcagccatttggcttttgtttttggtgagttctttttctttattttttttctgtttggttggttatatgtcgatgaggatgcatgaatacaaacagtacttgaggtttgctggttacagaccacttgtttgtttcacggccaccatataaccttatctatcgcaaactgttttaaagcatgtaaattactaaccaaaattaattgcatcgtttagttttacaaatagaaaagaaaaatcaactaaaaattaatgactttgccgctcatgtgtttgcacattgtgtttctgtgaaaatcaaaccgattccttcgtgaaaatagccgtgtcttcctccagatcgtgaatttggtacttcatacttaccggtcaaaagctcagaagcaatatttcagtcatggcgaaccgtatagtatatatcaaggaaaacctcataacataaacaaaggttcagaacttcagacaaaacctgttttagatgacagagtcatggatcaatctcagcccaacaacattaaaacttttcagcccatcaaacccaccaagtttaaatttcttttctctcttgaatcttgatccagtagctgatccgacaacgttttgatgtttggtcgaaacagttgaagtctcttcctcttaaatgtgattatcaattaaaaaatattatttgacccaagatacatgggtattgggcctccaaaagtttaagctttttagtaacaaaattaggcctccaaaaaaatttgttattgcaaaactatatcctatattctaaaattttaatatttagtctccatttttaaatttatctattttttattttctaaaagttataggatttagtcttaatttttaacttttatcaacaaaactcattaaagaaaaaattattttgtattgggccttatcaggaccggcgtctacaaataataatagacaacaaaattacacatacaatgaagatgttttattggtcacgatttgatttggtatttattctttaactaccaaaaaaataagtaaactcaaaaacaagaagggaggaaccactttaaacccttgtctacgctggtccgagtccagagtcctctactttgacagtctccctccatg

SEQ ID NO: 7216 - DNA, 3000 bp, Unknown
  misc_feature (1)..( 3000): cDNA_ID_1817015_gDNA_ID_1621133_Annot_ID_56505 3000 nt of promoter + ATG
ttattatactcctaaaaaggacaaaaagagatgcaaaattagattagtgtgacaaactacgtcatgattggtcttcttgtagcatacgtactaaataaccacagaagatgaatctgcaccatcaaagattctaaagtttaagactttctccgatctaaatccaatcttaaagttcttgaatcacatcctaagtcgctgaactataaactccaatcaaatctgaaattttgatgaagaagaaagttaaatcaaataccgcagcttccttgatctttgacattagtaacagctcccttctttctccaatcaacagaatctggaacctttacgctaccaccgagactctgtcccttactagccattatcaccgacggagcggaaacagagagaccaagacgagaagccttgaactcgtggtgagtcagatccgcgaaagcattgagagagagagagtaagtagcgttagtgatgagattgtgttgcgtaacgaagtcgtgattatctttaaagatttgaatcctctgttgcctctcttcttctgaaccgtacgttttgccatgtttctggcaccagtcgtcgaatagctcagagatgtcatcggaagatgacgatgaagaaacgagaagaaggaagaagaaagtgagagagataaaggaggacgatgacattgacatttctgtaatttttgtttgttagaatcgtggagatagttttggcctagaaataaggaatagcctggagatttgttttttcccatttcttttgagatttagccaataagattacaaaacgctggttttgcgttggcgttttaaacaaaaagcgtttggcgttgaaaaattgccgaacaaaatgattgaggcagaagaagtgaaccacgtgtgtaaataggagggatgtagctagaattatccacaactttgccaccagaaaattttaaattgctaaatttaattatacatattgtgaaatatgcattacaaacataatgtaatgttaataagtacgttcattatcatgaaagccttttaacataaaaaaacgatcattatcaaaatttgaatgtttgtttaataaaaaaaatgcggacttgtcagtattatcctcatcattcacgggctcaggaccgggccggagaggccaatggcaatcaaaagcctaacacatttagcttccaatccaactacatacacacagtactatcgtaaatcattgttttgttgttgtttggtcaacactaaaatcattgttaaatgggtaatatatctacgatactttattaagcaaaagaaagcaactttagcctttttaggttataagaccaccactccctatttgtgtaggctgatgagcagtacactttggacctacttacgactttattgcatttagcccttttttgcttattctaattagtaaataagatcacgcggagaccagagagtagtagtaaccaaagcaatgtgcatgcctaacgtgtattttcgagagagctcaccaaagcaaaaataattaacttcacttttgtgaaaacgggaatgtatttgatcaatcttttcgtatttagaaggcttatattatgataaaaccaattgcagataaaaaaaatacatccttaagctttaatatcactaataaaacccgatacaaaatctccatcgccacacacacaaaaagaagtgtgatgtgttaagccttacctaactgtcgacaagtaaaggcgacttttactatataataaccagcaaatacgaaagtggctttatttttttgaaattattttttgccctacaacagtattttaattcactagaaaattccaagaatatattgttgttttatcgtatctcaaaaatcaaaaggcacatattagaatataaatcccatatagatgcattttggagtggaggctcgaatgtgttgacaaaaacatacatttgaagcgatttctagtaatcacaaaatgttgttttcttttgtaaattttccactatagttgaaataagttgtacaccaaaaagtttgaatatccggttacaaaaattaggtaggctgaggtttgaaaattgagttccagttgttatgatatttggggacatccattaaaaagtatagtatgaaattttaacaaggtctaattaattttttgaaggaaaaaatatataactaagcataaataaaaatcttatagaaacataaatataagaaaaagattaatatatgatgcttataatgatgagctgtcgtctcatattctcgtttgattcaaaacgatagaaatcgacaaagaaggtgtgaagaagttgggaaaacaaaattaacgcttgaagaatctaaaggtttagcttttttctcaatccgatcattcaccgagaaatattctattttatatatttatgtgaagctcttcaattgaagaaagaagaagaaaagacaatcgtcaaatgcttgactttggtttcagttcttcttcacgacagctcaaggtgatgatcatttttattttactcttctacctaatcatatcactgcgaatcttttccaaagtttcgctctttattctctcaatgtgctttttttctgagttgttgttgaactagggttcttctgggtactagtaactgttttgctgattttctgagctgcttttggctatagaatttcagttttcaaaccaaaccttgtcgatttcaaatcaattctagtcggcagtagatctgatctgtctctattgggctaggttttacagtgtatcaattcaccactagttcaaagttcatcagtgcttacacaagtttacttttttttgtatgtgttcatgatttagctaatgatcaagatacttgagatataataacacaccttatttaatgcaaatgggcctacaaattctactaggaagatcggctctttgatgggatgggacaccaagaaatcaccatgggtttatgatgctatcaattactagtagtacgtgttatcttctgaatatatatcatg

SEQ ID NO: 7217 - DNA, 3000 bp, Unknown
  misc_feature (1)..( 3000): cDNA_ID_1817011_gDNA_ID_1621133_Annot_ID_56506 3000 nt of promoter + ATG
ctccctgttcttgtagcgtttgtcttgtagaaccttcttgatggcaacaacctccccagtttccctacatttagcctaccaaaaggaaacataaatgtgcaggggaatggagccaaatcaatagaacgaacatcatgggtcttatgttaaattagctcacttggaaaaccatgccaaaggaaccagtaccaacaacatgttctgatatgtaactgactgtctgccaatccaaaaaaaatctatatgagaaacagttagataaactacattaccaactaacacatacaattatccataaccatccaacctgtcttgattgaccatttcgaccacggagtgtggttctaatcacatgaccaggctcagcaccagccccatcaataatatctggttcactatcctgcaacgtaacgaaaacctcagacactgtaaccaactccataacatatataagctcaggataaagaagtgaagctaaaaaacagttgaataaacatgaaaaaaagaagaagcaatgcaagacttactctctcatcatcggtctctactttgtcccttatcctcgtctcagccaaatctctggtcaaccaatcgacagaactagaagagctctttaaacctttggcagatctcgaagtgcctactccatttcccagtccagaggatgccatgatatatattcagaagataacacgtactactagtaattgatagcatcataaacccatggtgatttcttggtgtcccatcccatcaaagagccgatcttcctagtagaatttgtaggcccatttgcattaaataaggtgtgttattatatctcaagtatcttgatcattagctaaatcatgaacacatacaaaaaaaagtaaacttgtgtaagcactgatgaactttgaactagtggtgaattgatacactgtaaaacctagcccaatagagacagatcagatctactgccgactagaattgatttgaaatcgacaaggtttggtttgaaaactgaaattctatagccaaaagcagctcagaaaatcagcaaaacagttactagtacccagaagaaccctagttcaacaacaactcagaaaaaaagcacattgagagaataaagagcgaaactttggaaaagattcgcagtgatatgattaggtagaagagtaaaataaaaatgatcatcaccttgagctgtcgtgaagaagaactgaaaccaaagtcaagcatttgacgattgtcttttcttcttctttcttcaattgaagagcttcacataaatatataaaatagaatatttctcggtgaatgatcggattgagaaaaaagctaaacctttagattcttcaagcgttaattttgttttcccaacttcttcacaccttctttgtcgatttctatcgttttgaatcaaacgagaatatgagacgacagctcatcattataagcatcatatattaatctttttcttatatttatgtttctataagatttttatttatgcttagttatatattttttccttcaaaaaattaattagaccttgttaaaatttcatactatactttttaatggatgtccccaaatatcataacaactggaactcaattttcaaacctcagcctacctaatttttgtaaccggatattcaaactttttggtgtacaacttatttcaactatagtggaaaatttacaaaagaaaacaacattttgtgattactagaaatcgcttcaaatgtatgtttttgtcaacacattcgagcctccactccaaaatgcatctatatgggatttatattctaatatgtgccttttgatttttgagatacgataaaacaacaatatattcttggaattttctagtgaattaaaatactgttgtagggcaaaaaataatttcaaaaaaataaagccactttcgtatttgctggttattatatagtaaaagtcgcctttacttgtcgacagttaggtaaggcttaacacatcacacttctttttgtgtgtgtggcgatggagattttgtatcgggttttattagtgatattaaagcttaaggatgtattttttttatctgcaattggttttatcataatataagccttctaaatacgaaaagattgatcaaatacattcccgttttcacaaaagtgaagttaattatttttgctttggtgagctctctcgaaaatacacgttaggcatgcacattgctttggttactactactctctggtctccgcgtgatcttatttactaattagaataagcaaaaaagggctaaatgcaataaagtcgtaagtaggtccaaagtgtactgctcatcagcctacacaaatagggagtggtggtcttataacctaaaaaggctaaagttgctttcttttgcttaataaagtatcgtagatatattacccatttaacaatgattttagtgttgaccaaacaacaacaaaacaatgatttacgatagtactgtgtgtatgtagttggattggaagctaaatgtgttaggcttttgattgccattggcctctccggcccggtcctgagcccgtgaatgatgaggataatactgacaagtccgcattttttttattaaacaaacattcaaattttgataatgatcgtttttttatgttaaaaggctttcatgataatgaacgtacttattaacattacattatgtttgtaatgcatatttcacaatatgtataattaaatttagcaatttaaaattttctggtggcaaagttgtggataattctagctacatccctcctatttacacacgtggttcacttcttctgcctcaatcattttgttcggcaatttttcaacgccaaacgctttttgtttaaaacgccaacgcaaaaccagcgttttgtaatcttattggctaaatctcaaaagaaatgggaaaaaacaaatctccaggctattccttatttctaggccaaaactatctccacgattctaacaaacaaaaattacagaaatgtca

SEQ ID NO: 7218 - DNA, 3000 bp, Unknown
  misc_feature (1)..( 3000): cDNA_ID_1816999_gDNA_ID_1621133_Annot_ID_56511 3000 nt of promoter + ATG
ttgacttgtttctatttgatcatagtttttttcggcgattggttgctttctctttgttgcgtaatcgttcgatgatgacttgtgtaattcgatattctggactcgaggttataacaattttggaattgatcggtgattgcaattgagaatatgtgtcacattaaagatactcgtgagctgtatgattcagtttggttccacggtttgtgtcggtgattacaagtataactagggattcgatggatggattagtgatatacaatctttttttctaaaagagttcatttttatttggtcacctactaaaaggttgattcttttttgttactttgcttaaagtccttcatgataaatctattgattatgtatcagcttcctggtgtctgtacaagagttttattgtcttctgtttatcgtcatgctttctacgatttgtctgatggtttgcttagtttctaaactttctaaagatatatgtgtatgctttgtctagttattgttgtgttgagtctgctgaggctggaaatttttgaatgccctaattcttatttgggatcagtaaatctaatcccttgtgtatgttcagtggtagcatttacctggatggttgatcccatgagactgattatcttaatgttttcagtgacagagacattccatcactgaatatcgatctgcatcgtgtacattgtgctcggaatttagaaaaatgtaagatttgtggtgatatggtacccaaaaagcatgctgaggaacactacttgaacacacatgctccggtacactgatttctctgtttcttacttgttgttaaactgttttctgtttgattaatttccacaactgtcatctttgatgtgaagagcttctctttgttagctccatcaaaattatatactttgtctagtgtgacgtccaaataggttgatcaaagggatttacattgtttcatatgataggattctgctctcaaatattttgttaatgtccctccaacgggttttaagcttgtttcaattaacaaatattagatcacttatgcatttattagactttttaacttagtgtgtaacacaaacagctagttatcaacgcttgttcctgactgttcttgagttttatggttgacaagaactcccccaagcgcagcttgtgtttgcaaggttgtgactgtttcaattactaggtcgagaatagttattcagtataacaagtaggaatttgttttgtttctgttttagactcaggatttttgtatggcctagatgctgctagatgactgaaatgacctacattttcttacgaaattctttctgttctgtattgagaagatagcatgctcgatgtgcaaagagaccatagaacgtgagattttcgatagtcataaaggagaaatttgccccaagaggattgtaacatgcgagttctgtgagtttccattgcctgcggttgatcttgccgagcatcaggtattcactctgacttgcacacttccttttctctccaactaaaggattttctgatccgctcgattttccgaatattaggaagtatgtggcaacaggacagaactctgttatcaatgcaacagctatgttagattgagagaaagatataaccatgaaaccaaatgccctggcactgttgaatcatccaggtacattttcttatcttcattgttttattttgaaaactctctgattcagatcttaatccttttttatttggctaaactcatgtcatgacatggattgtacagaaggatcccgagagcagcagaaggagatggaaacgggagaagacgaagagatgggaacggtgtttcgaacaaaaggcttttcttcacgatagcaataacgggaatagctgtgataataggatccttgttcttccagaggaagcctgagtagaggaggcgtagcttatctgtaattctgtaaatttgcctcaaatccttcagacagattctaaggaagggtttatacattttaaagcttacccagacaagagaaaccccaaaagattgtttgagctgatcaccatgagacttgcttttatatttgatttcaataaaagagatttcagatttctttttggagttaaaaccaaactaaaatcaaattacattcggtttggttgataagaattaaaactgaatgcaaaggcaatgccttgagagttgacaaacgcagtcgtgcctaaaccaaggcacagaagcgctttaacaaacgctaacgcagtctctctctctctctctctctctctctctctctctctctctctctctgggcttcggtggtgatcacttgggtcgaatactgatgaagaaactggctgatcggctccttcatcgttttactaatcatgaaaccgctttaaacgccggccaccactgtgatttctcgtctacccttctcttctcatggtttcttcatcctcttgaatttctctcacttgagaatggtttttaggctgctcaacgaaattgtgacagcaaagtttgtatttttagcccggattagtaaataagcttaaatttgttgtttacttcattttttatgacactgtaaactgtttttctttccttgtttcatcaaattgggtttgtttctttgttgaaagatgatttcccttcactgggtctacgtataaatccagaaaggaagggactttaaacgatcacagagttacaattgattgaatatcggaaataaaccattttgcttgactatcggaaataaacgccttttcagtttgttttaagacctgttctacagatcctatatctatgaccatttcaaaactcttgttttacacaagcacttatgaaactttgagtatctcgtgctgctgcattctgcgtaaagaggagttctcatattaatctctttagtttttctacattcaaaagtgttgatttttttccttacactaatatcaggctcagaggggacagatcaaggtacaagtggtcttagtcataggaaggatcacaggatg

SEQ ID NO: 7219 - DNA, 3000 bp, Unknown
  misc_feature (1)..( 3000): cDNA_ID_3050039_gDNA_ID_1621133_Annot_ID_172564 3000 nt of promoter + ATG
tgaaaacatcgatcaaaaggccaattacaaactgcgagtcgccatagcatctgcaaccttagccgagttgcaggtaaagatgaaacttcatttttctacagaaaagaatgagataagactgtaaagttttgttggtactttctatttgcagattcgaatcaatgatgcggaagcaatccgccctctcttcacaaccggactcattgggagagacaactcaatagcgaggcacgggatccacggggtttacatgctgtatgcggtgaacataccgggtaaccggcttgtgcaaggtgataatactatattcctgaaacagccaagatgcaatggtccctttcaagggataatgtatgactacattcgtcttgaaggccctccttcttagcttagaatgatatgtgatatcattgtttatgtatagatatataataaaaccaaaagataatggtaacaactgaatcatattgatatgcaaactccccaaaccaaaattctgacaacattacaactgaacctaagacataataagtagaaaggagctactgaaatgttctcttaagcacaaatcaacacaagagacctgaatcgtgagtaaactacttaatgctacatcttccctgcaacttgctcagcagagcttttcttcatgagtcccttgttacaaagctcattaagcagctccaaagcttcctttgccataccttcataagctaagccttctatcagaatcgtgtatgatgtttcattcggtttacaccctctgttgatcataaaaaccaagaaatcgatggcacgatctgtttgccgactcttacagagtccaagcatgatagaattaaaggtgactgcatttggcctaatgcccatccgctcaaactcatggaaaaacttaatggcttcgtctacttttccttccctgcttaaacctccaacaagagaggaataggtgatagtgtcaggctttaaatctttcgcacgcatctcatctagcagttttatcgctttgccagttttaccagcttttgcaagcccatcaatgacagtattataagtgattagaacaggagaacatcccttgctactaagttgattaagtatctcaaccgcatcttcaactttcccatctttgcacaaagctgttagcatagtgttgtaggtgacaatgtctggataacaaccacgagaaaccattctctccaaatactcgatagccctatccatctttttctccttgcaaaacccgtgaagcagcgggttgtaactcaaagaattcggctgacatccatgttgaggcatcttctccaatatgtcaatcgctcggccaagcaaaccttttctacacaagaaattaatcaagatattgaaagtgacaacgcttggcgaaaagcctttacgaagcatatcagcaagaagcttctctgcatccatccatctcccagtactacacatactccgcagaattatgttatgtgtaataacatttggttgacatccagaagacggcatgtcattcaaaaacttaatggcctcatccaatctcccctctttacaaataccattcacaagaacgttgtaagtcacaacatcaggagtacatcctctatccctcatttcatcgagaagcttcatcgcatgtcccacaccactatctctgcaagtagcttcaatcaatatagtgtaagtaatcacatctggataacagtctctctgaagcatcctatcaagaacctccatggcttgcttaagtttcccactatcgcaaagagaacgcaagatggtattataagtgacaacatccggcgaaacactcattctatcaagaacagataacgcgttattgatctccccagctttgcaatacccactaatcataacattgtaagttataacatcaggaacagcaccagagccttcaagaatctccaagatctttgcagctttcctcgtcttacccaacctacagaatccgcgaatcaatgtcgtgcacggaatgatatcaggaacattaccgtgataaaccatgttctctagaaacttaaacccttcctccaattcaccggttctaaccatctgacgcaaatggttattactctcgacatcttccaacgcaaaagacgaattcacagagctataatgaccatttccgttactattgctatacccagaggacaaagtttcgaacttttgagctctaccattaagacctgaactctcaaccttagaagccgcagaaaccagaacaagtcgattcctttttcgtgacccaagagggattttagaactaatactaccagaagtacgacatgagacgtcaagcttattacctcgtttatattcgcgatgaaattgttgaatcaagcaaaacccttcttgagcactgcttgtggacaccatcaaatccatagaggtatatcaatgaatcttcccccacaaaactaaaagccaaagttcgaaagtagacaaattaaactaaagttttaagacatctaataagaaattttcgagtgagagaaggaagaagaagaagaagaagaacagaggaggcgggtttaagccagtgagcgaaaggatatggcactgttttgtcttttttggagctttgtgaactttgggccttaaatttggttttgggctttcactcaaataattatatttgttgtagtaaaatttccactttcttttcagcccaaatacagtatatataaaacgaacaacctaaaaagtttgttcgagtgatttctttttttttggaacaatgtccaaagttttttttgttgttgacgtaagtgaaagctttgaaagacacaaatgtcgtcgtaacactaacaaccgaactgttttaacgacaaagtcaagatatactccactatatcctattctttatctctcgtccaaggcaacataagttctccaaatcggatctttatatatagaaaaacatgtaacatttactttgagcttaagaccaaaacccacaagacattttttcccaaaatg

SEQ ID NO: 7220 - DNA, 3000 bp, Unknown; identical to SEQ ID NO: 7216
  misc_feature (1)..( 3000): cDNA_ID_2990081_gDNA_ID_1621133_Annot_ID_172559 3000 nt of promoter + ATG

SEQ ID NO: 7221 - DNA, 3000 bp, Unknown; identical to SEQ ID NO: 7215
  misc_feature (1)..( 3000): cDNA_ID_1817019_gDNA_ID_1621133_Annot_ID_172558 3000 nt of promoter + ATG

SEQ ID NO: 7222 - DNA, 3000 bp, Unknown
  misc_feature (1)..( 3000): cDNA_ID_3050051_gDNA_ID_1621133_Annot_ID_172554 3000 nt of promoter + ATG
ggtgttgaattttgtggacaaaattgtctttcattgctaggttatgaccaatgacactgctcataactatacatgtatagctctgccgtaatataacaacatcaataacatttttatcatgtatatcgaacatgattttttgtgaatagtgatcaaaattatattttatatgttcacatgttcttattacgaacttagctagatttcatcaaataaacgttaggagtttcacgagagtttaatcatatgaatccctttcaccaataattgtggattaataattgagaatagctctaacaataaacgccatttgatatcatcgtgtatgtaagaaaactaaatagagttttagtaaaaaatagtggaaccttataagttaggtgaaaatctaaatctctaacaactgctttttcagcaattcgaaaattatgccaaaaagtttaacacatgcatctagttggcaatgatgtcccaaatctatcgcaatcgagtgaatttctcaaaacaaaataattatacgcaaaacaattattcaaaggaaagaaaatagcttagctagctgcggcaaaagcggagagacctctgacctatagataagactatataaccatgcacatgagacgaatgtctaaactcacacagcgttttgttttgttcttggtattacggttaaaacaatagaaaacactcttgttactagaaacgtttgatacaattgtgaattgtgatatgctggtactgtatcatatatgctactataactggagttggtgaataaaattcgttttaataattaattagggacctaattatttaaaaagaaaatttggcatttagagaatagtggaggcttaggtgaacttacagcaaagcaaaattcaaaagtaggaatgattttaatgtagaaaatagaagagaattggggattttgccttttgtgactcattgtcacagatcattcatgacaaaaaaaaaaaaaaaaaggccatcatgtcatgtgactgctcttcttctattcactctttagctttttcttttgcatttgctgtctttatttgaaccatttcttcttttatttctttctctttttgtaagtcctaaaggaatttctccaaccagaccgactctgtgatggatacaacaaatttggctatatttatgaaggtgcagacatgaacataagactacataactgtataattgttgttgttttcattagcaaaacacaactcaataaaaatataaccggagagtaatggtaaaatacaagaaagaatgcatctcttcttccacgaaactaatgcaggaacttctgaatgcatgctatcatataataatagaatctcgtatgcgtcgaaccatatacatacttaattaaattatatgtatatatattaatatatatagggaattgttcctgcattagtgatatgtttagattttagttgtcaagtattttataaatgtagctttaagagttttttacattttttgcttttttcgcaaattcggatcaagatatctctgatacggattaaattgtcagaacccacacgcatcgggatttgaaactaatacacatattagaaatattaaatagcacttaattagactagagtccgtaaaaataaatttgtgtgagtaatgaactttttagtcaaagttctaaattttgctgtcttccttttttgactataacttttctagcgtcgcgaatccctaaactctcattaaaaagaaaaaaaaaatcgaaagctaatggaaaaaaagaatagacctagctactggctactgtcattcatgactgctgttgttcagtttttactctatgtatatgaacaatcgccaaatttgtagctttgcgtttgcgaggtcatggaattaaacctggcgtctatatatacatgcatgcacatggttaactggtttgtatcatatggcatcaaatgacttacgtactactatctcggccttttttggttggggtttgcttgaatacataatggataattatagtcttaatattgaccgggcctttgaggcccaaaccatgaacatctgaatccaacggtgaagatttcctcctgaaaggaaaagttataagataatcttagccgtcggaagcttctctttttctgtgagggttcggtttggtcgtcgtcgcaactcccccacttgtgaattccaaagtacacttaacacatacacaacctcttcaagcggtttcccctgtttggttttacggcggctctaaacccgttttctcaggtttgcttcttatcagcccgctttctgtttccaactaatcattgatctgtttagttcttggacaattctgagtcccatatgctccgaattgtttttttcttcttcttcagaattctctgttttgtcattaagattggaactgttagtttccattgtaaactgtgttatgttttggaaactttatggtgaagtaaaagggcatgttttgacagtatttgttcatgttgagttctgtccaagtagagatattagaactcagagtttttgtctttattggaattgctcgttgagtatctcccggcgtcatgttttcccttgtaacgttaactcatgggaatgaattatccgttttgcttcagaaatcctataattctgcagaaagttgttctgttagggtccttagttctgtaatctctatcactgggaacagtttatatcttttccatttgactaaagttactaaaattgtgcatatcctgcgatttagcgttgttctttctggggagagaccataattctgactgcccttttgttttgtattattgcatcagactctaacccaaagcgtagaactttagtagttatctcttttgtggtcttttaccgaggaagtgatgaatctaaatggctgtttattgctgactaccataaacagattagttgattctccatactaacctttttcttttgttccctttcaatggttgcagtgtatcttcaaaattgataatg

SEQ ID NO: 7223 - DNA, 3000 bp, Unknown
  misc_feature (1)..( 3000): cDNA_ID_3050054_gDNA_ID_1621133_Annot_ID_172553 3000 nt of promoter + ATG
ctggattgtatccttaaatgctagcgcattttttgttctgtacttctttacttgattgagtttttattaagacaatgcttttgtgattgatttcaaattccttgttatatcaattagtgtttgccccttaatattaactctagctgaggctacttttgcgcaaacagtaccagctcttgattctacaacaaagaaacaggatgaggtatttacaatcttattagccacatactcaatctgctgctagcaaagaatgcttttacataaagtttggttatcttttcagtctcctccaaagagtaccccgtctcttactgtcactgcttgtgctaatggtaagacagattattaagggtttggttcttatcaaccacctaaaataagtctgctattttcttattattcttgatagatttttaaatttctatttgcataatctgttattatggctcagtagtgaatgatctatatataggtattttcttaagtgattgttgcttgtgatgcattttgcaggatctgatgtagtatcttctcagccaaatgacaatggccaagcacatactacagattttcgaaaggtttgattttgtccatttgcttttatagatctgatgtaatttctttgttttgacatgctatcatgtttggcgctgggtcattttcatagggaaatcaccgtgacaaaaacagctcagatgtctatgctgattcgactttgcgtggagatcgaccaaaaggaagcaattgtttgtctcaaacttctttttcggctcctaagcctcttggaaatttcaatggtgctggtagacttcctcccaatacacaagcacatgcattcagaccaccatttaaggtaccttacacatatctatttataaatagttgaagtcaagatttttgcatgacaatatcttacttaaggtttcctcttaatgtaaaaggtttgattaaaattgattctatttgcctttttaaagggaaaggaagccgcaggacagttcttaacattctccaatcagaagacaagctgtgtcccatattctggttacattaatggaaactcaaataatggtttctgggatcaaagggatcataataagaaacctgagagaaatggagagtctgactacttggttgaattgaaatgtggtccgagagccaatgcaaagactcgtcctccttccgagtcgtcaccactgaagcaaaacaattcgtttgccttggctcttcgtagagagatgtataacctccctgactttcagactgactatgaagatgccaagtttttcgtaatcaagtcgtacagcgaagatgatgttcacaagagtatcaaatattctgtgtggtcaagcactatcaacggaaacaagaaactcgatgcagctttccgtgatgctgaaacaaaaacactcgaggatggcaagaaacgtccaatatttctcttcttctcggtgagtgaacttgagatgtgtcttcttttcttgtatggctaagggtgttttgttagtctcatgtttgatgtcttacccgtcctttatacaggtgaatgcgagtagacaatttgtgggattagctgagatggttggatatgtggacttcaacaaggatttggatttctggcaggttgataagtggagtggctttttccctgttgaatggcatgtggttaaagatattcctaactgggaactacgccatatcatcctcgacaacaatgaggacaagccagttactcatacgagagatactcacgagatcaaactcaaagaaggtctccaaatgctttcgatattcaagaagtactctgcggtaacatttttgttagacgacatggacttctacgaagagcgagagaagtctcttcgagcgaagaaggagcataaaccagccactcttcgcatggatctcttcaaagagaaagactatgacgtaagatgctcacgaccttgactaacttgagttcatcttctctatatatactacaactttgtgtttttatctaaaccccgagttttgtgtttattgaatcagtatgagatggaaggcaacaggagaatgaatcaccaagaaagaggatataattggaacagaagtagcaatagcaaaacacaagcatctcttgtcaatcaaaccaagtatctttccataagaggctactctggttacaagaagaacactggcaattcaacatgagatgacattcgtcaatctttaattcctcgtcttctttattttattcattcatgaattgctttagtcagttcaggaatcattagggtttttttttcttccgttgttagggtttggtttctattttttctatttcatattcagatgtctttaggcccacggattcattttcacgatctcaatgataaatcacttttcagatacagcgaggaaattagggtaaagtaaacaaatcatgatcattagaagaagatgcacacaaatgtgttcggaattttctcagaaactaagcaaactgttctttgctctttcataagttttggtttttgtcccacatcgacaagtagaagagaacgtctcccaagtctgataatatataaaggaagctgggtctcactttcaaatcatacctttctcggccttttggctaagatcaagtgtagtatctgttcttatcagtttaatatctgatatgtgggccatcggcccacacgatattaactctatttttaaagggagaaagcccactaagatagcttgctatctgggctttcgcgagtcgcccatgcgttgcactactgcacgggcttggctcatcccatcaacaaatagttaaaatcattcataattagtgaatatattaatctgaaaaaatatgattggagagcataccaaatgaaagctaaaccgaaatttgattaatcgagcatccatccaaacgacaccatatttcttaaaccctctagacattggcactgagcttgagacggtgtgagatatcataaatcagtgagtgagtgagtcatg

SEQ ID NO: 7224 - DNA, 3000 bp, Unknown; identical to SEQ ID NO: 7210
  misc_feature (1)..( 3000): cDNA_ID_1664727_gDNA_ID_1621133_Annot_ID_172550 3000 nt of promoter + ATG

SEQ ID NO: 7225 - DNA, 3000 bp, Unknown; identical to SEQ ID NO: 7209
  misc_feature (1)..( 3000): cDNA_ID_1817045_gDNA_ID_1621133_Annot_ID_172549 3000 nt of promoter + ATG

SEQ ID NO: 7226 - DNA, 3000 bp, Unknown; identical to SEQ ID NO: 7208
  misc_feature (1)..( 3000): cDNA_ID_1807189_gDNA_ID_1621133_Annot_ID_172548 3000 nt of promoter + ATG

SEQ ID NO: 7227 - DNA, 3000 bp, Unknown
  misc_feature (1)..( 3000): cDNA_ID_2123944_gDNA_ID_1621133_Annot_ID_172575 3000 nt of promoter + ATG
tcattgaccaaacaaagattcgtcgattgatagttacggtatggttaaaattatcaataaagatcaatctcttaatatatagtttcacatcatgcaatcaaattttctttcaccgtggactcgtgagagagaaaaaaaaagaagaagctgtggttacttatttgtacagtctaaatttttttttcatatattaaatgatccatgcgtacgttaaaatttgtcccaaaaaaaaaatgtcataatcttttttatttattaatataaataattttttatcgcgccttatcgtcggtaaatatatacgttttatttgatttttgttttaagccctaagattttcaggataatataaaccaagatgattagagccaaatgagaaaactgctctggcttaatttttttctttaaaatcactgaactaggttttggttgtgtaattcattgaaattttttcatatctgtccgaattgttatcatggttgtggatctttctttttagtatatagcctaagagtaatctattatagtaattctagttttacgcttaattagaccatctatatatattatttctagttacgtcacctaatcataaaagactctacaacagcaagctagggaaacacagtagcaaagaaagttttttcttactgattttcaaaggtttgaaacacatgtgtttgtttggactcactagtgtcttctggcgtggaatcaattatttatgtctccacctaatcagaatatgacaaatgaatactcgcaacataaacataaaaataacgctctaatgataattctttttttttattgttttatgtcggaaaaagaagagtccaccgagaaaaagagccctcaaacaaatttgaacatggcaattatggagcggcagaatttaattattagtcctatagtcgatatattattgcattacctaatgtgtacacacacaatataaggttggttaatttggtaatcaaactaaagatttagaatgaaaatttccttttaaaaaaatagccatttgttttgttttaagataagagctaagacatataactacttcctaattaactttggaaaaaagtatattgtcgcaagttgcaactcttgtgccataaaaagcaagtgttcaacacatgtttatagtgatgcctcatcaacagctcaattaaattgaaacgtaagtataatacacaatcatctacatatttttgcagacattttagcaaataaatcgtagagttgaacttatttacaactcaatgtcattagcattaaatcttttttccaaaataattcattttactttaaattcttaatttaaattgtcaatcacattatcaatcaaatttaatccaaacaaacttcccatcaatcctttaaaattagcataaacgtatttgttaacaatatttaaaacaaagtttttgtttaaataaatattattcttactaaacgttttttgtttaaataaataaatcctgtatttgaacttatttacaatttcatgctactggcattaattatttaggaatgaaaatatttaattaaagatttaaatcttctaaatccttgcttttagatttattatgtcattacctaaaaggcaaaaactattagttttttaaatattattatttatattttaaatttttttaacattactaatatttaaacttataaaaagtttaatatatcaaaaaatcttaacatcattatataatatatagagtttttaaaaatctcaaatttttttccgtcatattttgtgattcaaaatttaaaaaatgaacatatattaaccaattggcgaaaaatatgtgagttcaacgtcccattttgactaaaatatttagagaatgattcataaacatatcataaataagatcaacattaacaaaataaatggtttttttttttgcgggacgagtttggcaggacgttacttaataacaattgtaaactataaaataaaaatattttatagatagatataatatataaatttttatatatattaacttaaaaaaataaattgtcctgcggtatactgcagattaaaatgtatattaatacttacgacggacgtgtacaaaatattatatagccccaaaaatagcgctgcatataaaaaccacatctacctaagcctaccatgtagtgtagttgcatataagacaactataaattaataatgtagtttaatattttttttggattggtttctttgtttttggttaagtttttttttcttgggggtataatgattttagttaagttttgtttaagtttcctcaatgacaaaggtacaatttcggcgttacgtctagtctaaaataatctattaacaaaagaatgtacttaattagtcaatactctactcaatagtaggatatcgtttcagttttgtatgtggatttttttttaaatttttgaaaaattctattcaatttcaataaaaaatttctgaggatagtcaatgaaaaccaaaaaagccataataataataattataaagtaatatatcaaaacgctcatataatattccacatacatttactgtataatcagaaaactaaatagtatagttatcaagggtccctcttaataaaaccaatattattcaactaagatatactttatttatttggagataatttaattttcgtaagcaccatataaaaaaacaatgacgcaaattattattttgtttatgtgataaataaagaaatataaaacgagagaaaacaaaaagagtgagtgatagtgattacaaaggtaagccaaaatttgaatatttaatggataccaccagataagaagaactttgcttcaaagcggcaaagcttaagcttttttctcgcgcccgcctctctctctctctctctctctctctctctctctctctctctctcttctcctctaaccaaatttcccgatgtgaaaaaacaagtttccgatcaactcaaaccaccgtcaccacttcttctctccgac

SEQ ID NO: 7228 - DNA, 3000 bp, Unknown
  misc_feature (1)..( 3000): cDNA_ID_1816988_gDNA_ID_1621133_Annot_ID_172571 3000 nt of promoter + ATG
aattttcttagtaaagaagaaaagatggctcgcggcataactggagcatttatgaactgttggtttatttggtttctattttgtaaggacatgttcctttcctgacatatgtcatcttctttacatgacgtgtgccttcttattttaccaacatgtgtcggtttcctcttcagatgttattttaggtcattccataatatcgagatgcgaccctgacagatatataattccaactggaactagtagtgatagatacaatttcagatataaacattttaattataaaacagactaaatattttaaagatttttaatgaacacttgttttaaaaaaaaaaaaaaattctctaggttatagtctttctttttgtcgattctataggttataatcaataattaccaaggataatttatattttattttcatccatattaaaattttatactattgtttaacccaacttgattctaaaaccagagttgaataacaacagcaaatgatgataagacgctgctctgattacacttcactccgacaagacaaaagtcacaaaaatccatttcgcccgccgacacatcgtcgatagaccgacatatcgtaaattaattcctaaaagatttttcttggtcaagcccaatgtagtagtatataaacattcttgcacaacgtacactcacagtccatacttacttagtgagtactccaaacataagaaacatgccaaacactagcagctctcaaagcttcactatcttcgttgatggttggttaatccgtcacaggtatttcgttgaacagcttatgtgtgcttcttccttggatgaaactaatcgtatctctctcgaagaacaacaatctctcgtggcccagtttctatctcactgtcttcaatactaccaagagaaattcgcctccgtttccctcgccggggacaacgttttcactttcttctgcccaccgtggtttaactcctacgctaaacttattttatgggtcggcgatttcaagccttctcttgtgtttaaactcaccgaggtctccgtggccgacctcacgcgccaccagaaagaccggatctcgagtcttaagtcggagactaggaggaaagagagagaagttatgcgagatttcgccctcgtgcaacaaagcgtggcggatccgccggtgatgctcgcggcgaggcgcgtgggagcggtgggaatggtggacggagaagaaacggatttggaggaggcgatggaggtgcttaaagctgggatggcggcagcgatgaacaacgctgatcagctacggtgttcgacggtggggaaagtggtggagattcttactccgccgcaagcgattaaagtgttgaggacaatcggacagcttcacctccgtctgagagacagagaccaagaaagagcttaaaaaaaaagatacttaatttgctttgctctgcttcttcaacaacgatggagtcatcactaatttttgtttttcgggctcaaccacttgatcctgagatttagatttccttttggtgatttatgatttttaaaagatttgagaattgggcttttttgtttgtagtgatatgatgtcatgttttttatttttggcttctcgtttcttccttaaatcagttcttactaaatctcatcagttacttttacaatcagaccaaaaaatgtcaaaagtacacagtacttgctttcaaaatcctacgtagcttatgatgtggtcgccatgtcatttatagtactttactaacttgctgacatgtaattgttgaaaaaatattacttttattccatttatcaacacaaaactgggcttaaagcattgggccaacaacagtgaacaacgggatacaaaaagagttcgtagttctgcaaatcgaatacaggaggtccaatatttcaaaagatgcatatttttcttggctaaattggtcaatgttattgttaggcatggcgttgactttagaggcttcctagagattgccagatgagggagtaaaagtcagctttgatgggctttttcatacgtgataagcctaagaatataaacaaacaatgctctaactgaagaatggattgaactatttttaatccaagtctagtttacatacacaaaggtattgtatgttgacatgttgtaatagattcgaattttccacaagtctatctacattgtggtttgagtcattattcatttattccttccaatttagtgaaacttaaatgattatctgaaaacaataaatgattatatatactaaaaaaaaaaaacatatcgctgctactaattttaaacaattacagaaagaaggaagaaaaagaacaattatgcaaacaaatgtcaactggttatatcatgtcgttgtttaaatattataactatattattctcaaaccaaggtattgaacaaacgttatgtcaatgcaatcaaattactcaaacgttaagcataataaacaaaacttgttttttcttttcttttcttttcttcttcttcacgtcatgaattgtgtcctaaatagaagttaagcctctcagatttttttcccggatgataatgtgtagtatttacacgtatagatttttcaattttattgtctcatacaaagattaagattataaaaaacttggcgttgaggaataaaaaataaaaacgtgttcaccacccgccgatttagataccgttttcacatacataattagaatttttccgtccaaattgtttttggtcaaagcctcaatggtcttgaattgacctgttcttaaaacccgacccggatccacctgcttctttcaactaacacacgctcctgatccaaaccattttttcatttttcaaatcattatcaactctctcgcttcttcaacgatcgcataaattccctctttgtctgctcgattcctgatctctagggtttgggttccggagacgaagggggtgtttcgtgtgtaattgagatattgagattattgctttgtaaaactcaaaatctatg

SEQ ID NO: 7229 - DNA, 3000 bp, Unknown
  misc_feature (1)..( 3000): cDNA_ID_3050027_gDNA_ID_1621133_Annot_ID_172570 3000 nt of promoter + ATG
gagtcaaagaagtgactgagtggatgtctaaggtgtttctctttcccatgcttaatctcagtcactagaatgatcttcttcttatgtctgagtaacttctttactggttgatgttttgggcatttctcattctcttgcaaatgttcttatcactaatggtaaatgctgacatatgttatttattttgtcagacaagtggaatcccggtttcagaaatctgtcagcatcgttttctattgtacaacaaggatgtcacgcaacatatatttgaagtctcagctggtctagactctcttgtcctaggtgaaggtcagatacttgcacaggttaaacaagttgttaaagtaggtcaaggagtcaatggttttgggaggaatatcagtgggctatttaaacacgcaatcacagttggaaagcgtgtcagaacagagacaaatatcgctgctggggctgtttccgttagctcggctgcagttgaacttgctctcatgaagcttcccgaatcttctcatgcatcatctgctaggatgttggtagttggtgctggaaagatggggaagcttgtaatcaagcacttggttgctaaaggttgcaccaaaatggtggttgtgaatcgaagcgaagagaaagttgcagctgtccgcaatgagatgccgcctggcgttgagattatttataaaccccttgatgagatgctgtcttgtgctgcagaagctgatgtagtctttactagcacagcatctgagacaccattattcttgaaggagcaagtagagactctccctcctgttagagatgcgaggctctttgttgatatctctgttcctagaaatgtcgggtcctgcgtcgctgaaatagacggtacacgggttttcaacgtggatgacctcaaggaagtcgttgctgcgaataaagaagacagggtgaggaaagcaatggacgctcaggctataattacagatgaatcaaaacactttgaagcgtggagggactcgttggagacggttccaacaatcaagaaattaaggggatatacagagagaattatagctgcagagattgagaaatccttgcccaaaatgggcattgacatgaacaagaagatgaggaaaacagtagatgatctaatccgaggtatagtgaacaagctcctgcacggtccaatgcagcatttgagatgcgatgggaacgatagcagaacgctgagtgagacactagataacatgcaggctctgaacaggatgtatggacttgatgcagagatactcgaggagaagattagagcaaaggtggaaaaaaagtagagagaagagagcctttgtttcatccattttttaggttcgtagaggttaaaaaccggcacctttgtaatatacacacttgagtagagggtgaagacagcctctggggaagatgatcttctggttcatgcccttgatgggaagcataccataattgttttattgcgttcttttgttaaagttaaaagtttaaaactttgtacacataatatatatacatttttttttccctaattaacatttgcgttcgaaacagtgataaccattattggagaagcaaacaaaaaggctttgaagatttttttatttttaaaataaaataaaatatacaactatcttgatgtgatgtttggttgagaaataaagccttgacgtaaaatttcggtttccttcatatttttgcattgattactctatgtaagtaaattgataatccgtctttcacaatcaaaccattccatcataaaaaaaattacaacaacattgcaacgtttttgtttatgcaaattttcttgggatttttggtaactaaaatttgggagtttttgcatgaattcttagggtgaatcgatttttttttttgtaagcaaacgaacctaaacttgatcaacaaacagtacaaaaattctagaatattggtgttaattactcaattgctaatcataaaggtttctagatagatggtgttaattactcaattgctaatcataaaggtttctagatagatgtgtgagagaaatttctaactaaaatatttcgacatgtttttgacgacaactatcttcagttatatcaaagacggaaatgtaaagtttcaaagctaaacgagtaaagactaacgactaacgagtattaatttttccagttcaaggcaatatataatatattaacaaatttcttgtagtgcacgatgtcttttgtctctttcggtttttcattttctacatgcttcgatccgtatttggctctaagatccaatgttgaaaaattggatgaaaaataaaataaaatcaatttcttggtgatataaacaaaatagaatatatgataatatatttatattactatgcctcaacttgttacgagatactgaatttcatgatcatatggtttctttagatccatataccttttgtatatatggaacaaaccattcatatcgaccgtgattaaagagaaaaaaactctttaactatcgttttgttcttgttgttgtattaattcaaatgagtcttggggaattaattcctctgaatgataattagaatctaaaaccaaaaatataatacttggaaacaatcatttgaaattggtcgttgttatacattagtaagaccaagctaagaatgagtctgcagatcaaaaagtttgacttgtatttgcatgaaagtttacgtacaattcgacttcacctgtgtggtcttgattatttcccagtatataaaggagacaaagagagcccatcattttgcctatcaatatcatcactttacgataaccttgagatcaaagaagaccccttgagatattattttcctgctaaaagctctttttaataggtttgatattgcaattctaatctttctagctagtgtaattactgttctcgataatatgttgtctgcctatatcatatttacaatgaaattattagttgtttcttaaagaaaatattaataatataatgtgtagagaaatg

SEQ ID NO: 7230 - DNA, 3000 bp, Unknown; identical to SEQ ID NO: 7218
  misc_feature (1)..( 3000): cDNA_ID_3050035_gDNA_ID_1621133_Annot_ID_172566 3000 nt of promoter + ATG

SEQ ID NO: 7231 - DNA, 3000 bp, Unknown; identical to SEQ ID NO: 7207
  misc_feature (1)..( 3000): cDNA_ID_1010209_gDNA_ID_1621133_Annot_ID_172547 3000 nt of promoter + ATG

SEQ ID NO: 7232 - DNA, 3000 bp, Unknown; identical to SEQ ID NO: 7206
  misc_feature (1)..( 3000): cDNA_ID_2123863_gDNA_ID_1621133_Annot_ID_172546 3000 nt of promoter + ATG

SEQ ID NO: 7233 - DNA, 3000 bp, Unknown
  misc_feature (1)..( 3000): cDNA_ID_3050062_gDNA_ID_1621133_Annot_ID_172545 3000 nt of promoter + ATG
cacctaattagcttgctgataatttttgttttgttttgaataaatgttgttatttcgattgaggggggatagtaaaatcttgaatacatttcctatgctgaggtaagttttgagagttgagagaagtcacgaggggacatggagtgtggtgtgaagtagccagtgaatcggtcaagagcttaaaggaatattgcatgtgaagtgaagtgtgatttggatagtgattaaaaaaaacaaaaccaaataattgtgctgccaaaaccaggacaaactataacagtctgttatttggtttcttctttcttttatttttgggttgggacaagtgaactatacatttcataatacgtcttgtttctcaagattcgcaatttaaattttgtagggtcttgatgttaaattttaacacttatcttggtacaatgctaagataaaaatcttggtgctctaatgaaaaagaacagtgtttaatatttttaagtccgtgactcgtgagcctcccttatcgtgttgacagtgacaaaccgacgatgcctctttcgtcatttactctcattgttcgttcacgagacctctgaaatacttacatctacaattgtcataatatttatatcctgaaaattgtcataatctttcttttaccttttgtcgctacagtagaatatacatttacatctacatccaactaaattccaagcaatttggataagttttgtttcaaagatttaagtgtagcagatattgcaattttttttttttggcccataatatggaaaaatgatcactaagggcaggccaaaagtcccaagaaaatcttggacctttaggcgaggcttgattgatcggttcagatttttcttacacgaattctttgtttctctcaactacttatccatgcctgcggtccaattaacatatcaacgagggtgagttagcccacattgtcaaccagttggctctgtaaatgtccttcatagtgatttgatgcaacaacattattcaattctcaaccgtataaaataaaacaacgaatatgaatacaacacatacactgagccaatcaatgtttctgtagctcttattaatttacattcacaccacttatttgggaagtaatctggtagaattcttgcttggcttctatagcttcacaaaacttcaaaagattacagatggtcttgatatccctttgcatatgtacatatatatcctgagaagtgaagatggtttgatactcggttacataggctacttgtaccaaaagagagtagtaaactttattgaggttggtttggatatgaaaagtagatcatgtgggttctgattgatgacttaacaaacttttgcatggtgaacatcgaatgaagtgacttgcaagaagctaaacttgtttacctctttatgcagaagaatcctcttttggtttgattatcacaacaggacaatgggcgtggttggtgcagtagttgcttacacttcccagaaacattctgttgaaagaaagaacaaactggattcaacactggcatttgctcactaaataagatttaactcactaaagaacacacagtgacagtgatatggtataaacattttcaaagggataaagattcctcgaagcactacttggtggttgagcagagatttgtcttcacacaagttcaaagattaactaaacatttcttctgttatttgaccgcacgagttgaaaaaaataacagtagatatctatatgccatttcaagcgaaagcgaaacaatcttaaactagagtaaaccgatatggaacaactaattcagcatagtaaccaagatcaaacgcctggaatttgatttacagcgctttcatcagtgttcaacatagcaagatactagagtactggaagaagagtttggtacctcttaatgcggccataagcccgggagcccatgacaagaagatcagcatgcaaattctctacagcttcgcagattttatacttgggatccccaataaccacttgtgttttcacattcacctgagagtaaaccatcacaacttggtcatgaatgaccaccctcaaatcaatatacacttctatagataacacataagtaattgctccagattctaatccatcagtgaaagagaaatattctaatccataaaacttatagaattacactactagatctggactatgaggtaaaatatcccattctcacaggggacacaagggaaataactctactcacagatttttcagcacaaatttgactagcgtgttcgaggatggtgtcggtgatccgcttctggtgttgctcgattgcagcagtgaaagcaggaacctcaagaccaccttaatcgcaaaattcccagagtcaaacaccacatggtcgagatcatatatacattaaacaatcacaaaattagtagtaacgagactcaactgggaccaccgaaaggtatggtgccgggactcacgccggcggctacagaaggcgacggctggacgtggagcacgacgaatgatgaatcggaagaagacgaagagagcttgaggttgtctagagcccacctcagagcttccatactcacctcgcttccatctaccgccacaacaacgcaattcaagcttcctgaaacatccatgacttcttcaatctctcttctctgtgctaaggctttctgtgattttcttcaactcttggaaagttcaagaggacgatggctttcacgtctcccatttttaaattcgcggcttacaaaagggtatacctgtcattccatagccgaattatgtaatgaaaatattaaattatttacgtactattataaatagagtaaacttacgtccgcgcgtgagtttcagacgcgctggcattcgttgttgacttatttcgtttagacgtttctctctctccttctccctcactcgaccccctcgatttctgatcgccgatctccggcttggattctccgttttccggtggggcttttcctcagatttccctagcgatg

SEQ ID NO: 7234 - DNA, 3000 bp, Unknown; identical to SEQ ID NO: 7204
  misc_feature (1)..( 3000): cDNA_ID_1817060_gDNA_ID_1621133_Annot_ID_172542 3000 nt of promoter + ATG

SEQ ID NO: 7235 - DNA, 3000 bp, Unknown; identical to SEQ ID NO: 7203
  misc_feature (1)..( 3000): cDNA_ID_3013398_gDNA_ID_1621133_Annot_ID_172541 3000 nt of promoter + ATG

SEQ ID NO: 7236 - DNA, 3000 bp, Unknown
  misc_feature (1)..( 3000): cDNA_ID_1028131_gDNA_ID_1621133_Annot_ID_172537 3000 nt of promoter + ATG
agaatgaagtgttatttattacaaaggtgaaagttattgaatcagtgaagaaatcatattttgttaacgactacaaagaaataagccaagtcatcgttttcaactcttacatctttagccatttatgtacatctggacccatttgtttgttctgttaacgacaaccaaaagggaaaccgacaactgaaaaatgtcgcaatattagattagggatgatgagtaagctaaggtaccttttgtcgcctaacgttaagcccaccttgtcagaaacagactctaaagcttccttccatttcttgatttgttctccactcgaagtcttagccaacctccagaagttgcgaccaaactcagccttttgatatctaacagactctgccttcactttaaagaagataggaaccactcgtagcttgcatttatcggctcttttcttgatccttgcaagctcgtccaggcaccagcttgactctgcgtatcttttggaaaatatggtgagagccatcctcgattgcttgatccttgcaaagagatgtttgaggtctttccctttttgttcgtctttgtctatgaagaagttgattccatgtcttttaaaagcgtcaacgaggtggctcacaaagctgcagcgtagctcctctccccggaaattgatgaacacttggatcttcctattactactactccttttcatgttgtttaatttcctttagttgtgagcgtgagcaatgaagagaagttggttagactttgttccactcttatacaattttgtttggacagaagacaagttttgtaatgtaatatggaacaatggttactaagatgtttagcaagagcttaatttatagtatatgatattgggatttgggagggtttaggtacattgttaatgttaggtttatcgatattactggagggaaggcgtcgttaggaactttgtcattaactttcttgagttaacatgcgtaaatgcagtggcggacccagaatttgattattccaaaaattggacagaggaggaagaaaagtcacaatcccaaacagttaatacaagatcgtagaaaagcgtttttggcgcacgtgcgcggagagagaaagcagaagcagacctcacttttctttttttcttggttttttcttgtctctggatcctcattgttgttctcaccaccacctactagctactacccacatttttccccaatgtcgaacttctatccgttttcttctttggttttaggtctttctttttggtagttgtactacaacatgtatacttttaatttgcagcaaacatgaaacttctcctttgtcagcactcagccttacggaacaacatgtacccctaaacaaaactctacatgacctaggggatttgaaacatcccaagaaatggatttttttttttttttttttttttgggctgtgattgttaatgaaaacctttttatgtatacatttgataaagtaaatactacatatattctagtagaataataccatttacctaatatactgaaatttcttgggatgtttcaaatcccctaggtcatgtagaattttgtttagggttacatgttgttccgtaaggctgagtgctgacaaaggagaagtttcatgttggctgcaaattaaaagtatacatgtgtagaacagctaacaaacagaaagcatagaaagaagggaaccctaggataaagaattaaaaaggggaacaaagatttatgctgtttcttctttatttctcattggcaaaacggcagaatcttcattaagttgcgttttattattttttccatttcttatagtagccaacttccaactacaccatttaacccggccgtttttttttgttgctaagtaataggtaaatatcctattaatgaaaattatgatttacatgaacaatagctaagatttaggatacaaacaaggaagacgatcaaggatcttgaagatagaagtaggcgcaaatgtgttgtgaattatgcagcatcttatttctttgcttccaagttgtatataaatcacggcttgagtaactagcttccttagtgtatatgtgactgcatctatcatatacagtatgtgtgtaaactgcgtttggtgtaaaatgtaattataatttatagaaaataaattaaagtagtggaacatggaaatcaccgttcagatattctaactgattcactatagacggaattcttgttttcgtccattgtttttactttttagaatttttaagtaaaataaatcatccattacatcactgaggtgacatcatcgctcaggggacatcactaactacgttcccactaaaaatataggcaaatgcaatcaagtgaatgatgatgacctttcaagagttcgtagagataaataaaataataaatatttggcatgttgaggatcaaatgaattagatgcataagaaaggtactaggtagaccaggcccggcccaatgtgttttgttgtctaaagcaaaacaaaaaaaattaagcccattaaagaatagttatattgcctcggaagggctcgaatccatcatcttcatttttttagtttacacggattggaagtaggctacaatgtccctgagggaaggtaggcccattattagtgacctgaagcccaataataatgaaaacgcaaagaaccttttaagaagaagatgacagaatctctagagaataaaaaactaaacacaaaaatagaaaatatcgaaaatgagatgagagagagaggaggagtctctcatcgtgagtagggcttttgactccctccctactttgcctacttcttcttcttcctctgtggccactctacacagtccacacctacttcaagacacctttctcatccttgagatcggcgtcagatcctccgccgcttctcctcttcactatctccggtcacaacttgtttttctctgtttttctttatctctactttatgcacaatctgactttctaagtggatttacagtgttaaagatg

SEQ ID NO: 7237 - DNA, 3000 bp, Unknown; identical to SEQ ID NO: 7201
  misc_feature (1)..( 3000): cDNA_ID_3050073_gDNA_ID_1621133_Annot_ID_172533 3000 nt of promoter + ATG

SEQ ID NO: 7238 - DNA, 3000 bp, Unknown; identical to SEQ ID NO: 7200
  misc_feature (1)..( 3000): cDNA_ID_1028612_gDNA_ID_1621133_Annot_ID_172532 3000 nt of promoter + ATG

SEQ ID NO: 7239 - DNA, 3000 bp, Unknown; identical to SEQ ID NO: 7228
  misc_feature (1)..( 3000): cDNA_ID_1816988_gDNA_ID_1621133_Annot_ID_56514 3000 nt of promoter + ATG

SEQ ID NO: 7240 - DNA, 3000 bp, Unknown
  misc_feature (1)..( 3000): cDNA_ID_1816980_gDNA_ID_1621133_Annot_ID_56516 3000 nt of promoter + ATG
tcgccgacccataaaataagtttagcgtaggagttaaaccacggtgggcagaagaaagtgaaaacgttgtccccggcgagggaaacggaggcgaatttctcttggtagtattgaagacagtgagatagaaactgggccacgagagattgttgttcttcgagagagatacgattagtttcatccaaggaagaagcacacataagctgttcaacgaaatacctgtgacggattaaccaaccatcaacgaagatagtgaagctttgagagctgctagtgtttggcatgtttcttatgtttggagtactcactaagtaagtatggactgtgagtgtacgttgtgcaagaatgtttatatactactacattgggcttgaccaagaaaaatcttttaggaattaatttacgatatgtcggtctatcgacgatgtgtcggcgggcgaaatggatttttgtgacttttgtcttgtcggagtgaagtgtaatcagagcagcgtcttatcatcatttgctgttgttattcaactctggttttagaatcaagttgggttaaacaatagtataaaattttaatatggatgaaaataaaatataaattatccttggtaattattgattataacctatagaatcgacaaaaagaaagactataacctagagaatttttttttttttttaaaacaagtgttcattaaaaatctttaaaatatttagtctgttttataattaaaatgtttatatctgaaattgtatctatcactactagttccagttggaattatatatctgtcagggtcgcatctcgatattatggaatgacctaaaataacatctgaagaggaaaccgacacatgttggtaaaataagaaggcacacgtcatgtaaagaagatgacatatgtcaggaaaggaacatgtccttacaaaatagaaaccaaataaaccaacagttcataaatgctccagttatgccgcgagccatcttttcttctttactaagaaaatttctacattattttaagatttttcttttccatgtagttgtctcatacttccttcgaaaagatctttctctaacttcaaccttggggatcgagcaaccatatttcaatcaacagattctttcatcactctaataacggacaaaaaaagaaaagatgtcaaaaaaaaaaaaattggaatatgcacgttgatactataagttcatttaaatcagtcgttagagtaaaccttattgagagttcaaattcatttaaaaacctgatgagataattatataatttcttataagatttttttttcttgtaagaatttaacgaatagaatttttctctctattacttaaaattcctcctcgtcaaaaattgcaaatgcttggcagttttaccattttctcagaactaccgtatgagaaataaagtacgtattaaaaaacaatacaagctttaaagataaaagaggcaacaaatttttttgacaaaaaaattagatgaaaagaagtgacgacaaataactgagaaaacacgttttgcaaaactaaaaaaaaaaaaaaaaagagagagttggaaaatgtttggagctggtgggcattagttggctatgcaacgcacggacgcggatacttttcaactcgttgcttacgcggccacgttttcgtcacaaaccgtgtttcttttgcggccttttaagttttaatcaaacatttttgttttcatttgaatcttttttttaaggcggttatacgaataaaatcattaaaaggagaaacgggccttcatgtttaggtttttgttcttcctcatttgggttatttagcttattggttcagcccacaagagtttccttcaatggatagggccttcagttgcatgccatcatcctttcttgtttctctataagccatttttgcaatgagaatttctcaatttcttatttttgcaataaaatcattttgccttagatgatggtggaatcatccgtttttctttattttgacccggtgagtaattgaacgcaaaaaatagtccaattattcaaaaccttacaatttcatatcgccataataaacctaaacatgattcgagtgagcaactacataaaaaggggaacgaaatgttggtacaaaactgaattccaacccaatcaagtgcatactaaactattgagcaaaaacaaagataaaaatcagttcacctaccctaattaaaacatgattaggcctaaaagactataagtaaagataaaaaagatgccattttagagtacgttttggtaaattggcgccatcgtgttatacgtttaaaccgtataacctgaatcatgcagcacgtgtacggctcacattggcccaagcttgattaacaaacaataacgtcattttcgtatttcaacaattttgatcgctcaatcctttcgacctaatttccatattaagtaatttattagttaaaacaacggactcaaccaaattacatattaagagaatatttgaaaattgtctatgtagatgaacatgtatttgaaaattgcgtaagcacactctttctctctctcttttttttttttttttttccccctcttctttctttgaataaagatgacatttttttctgttccaaacacaaaactgcatattgatagtgttattgaatactcaacgtctcttcttccagcttacgtaagtggaacttactttttgccccgtgatccaacagaaaatgacgaatgctccctcaaaatcatttcgtttcaacaaaaatatgtattttatccatagagaaacaacaaaccttacactatataccctcttttaacgtgcccacttttcattatttacacaatttccccaacaaatttaaaacaatttacaaaaagcactcaactttcctaaagtagattcctttagtccaatggaattcttacaacatcttcttcttcgccacctttttctctccactttaagctttttcactctctctacgccacgacgactgtgaagcgagaa

SEQ ID NO: 7241 - DNA, 3000 bp, Unknown; identical to SEQ ID NO: 7227
  misc_feature (1)..( 3000): cDNA_ID_1816976_gDNA_ID_1621133_Annot_ID_56517 3000 nt of promoter + ATG

SEQ ID NO: 7242 - DNA, 602 bp, Unknown
  misc_feature (1)..( 602): cDNA_ID_1816972_gDNA_ID_1621133_Annot_ID_56518 3000 nt of promoter + ATG
ttcaagttttcttgctgagttttctatatctcttaagttaatatatcaaccaacatgtttggtgcagtgatgcgagtaatggtaaaaatttgaccagtggcaatattcagtcttccaaaaaagtatgtgttcttagactcctttcagcattgcattttctgattcagcaaattgattattttgcattatgctcattcagagtctctacacatgatcgtatcattttcttctttaaacagtcgttcttttctcaggaagatgtaatttatgctagagttctattatactttagaatatttactttctggatgctagagctatcatacatcagtgtttcgatacgtgtttttataagtctatagaacccactagacttttcagtcttcttgacattgtttgtgtaaagctgcaaatagcatggtttcacagaacttattaagttctctgtttcgaagtaaattcttcccattttacaatacttttattgattgattgtttttgtaactcattaggcctttactcaaatcgcttctgctgacaagaagctggtgtcatttgtaaaagccttactcggagctcgtgacactttgcttgaagaaatg

SEQ ID NO: 7243 - DNA, 3000 bp, Unknown
  misc_feature (1)..( 3000): cDNA_ID_1817132_gDNA_ID_1621134_Annot_ID_56519 3000 nt of promoter + ATG
cctctgcacgtcttcaaaatgtaccaatgtctccatctttacgtataaatatgcaatttacgggcactaactatttcatcaccaaaacttaaaacctaaacacaatccaaaaatatttctaagttttcacataagagtgaaggagaaaaatttgaaatgagggcaatcacagcttcgtttttcattttctgcttccttgttccctctgttttcgggaagctccgacgtgggttttatgacagttcatgccctctcgctgaatctaccgtgtctagagttgttgccaaacatcactcccttaaccaaaccgttactgcagcgttgcttcgtatgcagtttcatgattgctttgtcaacgttcgtaagcttctcctttgtgtgtttgtatatgtatgcatgatgtatcataaactagctaattatattaaccaagcaaatattttgaatgctgcatgtgtagggttgtgatgcttccctcttgatcgactcaacgcccgaaaggccatctgagaaaagcgcggaggcaaacgtaagcgtgagaggcttcgagatcatcgatgaggttaagaaagagcttgagatagtttgcccaaaaacagtctcatgcgcagacattgtaactctagccacaaaagactcgattgcattagcgggtggtccacgtttcacagtacaaacaggataggtaatttccgtgatttatatcaagtcctagggctgtgattttgcccggaccactaatttccgtggctgtatcaatcaaagattttgaaggtaaaggtttgaatgtcaccaacatggttgcacttattggtggtggtcacagcgtcggtgttgcacattgcagtctttttcaggataggcttaaggatcctaaaatggacagcaaactgaaagctaagttacagaacacatgtcgtggtccaaatgacccatcagtggtcttggaccaaatgacgccacttgaggtagacaatcaaatctataaacagataaaaagtcaaagaggaatccttagaattgatcaaaacttgggtctcgatgactcaaccagtaggatcgtatcaaattttgcattaaatgaaacattattcggagaaagatttgctgaagcaatgcagataatgggtgaaataaaagttcttacgggaaattctggagagatcaggacaaactgcatagtcgtcagccactgaagatctctattctacatttggtggaactatgatcaaatctcgctagcttctacgtattcttcttcttcttctccataaacattttatttgtgattttcagttcggactacatattttcctttccattgctcatcttctttcgcttaatttcccgcctttttttgttttgaaaaatcaatgaatttcatttgatttatttatctacattgaccagtgtgttgcatattgtatgttattgttattttatgggattactcgccgtgttctattctgtgtattttttttatttttttttgtagatttggtagttgtttttataatatagttcctgattgtgataaattttagtttttattaatatggtcataagattagataatgtatatatgtggtgcaaccgaatttcaaaagatattgaatctttagagaccaacactctacacaatagatatatcaatcgagccgtgcatgtaggtttttggagtgatcgattacgatctcatcaacattttttggcaacgggagatccactccatgcacctacatacttataagttataagtttataaccaataatgcatgatgattttttttttccattgaatttttgttaaagtttgactgtatcatacaattgcttgttgtagtatttttaaaccatcatattgtagaatcatttataacttcattgtaaaaatagacatcaatttttgtaagtttcaatttttaaatattatcattttctatttcaataggctttataagcgaatttatttgcagtttttgttatacattgtcaaatgagtattttctcttcttaattgataacatccatcattatatgtaaatcaagttgtctccaatcatacgtttttaaaatattaataattaaaacaaatttatatttaataatttaaaaataaaattatattactataacttaataaaatatcataatatttaacattattattttatagagattttcctgtattattttattgatagtaaatatatgttttttcattgattcatattccgaacttttggtccataattacatatataatctttttttttttttctgaaaatctggaagttcagacacaaaggccctacctacatctccgagaggcgaaaccctcaccaggttaaattcatctcttttagagaagagatccttcccaacgtgcctcgaatccaacacctccacctgaaagatttactacatagacaatctttagtcgacttttgtttaaagaatccctcttcatcccaaaagagattgaaccgaggcacaagggaaccaacccttttatattaccactaggcactagaccaccatccctctggtgtttcatctaattgttaagtcaatactagcccttgtgccgtttgatacagtatggacattgttttggataagcaacaattttccaatgttactataacaaaatctttagtacaaatgcgaataatacttaagtaatagatagactcaggctcgtctttacgaagggaatcaatcaaaccattgtgtcgactaatccaaaacagaaaagtttacacgtaaacggatacatgatggaacggaacagaacgagaattatgcctattcctagtgtacacgtaagcgtcggcgtgtaattattaatttcataaaaagaatttcaaaatatgaattaattaataataaacaagttcgtcaaaaaaatcttcacccgccactgaaccatgaagaagaagatccttctctaattcctatcgccggatctgcaaaaacaaatcacaaatcaaatcaatg

SEQ ID NO: 7244 - DNA, 3000 bp, Unknown
  misc_feature (1)..( 3000): cDNA_ID_1817125_gDNA_ID_1621134_Annot_ID_56521 3000 nt of promoter + ATG
atctacttcacatgcattcaaatttatattcttttatgttagacaatgttataagcctttgtttcttaattcgtaatatggtgttattttccaaatctataatttggcttattagtttgcagttgaacaagctagggcatgtatagatgtgtctttatagttattagcgtatacaaagaacaaattggacgatagatgtctctttcaataatttcttattttttccttacaatgtttttttttgcctttctgtacttgatgtcttcttcataataattgcattttctatccctctcgaaaattagtacctcaatcaaattgatctcaagtcaagttctggacacaactaccttttatctttttgaatttaatgttaaattatattcaaaataaaaataaacgtttttctttgaatttaactctatttgttttattttggaaagttgatgagtgattgtcggtaactatactaaaaaatggttttgcatttttctataggtgtggtatgccttggtacgtggaggaaacaagttagacacataagcacatatgtactagacgcaaataatgtcacaaaaacggtttaaaatatctagttttcagtttgtatgtcgtacttataaccgaacgtgtgtgaagttctcatgtcatgtaccagttctgttaaactaatgaaatatgttcagaggtttatgaccactataactattagacctgatttcaattaatcaagaaaaatccaaactttttaatatatgcattatgctttacaaaattgtttgatcttctactgatgtaaagacatttacaaaatatagttatttaattgattctaactaatttgttcgcgcatagcgcgggccgtaaactagtatttgataattcaggtgcctttgttttgttttcttgtattaggagtgtgggggctaatgaattagttacaaaaaatataaattgaattgtggaatcatttgaccaaaaaattgagcaaaaaaagaaagaaaaagaaatgtagaatcaaaatattcatgatgaattgcgatggagacagaagaataactcaaaagatttgaccaatgtgaacttgttgaaacgtggaattggtccaaaagagaggcaaccttatcattaaattaggctaattcgcagttaaataagtagcctaaaatactaagaattaatttcacttagtttatcattgaaattggtttaggatcatgtttatgaaaatacgattgaaatctctttctgtttttttttacaactacaaactactaattaatattgaaatctcaagacttgaaaaaaaaaagataaaaactcgcttgtaatttgtttttcttttgaataattataacattccaaataaatgatcatacctttgaagttccaaatcattttatagcttttatcttttatgtaataaataagctatgggccatcacattccatttatttacataaatactaaatgataataacaattattttcctatatgatatcaacattttttttttattcaagcttcctacctttgaccatgctataaagctattatgacattgccacacataggttatttggtaaaacaatgtaatttgaaacctactttagattctgttgtcctttacttggtaaaaagtcaactttcattttcaaaactagatatgcatatacatgttgactgattttcttcacctttttctatttcaaggacttacaataattaccaaatacttccttcattcacacaatcaaaggtacaaaatggttaaatatttcaaaatttactacttgatacaacttagtttactacttggaatatacaacaaaagatattatattgtaattcttttatataaccataactcttttttgcctcaataatattgaattagaatgatttcaaacaaaagaaaaatagattgaaatcacaaagagaaaacaatatttattccgaatcttataactcgacgaaaatcgattttatcgacattaattattccatcacaatactaatttaaattccaaaaaacacctatcaaaagtgaattttcgcataacaaactcgaaacattacaccgatatgtatttgatgataatttgataacaacatatggtattcttcgaaattgacgtgtctttatttctgatttctgttgaagtgatcccaattcaaagaatttcaatgaaatccatttaaaagactatataaacataaatttaactatgtaaataaaatttggtaacatacaaaataattctaattatgtagtaatatttgataatataaaatatactgcaacttgttagtaaaaaaataataaaaatgtgtaaatgggattgagagttttgaagagtgtagaaatgggtaaaacgagaaaaagcctttgggggttgaatttttggctaacttcaccatctgacactctccaactcctcctctctcttcagactaacccaaattcaattcatctctcctctctctctctttctcgagtcgcgtttcttcttctcttttccttgtagacatctccacgattcttcagctgagagcttctcacttctctctagagctttgctcaagaactagcgacgaagaagaagaagaagaatctgaacttcaatctaattcccagatccaagtttctgactcttcttaggtctttcttctccattccttcaagctactgaattgaatttgtcgttttgggttcttctttagctagggttttcgatttcctcttgactttaaaatcttcttgattcattggcaggtttcgtatgagagaatcaagtttttttccactgagcaatttgctccattaatggactgttgctttcatacaaatcaggatttgcgattacagtgtttcgctggttacattgttcatccatttcaagtttcctagagagttcaatccgagatcagagtttttttttgcgtatggagagtttcgagagagtttgagagctaaatttggaaacttgctgtgatg

SEQ ID NO: 7245 - DNA, 3000 bp, Unknown
  misc_feature (1)..( 3000): cDNA_ID_1817106_gDNA_ID_1621134_Annot_ID_56526 3000 nt of promoter + ATG
atcaactatgataatacaacaaatttatctttatatacgttaattttatgtccataacgtctttaatattttaaaaaatcatgaatgttatcagccaaacatctaattctttttattggatattttttttttgtgtgggaaggggagtcaaaaaactccccccaatttattaagaactaaataaaaggaaataacaaacgaatagtacgagggacaccaggcccattaacatcctcgaacatgatcgaaagaacagattcgggacaaacatcaagagaaagaaaaccaaaatctaaagagaacgcatagtttgctaatccatcggcaagacgattagcttcctatacacatgagtaacccggactaaccagtcccgtgagataaagtcatggcacaaacgtaccaggaaagacagcggatgcattccagtcacccatgtttgtaagaaccccacaaccaacttagaatccacctccagctccacccgtcgaaagcctctctcccaggctatgactaaaccatagtacactccccataactccgccatgggaaccgaacagatgcctatgttcaacgcaaacccacctaaccactcaccttcttctctttttattgggtatttaacattgtatttagaatctctttactggagcgtttgtcgttttctttagggaatgccaacaaaataatataccatatattcatcatcatgataatacaacaaacttatatttgtatgggttaattttatatgttcgtaacgtctttattatttataaaaatcacgcatgattttagacaaacatctaattttgttttttggtatttagctttgtatatgaaatttcttcactgcatcttttgtctttatatttatttacactaattttatatattgtaacgtctttactattcataaaaatcacgtttaatttcaaacaaacatctgtttcttttggtattttactttgtatttgaggttccaacaaggtaataaagtatattgcatgttttgtctttagagggttccaacaaggtaataaagtatatattctttaacaatgataatacatcataattatatttctctatgttaggtttatatttacaattgtatttagaatctctttacttgtgtctttatcttaaggagatgctaacaataaataaaacatattatccatcaaccataaaaatatatttataaaccctaattttgaaatatccaacgtctttaccatttacaaaaatgacgctttagtctttagagaatgtcaacaagttaataaacttttatctatcaacaatacaaacaaattttttatataccaacgttaattatatattcgtaacgtctttattatttgtaaaaatcatgagataagaaaatatttatctatcaatgactatacaacaaaattttgtacatcaacgttaactataaatctgtaacgtctttatttatttgtaaaaatcatgagataagaaaacatttatctatcaatgactataaaacaaaattttgtatctcaacgttaactatatatttgtaacgtttttatttgtttgtaaaaatcatgcatgatgtcggtcaaatatctaatttatcgttttgatatttaacattgtatttgtaatcttttttactgatgtttttatctttaggcgatatcaacaaagtaattaaaagaaacacacaattttctctttttaaagttaagtacaaatgaaaaatgcagtagaattttttttttttatagactactaacttgcattaaacaaacaaaataactactctatttttttttctttttcacattcaaccatctacttcattgatcgtacatgcactatgtattatatccattgaattttgaaaatttattagtatttatttttttagtcaaagcagactatagccaaacgaagcaactattcgtacagataaaaactcaactgcgactaaacatctcttttcttaattagtaaaactaaccatattagaataaaatccttttacttcttgtttcagtgttcttaagttcatagaaaattgtaactttttcaaaagtctatagtcttcttgtcaaaattctatagtcttattgcagtgaaaaaaaagtgaatactcaatattgttttgtcttttagatatgtaaacagatttaacggtcaagaccaaataaaaaatagagaaaaaatggtctgaaacaaatatattttataatttagtttaaaaaaaacttaaaaaaaaaattagaatagtagaaaaaaagaaaagtggagcccacaggttttaaattaataaaaaggatatattattctcttcttcctctcttcttcaaacttcgtctccaatctttctctccaccgtcgatactcgttttccatttctctgtaagaaaaattcaatttctctctttgtttcaacagtgaaggcaaaaaaccccacaaaagaaatctgtcaaatgttctaagttttcttcaacctcttaaactcaatttcttcctcttttgcttccgtggtgagtcattctctcaacgatcttcttcttcttcttcttcttcttcttcttcttcttgttgctttctccggtgatttttttcttctccggtgataatcgattttcgttgaactgaaattttgaaaatcgattttactattcgacttgacttcgagtcttcgattgttgattttcgtcgtctctgttcttcattgtttcgtactgtagtagagttgttgacagagattcaaaatccgaatcgtaaattcttagatcttcgccggaatttgtgcgtatttgattttggcatatcaaatctccgtcggtcgatattttattttccttatttctggatttttatgatttggtagatttaatgatgatgatgatgatgatgatttatgatgcttaacgcgttttctttggttttaaacaggtggctacttctcgtgttcttggtcctgtggaccttggtgttacagaatctccattgatg

SEQ ID NO: 7246 - DNA, 3000 bp, Unknown
  misc_feature (1)..( 3000): cDNA_ID_1817086_gDNA_ID_1621134_Annot_ID_56531 3000 nt of promoter + ATG
gattcttctcgtgattcgtgtttcaaagctggtaagtttagtgctccaggttttcgatttcaccctactgatgaagagcttgtggtttattatcttaagaggaagatctgttgtaaaaaacttcgagtcaatgccattggtgtcgttgatgtttacaaagtcgatccttctgaattgcctggtaattttcaacaccttcttatcgattttgattcatgttttctctacgtatcgtgatcaattagtttaggttattaatgatgtagttgagtatatgacaaggaaaagttttggttgttgatgatttgttgagtatatgacaaggaaacgtctttattcactatttaattcgtatcgatcctcatttatgctcatatgatttcattttcacaatgtttaggtttccaatttgtttatttgttatgcaagtatcaaatttatgttggaattggttttctaacacggtgaatgtaacaggtctatcgatgttgaagacgggagatagacagtggttctttttcactccaaggaataggaagtatcctaacgcagctaggtcaagtagaggtactgcaactggttattggaaggcgacaggaaaggatcgagtcattgagtacaattcaagatctgttggactcaagaagactcttgttttctatagaggtcgtgctcctaatggtgagagaactgactgggtgatgcatgagtacactatggatgaagaagagctagggagatgtaagaacgctaaggttagtattatagccaaaactcatctgtttctctttttgatttatttgtagtttaactaatctgtcttaccttcaggagtattatgctctttataagctttataagaagagtggggctggtcctaagaatggtgaacagtatggtgctccgttccaagaagaagaatgggttgatagtgatagtgaagatgcagatagtgtcgctgtaccggattatcccgtggtccgttatgagaatggtccttgtgtggatgatactaaattttgcaatcctgtcaaacttcagttagaggatattgagaagcttctcaatgaaatcccagatgcacccggggttaaccaaagacagtttgatgagtttgttggtgttccacaggttagtttcttctctaataacatattggcttatgctttctttcttttttgggtcctttggttattctgttgtgcttccttcactaaatagatacttgtatttgcagggtaatagtgcagaagtgatacagagcacattgctgaataattcttctggagagtatattgaccctcggacgaatggaatgttcttgccaaatggccagctatacaacagggactcgagttttcagtcccatttgaattcatttgaggctacctctggtatggcacctcttctagataatgagaaggaggagtacattgaaatgaatgatcttctgatccctgagctcggtgcttcttcaacagagaaatccacagagttcttgaaccatggtgaatttggtgatgttaatgaatacgaccaattgttcaatgacatatctgtttttcagggaacttctacagatctgtcttgtctgagtaattttactaataacacatcaggccaaagacagcaattactttatgaacagttccagtaccagacacctgagaaccagcttaataactacatgcatcctagtaccactcttaatcagttcactgacaatatgtggtttaaagatgatcaggctgctctctatgttcaaccaccacaatcttcttctggagcattcacttcacagtcaacaggtacttaaaaagtctttaaactcaccctcatctcagagcattcccttatgttgtctgccaagttatatttcccacgaagcattagtttttgaatttaaccaagacatgtatatattatactctgttttctttttgttgatatcaaaccctcttgttaagatcttgaaacataataacctagggccttttttactgatactttgtgaataccaacttacttaggtgtgatgcctgagtctatgaatcccactatgagtgtaaatccccaatacaaggaaggacaaaatggtggtggaacaaggagccagttctcatcagctctgtgggaattattggaatcaataccatcaacaccagcctctgcctgtgagggtcctcttaaccagacctttgtgcgtatgtctagcttcagccgcatcaggttcaatggaacgtcagtgactagtagaaaagtcactgtagcaaagaagcgtatcagtaacagaggttttcttctgttatcaattatgggtgctttgtgtgctatcttctgggtgttcaaagccaccgttggagttatgggaagacctctcttgtcgtgacctagactcttgaatcttgattcagcataagttagcctgatccacatctttgattatgtatagagtttgaaagagtttaattcttaacaaaagatttcttttttcctggattctctgatggctttgaaattttgcttgcacttatcatattaagcagaatttttgaacctctgtcgtgtcagacaagaatgttggaaaaaaataacaataatgggcctgtcgaattaatgggcctgagctagtatatttcgagcccagtaggttctcacaaactaagtagcagaaaaagctgagaccatcaaatagccaaccaaaaaatcacctcaatctacacaaagtctcatttctcgttaatttccattttcgttatctctctctctcgccgatcaaaccctaggtgtatcaattcgttcagattcccggcggttggtctcactgtcatgtaggtttgattcatcttctcttctggatcttgagtgacgaagagagaagagatctgagtttttctgagagagagatttttctccctcgttgacccgatcagttttttttcgtcgctggggattttcaaattttttttgagggatcggttttgatttgttacgtagatg

SEQ ID NO: 7247 - DNA, 3000 bp, Unknown; identical to SEQ ID NO: 7246
  misc_feature (1)..( 3000): cDNA_ID_1817086_gDNA_ID_1621134_Annot_ID_172611 3000 nt of promoter + ATG

SEQ ID NO: 7248 - DNA, 3000 bp, Unknown
  misc_feature (1)..( 3000): cDNA_ID_1022211_gDNA_ID_1621134_Annot_ID_172605 3000 nt of promoter + ATG
tcaagaacaaattaatttctctttacctattaattaaacatgtgggtcatattatgaaagacttaataaaatacattactatacaacattaaataatctatctaaaacaaatatttgacaagataagatatatatttgtatttttttctacttcaatagcatcacttattttaaatataagcttatataatttgaatcttaaaaaaaaatcaacttgtgttgtaacataggtcataatctattactgatttagtagaatatcaacacaattacaacccaccagcaagtagaatatttttcatagaatcatagggacatattacaatacattaaatagataacataagcatgttttgaactaagaaacatcctaactatcacaggtttggtctagagaacaagtgaagtaagccaaagattagattaagagttgtccaccaattgaagaatgggaaagagctgagttaattcatgagttcttgacccatttgtagagatgacgaatttgatctctagatcatcttatccaacatctaatttatacttcatgcaagtatggcatattgaaatgtggttaaaagccatgaagaatctgatgatgaagttctgtatcatggttgttggtatgcaagagaagtttgacaaatattggagtgaatacagtgatatcattgtcattgcagcagtgtttgatccaagattgaagttctctatgttacaatattgcttcgatacacttgatgcttccattagtaaatttaagattgaacatgtgcgtaagaagctgaagaagctttttgaagtttataaagaatccaaaggaaattgcaattagaacttcaaaaaccatagtttgacaaaacattcttctaggatatggtgtaagtttccatctttaaccctctattaaaaactttctatgttttgatgtagtggtttgaatcgtttatggtttatgtgtattgatggttctcttaactttcacaatggaagagttttatgctttcatttctcaaacggctggggctaatggatagtcagcattagacaaatatttgaatgagctggttttggacatgatagcatttaagagcatggatattttgcatattggagaaataatgcaaatcggttcaaggagttgtctaaaattgtagcttcaaaagtcttcattcagcataggaagtcgggtcttaaacaagtatcagagttgtctccttccctactaacgtttaagctttgatatgcgcgaggaattggctatttgacatattttcttttgtcatatttcaatcaatttgaatttaaatgtaaatatgtttttttgttgtacttagatgatcatattgagttatttaatgaagacaaagatggcaagggagaaatataagaagtttaaatttgcatttaattgcttttagatttgatactttgttgaattgtgttcaaatttgtttttagatatatttcaaagtataagacttttgacttatgtattgattaaaatatgaaccaaaaactattatgttcaaatttggttctgatatgcccattgaacatcccatttgaacataaactttaatgacatgaacgttaatagacatgagttttagtggacatgaactccatttatctaatatcaaaatagacattattaaaaattggaatgtgttaatggatatggatagcctgctatagactaccatttttgttggacatatcttaaattatcaacgaagtactcaaaaaataagaaaaaaattctgaaatagtcttgaccaacatttctttcttcttagaccttcgaaacacataaaaatgttttctagaccaaaacacatattaatcatcatatttgttggagctcagattttatataaatatcaaccaagaagaaaggactagtttaaccgctaggaatctttttgtgaccagaaaacatttctgcctacgctaggaatcatctatcaataaaacatggaatttcttcgttacaaaaaagaactgaaaaatatgctaagctcattatttggtgctttgggaaaaggtcattaaaaccaagggcaaggttcacgtttgtgtgacaggttattttcaagatgtctgaacactttttggctgcttctgtaagttctctgctctctctcccattgtgaaccttatgactacaattattaactattcccttatagtaactccttttttggtcccacgccatatattatataccatatctttacgtataaaacttctctctatattcatgataccactaacacttacatatttaatgcttcgacttttgtaattatacattcgttcatccttgtgtacaatatgatcgatgggcttcttggtcttttagcggtagaactttgtgtatattaatatatatatatatgatttactggtcatatttttttatataaactatgatgtattggtcataaatcgatgctcaactaattttttttttagttttatgttgaactatgatttgtagtgaaatatagtcttctagttaaacattttcatccatggtttataatatgattgatgagatcttcatattatatatccactgactgaacatgaaaacatgcacacaagtcacaaccatatctcaggctttattgctacgtacatgtgaacagtttctcatattcaaaaatattcatagcccgcgaacatgttcattggtaactaaaagaataaatcataatgattttttctcagaaaatcgacgagaatcatgtgacccttcaacatgtgtgcctcttttcatcatttattatcataaatcataaacacataaccaattctttctcaccttttcctcaactatatatacacatatctcacttatcccacctttaatacttcacacacaacacataacacacgtagtacttgcttcctatcatttctagaaacttctctttaaaacctctgcctcaaccagaaagtttcttcttgttaaaaaaaaagattataaacatg

SEQ ID NO: 7249 - DNA, 3000 bp, Unknown
  misc_feature (1)..( 3000): cDNA_ID_2172730_gDNA_ID_1621134_Annot_ID_172602 3000 nt of promoter + ATG
gctttgttccacttagaaccatcacaacaatcatcatcatcatcagcaaaaacaccatccacctcatcttctggattttccggttcaggtggctcccaaactggaacatcatcactatcatcttcacgatcagataaaaactgcacattctcaacactgttttctttcgatttctcatccaaaatgtcgagaatatcactcggcatgctcttcgacttacgctctaaccgatctaccttaacctccttcgttaattccacatcttcttgactactatgacttgaacattcatcttcaatacccctaacaaagataacaacaatcttcatcatcaaacaaactgtttacaaaaattatcaatataaaagagtcatgttttgttgatctcttacctatcacaagagtttccatcaacagaacactcacctgccaaataaaacatcatccaaatcatttaaacgcgttttcggatgatttcaacagcacaagagaagaaatctataccagagagagagcgttcactgctagataaagaattagaaggagtcatcaatggagattctgtaacaccaaggtccacaggaccaagaacacgagaagtagccacctgtttaaaaccaaagaaaacgcgttaagcatcataaatcatcatcatcatcatcatcattaaatctaccaaatcataaaaatccagaaataaggaaaataaaatatcgaccgacggagatttgatatgccaaaatcaaatacgcacaaattccggcgaagatctaagaatttacgattcggattttgaatctctgtcaacaactctactacagtacgaaacaatgaagaacagagacgacgaaaatcaacaatcgaagactcgaagtcaagtcgaatagtaaaatcgattttcaaaatttcagttcaacgaaaatcgattatcaccggagaagaaaaaaatcaccggagaaagcaacaagaagaagaagaagaagaagaagaagaagaagaagatcgttgagagaatgactcaccacggaagcaaaagaggaagaaattgagtttaagaggttgaagaaaacttagaacatttgacagatttcttttgtggggttttttgccttcactgttgaaacaaagagagaaattgaatttttcttacagagaaatggaaaacgagtatcgacggtggagagaaagattggagacgaagtttgaagaagagaggaagaagagaataatatatcctttttattaatttaaaacctgtgggctccacttttctttttttctactattctaattttttttttaagttttttttaaactaaattataaaatatatttgtttcagaccattttttctctattttttatttggtcttgaccgttaaatctgtttacatatctaaaagacaaaacaatattgagtattcacttttttttcactgcaataagactatagaattttgacaagaagactatagacttttgaaaaagttacaattttctatgaacttaagaacactgaaacaagaagtaaaaggattttattctaatatggttagttttactaattaagaaaagagatgtttagtcgcagttgagtttttatctgtacgaatagttgcttcgtttggctatagtctgctttgactaaaaaaataaatactaataaattttcaaaattcaatggatataatacatagtgcatgtacgatcaatgaagtagatggttgaatgtgaaaaagaaaaaaaaatagagtagttattttgtttgtttaatgcaagttagtagtctataaaaaaaaaaaattctactgcatttttcatttgtacttaactttaaaaagagaaaattgtgtgtttcttttaattactttgttgatatcgcctaaagataaaaacatcagtaaaaaagattacaaatacaatgttaaatatcaaaacgataaattagatatttgaccgacatcatgcatgatttttacaaacaaataaaaacgttacaaatatatagttaacgttgagatacaaaattttgttttatagtcattgatagataaatgttttcttatctcatgatttttacaaataaataaagacgttacagatttatagttaacgttgatgtacaaaattttgttgtatagtcattgatagataaatattttcttatctcatgatttttacaaataataaagacgttacgaatatataattaacgttggtatataaaaaatttgtttgtattgttgatagataaaagtttattaacttgttgacattctctaaagactaaagcgtcatttttgtaaatggtaaagacgttggatatttcaaaattagggtttataaatatatttttatggttgatggataatatgttttatttattgttagcatctccttaagataaagacacaagtaaagagattctaaatacaattgtaaatataaacctaacatagagaaatataattatgatgtattatcattgttaaagaatatatactttattaccttgttggaaccctctaaagacaaaacatgcaatatactttattaccttgttggaacctcaaatacaaagtaaaataccaaaagaaacagatgtttgtttgaaattaaacgtgatttttatgaatagtaaagacgttacaatatataaaattagtgtaaataaatataaagacaaaagatgcagtgaagaaatttcatatacaaagctaaataccaaaaaacaaaattagatgtttgtctaaaatcatgcgtgatttttataaataataaagacgttacgaacatataaaattaacccatacaaatataagtttgttgtattatcatgatgatgaatatatggtatattattttgttggcattccctaaagaaaacgacaaacgctccagtaaagagattctaaatacaatgttaaatacccaataaaaagagaagaaggtgagtggttaggtgggtttgcgttgaacataggcatctgttcggttccc

SEQ ID NO: 7250 - DNA, 3000 bp, Unknown
  misc_feature (1)..( 3000): cDNA_ID_1817106_gDNA_ID_1621134_Annot_ID_172600 3000 nt of promoter + ATG
ttaacattgtatttagaatctctttactggagcgtttgtcgttttctttagggaatgccaacaaaataatataccatatattcatcatcatgataatacaacaaacttatatttgtatgggttaattttatatgttcgtaacgtctttattatttataaaaatcacgcatgattttagacaaacatctaattttgttttttggtatttagctttgtatatgaaatttcttcactgcatcttttgtctttatatttatttacactaattttatatattgtaacgtctttactattcataaaaatcacgtttaatttcaaacaaacatctgtttcttttggtattttactttgtatttgaggttccaacaaggtaataaagtatattgcatgttttgtctttagagggttccaacaaggtaataaagtatatattctttaacaatgataatacatcataattatatttctctatgttaggtttatatttacaattgtatttagaatctctttacttgtgtctttatcttaaggagatgctaacaataaataaaacatattatccatcaaccataaaaatatatttataaaccctaattttgaaatatccaacgtctttaccatttacaaaaatgacgctttagtctttagagaatgtcaacaagttaataaacttttatctatcaacaatacaaacaaattttttatataccaacgttaattatatattcgtaacgtctttattatttgtaaaaatcatgagataagaaaatatttatctatcaatgactatacaacaaaattttgtacatcaacgttaactataaatctgtaacgtctttatttatttgtaaaaatcatgagataagaaaacatttatctatcaatgactataaaacaaaattttgtatctcaacgttaactatatatttgtaacgtttttatttgtttgtaaaaatcatgcatgatgtcggtcaaatatctaatttatcgttttgatatttaacattgtatttgtaatcttttttactgatgtttttatctttaggcgatatcaacaaagtaattaaaagaaacacacaattttctctttttaaagttaagtacaaatgaaaaatgcagtagaattttttttttttatagactactaacttgcattaaacaaacaaaataactactctatttttttttctttttcacattcaaccatctacttcattgatcgtacatgcactatgtattatatccattgaattttgaaaatttattagtatttatttttttagtcaaagcagactatagccaaacgaagcaactattcgtacagataaaaactcaactgcgactaaacatctcttttcttaattagtaaaactaaccatattagaataaaatccttttacttcttgtttcagtgttcttaagttcatagaaaattgtaactttttcaaaagtctatagtcttcttgtcaaaattctatagtcttattgcagtgaaaaaaaagtgaatactcaatattgttttgtcttttagatatgtaaacagatttaacggtcaagaccaaataaaaaatagagaaaaaatggtctgaaacaaatatattttataatttagtttaaaaaaaacttaaaaaaaaaattagaatagtagaaaaaaagaaaagtggagcccacaggttttaaattaataaaaaggatatattattctcttcttcctctcttcttcaaacttcgtctccaatctttctctccaccgtcgatactcgttttccatttctctgtaagaaaaattcaatttctctctttgtttcaacagtgaaggcaaaaaaccccacaaaagaaatctgtcaaatgttctaagttttcttcaacctcttaaactcaatttcttcctcttttgcttccgtggtgagtcattctctcaacgatcttcttcttcttcttcttcttcttcttcttcttcttgttgctttctccggtgatttttttcttctccggtgataatcgattttcgttgaactgaaattttgaaaatcgattttactattcgacttgacttcgagtcttcgattgttgattttcgtcgtctctgttcttcattgtttcgtactgtagtagagttgttgacagagattcaaaatccgaatcgtaaattcttagatcttcgccggaatttgtgcgtatttgattttggcatatcaaatctccgtcggtcgatattttattttccttatttctggatttttatgatttggtagatttaatgatgatgatgatgatgatgatttatgatgcttaacgcgttttctttggttttaaacaggtggctacttctcgtgttcttggtcctgtggaccttggtgttacagaatctccattgatgactccttctaattctttatctagcagtgaacgctctctctctggtatagatttcttctcttgtgctgttgaaatcatccgaaaacgcgtttaaatgatttggatgatgttttatttggcaggtgagtgttctgttgatggaaactcttgtgataggtaagagatcaacaaaacatgactcttttatattgataatttttgtaaacagtttgtttgatgatgaagattgttgttatctttgttaggggtattgaagatgaatgttcaagtcatagtagtcaagaagatgtggaattaacgaaggaggttaaggtagatcggttagagcgtaagtcgaagagcatgccgagtgatattctcgacattttggatgagaaatcgaaagaaaacagtgttgagaatgtgcagtttttatctgatcgtgaagatgatagtgatgatgttccagtttgggagccacctgaaccggaaaatccagaagatgaggtggatggtgtttttgctgatgatgatgatgattgttgtgatggttctaagtggaacaaagcaagtttgttaggggagttgagtgatgaaagtagtgaaaagagaaaggtttatgaagaaaatcgaagagtgatg

SEQ ID NO: 7251 - DNA, 3000 bp, Unknown
  misc_feature (1)..( 3000): cDNA_ID_2107289_gDNA_ID_1621135_Annot_ID_56536 3000 nt of promoter + ATG
accagaaacagaattatttctcaagattttgtggttacggtttttgctgctatcatatccgaaagcatacgagcaaaagttctgataactctcgaacaagctacggttttgaatcaacctagtttcccccaagtacatgttacataccatgagcgtgtagttgctgtagtggttattggagatgcaaaacaataagccgtcgcagtgaaagagttgagatatcgcgaatccatcaaatgcacttacttgattcactgatgtgtcaacaaagtcatcgccgccatttaggtccagcttcattgaacagatcttgtcaccaatgaggataaaccctacgtgactgcttttccttgcggttgctttaccacctacaagattggttttcgatgaagcctcccatttcttgcacgttgatcggagtgatctaagagatgtaatgggaaccctagcgagaatctcgtctaccaaaaccactggaagggttgacatcgtcgtcgtcatttctctgaacttcagaaaaaccaaggactgttaggggttgtttcgtttttgggttcagtgtagccactagacaaatgtgttagtttacgatttaagggtaagaaatcttttctaaattggcaataaatgcttaatacagaaggaaatctggaaaagattttaattatttttggtggattttattccatctttgtatccctaatctacaaaggtgattggttaaaatgactaacagtaatcttgttcaaaaggacgttacacgaaacaaaaggagatgatgcaagaagaaaaaaaaaaattattgtaatcagtggaactaatttaataatctctctcgttacttttgcccggttgatagattcttcgtatatgcactaaacttggaacgtaagaagagaacacaagtggatcaaaataatatctaaacattttaggtttcgagatgtgatctgttccgattttcacaacagatttgtccaatgatgttaactgtttcgtatccacagttttcgttcggtctatacttacgagatttggaaaccacaacaactttcttctcctcgtcgatatagaagctctcaacacgaaatttactcgaaaaatcagagagcgatgtcctttccattgtgaagaacttggtccatgcatgatactgcattggactcaattttagtcgttatctccatgaccaagtccaaacataagtcgtagggttgatataacatagcgagctgctcttctctgatacaagatatatagagtcacagtctcttcatcactagagtgaaacggaagaggaagacgcggtccaaacctttctgatgtaaaatcaaaacagagtaaaaaaacaatacgatttgaaactgcatggctatctgacttctttttgtggagcataataataagtatttcccttcaaagacacaccgttgttgttgttgttgttgttgttgtttgtcgtaaccgaaagcatacatgtctaatctgtggaacttatggtatttgcttcttggttggatccacctgaattccccttaataagggttccacaccatgagcctccttctccttttgtgtatgacgcataacaatcaagccgtcacagtgaaatatattagatatatcgtattgatcaactatatatatttcctttaaagatggatcaacgaaatcgttgttgtggattccttggagatcaagtctcagggaacaaaccttagaatacattactacgaaacctagaaattgcttacttgtatctgctttaattaccaaaaacataattttccgacaaaacgttccaggataaagtgttccacgttgtacaagtacattgcacttcactcagagatatcaatggaactctagagaatatctctcccaccaaatctactgaaagatcggacaaagtcgtcattatttgttcgtctccttaaatgatgaagtgagagacgacacttgtatattctttgctaagaaccgtcatttgtgatcaaagaacaacttgaccaaatgatagatacttattgttctggtatttacaacattaagaactaattacaacttaatgaagaacagaacttgctggtctttgtgttagtctgactgtagaccataagtattagagatcttaactcattcattgatctgtaaataattcacagaactaacaactccttataaagcaaacaaaaaaggaccaatccaaaaacttgaacttttcctactatatacatcttcaaaattagctaacaaaagaaattaaaacttcaaacaagaaaaagatctaagaacaaaaatatcagtctcaaagattgcttgcggtgtacgtcaaagagagccagaagaagatatattaggttccaatctcatacttgaaccaaccttggtttcaagctttcattagtaatttcgagagcgagtcaaggtttgatcatccaatgggtggcttagcgattccttgtcctgaagatacctacatcactgcaaatccaacattttgttcttccgagttgaaaaatagacttactcattttaaacgtaggagtttttccccctcttcttcttaaagtttgaagatagaatgacaggtttttgcaatagacatgatcatgttcatgtcaatacatttaggatcgatcttagaaaaagaaagacaatagactaaaactagtcatctaaattttattgccaagagatgtacttcgaaaatgctagtatagattttagtctcttgacaataaaattttgtataaaatttgtctcctaaatagtatgtttttgtttttgttgtattccccaacagctaattctgtcttctggtatatgggtatacttcggttagtttcggtttgattacggttcacctttcaaatttaaacattgaaattgtaaaccatcttctttgtccaaaacgatgtcgtataataataacacgtagccgttaaatgaaaaccgaagcgtcaaaaaatcaaaatcgataaaaactaattagggtaa

SEQ ID NO: 7252 - DNA, 3000 bp, Unknown
  misc_feature (1)..( 3000): cDNA_ID_1690145_gDNA_ID_1621135_Annot_ID_56537 3000 nt of promoter + ATG
gctccatcgaagcttcctcaaaagaactgaagctgaaactgatttgcaactacttcgtgttgctttttcaatatctacttcttcatagaacttccacttgttgttggtaagatcatcctgaaccaataccttgttttctttagctgaatcaaacaaatcatcaataggaccgtaaattgcattgtggtttgttctattcggaggctgcggaaaactcgtcaagctctctttaatccatttacattgctcctttaaactcaatgcatcaggtataaagtaaaaacctgtataataatagttcaaaagctgagctcttggattctaatttaacacagatgattgaaagttggggattttaacttaccagggcgattatcgatgcagaacacaggagaagaatcaactttcgaaaccctaattccgtctggcaaaacaccgtcattgttgaaattttgtgaaatcaaattgaaatcaagtaactcagacaaatcaattggttttggtagcttcttcctgcgagttccaagtgattgattataagtggaaggattcaaacaaacgcaagtggagagaagataaaaaattggcttactttctagagaacttagaatcctgttcatagtaaagtttgtattttttctctgctcgccggaaagccgtacgatctgcgtcgtcggagacgttcgccgattcgtacatcttcttcttcaccagtcgacgattattctccggctgggggagcaaccaacccgagtttatttttttattttcttttatttgcaataaaaatcactagtctttcctaaattcttttttagacctataatacctttttgtgtataaatagaccaataatttattttgaaaaattgaacatttgaaccctgcatttctagtttttggccattggacataatcagagttggaaagtttacaaaaaaataaaagaaaaatctaaggtgtaacactttcatctaaaaactgataaaattaaatgtcaatggtattaattaattctaaggatgcaaaaacactctcataagctattaaatcaatggtgttaatttgtgaaacttagtcatctaaataatttgctaatttttgtaaaaatatatcatatatgtaagagaaattcattgcttacattatctaagacctacacttgattaatggtcagctttagacctacccttgatcttggtggccaattcatgtatagcaaatgtggacatcaaaatattttttttcataaatagagatgataacaatattggagataattattttgaacctttttcattcaccatttatcaagaaattaattacatataccatagtctataacaaatttccaaatttaccacaaaacttttctcaagaaggttttaaaaaatttaggaactcttttggcccaaatcctttgaaacaattgtgaaaggactccatttactttacaacaaaataaatagggaaatttgcaaaattgattaacaaaataactataattaagaaactaaccaacaaaaaaaacagagatgatattttgtatataaactataatatatactaaagtacccttatctacacaatcaccatctcttctatgctattacaaccattacccttgcaaccgtcgtcatcatcgcatccaccattatttccacaaatgtcataccatcatcaccatcaccactgcaatcgtcaccaccatagaaacaaccattacgctgtcatctctaccaccatcaccattattgcggccgcaattgacacacgaccactgcaaccaccaacacaaatattactacgacctacaccatacacaccatacacaccaccaccaccttaatcacttcttcctctcttccattgcttgtttcatctctctcgcctctcatctttttttttctactttaacttaattaaaacagaaccgaactatagttttctattttactttcaattttgtaccattctatttgctagttagaacgaagaaaaatgaaaacaaagactcacaagatcttattgaatattttctggtttgatcaatatctaaaattgaaaattcctaacacaaatttaaacccaaaatcgaatcgatttcaattcgcttaaggaaaggagaaaagagattaaaagtatataaacatgattttgtcagatttctaaaaactgaaacttgagatgattttatttagtttaattatttttgtttgggttctatatatagtatcttagggtttagttttcttaaatcaatagatgttttaaattagaatgaattgatataaaaaaagttaaattttctggaaattttctgttggattggagagaagagaagaagcaacgaagaagatgatgaatgaaaaaggtttgttaaaaaaacattacctttagatcaatatctgattcacaatccattacctttagaacatatggaatattacctttagatcaatatctgatcaacaaaacgaagaagatgatgagtcatggcaaattggaaaatagggaaataatacaggaatagacttgtaattagttagagtttttggttacttgctgaattacgtaaattatatggttataatcttaattttttgtcgaaatatggctacacagctaattcacccaaataaatatccacgcgtcatcaaaactatttattgttgacagaaaaaaaacaaacaacagacctttttgtcggtgaaattaattaataaaaaaatgatatatgtgtgtatgaaatgtaagtaacgtcttgcaaagtgtggacctttccgtctgagtaagagtattctgagttttgctcttctttgaaagaccttccagaaatccagactttttgttgtgacttgacgttatctctatgactctccattctttctcaccaaccccatttccccattgagacttttgttgacctaattcctccaaaatctcaccttcacattgctcgatttcagtcctctgaaaaaatctccctgctttgctatg

SEQ ID NO: 7253 - DNA, 3000 bp, Unknown
  misc_feature (1)..( 3000): cDNA_ID_1817179_gDNA_ID_1621135_Annot_ID_56539 3000 nt of promoter + ATG
taatgtcaaaggacatttactaatcttggatccaagaacacaacatagccacagacattattaatgtcaaggggcataatttagtactcaatcatttcttaatttcaacaatcaacagaacaaaagttcaagatattttaatacaagtgtaataaactataacagaaatcagcaaagactttctgtaaaaaccatgcaaggacataatcattgtaattcttcacacaaaatctaggctatcagtaagaatctatcagccacattatctctgagcgtatataccccaacaaaggatcctacagatcaaaattcagctaaacaagatccaaaatttacaaatttcgaaagtgaaatgatcgtcagaacacaagaaccaatcagcatttccataaaccaacatgttcgatgaaatcgagaagggaaaggagatgactcactaggaagcatacttaagtctctgtgaaaagaaagagattgagtctcctgagtcaaacccaattcatcagaggactttttgagctcgcggctaaaaggaatctcgccttcaatggcagtgacagctctctgagaagctgaagaagagcactcccagagacagaaacgacggcgtttatcagcgtcgaattcagcgagacccatgagaggagaacgatgatgagtcgtttggggacaaacccaaatgggaaaacacctcagagccatagcaaagcagggagattttttcagaggactgaaatcgagcaatgtgaaggtgagattttggaggaattaggtcaacaaaagtctcaatggggaaatggggttggtgagaaagaatggagagtcatagagataacgtcaagtcacaacaaaaagtctggatttctggaaggtctttcaaagaagagcaaaactcagaatactcttactcagacggaaaggtccacactttgcaagacgttacttacatttcatacacacatatatcatttttttattaattaatttcaccgacaaaaaggtctgttgtttgttttttttctgtcaacaataaatagttttgatgacgcgtggatatttatttgggtgaattagctgtgtagccatatttcgacaaaaaattaagattataaccatataatttacgtaattcagcaagtaaccaaaaactctaactaattacaagtctattcctgtattatttccctattttccaatttgccatgactcatcatcttcttcgttttgttgatcagatattgatctaaaggtaatattccatatgttctaaaggtaatggattgtgaatcagatattgatctaaaggtaatgtttttttaacaaacctttttcattcatcatcttcttcgttgcttcttctcttctctccaatccaacagaaaatttccagaaaatttaactttttttatatcaattcattctaatttaaaacatctattgatttaagaaaactaaaccctaagatactatatatagaacccaaacaaaaataattaaactaaataaaatcatctcaagtttcagtttttagaaatctgacaaaatcatgtttatatacttttaatctcttttctcctttccttaagcgaattgaaatcgattcgattttgggtttaaatttgtgttaggaattttcaattttagatattgatcaaaccagaaaatattcaataagatcttgtgagtctttgttttcatttttcttcgttctaactagcaaatagaatggtacaaaattgaaagtaaaatagaaaactatagttcggttctgttttaattaagttaaagtagaaaaaaaaagatgagaggcgagagagatgaaacaagcaatggaagagaggaagaagtgattaaggtggtggtggtgtgtatggtgtgtatggtgtaggtcgtagtaatatttgtgttggtggttgcagtggtcgtgtgtcaattgcggccgcaataatggtgatggtggtagagatgacagcgtaatggttgtttctatggtggtgacgattgcagtggtgatggtgatgatggtatgacatttgtggaaataatggtggatgcgatgatgacgacggttgcaagggtaatggttgtaatagcatagaagagatggtgattgtgtagataagggtactttagtatatattatagtttatatacaaaatatcatctctgttttttttgttggttagtttcttaattatagttattttgttaatcaattttgcaaatttccctatttattttgttgtaaagtaaatggagtcctttcacaattgtttcaaaggatttgggccaaaagagttcctaaattttttaaaaccttcttgagaaaagttttgtggtaaatttggaaatttgttatagactatggtatatgtaattaatttcttgataaatggtgaatgaaaaaggttcaaaataattatctccaatattgttatcatctctatttatgaaaaaaaatattttgatgtccacatttgctatacatgaattggccaccaagatcaagggtaggtctaaagctgaccattaatcaagtgtaggtcttagataatgtaagcaatgaatttctcttacatatatgatatatttttacaaaaattagcaaattatttagatgactaagtttcacaaattaacaccattgatttaatagcttatgagagtgtttttgcatccttagaattaattaataccattgacatttaattttatcagtttttagatgaaagtgttacaccttagatttttcttttatttttttgtaaactttccaactctgattatgtccaatggccaaaaactagaaatgcagggttcaaatgttcaatttttcaaaataaattattggtctatttatacacaaaaaggtattataggtctaaaaaagaatttaggaaagactagtgatttttattgcaaataaaagaaaataaaaaaataaactcgggttggttgctcccccagccggagaataatcgtcgactggtgaagaagaag

SEQ ID NO: 7254 - DNA, 3000 bp, Unknown
  misc_feature (1)..( 3000): cDNA_ID_1817171_gDNA_ID_1621135_Annot_ID_56542 3000 nt of promoter + ATG
ggcgtcggtgacgtaatcaacggagagtccgtattttcggatcatgtttccgtagccaccaccgctaatgtgacctccggctccaaccgtgggacaaactccggcggggaatccatgacttttggttttttcccaaatcctgtagtaaacttcaccgagtgttgcaccggcaccgacccatgcagactctgtggcggggtcgacggtgatgttacggagatttgacatgtcgaggacgaagaaaggaacgtgagagatgtaggaaacaccttcgtagtcatgaccaccgcttcgagttttcagttggatgtttagcgatttcgtgcagatgacggcagcttggacgtgactctcggaacgcgccgcgattacgatcgcgggtttcggagtcgctgtggtgttgaaacgcgcgttacggatgtaagcgcgtaagacgggggtgaaagcggcagcggtttttggtaaaacgacgtcggctaatgagttaggaggagcttttgtttggtttgtgaaacattggagaaagttttggtagattgtttcaggcggaggttcgacggcaagagaagtagagatgaaggaggagattaagaagagaattaaacaaaagatcttcatttttttttttttgattggattctatttggtgttttctgtagtataaatagttacatgtagtctttaaatttctgttgtgattcttatcgttggccatttttaggatttgttgtattggtcaaggtttctcctgttttttttttttttaatggtttaattgctcaagattttaatatagtcaagttaactatagaaagatcacaagtttcagaagtcaagttaactttagagattttaatatagtcaagttaactatagaaagaacacaatttgtttgaaggcattgtgagaaagataaatttttagaggtattggattaggttgttttgggaagagaataacatgtctttcaacctttatcttccttttttttgagggatcagttatttttgttttcatattagaacttgagatattaatgttctataaaacggtgaataaaagaccaaaaatgttttatactacaaaacaaaattatttttgattcaatctagagaatgaaaaaaaagagttacgaccatgacaagttatttgttattcaaaataaattttgttgaaaataatttaatgttcagaatatttgttctaaaatacatttagaataacaaatcttgaagcgattttacacttcgttctaatgacattaacaaactgaaaagatatacaaatataacgtttagcaatctttttacaaaaacataaggttatacttttcagctaataagagtagaagttattgtaatgatttgagaacaacatgtattttcgtgatgctactaaattaatatgttttgagagtttatgaattttgagagtagtgttgttatatgggatctgaagcatccaacatagcgaaacatcattcgttccatttttttcggtggcattctttcgaatttgcgtcgagtgtcacttttctatctacataaaccaaaattctaggcactgaatgtcaaaaaaaaaaaaaaaaaaatctaggcactataataaatgcaaggaggatgtatagctgatatatgatcttacaaacaaaaacacttcgaacaaaggcgagaacaagtaattaagcaatgtcaagagcttgtggcgcaaacgtaatgtttttttaataatggcatgttattttttgttcttgacgaattccttaaattgacatgaggataacatgcacataaacaaattgtccttctttgaatcattctgaaacttctcccttacacttttctttgaatgtaaagagtgattcttacatgaaaacaaagagtaataataatactttacaactatatcaaatcaaagatttgaataagcattttataaatattggataaacataggagagttttatcaacatccctaattccaatcatacatcttccgcatacggtgtatcaaagtactgtgatagatcccatcttcttgagcaacataattatacgagccaccatgaggcattctcttgtcttgaacatatgcgtcaaacttcttttgtaccttgtaatcagctcctttatacattgtacaccagaaaagtgtttctcccataacgtcatcgtggaaactaaaaccccaatcttctccaggtttcatatatctttcacgaacatcattgtccccagatttacaacgtaccttgagccatttgttgtgagaaagactgttcctgaataacaacgacgtcttttttcctttaaatggattcgaatggccatatgcattgctaatcatgcatagggcaaagacaactagaaagattgaagtatttttcattttttctttctagatgcttagaggttttgtcatcggagtaattttttatttacggtattgtatatatagacatatatgtatgctatttttgaatttacgttcttattatatattgctctcttattattagtattttctattaatgatttgcggtatcaaatcgtttcaaacacaacaatagatatggatggttgagtggagaacaatatatggatttagatctttgagtaaatatttccaaagaacatttgttttcaacacggacagtaatttgacgtgatacatttaccaaatactacctattatattctgccaattcgttacaaacagataaataattcgattagtatatacatatctatcgtttaattgtgataactttattattatattaacactaaagttgattaaaatcgtcttgatttcgattagatgttttattttataacattaaacacacatatttaaaagatgagaaattaaattgtatgtatatggaattttaacattaaaaaaaaaatccaaatgaccaatccggtttatgtcggtccggtttgtattaaccaatcttaatttcaatttttaccatataaacctaaccagactattaca

SEQ ID NO: 7255 - DNA, 3000 bp, Unknown
  misc_feature (1)..( 3000): cDNA_ID_2992483_gDNA_ID_1621135_Annot_ID_56543 3000 nt of promoter + ATG
ttattgttatgaaatgtgatgaaatacttgtatttgtgttcctttctagttaggaaagattaataagataagcgtagagaaatgtagtattctattgtttaaaaggagtttagtgaaatatgttgaaaaggaaatagaggatctatccttgattagaaagattgaaagaatgtgcatgaaattgtcctatctatgtattgatcagaactatcaacatctaaatgacttctagtagactcaatagatctctaattaatgttacaattacctgaattatctgagttactagtccacttataccctgttggtatcgtgaatggatccaccacttgttcctcatccaccaaacgccgccgtgagctcttgccggtggcattgatgttcagtctcaaccaagaaggcgttgaaaacgatggacgtgaacttgagattcttctatctaatttttcatcatcgtgcacgtcatgttggtcttccattgcagctaatagatgttttggacttgagagcggtgtgtagaattcatccaacggtggaagagccacgaacttgctgaatgtcatgactacttttactgttgggatcaccggtatggacaactaaataccaaaaagatggaaaaaaaattgatgtgaaaaagcaaaatctaaaccggttttggattttttacgtcccaacaaactgtaatcttttactgttagtaaaataccgaatctcaaatccgaaccaaaccaaaccatataaatttgataacctaaaagcctaaaccaaatcgtaaacgattcattttgttcctctgactttatgaggaatgtcacattagtgcaactctaaacatcaaccaatgaaattacgacacgtctgatagaatgttcatgatacttaaaatttctcatgcaaaacgcttaaaataaatttgagtaatgtccaagaatgccccttcttaccttgaccggaaaagttcccgccgggaacttggtggtaagcagctctcgcattctccgaacagccttgacatggttggctaaaatatcaagcaacggaagcaactcctctgttttcaaaggaaactgatccgttaaccaaaccgaaggacgcaaactcttcacaatctccttttctttgatccgccccacagaagaattcgccaccagaatcgccgcttccggtaaagaaaccgatctcctcctctgctcccgcctctgcggccgtaacggttctgacacactccgacgagtctcgtccaaacgcaaaccctgctcttttccgacttttcttgatttaaaactaaaactaacgttttcgacatcgtaagctttagctttccactctccgacagtttcaatcttcgcttgccgtcgccaattcgtaatctcaacgagctttgctttagtaacatccatccccggacggtacaagctagattgaccacaaaagccagctatatcgctatcgctaatcggatctttagcgttttcgaaagcgttcaagatcgttttatcgtctctgtttaacacaagcaacgtaccaggagacacatcaagaaactcatctccatcactaagaaagagaaagctctgattggcgcggcgtatcttgaaaccgtcgaatccggctaatgaagtatcggcgcgtaaatctccaccgcgtttccatatcttgtaagtatcggaaggagcgatttttccgacgaatggaatcacggagctctcgaagtgaaatgatatctccatgtagaaatctctcatgcggctgagtacggcgatgagatgaggaagtctccgtctccatttgcaccacgccgaacggtgatggtcccggagaattgcctccgtgatctctgagttccgacgacacaaagcctcatgcaaggagttccacccggcggcgttttggagcgtgatatcagcaccggcggaagatatagtctttgccgcgaaaacgtcgccgagacgtacggctaaatggagaggcgtctctccaaagggaacgtcacggcggtcgatgacggtggagattttctccgcgactcgctcttggctcattgagtcggactcggtgtggatttgttccgggtcggttagtttaggcaaagacgaaaccagacgagtcaaaccggcgtgatctcctacaacgacggcgtagtggacgggactgtgagcataatcatctatagtagtggccggaatatttgccggcgaagaccttgccatgttttccccggcgactgttattaaaactctaaaggagagagttgaataacttctttttaataaaaagtttatgtttcatatttatctctgacaacagtcaacgtaaatacaaaattaaaactccataatctttttgttcacagttttgaccattgtttaaattccttttaaaattgagtatcctagatctttgttttggcaacaaatgactaaaccttagattgttattcaaattcaaagaagatcctttcacaattcaaaagcacagagaaatggtgcatgaatttgtagataaagcaatgggattcatatgaggaacagaaatatatttgcatcaaaaaataatcagtcaatgcaaaaaggctaattaagtataagtgatgtattctatgtgaattaagtgttgtggtcaagcaatgactaatgaatcataatgactaattaagagtttgaacaacatgcacaacctctctttttttgtttcctttcacaaatgcaaaaccgtctctaattttacaaaattaacagatacagtgggcctattttgaatcatgttaaaaatattaagtttgtaatttgggcttattgaatcatggatttgggcttataatttggtttgaaaccttctgagtgcacctgagtctctgggacctgtgtcactgttgctgttgccttggttgggttcggtttaaagttcgtggccaaacagtaaccttgagtcttgccgtcctctgtcatctatccacgcctgaacccgaaaaactctgaaagctgagctctggtaatg

SEQ ID NO: 7256 - DNA, 3000 bp, Unknown
  misc_feature (1)..( 3000): cDNA_ID_1817167_gDNA_ID_1621135_Annot_ID_56544 3000 nt of promoter + ATG
gcattgtataggattaagtagtaacaagctggacctaaccaatccggtttttccataaagttccggtttgcttggttatcgtgtgtaaacaaaaatagaacacaactttcagatttttcagtaaaaaaataaacagtttagttttctcattctgtttagtagacaataaaaccaagaaaaccaaactgatttatgcacaaatatcagttacaaccgttcatattcaaatgaaaatggaagctttgaacattgcaatgagctgttgttgtgcattgtcctgtatgctgcttcagtattctgtttccaatagaccatcaatgagcccgaactcaagcgcctgcataaaaaataaccaagaaaatatcatatgcagaattcaacatcgttacagaatgatcatgaggaacataagaaagacaaagtccacgagatatggcgagacctcttaattcctaactatcagtgagccatgtctcgttgaaaaggaattcgcgttaatgtttcagataccagaggcaaattacctcagatgctgataagaaacgatctctttcagtgtattgctgcactttctccagaggttgtccagtgaaagctgcatacatcctgtcaattttctgcatgtacaaccaaagagatcaatcagtcaaaggttcaagttttggctccaaaaactcgatcttccatattcttaaagcaagaagcatgagaataaagagagagaaagagagagagagacttacttgtcgggcttcgatggcttcattgacctgtctcctcacgtcctctacatgtccctgcaaaattatgttagcatgaaatcaatgaagttcatatgcatataagatttccaacgagaatggtatattggtattgacaaggagaattcaagagccatactccgcatccagtttgtggttgatgtatcatgacacgagtatttggcattgcatagcgcattcctttttcacctccagcaagaagaagtgctccttggcttgcagctactccaaacgccactgttccaactttaggctttatctgaagatcattttcaagaaaattcaataggttaatatatcacagtttctaggagatgaaaacgttactaggaaaagaaaacctacccaagacatacagtcataaattgctaggacggagtaagtactgccaccgggacaattcaagtacatctgaaacaaggattacttccaagtaaatatgagactttacagaattgaaaaatgattgggaaaacaatgagctttcagctaaccaggatgtcggatttatcatcaatagatgcaagggttacaagctgagatatgactcgctgagcaacctgtgcgttaattggttgcccgatgaagattatgcggttacggaataacacagaagagaggtctaaaggtcctccaggggtcatcactgaaggcattactggggggtttccctttttcgcctctatcactccaaatctaaaacattgcaacatagaaacaaaaccagctaaatacattgaaattagaaaggttcagcgatctatcaaccaatttacaaccgtattgtcatcggttgacattagtactaagaactctaacaatcaatccagctaagagaaacagataaaactggatacataaagtacactgttgacgacttaagaatgttcaagataggaagaggcagtgagctattgcaatttctatggtgagaacataaaatggacacataatcaagaggcaaaacagaaaagagctgaccttggagccttgttgtcaatctttattggggatccagaaacattactagaaagtcctgaaaacatcaaacacaacccaatctcagaaacgaatcaatcaatccggaaactcttcagcatcaaagagcagcaagcagcttaattccaacatttaaaaaaacctaaaacccaaatgctttagagctagtagcagcaagcaaatgatttaaagttaccagctttcagagaatctccatatggactctgtagagcagaaactatacgtcttataggattcctacacaaatcaaaattcataaatttaaggtcagcataatcatttgagagtgtgtgattgcgtttagaaaagttagtagtacctttgattgtgagatagaaaggaagtgggtttagggtttcgagttcgagaagagaaggaaagaccgagaggaggtgaaattgctaaacccgccattaccagagctcagctttcagagtttttcgggttcaggcgtggatagatgacagaggacggcaagactcaaggttactgtttggccacgaactttaaaccgaacccaaccaaggcaacagcaacagtgacacaggtcccagagactcaggtgcactcagaaggtttcaaaccaaattataagcccaaatccatgattcaataagcccaaattacaaacttaatatttttaacatgattcaaaataggcccactgtatctgttaattttgtaaaattagagacggttttgcatttgtgaaaggaaacaaaaaaagagaggttgtgcatgttgttcaaactcttaattagtcattatgattcattagtcattgcttgaccacaacacttaattcacatagaatacatcacttatacttaattagcctttttgcattgactgattattttttgatgcaaatatatttctgttcctcatatgaatcccattgctttatctacaaattcatgcaccatttctctgtgcttttgaattgtgaaaggatcttctttgaatttgaataacaatctaaggtttagtcatttgttgccaaaacaaagatctaggatactcaattttaaaaggaatttaaacaatggtcaaaactgtgaacaaaaagattatggagttttaattttgtatttacgttgactgttgtcagagataaatatgaaacataaactttttattaaaaagaagttattcaactctctcctttagagttttaataacagtcgccggggaaaac

SEQ ID NO: 7257 - DNA, 3000 bp, Unknown
  misc_feature (1)..( 3000): cDNA_ID_2993855_gDNA_ID_1621135_Annot_ID_56546 3000 nt of promoter + ATG
attctttagggtatgttgagaatgtgaatacatttaatctggttatatattcgttttgtaaggagagtaagttgtttgaagcgttatctgtgttttaccggatgttgaaatgtggggtttggcctaatgttgttagctttaatatgatgattgatggagcttgtaagacgggtgatatgagatttgccttgcagcttttagggaagatgggaatgatgtctggaaactttgtttcacctaatgctgtgacgtacaattctgttatcaacgggttttgcaaggccgggagattggatttggcggaaagaatccgtggtgacatggtcaaatcaggtgttgattgcaatgaaagaacctatggagctttggtggatgcgtatggtagagctggaagctcagatgaagccttaaggttgtgtgatgagatgacgagtaagggacttgtggtaaatacagttatctataactctattgtttattggctgtttatggaaggtgacatagaaggagctatgtctgtgttgcgtgatatgaatagtaaaaatatgcaaattgatcgatttactcaagccattgttgtcagaggtctatgcagaaacggatatgtaaaggaagctgttgagtttcagagacagatttcagagaagaagctcgtggaagatatagtttgtcacaacacgcttatgcaccattttgtaagggataaaaagctggcgtgtgctgatcagattctagggagtatgttggttcaaggtttgagtctcgatgcgatttcgtttggtactttgattgatggatacctaaaggaaggtaagttggaaagagctctcgagatatatgatggtatgatcaagatgaataaaacatcgaatcttgtgatttacaattcaattgtgaatggattaagtaaaagaggaatggctggtgcagctgaagcagttgtgaacgctatggaaatcaaggacattgtaacttacaacacgctgttgaacgagtctctcaaaaccgggaatgtcgaagaagctgacgatatcttatctaaaatgcagaaacaggacggtgagaaatcggttagtcttgtgactttcaacattatgatcaatcacttatgcaagtttggttcttatgagaaagcgaaggaagttttgaagtttatggttgaaagaggtgttgttccggattctataacatatggaactttgattacatcgtttagtaagcatcgcagtcaagaaaaagtcgttgagcttcatgattacttgattcttcaaggagttacacctcatgaacatatatatctatctatagttcgtcctcttcttgatagagaaaatggaaggccttagtcaacaaagccaatgaaagcttgtttcagttttaggaagaaactactgaactgtccagagggtttgttttggaggtacggtacggatcagattcgtatcctgttcgtacacgtggacccttggacgattctttgtaatcaacggtcagtgttggaaacaggatcgcttgacgtggacctgtaaagcggggattgtctgacacgtggcgctaatgcaccggccaaacaatttggttgtcacgagctattacgatactttccacgtgatttgtttaagattagccgtccagattatgtaatgttggtagacaccgtaaggaatataatctgagaagcagacgaatattattttccacattatacaaacaaatggctgcgtgtgagagactgcgattgtaaaatctggtgttgttattttgctagatgtcaacaaatcagagcaccattggtttaatttcatgaataaaagccactgttatgataaatataataatattaatcaacacatgtattctctgaataaattggaataaaataatgaatgagatgagtttcagacttcggtgattgagaagtgtggtgtggtgaggcagtggagtcagggggctgcttcaacaacaaacattctctctctcttgtctaagcaaagcaacccatataagatatatacctgaagtacacgaccactttctttctccatctcgtctctctttctgtcttcttctttcttcggcagctatggaagtgtgttggcagatacagagaccagcgagtctcagaccgggttttcaggaaaagggtcgggtcaagatcaatactttttctgttgggttttttcctcgctccatttctagtgtaaatctcttttgtttcttctcgtctcaatttttttcgctgatatgtttgtatatctctttagattctacttatcgggaatttaagtgtaaagtgttctactttttcatagtgagatcgccttttcgattagtatatctttaattgaatcaatgtactatttttaaataagattcaactctggtagggtctctggattgggattctcatgttagaacctcgtttgaaattggtaagagtataggaattgacttaatttctctaggaaatgttcaatttcttctggtcaaaatcgtcacctcattgagaataccaactcgaggggagagaaatgattttggggactatgagctagaagtaagagtcagctgaagattcacagtagaatgaaaatgtctcatcttttatagtttgattttaatatccaccttgttttacttatagtgtgattagtttaggtgttcttggagatgaaaatgtctcattcaatatggttttgatttataaatggctaatattcttcttgtttattgctggtgtggctagtttatgtatttgttagagcttgtgaaccaggtgactgaacagttttataatcgatttctaaccatcagacatgtttggctttcagattgcttcattggaaagtcaatacaaatcaaatgggtttctgcatcagatcacggcaagtgcaggttaagaatctgtgataacctttcattgtgattactgattcagtccttttgatgatttcttattttcttaaccaagacttttcaaggaagaagcaaggaagaatg

SEQ ID NO: 7258 - DNA, 3000 bp, Unknown
  misc_feature (1)..( 3000): cDNA_ID_1378100_gDNA_ID_1621135_Annot_ID_56550 3000 nt of promoter + ATG
atagaagtcgaacttcttgcgggaaatcagggtaaaccaatattacaactcgagaatctcgtggtaaataattgtagaccaccttgatgtctatgtaagacgactataactcgaggatctcgtgggatcctacatggtaattcgatagatatattattaaaaagaacgtgagttttggtgaatcaaatgataaaaaatttatataaggataatattttaggtctagttagtttggtaagaattagctttgttaaactatatcttaaactaaataaatatctaattgataaaaattataaggatagtatttagtgtatattactagtagatattctattggattgcatagtacatatctgcaattagtattaaataacattaactattagattaatgcgtattacacatattttgatgaatgtaacgatttctagagatttggaattattattttttgtttcatacgctacgtaatctaaaagcttatactattaatttttattattgtaatcgtatatttaataatgtaagagagagaccaaaatttaatctcttttttttttcattctcgaaactcgaaaagcttaagaatttgcgttaaatactagtatttctattgagctaaatagattaattaacacaaatgttaattttgatactgccgaatctttttgtaagggttactggattaattgataagagcgacaccatgacagctatttttcgtctaactatttccaagcacttttcttaattctctgtatatatacagtatatcctattgttagggcgttaggatacattaatcgtactccatgattgttatcattaaattaattatccacttaaatttatcgatttttaatagacggtccatgtgatctcattatcttccatattaccatatctttgtttgtcatcctaaaaatttgtttcagcgtatcaatttatattagataagcatatattatgacgttagattaccaaactatttatcaaaaagagtagcaaagaaacagtttaccaaactatatatatatttaaactaattggcagtgaatataaaaccaaaattaaaaatttaaaaacatacattgacaaacaaagatatgatatgtctccacacgaacatatttttacaataaaagatttccaagaatcatgaactcataagagaactttttaaaaagaaaattaactaattaatataaaaaaatcttcacatcttggtaccggtgcgatctaaaaaaaataccaattgactaataaacatgtcttcgtataaacccaaaaacatgtcttgtcaattgtcataactcataaccggtctgagagagtcgttgtgtctaggccgatggtgattaatatctggtatcttacatgttatctatctctgtttttacacaaatccgacggatcagttcagagattcgatgagttttggtatagaagaagagaaactctagatttgttgaaaattctcaacatgataatccaaaacgtaacaggctcaataagataagcgggcctgaaaattaaaacaagcccaaagaacagaatcagaaactggtgggcgttagtgaaggaccactcctgcttgctcttggccttggctgcttagtgaagggaagggagagaattgccagagcagacgctaagcccaaagaaagtgtcaacatctgagttgtgcgacttgtgagacactaactgagaaaaaaactaattgtttatttatgttgaaaacagaaaaaaaaaactattctaattgaatattgtaagaataccgtgtgcgtaaacataaatgttatctaaagagattactactagtggttcctcgacatgcacacaattactttagtttaaagcttagcttttaacccaactcggcactactataaggtatggtgagagatcaatctcaagaaacaagaatattcgaagtctgggaactataatgagacaaaacaatctttaaaatactcgatcgcatgtgttgtgatcacgagctcactacgactcagtcactttgttctttctttaatttagtaaaaaagtcgagttactttgttttctccgtcttaaggcattagccatataaatcgcatcattgtccggatcaactcttgagtttaaaaacccacatagacataaatttggttcgtagtggaatcaatccgaatatatgttgtgattttacgcagaaaatgggaatttacattcgtcaaaatttgagttatgttggatttttacatgaataatactattgtgcaataacatatactacaactgaacataaattttaatttttgtgtcaaagcatataccatcaacgccgttggttttacttttgttgtaacgacgtcgttggctggttaatgaatatgaagcttttccgtaattataccatcaacgccgttggttttacttttgttgaaataatccaatcatattactagaaaaaaacaaaattgccacatgggtgtgttttcactttttactttttactttttacagttgaattttatattaaggaaaaagtcgaaatgaaatagtaaatcgaaaacaaaatcagagttaaaagagtaaattcaggtgagagaaatcagcttcaagcttaagagagcttcgaaagcgaaagcgacgatttcttctccatcgtgagagcaaatctccagagccgttttctcttcttcttcttcctcctcgcgccgtctctgaaactccatcatcgtatcaatcaaattgcttcctcctccaaagtaagcttcttttcgattctcaaccaatcatagtagtagtgtgcttctctcttatcctctgttttctaagttttgtatcaatctccacatagcttttctcgttctattatcgtagaaactcttaaactatagattagatcactcacgattcaatcataatcaatctggatctgaatctaattacgcatcgtgattcaaaatttgtgtttttttgtgtgtgtgtgacagttgaaaaacaatg

SEQ ID NO: 7259 - DNA, 3000 bp, Unknown
  misc_feature (1)..( 3000): cDNA_ID_2168750_gDNA_ID_1621135_Annot_ID_172647 3000 nt of promoter + ATG
ggacgaaccaagggctcaaatctctcttttgagaaatcaaaactctgtactgaaacgggtttatgatttgacttattgtaagctatccaataaggagttccttgtaaacacacactcgactatggttatcaatataaaccattagaggtcttatcaacagccgtcttccaagaatcagatttgaatgagtaaacttcaaccgttgaacttaaatcagattcaaactcataaaatgtaattcctatctgtttcttgaatttgaaagtaaaaaaaaaacataaaatatccaaagatagaaactgagaaatccttaaaagaaaaaccgaaaatgttccaaacaatggagccagcttctttgttcttattctcatctcgaaaagcctggaatctgaagcaagctctgaatatagcagcaatcactgagcatgggaccaagaccagtgaagtattcaaatcttttgaattcttgattctctcccccaatgtagatgctaatattcctgcttttgatcaataatgcaagcctaccatttctctcaatgaaggaactgaaatattttccatatatcgcatcttgaggtacatcaactgtcatcagcctgctccaatgctgcttcttcatcacccataagtgtaacttacatgtttcgtggcattcaagtaacaaagaaagttgatctcctctgaaaatccctaaagagatatactttaccaaattacgtgacccaatggattgaggaggaagaaacaagggctcaaatctctcttttgagaaatcgaaactctgtatcgacatgagttcattaccagatttattgtaacctagccaataaggagttcctcgcaaacaaacacttgacaatggcaatccatcgaatccaccaaagtttgtatcaacaacaaccttccaagaatcagacttgaatgcgtagacttctacccttgatgaatttttaattccacaacgaaatcttacaactttgtaatcataaaaacctgatgattggttaaaaaggtatccaagaccatacgcgtccatggaatggtcaaacccttcgctacatttaatccatctcttttgactcaacaacggattcgcaaccaaaagcatacttttagtgacgtatagcaatagaccgtcacaatgagatatattgatcgctggtgaaagagctattggaaaaggcaatttcacaccacaattttctggtttgttgaaatcgatacctacataagaagttgtggaaccgaacaaaggagaaactatgtgttcgttgttaaagactgtgaattgttgctcacggtaacgcatgtgagacaagtgcttgttgacgaatctcggctctgcgattagggcttcccactgcttgcatgtggatctcaatcgtacaagagatctcgctggaacccgtgagagtatctcctctaccaaatcagacgaaagatccattgtagccatcgtgatcagtagttttttattcttctttaaaagggagtttgatgggatcggccatacgaagatctaggagattatgatatttgttaatatcttcgtttatgaatcatgattattcatatttatctctaatttttttatttttatattatgtttattttaattagtaaaatgatttgacatttaaatatgtaaagtcttggataaatccaaaatttaacaacaagtacaatgatcctactatattatttgggaagtacattttaaatataaccttaatttttgtaagtaattacataggtatgccattagaaataaaattttaaagagtaaattaatttatctctttaaagattaaaaagtcaaatactaatttaattaatgaaatttaattaaaaacgaaatacattattaattttcaaaaataataaccaatcaaaatcaacatataagatttgatatctaaatttaattctaaaactaacttcagtatattattattttcttacagaagtacaatccaattcattattactacattatcattatcatctaaactgattctaataaaactgatggttcttattcataaatacaaaagtcaaaaggtatatatcaaattagtaaaactttacgattttaatattctaatacgagttgttaaaaagaacgtctagttccaaacactatagtttgtatactattttctaagtaaacaaaaatacagtcaaaattataactactatcatatgtcagctagctaaacttattctcatgattataatgaaacaattaaatatgatttttttttttttttttttgtcgtaacagttaaatatgaattaacaaaaaataactgtagtgttatatattactaacgtacacaaacattttttttccccattaaaaaggggtaattgcaaggccgaatggcttatgacggctacaagcccaaacacaaaagaaataatccagagcaaaaatcagaaaaggcctcaggcccaacaagctaaggtaagagcagagaataaaatgaagaaatgaaatgaccaaaatgcaaggattagttgttcaaaaaagacgactagatatagttgcccactggcactgagccactgactatagtacttttttactcttcaacgtatggacaattcctatttgaaaagtagccactgacgatagccactgactataggaatcatactatggacaatttctcactattcatgctttgtttgttcacaaaaaacgatgagttccaataaaccctattaaataacaagtagaactagttccaataaacccaaaatgcaaggacaagttgttcaaaagagacgactagatatagttacagaaaactgactataatatttttcacgtttcaaatattttttgtttcaagtattttttacttttcaacgtacacaattatgcaatcaaactattcacgctccaataaaccctataaataaccagcagaagatgagttaaaaatcacaaatcatacactttcattttcatacatgagcaatattcaagaa

SEQ ID NO: 7260 - DNA, 3000 bp, Unknown
  misc_feature (1)..( 3000): cDNA_ID_3050109_gDNA_ID_1621135_Annot_ID_172644 3000 nt of promoter + ATG
cttcagattccaggcttttcgagatgagaataagaacaaagaagctggctccattgtttggaacattttcggtttttcttttaaggatttctcagtttctatctttggatattttatgttttttttttactttcaaattcaagaaacagataggaattacattttatgagtttgaatctgatttaagttcaacggttgaagtttactcattcaaatctgattcttggaagacggctgttgataagacctctaatggtttatattgataaccatagtcgagtgtgtgtttacaaggaactccttattggatagcttacaataagtcaaatcataaacccgtttcagtacagagttttgatttctcaaaagagagatttgagcccttggttcgtcctcctttttatctttcgagtgagttatcttatttgatgaataatctttctttagggattttcagaagagatcaactctctttgttacttgaatgcggcttaacaagtaacatacacttatgggtgaagaagaagaagaagaagctgcattggagctggctggtggcagttgctataacagatcggcttccgatatatggttgtagatatttaagtttcttcaatgagaagaatggtaagcttgtggtatttatcgaaagcgggtatattagcatctacattgagggatataagcaagattgccaaaaagttgaatacaacactgatatgggtcgtacactcggtggttgctgttatgttcctagcttgctttggcttccgggcttttcagaggtgggtataggtagaagaagaagctggttccagtatttggaatggctagatatgatgcttttatttttttgttttggagaagaatgtaaatatcattataatgaagagttttggtcttacataagcttaacctgatggacattttcatgaagctaacatggtcccatgccaacaaaagacattcgagattcaattcatcagcaaggccatgaagcgattaggctcatcgtttccgatatattgaaaaatgttacattccatttatatacaacatgttcaaaaaaattcagtaagaaaattgataattcaccagcaccaatccttagagagatagcttcttaatctcaacgacaagattctcttcaaactatatcccctttcatttcaattttgacagatgatttcagctaaactaaccaatctcaaaaacttcaaatcctcatgtcaaatcgaagatgaatgacttcttctatgtgtacctttgttcactgaggcaaaggcaatgcagcttcgacttcattccacaagtccacatttctggtaaacttctctttaactaccgcaatgagctcctttgcttcatcgacctttgaacgacttgctagtccattaacaagccacttcatgacactaaaactcggaacccaattcttctccatactctctctacaaaggatcaaagctgtctcaaagtcccctcctttacacaaacaatgtatcaaagtgaagtaacattcactatcaggcttgtatccattacacaccataacctcaaacaaattcatagcttcatccaaattctcctcactgcaaaacccatgaatcaaaagcgaatacgtcacagagtttggtctcatcctacaagacataaccccatcaatcaacgcctttgcttctgcagatttcttccttttacacaaacattgaatcataatgttgtatgtagctacaccaacatgaacaccaaattcatccatcattctcatcactttcctcacttcatcaaacttctcctccttgtaaaaaccatcaatcattaaaccaaagctagcagctgttggctttatccatttcctctccatctctgcaacaatggagtatgatgaactcgttgaacctgattcacacaagactctaatcattctattgtaagtttcgagatcaggttcaatgccatacatcttcggcatttcgaggtagacacgattcgcttctttgtaatccttagccattaaacaagcgaaaagaagagcatttagagacttcaccgtccttgggatctcgtattgctcgaggttgcgaaatgtttgtatagatcgatcaagcatattcgctctgccgtataggataatggcacggactgcgaaactctcggattttggatcgggttggttttggatgaaaccgtcgagaagctgcgatacagcgacgaagtgtttctctctcgctagtgtcaccaccgcaacggagaagatgatacggtcgacgtgataatcaggtgagagtgaagtggatcggcagatttcgaggattcgatcaggattattctcggatttgagaagggagagagtatctcggctcttcttctgcttgctagtgagagattttagtgtgaagatagatgaagaagaagacttcaatcggaattgagtcgctttctggagtataaattccgatgttcgaatgcggaagaggaacgccattactagggttcatgatttccccgaagaaatggagacgacggctgagagagaagaggtttaaaccggtttaggggtttgacaaaataaaatttttaatttcaatggtttacttaaatcatatacataattcatatcatccgttgattttatgactagtcagcaacttggacggttccgattgaatctaggatattttttaaaaagttaaataaaaagttaaggatcatgtttaaaccgggggtttgaacccgacgtgaatcgaacacgcaaccttctgatctggagtcagacgcgctaccattgcgccacggatcccttgtgattacaagcaccaaaggatatttatatagtaaaacacatatcgttttattacaaaccgccgccttctcaaagggttatcaacaatctctcatctttagcattgttttgttatcttcttcttcatcacaatttttctacggtcagagattcaaaagagttctttctctctatcttattctccgatcatcatg

SEQ ID NO: 7261 - DNA, 3000 bp, Unknown
  misc_feature (1)..( 3000): cDNA_ID_2168742_gDNA_ID_1621135_Annot_ID_172642 3000 nt of promoter + ATG
gcttttctctaggtgtgtgttgagtttttaactcttaataatgtttctgcgatgcttctgtttttaatgttttcatcaccttttgaaagaacgtaagcgttgattatattttagggttatgtgtttatttttgaatgttaaaagagtggtcgatgaatgataatcaccagagatcttgagcacaactaggctccagctttagaacagttggagtctttagaggtctatgtagaggcagtgtggtatacgtctctcaaatctcaagttgaacattttacatactatgaatcttggagtcatgtatgtatggactcatatcaacagctccaagctttgaaaaatatatttaaaataattgtcttgacccgttgtcctaaccaaaggacacataataaggagaatcttgattaatttagtagatcttgcaaatcgttgtcttatatctgagaccaaaaattgttggctccgaaacaatattattattttctcaagttcataacgttatagacttatagctttttcataaccgaggaaattagaattctttcattacaataaaaagaaaagtcagcgatttttcccctgctagatcagtaatattcctaaattatgtccattaattgaaatcattattcattaattataagaaatctatcaaaaaattaagaactcaacaaaactattgattaatggtttttccgacatggacacaaaggttaaaaccaaattccacatatgtatttttgggctgcaaactcgtaaattaaaatgctaaagtagtaaatgttatcttatacatgtaagtactatatatatatgacctcatttttgcaaacaaataaattaagatatttggacggcaagctcttaaatttaaatgtttacagtctaagatgttatcttacaaatatataaactatatgacctcattttgcataattaaatatgaacaatgatttttatatacaggcattaactataagattgttagctggaaaattcatactatcttatatattatcttaatgatttgacttataattaagtttaattgtcctctctttttttttggccaaaaagtttagtttctaataagaaattacataacttgagaaaaagaaaataagaaacacgtatacaagctacaagttagtgcaccagcactgctcaatgcaatgactacaaatacttggtcatttcaactcctctcctcatctctctctgatcacactaccttctcttccaaaagtcgtcgccgggaaaacacaaaaagacgaaaatgaccctattcaagaggccatgtctttactcaaagatggacaaggaagatccagaagaggtacttagccgacgagccaagttcttgatttacaaaacacttcaagaagccgacttgatttctcggcgtgatcctcattcgtcgtttatacggctgaagctttatctgttgaaggtcaagatcggaaagaggttggctaagctacgccggagtgtagtatccgccgttagatttggcggaattcgaaagcattctcataatggcgtgagagcgttgaagaagatgttccaaggtggtgcaacaactggactacctaggcctattttctcccttgaagtttgaaatttcatttatttatatttcttgttttgtgtaatttttttttcttttgtttccggagtttcttttgatctctattacaaaagtttatcaagaaatgtaatatgaagagatcatgagttttgtttctttcaaaaaggtaaaaaaaaatcttgaaataatcatttaactatatgatgatctatttttattttgtcaaattttaattatatgatgatgctaaaatatatataagacacacagattagtgtaaatgtgagttatgtttacttaatttttgtacctaaacttttttttttttttttttttgctaaagaacctaaacttttcaaacgctcatcaaagtggttagagatcaaatttaagtttgatgtaaatgtgagttacgtttacgtaatttttgtacctaaactttttttttttgcttatgaacctaaacttattattcaaacgctcatcaaaatggttagagatcaaatttgagtttggatattttggatagtcataaaaagcatggttggatagcttttttcaaatttcaaattagtaccacatatatggatacaaatcaagtaattcatgcatgttagcaatatgtaagttcaaacgacctaccttttaaagcgaaataaaatctcaagtcaaaaagttattgaatccgaaaatccgatcctactcgattgaaagtttgaaacatgtgggggcattcgtgcgacatcgtgaatcaatcttgcgctaggttgtccaaaaatatctctgggatataatatcaattaaaaggaattaataaggacttaaatgcaaatacatttttcttttcgttagcctttcccttgtctcttatttttctaatttctagccctttctctcatcttcttcgttcctcgttcgagaagtcatcggaggtccttcgaagtttctgatcatcggtatagtcttcttcatcattttcttcttcttattgtttgattagatttatccttaacgagcacaaaattcataatgcgtatatatatatacctaagatctcttattgttgatttgctagaaaaatctaaaccatagagaagaaatttctgatttcgtttagtgttaacgatcctgttaggattttagtgcgcattcttgtgaagttgatcttggttgtatcaaatttgttgaatgtttgcgttgtttctcagattgtttcgggtcgtgttcttactttctatggatacatggattaaaaatctatggtgcattgtttcgattcctttttaatcagtagattctcttactgtttgagattggttgatttaattgtggttctggtttcccatatgcagagattcttttcttcctttgagctagacgaaatcaggtaattgaggtttgttaaaatg

SEQ ID NO: 7262 - DNA, 3000 bp, Unknown
  misc_feature (1)..( 3000): cDNA_ID_1817148_gDNA_ID_1621135_Annot_ID_172641 3000 nt of promoter + ATG
aattaatggtttctgttagagttcgattgcagaaaggttgatagaaataaagattcatataaaaggcatcggaaaattatttgattaacgtttgtttcgatacgagtatactataagtttgatagaaatgtgccaattgatttaaactcattagtttcattttcatactaaaagtaaaagcattattagttaacataatttttgctttacaactttagttgatgtgacgctcttcttaaatcttaagcatgtaccaagagttgtcaatttcctcttttaacatgtttcaattttgatcttgtagttggagttggtatttctataggatacacatattggataaaataagagatacaaattgcaagttacgtgctgtgcaaaccatatccacatactaatctttgtaataaccagaatcttatgttggtagtcagtagtctatattttttctcgatctcatccatattcggtcaaagaacactcaataaatcatttacttgcatataaagatcaatgatttccctttttcaaattagatattaacagaaattattattgttatattattacaagcttaatattttggtatgcttacgtatgtattattatgtacctaatcggctaagatctttgtaagaaaattagttgagtacgtatattctttttcttcaaaatattaaatatatccatgtcaccatgtgacatcgcagacgaaatgactcgttgtttttcataattgccacgatacgactgccatatttccaacatatcttaactgttagcattggcacgaatttaatgcaatatcttcaaaatctgtaaacaaaaaaaaaaactacatactataatgtagtgttctttatctacgccaacaaacccaaaagatatctttgatttttatttttttggttggtttcccatccgtttatcttcaaatgaaactcgtaagagatttaatttaaaagtagtattgtgatagattcttgttgagatttaaagaagggttaaattgtaaattagtcactttttcaaacttaattagaaaagtagtcactttactattcataatttgcaaaatagtcatttttcactgtttgatttgtaaatttagattgtacatcacttttagtgtacaaatatatataaaaatacacagtgtacactttacatttgtacactaaaagtgatgtacaatccaagtgtacgaatcaaacagtgaaaagtgattgttttgcaaattatgaatagtaaagtgactactttcctaattaagtttgaaaaagtgactattttgccaacacaccctttcaaaaatcggggaggtttataataaaataaaatatatctaagagacataattaataactacagttgctttaagaatacataatgatacacgtacgtcgaccaaaaataagagcttttttacccacacagtcgcagaagatacttagaacgaaactaaaatattaaacgtaacaaagtgtcaaaattggaaaggttacttttaattgctctgtgattgtgtagtagtgtctggacttaatttccgggaggaagtacgttaaactcacgtgttctgctttgatttccgcgttcggcgtttcattccacaagtgttgtcaaaaaaaagacaagatgtaaatttttcaattatcattatcattattgttatcgttactaatttatgactagttttctattttctaattaatatttttgttgagaaaattttgcgacaaacaattgtcaaaagaacataattagtaaactgtgacaacgaactttttcaataataaaaaaaaaactgtgacaaccaagagtgaaatgctgtgattagaacttgtatgattgttgatcaaaaagaacttgtatgaaaactgttgcttaattagagaaaaagaactgaaatatctgttttggcaaaaaaaaaaataaaaaaaaaattgaaatatacttctctgtttctttttatttgatttttcagaaaaaaaaattgttccaaaagattgtttttttaggtttttaatgcaatacttattagttataattgataaattataaaattcaatacaaattattgaatattattggtttatagttattgaaaattgtaaaccagaaagaataatatatttaaaagtaatatttaatatgatttcttaatatttctgtttttcctaaaagatcaaacaaaaaataacaaaggaagtatatcatttgttgtgtgaatacttaacaagacctatatttaaggaaaagagaagtttgtgtaaaaaatttataaatatgtaatatctttatacgttatatatatatatatatagatatgtatgtatttataactagttttatagttgcattaaagtatatgctacaccatacgtttttaattaagtttatgatttaaggataaatgattaatttgtgtatttgttgaagttcgtggatatcaagccggtggtcctgataaataaggttatgaatttataatcgcactttgcaaattatcgggtacaatctgctaaatgattcaatccggcacatcccatcacaaggcttatctggagtaacttgtttccatgtacgtactagctagtcatatcggtaggactcatatgactctatatatatattgatccaactattcaattttagttactttttagcctaaagagtaagatacgattaggatcggttcaccacatgccaaacatgcaaacgcctattttgtgtaaacattttatataattttcacgaaacggatgttatgattaaaaaaagaaacaaggcttattttcctctttttcagctttgttttttcttcaataatttaaaaaatagcagacacggcaaaatcgcctttatattacacctactctctgagccaagtcgcagaaagatacagacttaaacgaagatagagatagagagagagacgaagttttgtttttattttttcataaatatttgttttctttttggatatttaaaaaaaaa

SEQ ID NO: 7263 - DNA, 3000 bp, Unknown; identical to SEQ ID NO: 7258
  misc_feature (1)..( 3000): cDNA_ID_1378100_gDNA_ID_1621135_Annot_ID_172639 3000 nt of promoter + ATG

SEQ ID NO: 7264 - DNA, 3000 bp, Unknown; identical to SEQ ID NO: 7255
  misc_feature (1)..( 3000): cDNA_ID_2992483_gDNA_ID_1621135_Annot_ID_172629 3000 nt of promoter + ATG

SEQ ID NO: 7265 - DNA, 3000 bp, Unknown
  misc_feature (1)..( 3000): cDNA_ID_1817171_gDNA_ID_1621135_Annot_ID_172628 3000 nt of promoter + ATG
ttaggaggagcttttgtttggtttgtgaaacattggagaaagttttggtagattgtttcaggcggaggttcgacggcaagagaagtagagatgaaggaggagattaagaagagaattaaacaaaagatcttcatttttttttttttgattggattctatttggtgttttctgtagtataaatagttacatgtagtctttaaatttctgttgtgattcttatcgttggccatttttaggatttgttgtattggtcaaggtttctcctgttttttttttttttaatggtttaattgctcaagattttaatatagtcaagttaactatagaaagatcacaagtttcagaagtcaagttaactttagagattttaatatagtcaagttaactatagaaagaacacaatttgtttgaaggcattgtgagaaagataaatttttagaggtattggattaggttgttttgggaagagaataacatgtctttcaacctttatcttccttttttttgagggatcagttatttttgttttcatattagaacttgagatattaatgttctataaaacggtgaataaaagaccaaaaatgttttatactacaaaacaaaattatttttgattcaatctagagaatgaaaaaaaagagttacgaccatgacaagttatttgttattcaaaataaattttgttgaaaataatttaatgttcagaatatttgttctaaaatacatttagaataacaaatcttgaagcgattttacacttcgttctaatgacattaacaaactgaaaagatatacaaatataacgtttagcaatctttttacaaaaacataaggttatacttttcagctaataagagtagaagttattgtaatgatttgagaacaacatgtattttcgtgatgctactaaattaatatgttttgagagtttatgaattttgagagtagtgttgttatatgggatctgaagcatccaacatagcgaaacatcattcgttccatttttttcggtggcattctttcgaatttgcgtcgagtgtcacttttctatctacataaaccaaaattctaggcactgaatgtcaaaaaaaaaaaaaaaaaaatctaggcactataataaatgcaaggaggatgtatagctgatatatgatcttacaaacaaaaacacttcgaacaaaggcgagaacaagtaattaagcaatgtcaagagcttgtggcgcaaacgtaatgtttttttaataatggcatgttattttttgttcttgacgaattccttaaattgacatgaggataacatgcacataaacaaattgtccttctttgaatcattctgaaacttctcccttacacttttctttgaatgtaaagagtgattcttacatgaaaacaaagagtaataataatactttacaactatatcaaatcaaagatttgaataagcattttataaatattggataaacataggagagttttatcaacatccctaattccaatcatacatcttccgcatacggtgtatcaaagtactgtgatagatcccatcttcttgagcaacataattatacgagccaccatgaggcattctcttgtcttgaacatatgcgtcaaacttcttttgtaccttgtaatcagctcctttatacattgtacaccagaaaagtgtttctcccataacgtcatcgtggaaactaaaaccccaatcttctccaggtttcatatatctttcacgaacatcattgtccccagatttacaacgtaccttgagccatttgttgtgagaaagactgttcctgaataacaacgacgtcttttttcctttaaatggattcgaatggccatatgcattgctaatcatgcatagggcaaagacaactagaaagattgaagtatttttcattttttctttctagatgcttagaggttttgtcatcggagtaattttttatttacggtattgtatatatagacatatatgtatgctatttttgaatttacgttcttattatatattgctctcttattattagtattttctattaatgatttgcggtatcaaatcgtttcaaacacaacaatagatatggatggttgagtggagaacaatatatggatttagatctttgagtaaatatttccaaagaacatttgttttcaacacggacagtaatttgacgtgatacatttaccaaatactacctattatattctgccaattcgttacaaacagataaataattcgattagtatatacatatctatcgtttaattgtgataactttattattatattaacactaaagttgattaaaatcgtcttgatttcgattagatgttttattttataacattaaacacacatatttaaaagatgagaaattaaattgtatgtatatggaattttaacattaaaaaaaaaatccaaatgaccaatccggtttatgtcggtccggtttgtattaaccaatcttaatttcaatttttaccatataaacctaaccagactattacaatgaagaagaagaagaaagaaagtgacacaaatcggactctccgttcatcgccggtaagtttctcctctttatctccggcggttttgggctgatttttttagattctgtctaaaactgctctaatgattcaattccttcacgagtttacggattctatgccgtgaatttgaaccctaggtttgcgaaagcaatcgcgagttttgcaatttcgttaaatttctgtctcaaagatgtaatctttttgatcatttagcttccattgctaccgtagcatcttattctttccctgaggttttgagttctctcattctatgtgtagcgttaacgagaacgaattaagattttttgaggtttttagggtttcttatttccagatacttttgctgggatcttacttgattccttttgcagttttttcttgtttaacttgaaatctcatgattgatacttggtttgagcagttatttgaaggggagggatcaa

SEQ ID NO: 7266 - DNA, 3000 bp, Unknown; identical to SEQ ID NO: 7253
  misc_feature (1)..( 3000): cDNA_ID_1817179_gDNA_ID_1621135_Annot_ID_172624 3000 nt of promoter + ATG

SEQ ID NO: 7267 - DNA, 3000 bp, Unknown; identical to SEQ ID NO: 7252
  misc_feature (1)..( 3000): cDNA_ID_1690145_gDNA_ID_1621135_Annot_ID_172622 3000 nt of promoter + ATG

SEQ ID NO: 7268 - DNA, 3000 bp, Unknown
  misc_feature (1)..( 3000): cDNA_ID_2107289_gDNA_ID_1621135_Annot_ID_172621 3000 nt of promoter + ATG
gctgctatcatatccgaaagcatacgagcaaaagttctgataactctcgaacaagctacggttttgaatcaacctagtttcccccaagtacatgttacataccatgagcgtgtagttgctgtagtggttattggagatgcaaaacaataagccgtcgcagtgaaagagttgagatatcgcgaatccatcaaatgcacttacttgattcactgatgtgtcaacaaagtcatcgccgccatttaggtccagcttcattgaacagatcttgtcaccaatgaggataaaccctacgtgactgcttttccttgcggttgctttaccacctacaagattggttttcgatgaagcctcccatttcttgcacgttgatcggagtgatctaagagatgtaatgggaaccctagcgagaatctcgtctaccaaaaccactggaagggttgacatcgtcgtcgtcatttctctgaacttcagaaaaaccaaggactgttaggggttgtttcgtttttgggttcagtgtagccactagacaaatgtgttagtttacgatttaagggtaagaaatcttttctaaattggcaataaatgcttaatacagaaggaaatctggaaaagattttaattatttttggtggattttattccatctttgtatccctaatctacaaaggtgattggttaaaatgactaacagtaatcttgttcaaaaggacgttacacgaaacaaaaggagatgatgcaagaagaaaaaaaaaaattattgtaatcagtggaactaatttaataatctctctcgttacttttgcccggttgatagattcttcgtatatgcactaaacttggaacgtaagaagagaacacaagtggatcaaaataatatctaaacattttaggtttcgagatgtgatctgttccgattttcacaacagatttgtccaatgatgttaactgtttcgtatccacagttttcgttcggtctatacttacgagatttggaaaccacaacaactttcttctcctcgtcgatatagaagctctcaacacgaaatttactcgaaaaatcagagagcgatgtcctttccattgtgaagaacttggtccatgcatgatactgcattggactcaattttagtcgttatctccatgaccaagtccaaacataagtcgtagggttgatataacatagcgagctgctcttctctgatacaagatatatagagtcacagtctcttcatcactagagtgaaacggaagaggaagacgcggtccaaacctttctgatgtaaaatcaaaacagagtaaaaaaacaatacgatttgaaactgcatggctatctgacttctttttgtggagcataataataagtatttcccttcaaagacacaccgttgttgttgttgttgttgttgttgtttgtcgtaaccgaaagcatacatgtctaatctgtggaacttatggtatttgcttcttggttggatccacctgaattccccttaataagggttccacaccatgagcctccttctccttttgtgtatgacgcataacaatcaagccgtcacagtgaaatatattagatatatcgtattgatcaactatatatatttcctttaaagatggatcaacgaaatcgttgttgtggattccttggagatcaagtctcagggaacaaaccttagaatacattactacgaaacctagaaattgcttacttgtatctgctttaattaccaaaaacataattttccgacaaaacgttccaggataaagtgttccacgttgtacaagtacattgcacttcactcagagatatcaatggaactctagagaatatctctcccaccaaatctactgaaagatcggacaaagtcgtcattatttgttcgtctccttaaatgatgaagtgagagacgacacttgtatattctttgctaagaaccgtcatttgtgatcaaagaacaacttgaccaaatgatagatacttattgttctggtatttacaacattaagaactaattacaacttaatgaagaacagaacttgctggtctttgtgttagtctgactgtagaccataagtattagagatcttaactcattcattgatctgtaaataattcacagaactaacaactccttataaagcaaacaaaaaaggaccaatccaaaaacttgaacttttcctactatatacatcttcaaaattagctaacaaaagaaattaaaacttcaaacaagaaaaagatctaagaacaaaaatatcagtctcaaagattgcttgcggtgtacgtcaaagagagccagaagaagatatattaggttccaatctcatacttgaaccaaccttggtttcaagctttcattagtaatttcgagagcgagtcaaggtttgatcatccaatgggtggcttagcgattccttgtcctgaagatacctacatcactgcaaatccaacattttgttcttccgagttgaaaaatagacttactcattttaaacgtaggagtttttccccctcttcttcttaaagtttgaagatagaatgacaggtttttgcaatagacatgatcatgttcatgtcaatacatttaggatcgatcttagaaaaagaaagacaatagactaaaactagtcatctaaattttattgccaagagatgtacttcgaaaatgctagtatagattttagtctcttgacaataaaattttgtataaaatttgtctcctaaatagtatgtttttgtttttgttgtattccccaacagctaattctgtcttctggtatatgggtatacttcggttagtttcggtttgattacggttcacctttcaaatttaaacattgaaattgtaaaccatcttctttgtccaaaacgatgtcgtataataataacacgtagccgttaaatgaaaaccgaagcgtcaaaaaatcaaaatcgataaaaactaattagggtaaatgtcaacaacaatccgatttctgagaattgtcacaagtcgagca

SEQ ID NO: 7269 - DNA, 3000 bp, Unknown; identical to SEQ ID NO: 7262
  misc_feature (1)..( 3000): cDNA_ID_1817148_gDNA_ID_1621135_Annot_ID_56551 3000 nt of promoter + ATG

SEQ ID NO: 7270 - DNA, 3000 bp, Unknown; identical to SEQ ID NO: 7261
  misc_feature (1)..( 3000): cDNA_ID_1817144_gDNA_ID_1621135_Annot_ID_56552 3000 nt of promoter + ATG

SEQ ID NO: 7271 - DNA, 3000 bp, Unknown; identical to SEQ ID NO: 7260
  misc_feature (1)..( 3000): cDNA_ID_2992629_gDNA_ID_1621135_Annot_ID_56554 3000 nt of promoter + ATG

SEQ ID NO: 7272 - DNA, 3000 bp, Unknown; identical to SEQ ID NO: 7259
  misc_feature (1)..( 3000): cDNA_ID_1817134_gDNA_ID_1621135_Annot_ID_56557 3000 nt of promoter + ATG

SEQ ID NO: 7273 - DNA, 3000 bp, Unknown
  misc_feature (1)..( 3000): cDNA_ID_1989612_gDNA_ID_1621136_Annot_ID_57792 3000 nt of promoter + ATG
acctcttagctactgagagtggcatgagatttactgatggtcctaggtcacaaaggcatttattgaaagtcaatgaacctagggagcatggtagagtgaatgaaccagggtctcctagcttttctgagacatcgttctcctgtatgatggcactgcactcatggctcaaaactgttgttttctgaacctcttgaattctctccatgatcaagtctttgaggaacttttgggaatccgggatatgcgtgagagcatcagcaagaggtatccttaattcgactttcttgatattcttggcaaacatagctctatacttatcttctacctctttcttgtgtcgaccaggaaatggaagtggaggcttgtaaggaggaggaatgaatgctatctcattgtttttagcagcaactagttttagagcagcggatgatgttaatggattggttggtcgagtatcacggtcgagtatgggctcgagtacttcagttggtttgtcaacttgatcttcattgagactaaaatcctccccatcttgatatgcactatcctcagtgactgacttgggtctctctctagtggataactccttatggtgatagcatgaacattaacatactccttgggattctgaattgacttccctggaagtcccgtaactttgggagaagaggtagatgcggattctccttccaagtatctgactttagaattcaacgcctcaacttttgcattcaggtcattgtagctgcagtctagcttttggtgcaattcagatatctttttagcaatctcaatggagctagatacttgtccctgataagtgtgtattttgcaagttttgagcatccatttgtcatcactttagcatcatatcatcactgttttataccatttctcatcatttgtcatcactttaattacatgtttaggatagatttgcatgcatattgcatatttgcgttgatttcatgtgatttggagctgttgacgagctatctggaagaagcggacctgatcatgtcaaaccactcgaccccgaggtcgagtaggagcttcaagatctcaacagatcactcgaccccctggtcgagtagaggacatcactacttcaccacatcactcgaccccgaggtcgagtgtcttcatcccatcacctgaccatcactcgaccccgaggtcgagtgtcttcaccttcattgccagaccactactcgatctcgccactctaccttgaagtcgagtatctccatcaccaccactcgactacatactcgatggcaagcttcagagttttcttcatcccgcactcaaccagacactcgagcacaaggaagaaaagaagctattcactcgacctcccactcgactacgtgggttgagtacagttcttaatccgtcccaatacttcgtcgttttaagtattagggtttcggaatatttggctataagtagcatgtacttcacattttcgcagacaagtttttatctagttttattccgcagaccttgtgttctagaccttttgtaatccggatttttctttatctattcagtattcagtatttagtttctgttcttgatttcgtttactgttgttcattctgttatcatcctgctgttacacagttgttatcatgttttcaagttgttcaacgtttatgctttctgttatgatgtctgagtagtgaataggtttctgaggatgggttagagtagtgtagaattctcagtatgctaggtggttgagtattgattgatagatcccttctggattagttgttcttaatgcctattgctttctgatcaactggaatttgagcccagacatttccgcgcccaataggtgttcgatgaaatgtctgaaccactaatttcagagattcgtggccctgtaccaaggtattggttgcagggagcgttttggctttaacttgttcattcgtaatgcttgttaggttagctctcgtcaatggtgattgagtctgggactaggttaacttgagggtctctgttgcggtggcacttagatttggttaatgaacttgttgtgtagggtaatttattgagcatgtcaatcacttgtaaactgaggaaacgaaactactcgattaccccattctcgggaattctttatttgattgattttattgtttactctactgctgtttactgcatcctgtcatctgttgcttagtttctgcaattctttactgttactcgacctggtactcgaccacccagttgtctggcaacagactgtgcagtcgagtatccctgttacattttctgtctgttactcgacctgtcactcgaccacacccagtgctctgtaacgagctgtgttggtcgagtgtttatttgtttctgcttgattttctgttttctgcaggttcacttaggactgctagaacacaccaaaacctgttattgcttggcttgacttagtgacttctgatcacatcttgattgttagcatcacacccatttggattgacaaccttcagtactacaacgacatgatagtgttttaggtttaattgattaaaaacctattatcaatttggcgccattgccgattgggtgtttgtttgttacatttgagatttcagacttgcttagatcaagttctttttcaattttcaaatcggttgctaactgtgtgttttccttgttgtcttcttgatccaggtacacctctgttgtatgcgaactcgatcaacaggcaatcagaacctccttttcaacgacaacatcgaccacatagctcgcgaactcagagaaaggagaaacacagtcaaccttgtacctcagcaaccagtcgaaatggctgaagaatagaatcaacaaaatggccctgccaacattggtgctggagatgcaccacgtgatcaccgtcagaggaaaggaattgcacctcctgctatccagaacaacaacttcgagattaagagtggtctcatctcgatgattcaggggaacaaattccatggtctgccaatg

SEQ ID NO: 7274 - DNA, 3000 bp, Unknown
  misc_feature (1)..( 3000): cDNA_ID_1989609_gDNA_ID_1621136_Annot_ID_57795 3000 nt of promoter + ATG
agcaagtgtgtaatcttgaaccatgagctgattcaaataatccgagaaaagatcacgctgctacaataaatccgtagtagctttctcactctccttaccaacagtttcctcatcaccatgaaacagatttttacgcaccgtctttactgcgaccgcttccagccccaaggtggaggaattgttcgcagcaatttctgaaacatcaacccccaaatcaccagaaactgcttcaagcttacctgaatatgatcctaggaaagcatccatcatctgttgatgatctgagaggctatgactcgtctcaccaaaatcacagtaccaacccgtccagtgggacccagtcggtgctgcagcgcatcaaccctaacctctctcatgtgggcccttctagcccaccatgtaaattattgttgcgcttgacgtttctcaaacccaagacctcaccctttaacaatcttcccataggacaagttgttaccaattaacccacatgagagagattagggttgatgcgctgcagcgccaaccgaatcccatagagtgggttgttacaatcaccatcttacattttatatttttttaattagaaaattttcaaataaaacaatttgctgcaggatttaaattttataaccatcataattatctttttaaattttacatttttaatttaaatttccacataaaaatatttgcagcataatttaaatttagttgcaagtttaataaatatacaaaaatgaatattgtcaaataaatatttttgctacataatttagatttatctacaagttttataaatgtagagaataaaacattataacttcaaaagtattaaccgatgaagtggctaaccgcgattggtcgtttaaaagcttagttggacagcctgagaagcttatagcttctacttttctattttttaaatagtaagatgattaaaatattaattagtgagatgggtaatcgtgattgatcattttttgtagaaaaataagaaaaataacaaaataagaataaaaatagaaatttctaattaaaaaataaataaaaattgacatatttgccatctttgtataaaaaatattaaaatttaaaaatattagtcagtgagatgactaaaaatattaattagtggaatgactaatattacatagattccatatatttttctaagtttacataattactatattttaatataaaaagtaattataattgtaaaaatgttaatttgcaagtttctccatcacatgatgcgttaaaacttttaaaataaaacataagtatttataacattattattataacctcattaagtttttaattttgtttttatggttggttttaaagaatgaaaacactatattacaaagataaatagagttttatccaattaaattaatgttaaataagttatatagttattttaaacttcaatgggctttttaattattattattatctacactaaataatttttttttttaattacatgctaatttaattgaccaataacaaatattaaaagaaatttgttaattttccttattgttaataattttttccctcttttatatatagacatataaattagtatatttagacttattacgcttttttagttttttatacggtgattttgaaaattaccctatttttaagtttttatttgaaaaatacacttttccatatttttaattaaaaatacaattttaaatatgtgaaatgacaattatgtccagatttaaaacaaaagaattattttaaattaattaaaattaaatacgaatttttgaaaaagaaaagaaaaaacttaatttaaatcttaattattatttttaactattttttatatatcttaaatattaaattctaacatattttatcaaaaaatattttaaagtttatcacttcatatttatcacattatataaagaaattaatctaactccaaacacataattctttatttcttttgcttcttctttttcttgtaacaatattttcctttaaaaatttattcaagataaaattatatggaaaattgttagttagttattagcaaatatttttaaattaattttttttttgtgtcgacaaataaacaaaactgattttattttaaatataaatgttttcaaattattagtaaattttagtaaggatatttttgtaattttatattccatttatctcttagaaattatattttaaaagagaaaatatggataggttatttttcaaacaaaaacttagaaaagatcaggcattattccaaattttctctttttatatccaattaaattaatgttaaataaattatattgttcttttaaatttcaagggcattttttaattattattattatccatagtaaatgattttctttttaaaattacatgctaaattgaaatgaccaataacacatttagatctaaatttcttaatttttcttttttgtttagaaaaacaatttttattttattttatatatagatatataaattagtatattagatattttttttttttactttttgtatttttttccaaaaaacaaaacttaaatctcttctgacacatgtcaacatctgatcgatttatttgacatgtggtgcaatcttatgattgttttgttaacggaaatttaacggcatgtcttaaacggcccaatcaacgaaacttagctattttattgagaagtcaacaaaaacttcatgattattctaaatttaaaagttgaggctttttttttatattttttcctctatataagaaagaaaattattgagtctattgaaaattgaagcaaaaaaatggaaaaccgagaacgacgtaattgggctgagtaagaggccacgtattaaagcccagattgttatggtcggaaagtttaagattagagaccacttcacgcgacttaaacaacgaaccaaacctctctctgctcagcttttccgaccaaaagatccaagcgcaagatcaactcaaaatca

SEQ ID NO: 7275 - DNA, 3000 bp, Unknown; identical to SEQ ID NO: 7274
  misc_feature (1)..( 3000): cDNA_ID_3050138_gDNA_ID_1621136_Annot_ID_172667 3000 nt of promoter + ATG

SEQ ID NO: 7276 - DNA, 3000 bp, Unknown
  misc_feature (1)..( 3000): cDNA_ID_3050126_gDNA_ID_1621136_Annot_ID_172681 3000 nt of promoter + ATG
ggggtagcgtcttttcccacatataggctttatctccaagtgaaaatggaaacaagcgaagcttgaaaccatcttcactaactccattgattttagtatggccacagagcctttcaaacttgtcaagatgatctagcggatcctccattggtaggccatgaaacttgttcccctgaaccatggcaatgagaccgcttttgatctcaaagttattattctgtactggaggtggaacaattccatgacgctggttgtggttgtgagggaagtcaccagcaccaatgttggtaggttgctcttgctcatctacaacgtcagccattgtgtcggtttctgtgtgttctctttgttggcgagcaatactgtcgatgttatcgttgaataggaggttcagatttccttgtgaccgtgtatgcatgcaacagatagcagccgggatataatagacgaatcagagatacttctgtaaagcaggttgcaaggtacctgaaacacaaagacagaaaaggcacaatgttagtaacttgtgtaacaaaaacgaacttgatcttaacgtttctaatgatctcaaatatagcaaacaaaccctaaattggctacggcgccaaattgatagtaggattttactcaattaatccctaaaacactatcttgtcgttgtactattttaggatgtcaatccaatccggtgtgatgcaaacagatgagatatgatcagaaaactctaagtcaagccaagaagaaagttggttggttctaacattcctagtatgcaataacagaaatgaaatgaaactaaaagcagaaatggcaatagcaggcaagtgaatgacaaagcagaaatgataacaggcaatcaaatggataaacgattcctaaggatgggataatcgaatagtgtggtctacttaatctattcaggcggttgagaaaacttcacagaagctatccctagacaacaagttcaacaacagattaattcactcccgtgatagaaatcctcaagcaaagctagacactgacctaaatccctttagcgatctctaactaagcaggcattatcgaatcaacatgttaaagtcaataccctctctacagccaatcccttggggtagagtcagatatctctggaattaataggattcaacgcttaaacgccttatgagcgctggacgtctggactcatactccacattagccagtgaaacaagcaataagcgcaactaatccagaagggattctagtattctaaactcaacaacctaaaacgaccaagtaaaccacaactattctatcccatcctcagaaatacagttcactactcagacataatcaaagacaatagcaaagcaacgattgaaaacatgataacagaaatgacgaaagacttaaacgaaaacttaatatcaaatacttgaaagtgaaaatacaaagtcgcaggagaaacattgcggctatgaaagttgcgaaaatgtaaaagcgagataataacggatgccctagggaaaaccctaagaggcagtttatataagcgagaaatgaaacaaataaggaaactaaatatatagcgaatcttcacgtcatgatcctgcgaccgaatatgtcattggcatctgacgggctgaaatgagcttcctagtgatcgagtatgtcattgatcaaactgggctttaggggctccgtcttgcaatcgactaagatgcagtgaagtcgagattgaatggtccagcgatcctgtgatcgagtgcgatcgagtggatgtcatgaggtggtgatcgagtggcttcttcggcttctcttctattctttgttctcagcttgtctggttgagtgcagaaagagcagataggcttcttggtggtcgagtggtgatcgagtggttctgatggggtgattcctccggcttcgcgattgagtgaaactgagctgcttgcttctccggggttgcgatagagtgatttgccctggcagggctccgaggctgcgatagagtacttttgctgaaggcgtcattgggcattccgacttcatattctgtttttcctctgtttgaactccaaaagcatccaaaatacctgaaaacaaccaaatatgccatgcacatgcaatcctaatgcaaaatcgtcctaagtatgtaaaacacactaaaacgactcctaatgagatgatttatggatgaaacaatgacaaagtggtgaagaatgaatgcctaaatcatgcaaattatagacatatcacaaacacacatagtttttcatacgaaggaaaacgccttacgttattgcaatctcaaaagtgttctgagccattggttacaagtcaagatattgagaagaaatctgtgtctttggaagagacgaaacctgtactcttaataaataagtctcaactgttcgaagaacttcaagaggaggaagtagcatttgtgctaatgatggaaacaagtacagtctctataaattaatactagataaattaataatttctataaattaataaattcttccgattccgagttgggaccagtgtaaaaattgatacaaattgataaattaataagatagtaactttttttgaaaatcttatgtaaatatatggtcccatcaatattataaattaataattgtataaatttatgaatatatatatttatatttatgaatatatattatgtaaaaatttagtaaaatatgactctagtatttcttttatacaatttaaattaattttttgtagagttccgatctaatatttttaccaagtacaaaaagtttattttgttttaaacctaataatggttttatacttgtaattgattttaaaaagattattgattatatagaaaaacctattttttaaatcaaattttgtaagaaattacaaaaatttgtaaaatatctctatcaattaataattattaatttatcgataaattaatacctctttaaattaacaaatttttccggtcccgacattattaatttatagagtttttacatg

SEQ ID NO: 7277 - DNA, 3000 bp, Unknown
  misc_feature (1)..( 3000): cDNA_ID_2165569_gDNA_ID_1621136_Annot_ID_172686 3000 nt of promoter + ATG
tcgaaataggatcatccggggcaaagccaaaacgggagaaagttgcctcgaatacatggttgattgaccatatgtgcccaaaagctgataaacaatcaaagggcaaaacaaataactatttgagcaagaatgggcaaaggtgggcaagaatgggcaagattcggcaacacgggcgtgtcgtaggcgaagttgccctgccgggcgttaaccgccctttgaccacgccatggacgcatggaccggctaacttggggctcaagcaaagttgcttggagccgaatttgagttgcgtggagccaaagttttgctgccacgtgtcgcccaaccgttaaggcggcgagcgtgtcatcataggcggatgacacgtggactgctgactcgcccttgcgaatgacacgtgtatatgctgactcacccttgtcgcccctatataaacacaactcgacccaaataattttgagaggaaaaagagagggaaacaaaaggctgccaagttgttaagtgatcacctataaccgagaaaaaacttcccgcgattgagaaactttgcccgtgatgaagatcctttgcccccaactaaggaattcatgtttgtgatcaagagaacctgtttgtaaatgagaaatccctgtccgcgaccaagaatcgttgaagctaaccttaaaccttcagccgaatctctatgagtctcgaagcgtgtgatatggcacatgataggtttgagtgtttatttgggtgattgattacttgtttgttgcatgatcatatatactcttgtattcattgatttatttcatgaattatatgagtattgcttaatggtgtgaatgatggtagtaagccgcatatgagatcttttagtttcttatgcttaaggcttatggttgggaggttgtggtaagtaaggatattgatgattctatgtgtttgagtaaccatatgtctcataatatcttgaaatattgggtcttgatgtgtggtgctcgtggtaggagacagaaaccataagcgtatcaagatcatggtatgtctgacttcgttaatgaaccgtgctatcgtggggtcttgtaatgatgttacttgatcgccatgtagtgcgaagggctcggagagacggggctagctaccctggccgagttgtctacatgcctttgtggttgtaaagcgggagatcccgggagtttgtgtttttggtgtgggggtgtttgaaggcagcatatcagaccctataaaacttaataaaactggagtcttaattgcatgtgcatgtatttggtaggtgctttggcaatctacattttgttgttattctctgttgcgtgtttcgggatggggaactaatatctattgtaggtagactgagctcactaagtaatcttagataacttatcacaccatttttgttttgtagaaaaccctcgtgggaaccattagagggatgctcatgacgtaggaaaggccgtatagagtttgttgcttttgcaaaacttaatgattttggttcttgttggatttgagcgtataggctcgaggcgccattgtaaaaaagttttggatacttggttgtacgagaatttatatgttttaaaagattatttttgtataaagagtgtttcattcgatattagtcttgtccgggctaacacaactcacgatcatggcaagggttgaaaagcctaaaccgcgttcgtgagagatggttcatgtgggtaatcctgctaagggtctaaatctatttggaacctaaattgggttgtctgtgtgagctatcaatgtagtgtttctaggttgcccttatcttgttcggccatagagcgattcgggggcgttacagccgctgctttatcttttacgcttttcttcttcttctcattcttcttcacatcccaataacctctaacaaactaatcctcatgtatgtcttcgatcaagtgatcaagtgttgggtcttttacttcatctggccaagtatgaaacagctcgcttacattatccttcataaccattttatgcacatgcagctacaacacaagagaatattgataacacggctttttagcccgttttagctattgttttcttatgtttcagagagcatttggtgccattctagagccaagaaaagtagaaacacgtattctaggtgccaagaaggtttttaagagttgtgaagctaaaagtatcaaaaggcgatcaattccagtactttagaagtttagcatcctttcgaggttttccccatcacggcagcgagatatttcggtatgcatggaaagctagaagattcaagattaacgttgaagtcgaaccgaagctatccatgaagccgtttagaagatattacccgaagagtgaaaacatgtcaagaatcggccgtttggaaataatgaatccagaaagcatccggccaaggagacttgaacccgggcagctccgagaagcctatcaacgaccagtaggtcacgcccaagtccttccctctttgtgccaccgtcattaggcaccttcccttaagcccacgactcggcccgatcacttattcacctcgcggattgtcgttcttacccctaaacctatttcttggccctcaagtataaatacttgttttaagccctaactgatgtagcgtaatcatccatctatctctttattgggtttttccttttaagttttcataatactctcgttgggctttctttgttttgaatgacggtttagtgttgcttagtcgacaagctttcgtcatctagggttttcgtttttaggagagtataaatactcttattcttgtaagcttataacttggttgttttcgttttataaaagagaagcttttttcatctgaagtctttgagttcttctatcttttgatccatagatacttaagaaagcgagagatccgagctacgaacgaatactcttgatccattgatacaagagctttcaatcgtatatttccctacattagttggtatcagagacaaatgatccttcatcatg

SEQ ID NO: 7278 - DNA, 3000 bp, Unknown
  misc_feature (1)..( 3000): cDNA_ID_3088491_gDNA_ID_1621136_Annot_ID_172670 3000 nt of promoter + ATG
atagatcatccttttcttgaaaccctagtcgcctatcactctgcttatgatttttcgtatttcttccattttatcattatttgctaatgtgttttaatgaaaatcgcacaaaaactacctttaagttacaaatttatagtaagaatatatgtttgggttctttaattcaactctctctctctctctctgaggaatttcaacaaacactttgtggacgaatctaaaatttgtaaagagacggaatttgactaagactatgatggatacaataagagaagaagaaacccagaaaaaatatatgaaaatttcaactttatgaaattaaaggaaaaactgaatcgaaatctggaaaatcttcagcttttaagatctaagaagagaaaagaaaagaaaaacttagatctactttttggtgtttttgatgagagagaagagagaaaaagtatggaacaattgtcttttttctaagaataaatattgcaaatgttttgtatttacttttgtaaagtggagagaaagaaaaatgaatgaagagagaaaaaaaataaaggttggtaaccatagttagtttggattagttaggttgggttgagggtgtagtagtaaaaaaacttaaaataaatgctcactacctctaaagtaccccatagccaaattaagttttaaaaaagtgtctcatagcctaatattcccttagttttacttatgatttttttctccaattaatttctgcttttaaatttactcaattatattaaaacaaaactaggattaatatatgcaattaaaatatacaaatctatacaaaaggaaatacttaacattttgtgtatctattaagatatatatatatatatatatagagagcataataaacataaacattagaaatacataaaataaaaatttacctaatcttgataatcattaatacactatcgtttatgtaacaatataaaaatagaacaccttcattatcgtcaatacattaaaattatttaataactgttttgtcctgcatatagtgcaggttgtttatcaagttaataagtatctaataaaaaaaggtcacattggaaaaatacacttactctattttcaattgttttttataggctatttttagggttgtcaaaatggtttaagtttcatggatcaacccaattcaactcaatccatgaaatctaattagttgaaatatttgactcaaatgagttgatggttcaaataagttattgagtcaaatggttatattgatcaaataagttgggttgcaatgaacccaccaattttggttaaaatgaattaaacaaacttaaatctctaaaccgatatcaatttgagtttcacaaaatttctaaaccgattgaatatcaaaaatcttttttcaaatggcttcatccacccatccgtatatttattatcaactaaatatcatcatcatcattaccctctcataatatcatactaccatcaccatcatcatcatattatcttcatcataatcatatcaacatatcatagtcatgatagctatcatcatgatgataacattatcataaactcttaattttcccgccaaaaacattaactcttaatttttttgccaaaaaccggtaaacccgtaattttcccgccaaaaacgtaaacccataattttcccgccaaaaaaataaacccgtaattttcccgccaaaaacataaacccataattttcccgccaaaaacataaaaccgtaattttcctaccataaacgtaaatccgttagtcaatcataaagctcccgcaatcgcacctatttttaatcgctaaactagtcgttcaaaatattttataaagcttgaaaccgtaaccgttcgattccgtaaactcttgcagtcataaccgtaaccgctgcgtttcaacaagtcaggcccttagataagttttcttagtcatgggcattcggttatccattcagtttcagtttgtatccattcggttatcggttctttcggttataaagtatagtatccatttggttattttgaaattttggttcggttttggtttggttccggttcttttgcttttttaaaatttaatatccatccggttatttttctatgaatatttttagatattttggttatttttgttattttcatatattttcggttactttcgagtatttttactattgtatatatatttaattatttagtttagaaataactaatatttttgaaattataattatatttcggatattttcggttacccaaaatatttctgttgtacccaaaatgtttcggttctttcagttatagaatttaatatccatttggttattttcaactttttggtttggtttggttcagtttgtttgcatcggtttcagttcggtacattcagttcagtttatttgctccggcctaagttttctagataaggaagtttaggcccatgtttttatatagattttagttttgaaagtactttggtggagataggccatgacacctcgttaaaatcaaaatccaatcagaacatttcgattaatacacctcatttacgttgtccaattcaaacttactatttttcagcacatgagagattcttagtgtttttttggtattgattgatgtgaattatgtttcttttacgaaacatatatttatagtgtttagtattgggtcacaatttataatcgttaggaagcatattccgtattatgattttgcgaataagattagtttcttaaaaattctttaatgtataaatttattatcgtaattaaatgttgccgagtttgaaaatggagaataatgtgttcctcaagttggtacaatgttcactcatactaattgaatgacaaagttttagttgtcatatataaagataggctatgttcttttacttaacggagcggcaacggcaaaaaagaagaaaaacaattaggcaaagagaagaaagtacagtgatgagagaaaaactgtcgcagaagatgaacgccgatg

SEQ ID NO: 7279 - DNA, 3000 bp, Unknown
  misc_feature (1)..( 3000): cDNA_ID_2165457_gDNA_ID_1621136_Annot_ID_172658 3000 nt of promoter + ATG
ttctctggatttgaatgccactggggacagtgtcgtttaagtatgggggaggttcttactaatgatgcttttatttttgtttcttatcatttttcgttttgtagttcatttggttatttcctttatttcctttttcaaaaaaaaaaaaaaaaaaaaaaacgttttctttagtttagttaggaatcatgatctatatttctcttgtttattgcctgattgatgagtgctgcaggttcgagtcaatccgactattggaaaatctagatggcaaaccaacagacttgaggatatcctagtttccaactcaaccactaaagctggagctaatctgctcttccttttacctcttcaaacagttagtattcatagatcttgactccttgttcatagctgttatggagaccaatgtgataaaaataatatgttcctctcctcttataaaaagaaaaatataatgagagattgagacgactttcagatagtgtataggggtaggaatgtttcctatgaccccattattatacattatttggaatgatcaattacaaaggttggaaaatgccgagggtgtcgatcaagtatgcgagttcccctttgtttactctctaaaaagaataagtctggggagagaaagaacaccaaaaaagaaaaaaaatataaagaatggtcaaatgttcatggtatagtacatgaatgagtctagaaggatcttgaatgttggcttgtttgatgagacccagcgatgaaagcctggtgggtgtagttgtggaatttaggtatggaatctagaatgttgtgtaagcttgcagagaagtacatgttggtaaggatttgattagacttgttaggcatatggacttagtttggatgatcatggcaataggctagagaattttgggagttcctttgttttcaaaacctcttccacgggttcggtttttgtgtttcgcttgagggcaagcaaaagcaaattctaggggagttgatataacccgattttcaccgattttatctatgtttaggtataggattttgagtctttatgttatttctcgagtctttctagtgtcttttcaggtattctatgcagtgggacaacaatggagataagtagacattatctggagcaaaagctaaggaaaaggaagctaaggacgattttggttcaggaatcagcgaggagtgtcgatcgacacactcttggtgtcgatcgacagcagtttcggcccagcaaaaacctagacgctttcgagtttacagaagctcaagtttgccccagaagatttccttatttgcattattagtcccttgacgtctttagggtctatatatattgtttttagacctaagtttcttttatcaagtcttttatcaagttctttgccaaccctattgtgagagatataagctattcatccattgttcttgagagtttcattcagatctatatacagtgaagagatcccttctttccctttctctatctcaaatattttgtttgcttcatccaatatgtctgagtaatctgcttgttaggaatagggtttctcattagggattcatatggtttagtagattgccccctttgctaggttatctgtagaattcttcatctttaattatgcctaatgctagatctagagtaattaactagatcttgaatctagacaatagatatgcccgccataggtatctggtgttggatctattatttgatgagtctggtttataggtgtgtaataagaatcggcctatctactaagatgaccaattgaactcgttaagaatgcatatttaggttgatagtttatcggcttctccggttataattagctatagatatagggagtttcgcggcacgcccaccagttattccataattagagtttgagtttaagaatggttcgttaacaacctagctttcactagatctactaaccaatagtttcctgagaatactctgttcctagctctttattaaatcgttcacaaccaaatcaatttgctgtctttttactttgttctcttttattttcactattaccctgctagcttaatctcaatatttaactcattgtttgaacaaaagaactccgtgaattcgattctaaaatactgcaattgatctcttatttgagagagtagttctaggttatttgaaccatatcagttaataatttagttcttataaaaaaaccagaatttaccttaaaataagtagtcattggcttagagacttgagagaattcataccaagaaagactctcccaatcacaaatatttcctttagtgcttgagttttgttaaatagaaaaaaaagatcttcatagattagaaaatttaaatactctttaagaaaacgaaataacaaagtttaaaaatgtttccatataaatagttgatatcttaatagatttaattaaataacatcactgcaaatattctgtcaatcttttctggccggagaacaaagaaacgagcacataactaggttaacatattatagaaaagtcatttctcataaagttttgagtgtttagctatcacgtttttactggtatcttttatttgttcttcatgtcaaaaagaaaaaaaattcaagaaactcaatcttcagatttgtctaatgttattcaaaacacaactgataagcggttcagacatgaagaaacttctgaaaatacacccccgtcattcaatgcaccaagtgtgaagaaatcagtgccagttagttatgtttttaagagcgttctaagtgatattacaaatcaaagagttcatacaccaagcattagccaaacgcctggcactttggagtcatctttaacatcaaaaacaagttaagtttactgattaatctataatatatatttaagctttagaggttgtcctctataacataactacatttaacaagaattatttatgaaatgttaacaatgccagcaggaatcgatctttcaagttctatttaatcatatcgaaagcatttaacatatg

SEQ ID NO: 7280 - DNA, 3000 bp, Unknown
  misc_feature (1)..( 3000): cDNA_ID_1989607_gDNA_ID_1621136_Annot_ID_57797 3000 nt of promoter + ATG
ttctagcctcttttgtgaaaaccctaaatatgttcctgaattaatgaccgtcaacacacatccaccaaactctgaccatgtggtcatttcaatcatttggaattatcgaccatccatgcacatccacctaactctgaccacgttgtttgcataatagtaatttgcatacaaatgagaagggaaaaatagtaatttgcttatagatcatccttttcttgaaaccctagtcgcctatcactctgcttatgatttttcgtatttcttccattttatcattatttgctaatgtgttttaatgaaaatcgcacaaaaactacctttaagttacaaatttatagtaagaatatatgtttgggttctttaattcaactctctctctctctctctgaggaatttcaacaaacactttgtggacgaatctaaaatttgtaaagagacggaatttgactaagactatgatggatacaataagagaagaagaaacccagaaaaaatatatgaaaatttcaactttatgaaattaaaggaaaaactgaatcgaaatctggaaaatcttcagcttttaagatctaagaagagaaaagaaaagaaaaacttagatctactttttggtgtttttgatgagagagaagagagaaaaagtatggaacaattgtcttttttctaagaataaatattgcaaatgttttgtatttacttttgtaaagtggagagaaagaaaaatgaatgaagagagaaaaaaaataaaggttggtaaccatagttagtttggattagttaggttgggttgagggtgtagtagtaaaaaaacttaaaataaatgctcactacctctaaagtaccccatagccaaattaagttttaaaaaagtgtctcatagcctaatattcccttagttttacttatgatttttttctccaattaatttctgcttttaaatttactcaattatattaaaacaaaactaggattaatatatgcaattaaaatatacaaatctatacaaaaggaaatacttaacattttgtgtatctattaagatatatatatatatatatatagagagcataataaacataaacattagaaatacataaaataaaaatttacctaatcttgataatcattaatacactatcgtttatgtaacaatataaaaatagaacaccttcattatcgtcaatacattaaaattatttaataactgttttgtcctgcatatagtgcaggttgtttatcaagttaataagtatctaataaaaaaaggtcacattggaaaaatacacttactctattttcaattgttttttataggctatttttagggttgtcaaaatggtttaagtttcatggatcaacccaattcaactcaatccatgaaatctaattagttgaaatatttgactcaaatgagttgatggttcaaataagttattgagtcaaatggttatattgatcaaataagttgggttgcaatgaacccaccaattttggttaaaatgaattaaacaaacttaaatctctaaaccgatatcaatttgagtttcacaaaatttctaaaccgattgaatatcaaaaatcttttttcaaatggcttcatccacccatccgtatatttattatcaactaaatatcatcatcatcattaccctctcataatatcatactaccatcaccatcatcatcatattatcttcatcataatcatatcaacatatcatagtcatgatagctatcatcatgatgataacattatcataaactcttaattttcccgccaaaaacattaactcttaatttttttgccaaaaaccggtaaacccgtaattttcccgccaaaaacgtaaacccataattttcccgccaaaaaaataaacccgtaattttcccgccaaaaacataaacccataattttcccgccaaaaacataaaaccgtaattttcctaccataaacgtaaatccgttagtcaatcataaagctcccgcaatcgcacctatttttaatcgctaaactagtcgttcaaaatattttataaagcttgaaaccgtaaccgttcgattccgtaaactcttgcagtcataaccgtaaccgctgcgtttcaacaagtcaggcccttagataagttttcttagtcatgggcattcggttatccattcagtttcagtttgtatccattcggttatcggttctttcggttataaagtatagtatccatttggttattttgaaattttggttcggttttggtttggttccggttcttttgcttttttaaaatttaatatccatccggttatttttctatgaatatttttagatattttggttatttttgttattttcatatattttcggttactttcgagtatttttactattgtatatatatttaattatttagtttagaaataactaatatttttgaaattataattatatttcggatattttcggttacccaaaatatttctgttgtacccaaaatgtttcggttctttcagttatagaatttaatatccatttggttattttcaactttttggtttggtttggttcagtttgtttgcatcggtttcagttcggtacattcagttcagtttatttgctccggcctaagttttctagataaggaagtttaggcccatgtttttatatagattttagttttgaaagtactttggtggagataggccatgacacctcgttaaaatcaaaatccaatcagaacatttcgattaatacacctcatttacgttgtccaattcaaacttactatttttcagcacatgagagattcttagtgtttttttggtattgattgatgtgaattatgtttcttttacgaaacatatatttatagtgtttagtattgggtcacaatttataatcgttaggaagcatattccgtattatgattttgcgaataagattagtttcttaaaaattctttaatgtataaatttattatcgtaattaaatgttgccgagtttgaaaatg

SEQ ID NO: 7281 - DNA, 3000 bp, Unknown
  misc_feature (1)..( 3000): cDNA_ID_1817235_gDNA_ID_1621137_Annot_ID_56563 3000 nt of promoter + ATG
gtctatgtttaataaaagagttgagtgatatgatataaaataatgggagaaaataatgatattatgatattccagaaccaaaaggtgtattttttgttgttgtaattaaacatcatttattatctatgttgttgtaattagccaattaacgaaatataataataaataatgataaaaattggaccagctttgttttttttcatatttgtttttcttttccgggcaaggaccacttatggttaccgtatcagctgtcttgtatgtctcattctgtcaattttaggttacaaacacgtgcatgtacatatcgtagtaacatatgagtccatacaattctagtttcttttttttttaaaagacttcgaggttgatcatcagagtaggcaagatttttttttatgatacacactttgtcacagtccatggtcactttgaaacttttaattcgaaaagaaaagtttgttgcatcatgcaagggaagcgaaaaaaaatcttctctcgcttcaataccagattgagaaaatggatcgaaaatttagtttttaattaaccgtcttttatgcatctatgtttttattcttctttgccatagatccatatgtatagatttcaaattttatgtttgtaacctaaattttgttcattttcaatgaaatatttacaatttaacaaaaacaaattcgaaaaatacaaagcatcaacttaaaattcataggcaaaaggcttttttttttttttttttcaaaagactgtcttgttattatgaaaatgtcatttaaataattttgaatgctagcttttagctatctaacctagtggtagctagtaaccaaatggacattaacttagcttgtttatcataatttatctaagatcgatcgagagtgttattagacatttctttgaaacatcgcaaaatgataattacggctatagattttaaagtttcttatgtatttcaagttctaatcatagataaagaaatttaaaacagttttaatcgtatcttttaattcacacatgcacatatacatgaaaagtaaataacttaattggaaacattttttttttgataaatgtatcgtaattttaatttggttatcttacctgttaccaacataaaatgaggacacgttatgatttttttttattttttttttaatgatttgttttagtatataaatattttgattttcatggccaaacatatagcacagttcttattagttattacgcgcaagataacacaattatttgtttatctttagcacatactcgaagtcgaagatcctcaactgagatcaagtttagtcaaatatttaagaagaagctataaacattacgtactattatagacttaaaaaaaattcgtacatgattacaccaataagttaactgcacatcctcgatttaaagaatgtcatttgatgataagatttatcagataacgtgtctttttaaaacactaaaaaaagagagaaaaaaatacttggggtgtatgtattgttaaacaagcattatcttgtttgcgatttatctatttctgaacatcattttctttgagtcaaatgtctaatgtttgaagtttgaacatataaatacgtattacaagatgatacacaatataattaaggaataaataaattaaattttgatgaactctaatttccattttattttggttacccaaaatggtaaagtacgagaccacatgatagagatagaacagtgtactttgaccttaattatgcttttttttaaacgaagttaaaaaatctcacaaggtcaaagctggaaaaatgaagttttgttcttcaaagagaatttacctgggcttgaagtcctagcggcaaagccggcagcgaagtttttgtccaatttatttatttattctaataatttatactccacattatatatgttaataaaaataacaacacaaatcaattgtgtttctgtaatatttttaacaaattaaaaatacagttactattccttttttttattcttccctatttcatctataggaatataaacttgtaaataattttttggtatttttattttttgacagccttgtatagaaatttaaatatacgtaaataaattaggtaatgtccccaaaagacagagacagttttagtataatacaatttcaatacaatgacataaagtttaattatataatttttaaaaacgctaattatatttttaattaaatctctcaatcctcgtcgttgtcgtaatcatatatcccctccccagttcttcttccctctctctctctttcaccataacaaaaaaactgatttgtttactctgttaatcagagaactttctctgagaaaataacaggaattcagttagttcttagttcctatcaatcaccagctgaataaattcgtttttaaaagagaacgaagaaattcaaaaaacccaattctgctttttcccgataacttcgatcgtcttcgcttgggttttgtgtaatttgagtctgtgaattgaaccgagccccaccaaagtaaatgctccataacgttgaaaacattttcttctttatacaagaatttcaaattgtttcactttctccataggggtttttggggttctctgtttttctttgacgaattttgattttgcaaattcaggaaaaaagtttaaacctttaatcgtttgtttaaaggatcgattttttaatttcttactcaaattgggatgcagtacataagtagatgtttgcctttttgtgtaaactttgtgaattttcaatgtttatttctcctttagggatttgtaggttctctgttaattgagaatttcgaatccaccaaattggaattgaaacgtggtgattccaaattcgaggttatattcaggttttgggttaggtgaagatctgggtttgaagttatagaggggatttagggttctgggtttatagcaacaaaagggttttgtgttttagaatcaaagataagattgagaaagtaagaaatg

SEQ ID NO: 7282 - DNA, 3000 bp, Unknown
  misc_feature (1)..( 3000): cDNA_ID_1817231_gDNA_ID_1621137_Annot_ID_56565 3000 nt of promoter + ATG
gttgatcatacaaagcggtcttatcaatagtctgatgatgataactcttacaaacatagtaaaacacactctgaaccaacaaacccacaagattaaccatcacaagaacaccaactaacaatccaccaaccaaagtcctagtaaaagttccatacttcccaccaccatgaaccacaacagcaccaaaaacaactccaatcaatccacagaggaaaagataaacaaagattaaccccatagccatcttagtcttccctttaagcaactcataagcttttctcatagcggcgattccgtaaaccggttcaagaacagagattacactacctaaatgccataaagcagtgaaataaacatgaacaccaaagtatagaacagagattataaccccggctacaatagctaaacctaaactattcaaatcaagagctacgagaagcatcacgaggaagacaaagaagactgcgttataagcaaacatcaacagagcaacccaaaggaaagttataaagagtcgtttaaagactttgggaatcgcagagagagttgacgagaaagaaacaggctttccggtgtaaagagaagcgacggtgaagacaacagcagcggttgagagaagagagaaggcaaagaggaagatcaagtaactgaactggaagattagaagaacagtccaatcatgacgtgaacgatctgagtttggtgggtcggatttgtcgagtttggctaagattggttgagtgaagagtgagtgagcgaggatagcgaaggagagagggaagatgaaggagagggttatgaggtagaaggttcttggagatcgtttcttgattgagattgattcttgaagtagttgaggtattgtcaagaattgaagctcttctggttggagatccatggtttgtttctttggaatgaggtttgatcggagaagaacagagaggagagattaagaatcaccgacgggtcaatttcgaaatctgagagagatgaagtttttttttttttgttgaggtgtgttttgttgatatcaagaagatggagaaaaaatgtttacgggtaaagactttttttttccttggaaacttctgggaaactcatataacacgttttgactagtattgttattgtgaccatttttttttggggggggggggcaactaattgtttattttttgctttaattaatatgatggaatcgttattttatgggaaaatatgtaagtggtaaagagatggacaaaaaggaaaaggagatttggtcaagttttatgagcacaactctctttgcatgagctgagacgcaatcatggaactagactttctatagagtttatgaatcttgtatacttacaaagaaatggtaagatagggtaaatctaattttgatagagtttaattatgcacctaatacctaatattcaccgtgaagaatactctagaagagtattcagattttcatatttgtaatacatatatatgtactacatttttttaatgttatttatttacattttgaaattaaataaataagttcaaagaataaatatgatttaatttgaacgacatatcagaaatgttgtaatctgttttttttttttttttgaatattgtaatctgaaaaatgaaagtttaatggtttgatatttcggttgtatgtgtgattatgtatgttttgatttgttttcacgtaataatgaggaaatcaggatcaaaactttaaaaagagcaaacagaaaattaatgatgttaaaagtttattaatacgaagaagaaaaaaaaaagttttattgatacgaccttgtttgaaataggattaataaattttctgatgaagttaatttatgatagaaacaaaatcaaagattaatgcttacttccactgaatctgaggtgcagggaaatcacatggaccgatggtcccaacagttaactgtccatgtcaacttaaatactactaatttacataattaatagatgtgaaaattatctttgcaatgaatattgaacttgtaactttttgtatgtgtttaatttggagatcttataagtttacgtaaggaaatagaactagcaatcaaatgttggtgtataagcactatcctacacacacgatttctttaattatactttcaatttcgaatagagaaatataagaaatggacaagaccggccggtccatgattatatactctcaagtttcaacttttgttttggttttctaacttttataaagatatgtaacaaatgtgtttttaatcgaatgtgttttaatcttttttcttctggcactaggttctttctacactagctactttaatcgaatgactaatggaatgtaataaaccaatacttaaactaaacacttgcctcttaaagccttattacaagaaaaataatagaccgtgtatcatcaaaatattgaaaaataaataaataccccaacacgtaatttataacagtaagactatgaatggaggtagcggacaaagcggtttaatttgtctgcgatttagtccatctcatttttgaggcgaacaataaaccgctgcggaccaagtttatttgtatgtaaaaacggtccgtagatgatccgctgcggttttcttctattttttttggtcattgatgaattgtaaataaaaatagtctgattcgttgacggttttgtccgtcccaaccgccataaccattcaaaccctaaatcgaattcacaagtcataacaactaattctccctaaatataagcatatcctaacacaaactaaagaaatacctattattatttaataaatttagtaagaatacctattattatttaatgaaccatccaaaccatacttacaaaagtagcagtccctatctaaatagaaactgttgatctcaaggtttcatttgctaaaaaaaaaaaaaaaaagcaaccacatttctttctctatctcactctctcgtttaacattctcatgaaattagggttttagaaagatagatcgattgaag

SEQ ID NO: 7283 - DNA, 3000 bp, Unknown
  misc_feature (1)..( 3000): cDNA_ID_1808497_gDNA_ID_1621137_Annot_ID_56567 3000 nt of promoter + ATG
ggacgcacaaaagaaccaactgtaaccacctatagtacatttctaattttgaatagtttttgtactacttttataattttgttttagaaacgtactactttacaaacaaactctaatatatatatgttgagaatttcttaaatcttttgctaaatcttttggctaggtatcatctgttttggctagcacatcatggaaggatttcgtaggtcttgttagaaaccaacaacaacaccttctctgttgggcgtatgcagcatctgactaattagtcagtgccaaaaggattctccgccaatgggaaagcgactattatcctctctgtccgcgttacctctaccgttttacacatccaagatggcttggaacagataagaaagcaaaactgggacatgtctgttacttcattgttggtggcaatgatataatgaaagagaaggttaggcgaactccccaccagatgcatctactctctaattttattgtcccactaatggactgcgctggaagcttccatgcaggattaaaaaacaactaggttatataagacttatatgagcttgagtgaataaattttatggaaaacaaatatgataaagagaatcctcagaagcatttatttagtatattagtattagaaaaacattatggtaaatagatgtaacatttcacagaaacaatcctaggaaaacaattaacaaataactgaaattcatagttatttagaaggaaaaaataataatatacagtacaaactctataaattaataatgttaggaccatgaaattttattaatttatagtgatattaatttattttatatattaataaattaatatttatcaatttatagaaatatttaagcaaaatataacactatattctttcagaatagaataaatgtcaagagcttactcgactattcgggtaaaaatgaatcatagtaaaaaatttagagtttttaaaagaaattgctatttatgtctataatgttggtgaagaagttgaagacgataatgagaaacttttggaaatagtgacacgtaagaaaccaattttcgcatctagaactcttcacaaattttggatgcatattgagaagatatcacccggagtttttgatgcaataaaaagaaaattacagatgaaattcaacaagattcaaactttaagaaaagacaacaaacaacactggactcatattatagtagattatcttaaaaattttgattattaatttatgttattattgggaccatatttttacatagagatttcaaaaaaattattatcttatcgattttgtttaatttttacattggcccgacttgggaccaacataatttattaatttattgtgtttattaatttatcaagtattaatttataaagtttctactgtagatgacaaagtatatacatgaatattaggtagccaaagaatacaactttctataaaaaggaaataataaatatacacaattattctcaaaaaaggaaaaatatatagaaatttaaaaagacatgaatgtttaaatagacaaaattgttggtaagggacataattattgaagataatagaaacactaataaaacatagtgaaaaatatacaactctaagtgaacatatataacttcaattaattctcaaaaatatctttaatgactgtaaaatacaattttgagtataacaaaaaataaaataaagtaaagtcgcgtaaaaagacacaacttttcacaactataaattaaaaattaagttattaatttatgaaaagttacactgaaaaatgtgacaatggataattatccatagctttgatttgtcggagatgactagtagagttcctttgttaaattagaaatggtttgcttacatattactaactgattactgtttttgttagtgtttcgattttgatggtttaatcagtagctattgaacatgtggagccgccgaatgaaagactcaacgccaaacgtgcgattgtcacagtaaatttgggaaaataatctctttatgagctttcatttgaaaaataccctatccttttttcttttctaaaaattaaatttttaatatataaattattaaactaggctcactaaaatttagcaataattaaaattattttgaacttaaaataaaaagaaacccataatttaaaagttgatgcaactaaaaattttaaagataatttttctcttaaatatttttaactaaaattcgtcaaaacaaataaataaataaactttattaagtgatagactaaaaactattttagatatcattttgttaaattttaatataaatataataaactatttttatctcaaaaatatttgaaaaataaacaacataatatatttattttattttattttttctaaatttcgttttttttttaatttatcaagaaaacagcttttgttttaaatctggacaaaactgttattttatatattaaattttttaatattttttaaaaataaagaaagtgtatttttcaaataataactaaaaaacaaggtagttttcaaaatctccctaacttttaagggcttggccatgggtaggaatagtgaacatgttgaacgcaaagctatagttagaagagtcatcaatgagcatgaaggatacttgtctctcaagggtgacatttggagttgagaaaaagctttgaattcggaattgagaagatccagtgagaatgtggacctaataataaccaactaattgactaaaaaaatattttgtgaatttgaagttggacaccgttaagtagatttgtatcttggattatatatacgtgtgtgtgcattgacattcttcttggtggttttagacgttttagttttccatttcggtatttcccattaataaagagttaaaacgacgacgtatgttgataatctctaaatgacgtcgtttgattgaaaatgtcgtaagaaaaatcgatcgaaacggttagcgaatcgaagcagagagagcttcaatg

SEQ ID NO: 7284 - DNA, 2264 bp, Unknown
  misc_feature (1)..( 2264): cDNA_ID_1817193_gDNA_ID_1621137_Annot_ID_172724 3000 nt of promoter + ATG
ttcgatatgtgatcttaacaaaatttaaaaacttgaaaaatcaataatttcgtaagggatggtttttaccggttcgccggttttcactggttttaagaattcatatgttcaaacttatgtttttcatgataaacatgaccggtcaagggtctcactcgcggttcgatgggctcaaaccggtcgatccgtatcggttaacagtttattttttcccttcaattatatactttgtttagattaatatttaggatggaataagatcctggcttcgtggcttgtagtgctgattaaaaatcactgataaccaatgcaacgccggttcgatacttcacaaaatttagggttctttaaaaaattcataaactccaattcgcctccttctctctttctcgatcctctcaaaatctctccaccaccaatgaagcgacgacgccgtaactccaaacttaaattcgaagaaacctccgaccaatcaccgacatccacggcagagttctccttctctctcaccaaaatcgccgtcagccaaatctgccaatctattggatacaaagccaccgatgcctccgctctcaacactctaaccctaaccaccaccaaattcttacaatccctcgccgaactcgcatcgtcgttctctaacaccgctaatcgcacggaggttaatctcttcgacatcgtcaatggtctccaagatatcgctttatctacttccgattgtttccccggtggctctacggttcacgatattgaatctcagtgcctgatcaaatccgctgttctccgtaacctctccgatttcgttacctacgctcctgagattcctttcgctaaaccgttaccgagacgggaaagagacggatcgttcggaggagatttggatcacgtggcggtgactcgatcggtggatgtgacgtcagttccagcttggcttccgccttttcctgactctagtctctgctccgatcgttgttcaaaggataatagatctgatcacttgtgggaaaactctgattccgttattcgccgtgaaattttgccggagagtttgaaatctaaaagcggaggaagattaccggtaatgagagataaagtgagattcaagatggaacaacgagattggagtagtggtggtgatacgagattggagcggtcgcgggacaataacaatggcgaatctggccgtgatcttgaggttaagaagaaaattagagaaggatacacttactgtgccggcgagtggccgttttagtctattctgatgacgtggaaaaaaacaaaatcgcgaggtttaagatggattcgaacccgcgaggcttgagtatatgtgtgattggccaattggaatctaccgcacgagctgcttctctgatagtttcggtgctccaattgtttattttataaagccattactctaaggatttactttatttctttctatgggattattttaaaaattgaaatagaaaaatggttgaacctgttcgactttactcaatgttaacttggttagtccattgaaccatcgtacaagtgatgaagtaaacaacggattcgtctcacaaatagaggtttgttcatgaatataatgcttgtgggtgaagtgtggttcttttggaaactagaatgagaactcattggatgagttatatctcaaagaattggggaaagctatgtatgtaattgtttgtttcatttttattttctcaaaataatgcaaactataggttggtggattaaaaaatgttagaaaaactaaaatgtcatgttgttattcttttcaccaaatttcatgtattcagtatttatatgaaaaaagctttttaagcaacttgactctagtgtggcttgtatagacacatgtatgcagtctttttcttaacattatttttcattaagatctaaatgaatctcaaccgtccattcattagagaagtaaaacaaaacttacacgtggcaaccatcgaggtttgaggtacactgtttcattacctccactatgtttcatatatatataacaaaaacaagtcgccttccttcttagtaaaatttactgaaattgccactgttttcgattttgttggttctccgatctcagtggtgtcttcttctccggtagataattctcgtgttgaaaatctccggtagtgtttgactgagttacggtatgattttgttcttcattttcttttgcaataagtcgttgttatgaagtgagtaatccactggttttgactatagaaatcaaattgctacagaatatg

SEQ ID NO: 7285 - DNA, 3000 bp, Unknown
  misc_feature (1)..( 3000): cDNA_ID_1817197_gDNA_ID_1621137_Annot_ID_172723 3000 nt of promoter + ATG
taatttttttttttttttttttaattatattcctgtataattatattttgattgtttattttaggatttcacccatgttatacatcttgtattaatatcgaccaacccgtgctaccatataatatgtcccgtcaaattgaacaccatattttttttttttttttttttgaagattagctgaagatataacatattaatttggttttttttttgaagattagctgaagatataacatattaatttgtcttatttaaatatagatatatatctatgtattatttagtgtatgattagtattgtttaggtttcaatatttaaaatttagatacgaaacatacagttcattaagtaacgatgtagcagattttaaaaattgattttttttggttttaggattttagtatgaaaatattaaaagtatataggaaatggtatgtacgtgaaataaagaattatttgttttttttttgttccatatatactaaatattattaaaaatctgtataatatcttgtatttaaaatttaaaatctaaataattagtgcattattctagctgagattgatccgcaatatacgacgggctgtttcttaaaaatttttgttatttataaacttatgattttgttgtatataaaattaaccaatttattgtgtatgatttttaattcgatgtaactcttatatttaaagtatagtattatttagctttattatggctgaatatttatatgaatatgtttttgacctgatccatcaaaatcaagaggttttaacccccatggcaaatatttagtttttgtactttagattttaaaaataaaatttaatatatgattattatttttagatcaaagtaaatatagtaattttaggttctattttatagtcaaagttctaaaccattcacgtttgtttaactattattttatttttttcaacgaaaaaactttattgaataaagattattaggtccgatcataatacaacatatcataaatctaaatcaaaggactcaaacaatccgagaaaaacatagaatctatctaacctttttctgccaacaaatgagctaactgattacacgatattttagtaaaagagaaaaagatatttctaaacttggttgcccaaaagtgaatatttttgcgtaaggcttcggtaatgaagtccaccgtaagaaccttgatgatgttgatgagcgcttcagagtctctatttttgataaattgatgtatagcagtcagaccacacttgatgcattgacattagtagagctttagcttcagcttccggtggggtacgtacggctccccatctttttgcttcaccttgacatgtatatttaattttttacttacataaacttctttacaaaataaaaaaaaacagaaccgcaaatacaacaaaattaaacacacgtatatatacacacaaacgttcatatatgaatatctaaatagtttggaacaataatacacaggtcgttaccaaaaagaaaaaagaaatacacaattctcaagtattgtgttctttaatacagaaatcaacatcaatacattgacatcacattcataaagaagggtaatacgtacaaaaaaataaaaaaaaaataaaaagaatgcccatgatgtgtgtgtttgataatgtgatgggagataaacatatgtagtatatataggcttggaatgattaggtcaatattttggtgagcaagcaaaattaatttgcgatcttaactaaaatggaatcaaatatacgtaattagaatattttaggtatatgctataaatgcgatttgtcataataattaaaattttctataaaatcttatgtataaatattttgtagtgtatagcaattagttatgtcgagatattttagaaagatttttccgagaatattggcaaagatttgggaaataatttgatgtggtaagattatgatattgtgaggcactaatattccttaaaatcaagtatatgcttattttaaataaatagaaatgtagatatgagtagttgataaaaaatcaaattgttgatattctcatatatttcgaaatgaatgtatattattgataatagtggaaagttttaatggcaattgtttagcgttaatcgttttgtattatacatttttggatttactaatcaaaccggaattattgttgtaattgataacaaaagaataaattttggtaagatttcattagcatttaaaactataatgatttccgaatctaagtaattatagatatggttagttaggatttagtatcaaatttagtaattaggaattaatgatttgcgaattacgtagagtttatagggattgatttgtgcaatttattagggtaataattaacaatatctatgtttaggcaagtagttagtgcaatatcataatagttaaacaaaagtttggtcattgtcctaaataaaatatcttgtttgattgattttatagggactaaacatacaatatcaaaattgaaaaagaatttttctacacaaatcgttccaaaaatgtatatgtagattcttaatataaacaacaattattcacttggccctaattaaaccatcagcccattaagcctcttattaccaaaacccttcaaacccaacttctttccttcttgttgactttccttcttactctgtcgttgactctctttgcgacttcttcttctcttttcttcatcttcttctccctgattcctttttcttttgttgcaggactaaaatcccaacacctccctcctgagttctttgattaaatccccaatttcaattttagggttttgattcccattgtttcttttgatttatcttcattccggaaattgctccggtgaaacagcagccaccgccacatctttctccttctccggcaagcaacttcattccggattttcgtctgagacttcattcttgtctccctcttcgaccaaactgacacttattccgacaaaaccctctgattagaccgtcgga

SEQ ID NO: 7286 - DNA, 3000 bp, Unknown
  misc_feature (1)..( 3000): cDNA_ID_3050185_gDNA_ID_1621137_Annot_ID_172722 3000 nt of promoter + ATG
ccaagagtatcttgaataatcatcaacaaaaatagcataatatttgaggccttggttggatacaactggagaaggaccccataaatcacaatgaatccgatctagaggatgtaaaacacgagaatctgaaattaaaaatggtagtcttgaacttttccccatctggcaaggttcacaaactggagatgttctgctcttatttatctgaatcgccttgctgttttgaaggtgctggagagccttagaatttgcgtgtccaagtcggtgatgccatacttcctctgttgctgcacactgacggtttgaataaagagccacaaactcttgattctccaacacatagagcccatttctacgaggacccgtggttaccactttctgtgtttgtaaatcgattatgcaaaccttattagcatcaaagtaaacaccgcaaggatagtcatcacacaactttgacacagagagaagagatttttgtatatttggaacaaccaagacttcatttaaaggaatcttaccatttgaggatttgatagtggtagatccagtgtgagtaatcgggagataagtgccatcgccaaccaagacagcatcatccccttcgtactctgttgcagactgaagtccattggtcgatgatgttacgtgagccgtcgcagctgagtcgggatgccattccttgcctgtatcatctgagacccggagagtagaaaaagcttgtatttcagcctggtaattgttatcaaaccgattgtaacacttgagagcagtgtgaccagtgcgaccacatatctgacacaccggtcttggacctgaaacttgtggggaggattgatgttgggaaaaccctcgtccacgagttgagtagcctcctctgcctttattttgaccagaacgtcctcttcctttttgattggggttgtattgaggagatccagactcagatctttcaatgttgaaggcaaggtgaggagtaacagatgccgcttcttcatatgattgtagcttactgtcaaagccttgaacttctgagacaacatcattgaaagttggagtcggaagcttgctgagagagctttgaatcaccgtggtgatggggtcatagtcacgaccaagaccgttaagaaaaccaaaaattttcattgattcatcgactggcttgccaatggagctgagagcgtcgcagatggtcttgaactctcggcagtagacagagaaaggcttttcctttttggagagaagctggagattctgacgaagtgagaactcacgagcaacactgcttttgttgaagttttcagctagagacacccaaatttgacgagaggtgcttagattgtgaacatgaccaaggacttcttcagacaacgtgccaaagagccatgaccgaactaactgatcggtacagaaccaagattcatacagaggattgggttcctcggaggtgacttcgccattgacgacaaggcgagactgagatggtgcattgacggcgccattaacaaaacctatgagtttttgactcgataggagagactcgaattgagttttccacaagaggtagttactgtctgtgagtttgagagtaacagaacttgtaacatgaacattatctggaaaagggtatgaggtcgccatttgaaatacctgttaaggctacaaaggctctgataccatgaaacgattagagaaagtttcaagcttttggtaaaaaaatcgtttctttctcaataattacattagggttttacactactcttttatagacattgtagaaggaggtagatatggaacagtctagaatatggcagatgctgtgtagctggctatggtgagtcatcaggcaaaacgcccctcctctgtacgatcgttgctctgttttgagctggagtctattttgtcttcttctatttgactgggctgagatgggccttttgttgttgttgggccggttacttgtttgttgctcacaattgccattttcttatttacaaacaatgtaactagggtgtatgtcgtttatatttgtcttagttatttgtttttgatttgcaaatctctaaattctatcaatctgttttttttttcttctaattttcaatattttttctatgagtaaattattatatcaactgtttctaaaaattatctaatcatggtatgtcttagttatttgcttttagattgaattacatattaattagataacaaaaatggtatcgaacttccaccattggttcaaaaagaaggtaccactacaaaaaaattaatatgcttaacataatttacttattaagttagccctttttaaaagtgaaattctaattatataattgcttgtaaaattaagggttttgtgcaaaaaaaactaaaagttgttcttttttgtaactttacccttcacgtcaaaaaaatgtaaaattatcatatgaaatctaaaataatatacaatatagcttttctaattgttaatttttaaaattttgataaataatatatgtacattatgtgattatgaaaacgtttatagtatatgtaaagttaagaaaaatgggttatatattattgcatattattttggatttcatatatttattttgtattttttagacgtagaaggtaaaattacaaaaatagaagagtttgagagggtttttttttacacacccctatatataataacactagatattgaccctcggtacaccgcgggttgattatttgcgttagaaattaaattattatttttatttaatattatccatatttaatatcaagttatattttgaattcatcattttacattttatatctatttacttttgatgttatattagtatttgtttggtttgatgttgtttagtttagaaaaatctttttattatacacatcatttatatagagtgtgtattttatggtacgtaattatgtgtttgttatataatacttttttttgttaaaagtaaaagtattataactacctaaaatgtatatgtagat

SEQ ID NO: 7287 - DNA, 3000 bp, Unknown
  misc_feature (1)..( 3000): cDNA_ID_2025553_gDNA_ID_1621137_Annot_ID_172717 3000 nt of promoter + ATG
tttctttgctattgaagataatttgcaacatctttttaaatgaaatcaccaaactttgattaaaaatgttttatcttgcttttgtattttccttgttaaattctgcagaacaatagaaaagcatggatttcacaaccgagtggtcttaactttgtttggggaggtgactcgagatattgggttatccctaaagaaccaaggtatcatccgattcattccgacttaaccgataaacccaactttggtttactgataccaaaaatcttaaactgattcatttgattgttggttttaggatgcctgctgagctgaagatggtgagttggttagaagtaaccggttcattcgacaagattgaacccgggaaaacatatcgaatcggttttaaaatctcgtttaaaccggatgcgaccggttgggacaaagcccctgttttcatgtctgctaaaatcgggaagaaaggcaagacagtgtggaaaagaatcaaatccgttagccagaactttggtatactgaaaggtggatcagaacccgtcaatatacctgacgagtccgatggcctgtttgaaatcttggttagtcccacagcgcttaaccaagatactaagcttcagtttggtctgtatgaggtgtggactggacgatggaagacaggtctgttgatccacgaagcctttgttcaagaagtgtaagggggaatatgatcattattgattttcataatccgaacgcaaatcttatacctcgtttcagttcaaatataagagctttagatcataacaatgtaatcttatatacctttcttgaacaagtcttaaagctctgtatgataatcttccggtttgaaccataacgagaaatcgattcctttcgacttcaaattctcagttgcgggtgcaattctttccagaagctacaccgattaaacaaaaaatatgtgagacctgatctctaagcacaacagattaaaagcattgataaaagtatgaacagttcatgaaaccttggggtgaagaacgccgttggagaccaaaacagacctatcaaacacagaaaacttccctccgtccatccgagtcacagctcctccagcttcctcaactatctgtgtccattttctgacatggattaagctctacaacttaagtactttagtaagaaaaaaacaacaagaaggatgaagaagactacaagaacaccagcagccatgtcccatggctttaaacggtactcccaatatgattccgcaatcccaagtgcaacatgacacatgtcaactgcagcagcaccgagtcttcgcactccccgactcacatcagtaaactctttgaacagttccatgttagtgctccatgcatcatcatgttcataaccaaaccctgtgataagaagtgctctctccaccttcattcaaacccgaataaatatctaataaaccaaaaccattgaacacaccatgtcgaaacttaaaattggattcttgataagttacttacagcatcggtcttactgacatgaattttttgcccgttacacaatgctccaccacctaagaagtgaactagttagacaaaatttagatatatagccaaacataagcttgtcacatagtacctgcagttgcagaaaaggttcgagtgttccagcacatcggaccaccgacaaactctacctgcatgatgagattttgttgttaatcctactgaccaaagaatcagcaaataggaactaacaagcattagctggtttgtgcaagtatatattggatttaccacagaagcagcggcgggatttccacgatacagaacaccgacggaaacagcaaaactgggatatccatgagcaaaatttgtagttccatctatgcataaaggaattaagagactaatactaaaaatctcagagattccacacaaacacatgaaaagaaagcaatgagatttgtaaagagagctaaacctagaggatcaatgcaccagaggtaatcagaagacgaatcgccgatgatacctccttcttcaccaagaataagatgatcactaaaattcttcttcactacttccaaaatagcagcctcgcttgctttatcagtactgcaaattcatcaaaagtactaaaactttaatagcttcaaccaatcaagtcaacatgaacatagttaaaacctcaagctaacaattttaaaaggtgaagaagtccttactcagttactaagtcactgagacctttataagtaatattccttggcttatttacagcttccataaccacctaacaaaccagatgattcaattcaagttagttttgttattattctccttgtgcagttgtgccctacgaacccaagaacttgattctagtaccattgaacacaatttcaagtctcatcaagagtttttgtttccaataaacataaattcagatattgtattctacagacatgaaatttcgaacctcagcgccggttttagcggcgagttcaacgacttcaaggaggtgtgccggagatatagttccggtggttttagcgccgattctgggatatcgcgtctgatcagaaacctcagacagaacagctttggtttgaagtctcgttgtggacttgaagctattagacaaaatcctcgtacaccgatatcggaaagttctgttcactgtccggcctgaaattgggttttgcagcggaagagatgatctgggtaagtgagagattctcaatgacatgtttccagagaatattagagaccttcccattgttggtgtcgccggagaattttcgaatttttgttgttgttcggtttttggtttatatgaacgcggccaagtgaacggatggtggacatgagagagtccaaaaagctgatagaacttaaaattgaaattaatgagaacattgaaccaaaatcaggttaacaaataaccagagataaccggtctctgtagtatactcaaatggttagtttttgccgatggtggtgccctaaactcgaaaaaaagatg

SEQ ID NO: 7288 - DNA, 3000 bp, Unknown
  misc_feature (1)..( 3000): cDNA_ID_3050201_gDNA_ID_1621137_Annot_ID_172716 3000 nt of promoter + ATG
tagaagctgaagctgccagcatgatctggtaatcgctacatacgacatacacacatcactaaacttctttataatttatgcacacacatacagctcttaatggccacaactcaaagttataattagtgcatgatctctagttatttgactgcttttaatatatgtttatggattcacgcatgtgtgtgtatgtacataatttacatgcatgcactttgtgtatggtacacatcaatttgaacccgttcaaaattctgtttttattagtatatatatagatgtatgtggtgtgtgtgtcagtgtgtgtgtgtgtttatagatagtagtactaggtcatcctgcagcttcagtcactaaatcaccaacaatgcaaaaaagatataaacacttcatttcatgagaaaggcgtttccgccttaacttttacgatccctctatcaccattggagaggtaacgatacatttacttgtcattttcttaattttacttcctatagtaaatccaatccaattatgtgttattttcaaagtatcacatcttcattctccgaaatatacgcatatatgtcttagttactgtgtataatcaatatgtccacaagttcatgtttgttggtagctagcgacgcgtttacatgtgcctatgtgtttctttctcttgacctattatacttagatctattattaaataaacatatatcttgtgacaaagaaaaaaaagaagcgtattagtttagtgacaagacccatgatattaacaacaatttatcttatattggagacttaggaaatatttcaataaaatatatataagttattaatgaacttaaatacaattggcttgttacacatcactctaatccatgtgatagatgttctacaaaatatacgtttttattttaacatggaatcttatgattgctttattgtacatacaatgagagctaatagatcaaacttgtttgaatgtaaataatttggaatcttttttgtggggatatagagttgggttttataatctcctcgagttagaaacaagcattattggttttagatacatctaagattaatcttgcatactattgccatttttttggctgattgttactcatatatagttcgaccagagaaaaatcaacgtctacacttttcatgtacaactgactacggctcaagccttctctaatatagattgtgccatatgcaaatgtaaccaatcatcgacattgagattctctgctttgatcagcaacttctgtttgttttaaagattcttaattgaaggattcataatggaatttttttttaagatcgtgaagattatacttccttatagtttggttttaaagatgtaaaatttatttcatatggtttctgatgtcttttgatcatttgtaagtatattagttgtttgtgcaaacaatattactagttccatgcatcgatacatatttgattaagaacattcgccaaatggtcaatacaatggggtatcagatcaaagatacaaaccaaattaagacccttggaatctgtaacaaatatggtgctggagatagatatcacaattcataataattaattataggatttataatcaccattttaatattgatgtatcaattaatggaaacaattgcacggacctacttgcagtatatgcaaaatgaaattggtttgagctatgttttggtattaacttgctttgtaacgtttgaatctttttttctaaatatattcacattttaatataacattgtacaattacagatgtatgagaactataatatctaaacaaagccatgattaatgacaaataataaattttcgaaagtgaatatattattatagaacttaattatttatttaaaaagtaaaaactaatcataactcatgaagtaaaaaaatagttggtctagccaattgcaaagtagtcacatataaccacttcggttaagacattggcaaagatcaaaaagtcacaaacatacttttttctctggttgactaaatcgtcgaaccaccacatgtaattaatttgacttaaactaacaattaaaaagtaaaaataaaaagaatagtggtattttactgatgggaggacatttttccaacgattattttgtttcacgagaaaatgactatgtacgaaatcttcatatatgtgagaaatcggttttagtcaactcacgacttgggccagatttggaagtttaattctttagaacattttcaacgggagttctcttgaataattagatggattctcttgaattagtagaataaaaataaatataaacggattaaaaaacagagaactagctctctcaaaagagtttcgacttttgagtaagtgatagaaccggacatgtgtcaaatagataaaataatacatgacgtaaaaaacaaaaacaaaaaatgtattaggaaaatagttaccttacttttaatttacttatctatatgtcgtgatttctggttggttgccttcagagacgaggacatgagaaatgagacctctgtaaatactgctactagtttgtataaaaccaaaacactaaagattgtagcatcaagttgtattgtaagcgtcactctgaatttgttattgtaaagaaaacattctacgcagacaatatcagatcaaataacatcattgtctaagcaaatcacttatttttattttttttaattggaaattaagaatcatctcttttaattttagtgtctcaaattttaaactacattttctaccggttgtcattatttcttatgttttgcatatatttttcttatgttttgctcatttatgtatattttgctagttgaattttttgttcaaaatttccagtatttataacatattcaattttaaatttagcattaattttttaataaatttaatttgatattttgaatttgtttaattattttgtttttatataatgatataatgtgtgttaaaaaagtgggtttgactctattaacaaagagataaat

SEQ ID NO: 7289 - DNA, 3000 bp, Unknown
  misc_feature (1)..( 3000): cDNA_ID_1817223_gDNA_ID_1621137_Annot_ID_172711 3000 nt of promoter + ATG
ggaggatatgacgattcccatggatgatgatatggagaactgcggcaagcgtcgagtggagagggatcagatgtaattctgtttctttcatcttctgattgtttagaggttgatccatgcatgtgttggaatttatccacagctttgatttgtcggaaatgactagtagagttccttttttaaattagaaatggttagtttacatattaataaataattatttttttgttagtgtttcgattttgatggtttaatcagtagctctggtgccttggaagcctcctactgtgaaggcgaagggtgtcataaaaagcatacttatcttgccttggtcaagcttatgcgaagacggggcttcatctttacaagtgtaaaaactaccaacgagctgttagccgagtgataaatcttccaaatggagtagttgagttcgaggcacgttaggagggatctcttctcgaaaggagatgaatttaacttggtgtgagtcccgcctctggaagatgtagggcctttgggcttgaacttccagatattcaagaaaaaaaaaatgtaaaaattagtctcctctctttgtgctttttattgacatgttgtacatatctcttagtttcttgttttcttgatctacgaggggacaaacttgaagctcgatctcctaaagagatttaacaacgatatgcattgtctttgctctttctacataactttgcttgcattcgatccaaccagccgtttgcaagagacttttcaggttaaagttgaataaaaaatgttatggcagtttagatttcatatgtcgtattgctaaacctagacccctaggtaaaaggtgacttgtggtgcattttttcatttttacatcacgtaaatctcacttgttggctaattaatgttgcgtagtgaacactaggcctgggcacgaagcgaatatccggaaaatttgggatatttgttattcgattcgttttaatcgaatacttaattttattatttgctttgatccgaaaatttccgaatatccagaaatacgaatatccggatttttgtgtgatatttgccggatatccgctttgctttgctacatccaaattttttttttaaaaattatttaacatgatttcaaatttcttaccttatggcttacgagtgtgagattgagagcaactggaaattttctggttataaattatgtaaccaaattgagtgataaaaatagtgaaaggtcgaagaaaggaaacagaaacgtcgctcttatatttgatggattggaaactaaaacgacaattttaggataaaatataaaatatgaaacaattttattttaaaaaattccacttatctaataaaaactgtgtcacaaaaaaaaacacatgcccaaaggatacaaatacaagcccaaatcccaacatatacaaatccacaacctatattatgatatatatacggatcgaagcgaatatccgactttaaaaaaaatagtatttgttatttgcttcgatttttacgaatactacattttcctatttgctttgctccaaaatcttatggatattcggattttttgaatcaaatcaaatcgaatagcgagtcgaaacggatcgaacgaatattttgctcaggcctgaacacggagccctcgcctttcatacctcaggattacacacctttgcatggtttctacaaaggtagattgtatgtgtggccaatagaggatgctttcaataacagaaaataattttacttggtacacagattaaaattagttccacgtcacttgtgttggcaatagtattgctttgttcatgatcagttaagtaggggttatcaaaatgacttctcagtgacagtgactgttcaagtcaaatctaactattatactatccaaagaagcaaacttcaaagagaatgaaacaacaaaattggcacatctagctactaatcaaaccaaagcatcagaccaagtcataacttgtatccaggcgcttcatattcacatggagttcgctcccagaaatatagctacccctaccccctcacgtcaatcccacgagctaaacaaaactcagcaaatgataaacaacttcaatcataatcataaatttgacaaactaaactatcaataagttagtacaaaaccgaaaatgatttcagacagagaacaaactcgctcaagtgactagatctacaagacaaggcaaaggcgagttgaaacacctaaaaacaaactttcacttatctcgtatgaggtggaggaaaagcacaaaatgatactaatttgcttttaaatttcagttctcatctatgtagtgagcagttaagcataaataaccctccactgtgagtgccatccacaaatcagtagtcaaatagattttacccggaatttcactcaaaatctttctaagcttagttttctccctctcaaatattttaagaacatcagcagctgcaatatttctactccactcttcaatactagaattagcatatgcaaaagcttccctaatccttctatattcaacaaatgagaaagggagatcatgctcaattatagcaacagcaatcaaatcacggaatagcatcatgtcaagttttctattacatccagggactaccatgagttaatttgcaacgtcgactatggcgaagaattgtgttagtaccattcctatccagacataatgtcgctttaataattatatgtatgtgtatagagtgtgtaaattatatagcttgttagctcgagcaataattataaattccttttcccaaccctaaaggaccaattatgtatcatacgagaggaaactatatattatcatcattaaaaaaaaaaaagagtaccattaagataaaacaaatcatcggaaaaaatcaataaacccattgaaatattcttgggccttaattaggttagtaccgactctgaataggttcaaattcttgagattaattaagagtctgtgcgattcgtattcatagatctttctcatcatg

SEQ ID NO: 7290 - DNA, 3000 bp, Unknown; identical to SEQ ID NO: 7283
  misc_feature (1)..( 3000): cDNA_ID_3050205_gDNA_ID_1621137_Annot_ID_172708 3000 nt of promoter + ATG

SEQ ID NO: 7291 - DNA, 3000 bp, Unknown; identical to SEQ ID NO: 7281
  misc_feature (1)..( 3000): cDNA_ID_2044319_gDNA_ID_1621137_Annot_ID_172700 3000 nt of promoter + ATG

SEQ ID NO: 7292 - DNA, 3000 bp, Unknown; identical to SEQ ID NO: 7289
  misc_feature (1)..( 3000): cDNA_ID_1817223_gDNA_ID_1621137_Annot_ID_56568 3000 nt of promoter + ATG

SEQ ID NO: 7293 - DNA, 3000 bp, Unknown; identical to SEQ ID NO: 7287
  misc_feature (1)..( 3000): cDNA_ID_1842703_gDNA_ID_1621137_Annot_ID_56572 3000 nt of promoter + ATG

SEQ ID NO: 7294 - DNA, 3000 bp, Unknown; identical to SEQ ID NO: 7285
  misc_feature (1)..( 3000): cDNA_ID_1817197_gDNA_ID_1621137_Annot_ID_56576 3000 nt of promoter + ATG

SEQ ID NO: 7295 - DNA, 2264 bp, Unknown; identical to SEQ ID NO: 7284
  misc_feature (1)..( 2264): cDNA_ID_1817193_gDNA_ID_1621137_Annot_ID_56577 3000 nt of promoter + ATG

SEQ ID NO: 7296 - DNA, 3000 bp, Unknown
  misc_feature (1)..( 3000): cDNA_ID_1817289_gDNA_ID_1621138_Annot_ID_56581 3000 nt of promoter + ATG
tttgctatttagtcatttaattagaaagtttttgatgttttacaataacttaagttcaaaattttaataaaaatcataaattttgtcttaaatctatagttttatgtatctatattattaattgggaagcattgtgtgaactataaaattgtaagggtagtttaaaattaactaaatgaatttttgcatgggtaatttagtaaattaacaactagtacaactaaataaatatcttggattttgttcttttaaaaaattaaatttaaaatcaataaatttgtaactacccaatattttcagaaatcatttaaaaacgtttccataacatatcagactattttaattcgaattgtatatatgtaaatttatttattttggtaatatgttattagataattcaaaaatttcaatctaatttaataacaaataatcatttagtttagattttaaacaatttccttaacaaaactatgttaattgtttctcattagtacacttaaaaagaagattttaaattatgatttagcatattcaaaagataatttttggattttagatttgtaaatatctagaagatattatgagtatagattaaaatatttaacattttaattagaatttaaatcatataaacttttcaagtatttttttaaacatgtaattttcattatttttaaacaagtaattttcattatttttaatgctatgcatatattcacattgcctcacaatcaatctagaatatcgattctttaaaacaatagatagagattcataagtaaattacttcatgttctaatgagtttatctcctaatattactatctatttatgcgtattcttatggatttttctttcaggctaaacactagattacaagaaactagattatagttatacaatcttaaacaataaacaaaacaaatataacttaatttaattttttatttttaactaaaatcaacaaatttattagtttataaaaaaccaaaaactattactcaaccatataaaaaccaaatactattatactttaattataagaactacatcttatggaaaggtatacactaaaaatcggttttatatactagaatatcataaatatataaatcacaaattatttttaaatatattaatctaacatgtaccacatgtcaacccctcgatttttttatatattacaataacaatatttaaaaataacaaaatagtttttcattttacggaataaagttatatggtggaactagtttgggttgatattaatacgggacaataatctacaagtgaaatcttagaattaataattataacataattatacaatcttaaacactaaacaaaataaacaatatttacaaaacaactatatcttaaaatttgagtttttagttacaaacaaatcgaccaacggtgtaccgcggagtaaattttacattatatcatctaattgatcaaaaatttcaaacaaaaataatcaatttatatatacatcaaactaacaaaaatacacaaattttccaaatatctctatattattccgcaactcgaaacaaatataacaatctatttactatgctaaatacaaataaaatataaataatataaattaattaaaaaaattagctattttatcataaataacactatacactttctatgcatattataatttgtacactataatatctttcactaaaaatgtattccaatacatttcttaaaatatgaaaccccgcacgtatgtgcgggtcagaatctagtttactataattttgaaaacaatactagattaatatgtttttaaaacattaatataatcctaaaactaatctcgtttaatctccgattttaatctccgattttaatccgatttatcgattaatagctagtcccataccgagcgcccgattaacgcctaacgcgattttttaacaataatgatatatatatatatataaatgtatatatgatttatatattctagtgaattttacttgtaaactaaatctacaatttaaaagttaattaataaagtagtttagaagaagaagaagaaattgggttgtcttccctaaagattttttctacatatgttcgtagagaactattttttctaatgacaaaaaaatatttatatttaatatttttaatataggtttcaaaatgtatcattcataaactgcaatactaaatttaactaaaatgaatgaatttttaatttcatgctcaagtctaccgaaaaagataaacaaaccacaaaaaataaaagaatattatgggggtgattggggaggaggactttgaaaactgtaaattctattaacaatttttacagttttaatttatccgatcacacttttttgcttttaataatttaaaaattctcacaaccttttttctcattttgttctttgatttcatgtttttgtttaaatcgcataaatctggctttaaaatgataataaacaaaagtcaatagtttttccttttcgttcttctccatatttatgaaaactcccatagatgaattattcctttttaatttttttttacgtttatttacaattgaagtctttttcttgttttattaagttccatattttcaataattatttaaaatcataatttatgttgtcacaacctatagtatatagttatagtttttaaaatattaaaaattttatagcaaaaatttatgcagcaaaagtctttacagccaaaagtaactttcgagatgcatgttttaatttgtcttatttacttgatgatatacaaaagtcagcctaggcgacctttaatgagatgcatgttttgttgtctacaagggtctagttgcaatataataataaaaatgaaattaccatgtcatttcctagaaaatctcatattacaactttgacacgcaaaggcattccatagattctataaattgctctcccaaaacactccaaacaagtcaatataacaaatttttatcttcaatcctctccccatg

SEQ ID NO: 7297 - DNA, 3000 bp, Unknown
  misc_feature (1)..( 3000): cDNA_ID_1817285_gDNA_ID_1621138_Annot_ID_56582 3000 nt of promoter + ATG
tgttatgatccatcactcactgtctaggtttacttttttactttggttctctgattcactcattgttgttaacagatccgtaagtcgttgttcggccaagttactgcctgatgaaagaaaggaaaagagaaaagagattattcaaaccggtttgcgtttggttatttacctattttgggagagatttctctttgttgtgattctttgtattttgcaaaatcttactttggtgccaaacccatcgaacgcttctttttttcgaattcctttttttcattcctcctcgaatgtgtgttatcatggctatacaaataaataaaatgaaagacttcttttctttttcttcactttttctattcaatgtctatgctttatactagtggtttttcgtcatcatagataaacacttaattcataaaaagacccttgaatttttattataaggttagcaatttatccaacacgatcctgaaaatcgtccatcctagtatttttttcgtctaaacacctttaattgcggagttttgataagtttttaacagaaaaaaactcgaataagatatttttttggtttgggctaaaattgttatagacttggcccttgggttttatcccaaatacattttaggtatcacaaacaagaaaaacatagaagtaaaaaactagaagttttttgcgcttttgatctttgtccttttttctacaagttttttctccagactaatctcctcacgattgtctgaagacaagagtctacaagaccggagattcaccgttcgacaataatttccgtacctttcaaggttagatgttcttgcgcttaatttgacttgtgttctttttgtgaattttggatgcgcgcacaaggtgtttgttcatttgcctagacaaagtaaaattgatttagttattcttctcattcatcttctatagtatttgtacttgagccaatcattattcatctttggtgcaatctgaatctgacccatttgagctgttttgtctccttgttcaaattttgtgtgaatgtgtgtaaagaacgcagaatctaatagaagcttctctttagggtttgggttgttaggacatgcgtttcatcctctcaaattttgattttgtttcttttaatgaactcaagggttagtttgatgcttatcaaattgagggtttttgttttggatgcagagactgatttgacatatgaatgacgtcgaggcacttaggcaagaaggtgctctttttatactctttaccttttttttttagtgaatttcgtcgagtgtttctgaagaatttcagcgaaaagtttgtagctttagcttccatttcgttactattttctggtatttttcccaagatatgcatagctttaatgcaaattcttggtgtatttatgtttgctggtttgattagaagttatggatgatggatgattattaaatgttgtattcttagttctcatgctgtttatttattggggtttaggcctttagcttggatttaaaagtctatctgacattttatagtgaagcaaatttgcatatgtatgaatgtgactagacatacgagtatgcgtttatcattgtctaagctattggtattttaaattcttgatgtgaaatattactatttcggctgtctttcgaattgttgattctaaaaatcgttagacgctactctgccggtgaagtagcgcttagcgcctagacggtcgaaacggggattaatcggggcctaggcgttaaagtaaactataatgaatttatattgttttataagaaattttatgaaatttattatattataagtgaagttgtgatgtgaagttatgttggtcctgtggctttctgctcaaattttattgctacagcccttggttcgatacttttcacgctaaaaaaatcgaatttcccccacttaaatgataggggcaaaattgtaatttaaaaatgttggggtcatcttcttcctcaaaaccctattcgcttgtttgatcgttttttcgcttatactcaatttttttcgtttttatccgcttgtttgatcgttttctcacgtaatcaaaccaaaataacacagatctaccactaaaatacatattcatgatcaaaaagaagataattaagtagattctcatgaacgccgatttgttcaccgattgagccaaaatcgcggcggtccacgcagaaatagcgcttttttcgacgcctagtcgaccgattagtccgatgtttagaagcgtttgttttagagaataattatgccttcatttttgtcaagtttgtttggtttggtgagtagtagttacacaatgttcttattgctttgcatatgtttatggatgtctcaagaaactttatgaaatttgcagggcattcaagcctcttttagaataggtttggttcttcctcgagtagtagcatctacagagagacagatttcctctacggttttaaaaagagcttctgaaagtgtctctttttcattcgctccgtacataaatggtaagtgtcactcacaggcgattacaatttttcttagattgttagaaaatgaattagaataacgagtaatctcacccttttgttcatgtttagggtttggttttagttcgttatcaaattggtctcgtagttatgaatctttccctactgaaacatccataaggtaaaccattcgcctagacttttctgtcatttctctcttaaatttcatcctcagagcactcactatgtgaatgtttgctggcttgggttgtgtttcttcttgaacaggtattttcatgcgagtcgagaaacattggcgaaaagaaaagaggatgctgatcgactgctgagtcatcgtgaacgcaagaaacagactgtgaaaacgaaaggaaagttctcaaaacgggagaaaaaaacagataagccacctgttgaagctccttatgtgcctcctaggctgaaaagattggcaaagggattgcctgggaagactgtcgacatatttgaagggatg

SEQ ID NO: 7298 - DNA, 3000 bp, Unknown
  misc_feature (1)..( 3000): cDNA_ID_1817281_gDNA_ID_1621138_Annot_ID_56583 3000 nt of promoter + ATG
ttcattttttttaatcaaaacaactaagaaagtaaaataatattttattaattctagatttagagagatattttttaaaagaaaataaacgctattattcggtgttactacaaacaaatgatacttaatagtgatacacatttatttatttgtctcatttttactggaaagtaatttgctttataagaatgaagtatttgccttataccctaaggcctaagcaatatatggatgtgattagtaacatatatgttatgattgatttaatttgaggtatggatgttatattcatagttagcttaaaaatattgctaagtaagaattcatttaaactttagagttcgcgttttgttgagtattaatggttgagttacaagttttagttatcacttctggaaactttatcttactatatagtattgtgtaagaaagctcatcttctgtatacattggatgatatacttattcatgctaagcaagaactaagaaaataatttacacagcaaaaaataatattacaatttataactatgttgatagcggcaaaagctgaaatctttgtaattcatcaccttcacggggtacacacgactctactaaaataattcatgtaaaatcttgagtcaccgatatccacacgtgtcccttatgtttaaattttaaaatgtggatattgcttttcctaaatttggttagtatctctgactagtgactatataaacttttagttacttatcttagccgattggataaatttggctgacaagtttataataaaaaaaaaaccacttcgttttagtttgttatcttgatgttattacatagacaaattgaggttttggcctaaaatcatgttaaaaaagacatcaaataaaacatcaaaccccatttttgaaaacaagttagctacccaatcatttgagagtccaataaaagtggtagtaatagaaactaggttttcaaagtttcttcgtgagaataaatagcatatgattaaaggtaatgatgagccttcttcatgacacgaaaataaaacaaaataagtaatgatgtgcccttggtccatgtaatattatgattatgacaaaatcatagagaaagtttttttaatagcggtaaattacgataatcgtaataatgtatacttaggttttgaataatgactcaaccgcacattaccgtgcgttttaagtagtaacaacttttttttaatatatatatatatatattttttttattactatttaaaccacaccagattttatctgcagttgaaccgtacattttcatcgaagccttaaaacatattagctcacgttattgggagatgtagctatcgatatggattaatggcttaggaagtaagagtttgattaattttgaaccaagtataagaaaaaaaagagaccgtacggataaatgtcgaagaatataaggacaagagttggacgttagctagtaggaagtgggcctcacttaccgctcgcaccgttagtcccgcaaacggcgccgttctctcgtttcgagccatcatcccacttgtttgttgtttcatgtgacttcttcgtctcgaggcaaacttgactcttcttcactttcgcttaattacccatttgtctgccaacatctcttttggctatatactcatgaaactttaaaaaatcttcttatttgtatgttcgaaactccctgaaagtttcagtcttcttatgtatgacaagaatcgcgagagactatgcaatgaacctaatcaaatataactcttctcaagaaatgatatgaaaaagattcatgaacataagagttggtccttggaaagcgacctcttcaagtcttcattaattagacattgattcaggtgcttaggagttaggacaatgtaaattaataaacaaaggtggtgcttaaggcggtccatgacgttgtagaaagtattttttttcgtataagccgactatatacatatgtgtttttcatttacttatcgcaaataagaaacacacactaatcaactatttgtaaattcaaattcaccaaaattatttatgttatatgttgaacctacgaaactcatagacacagaataaaacataagtgaaaagactgaattaaacacttacttataagtgaaaagactgaattaaaataacaaagaattatcaatagtatttttaataaaattaaacatttaaaaaataaacttatttgaggacgtaacctaaaaatctctatatagttgtttttgacgaatatgagttttattataagactaatttttccaagagataaatttataaaaaatattaaatacgtaatattttttaactccaataaaatattgtaatttcaaaccaaatatttattaattaaaatgtgtaatgagatacttacatatcatctagacaagttgagattttctttatagggttttgtaaaaatttgatgatttttaacaagaagaaatccataggaactaataataaaaaatacaatgcaatgatatttaaaaaaacaacaactgcattgcagtgaatttcatcaaaatccattaaaacatttccaaactcaaatagaaacaacttcaaaaccttaatccaaaatgttatagatagatatgcaatagctcttaggcctagtacatagctagatcttgtaactcgtgaaggcaaatgattgggacgttggttcggttctagtggtcgggctcagcctggcggaaaaaattgttatgggtctaaggcccataaagtggcccagaaataaactcgtcgtatttacacacgttgtcgtttctcttatcttctagaaaactgtatcccgtttttgttcttgtactctacacaaacagacaacttcaaattactcaacaccacgtcgtgaaaatccgatctacgtctctgtctctctccaatctctctgcgccacagaattgtgcgatttacgaaaatctctgaaacctccgatcgttaacggcgaccgccgattttcccggtaaaaatg

SEQ ID NO: 7299 - DNA, 3000 bp, Unknown
  misc_feature (1)..( 3000): cDNA_ID_1817265_gDNA_ID_1621138_Annot_ID_172749 3000 nt of promoter + ATG
caagcgtttgttactcacttcaagctccttagctttgttctcatgatgcaacttaatagcctcataagcttcctcagcatgcttaatcctctcctgaagactctcataatctttcaacagagtctcatgattctccttcagaatttcatgctccaaagtcatcgttttctctaaaccaaacatcatcttcttctctgatttgtcctaaacccaaacctgaaacaacatcaaccaatttctacagattattaccaaactcataagcttaatcaaaaattctgcaaaaaccctaaatatccaagctttatgttctctttatgactgaaatgcaacgaagatgagaattaaaccagatttatgagctcagattgtggaaatcgaaatgggtttcggaggattcagagagaaaatggtgagtaacagggaagagagagtgtggttaaaactcagattctttcaagcattcaacaatgtaaacagaatcagatagaaagaaatggaattttctcgagaaaatcttaccaggattgcgaacttgaagaacctaaagagagaagaagacgaagaagcaaagtcctcctaaacgttggttaatgataacgtaatcgaagatgacagataatgtttgtatgtatttaagtaatattattcaaattaattaattgtttattccatgtgaccaaaaaaataattaataaattgttcattcttaagctaatttaacccaaacctttttttaatttaatccaaaccttgtaactgatgcgatgttttttttactagaactttaattttctgtttttaccgttttatatatggcattcagtaggtctgggtacgaaacggatatccggaaaaattgtgatatttgttattcgattcgttttaaacgaatacttgattttgtgatttgctttgctttgcttcgaaaatttccggatatccggaatttcgaatatccagaattttttgtgatatttgcggatatccgctttgatatatttaaatattaaaaaaaatctatatactatataactatatcagatattcaaagtttttatttaacatgctttcaaaataaaaactaaatacttgttggtaccaccagtctacaaaatgttatcaaactaattccgaaaactaaaacccgatagtttttgatgtcgttgatcaaaacataacatgagaaaaatgatcaaacaaacattttaacataaaaacgtaaaatagcaacaatacacaaactattatgatatatatatagatataactatattttctaatatatatataaaaagatacggatcgaagcggatattcggttttttttttttaaaatttgttatttgattcggtttttacgaatactacattttcctatttgctttggtccaaaatcttacggatattcggatttttcgaatcaaaccaaatcatataccgaatcaaagcggatcgaacgaatattttgcccagccctaacattcaggttaacaacagaaattaaaggtattctaacattgtaacattaatgtatgttttcgtataaaaatgaaagtttaaatatcaaattgaagtttaggttaaatcaactgtggtataatacgtgtataaatgcagcatagttcaaactaaagatatgaaaaaaccaattttccgttttttacataacatttgtgcaaattcctatactattaaaagagaaatataaatttgtttcaatttgaattggatcgggttatgttaaaaaattaacataaattgacctgaaatttaagtaattggatttttggcaaaacaaaattcggaatataatatgaaaatcaatgtttttaaacccgatctggacagtgaaccggacaacagttttttttcttctacgcatcgtttgtttgtattatttatatatatatatatatatagtgatatgataacttccctaaaattagctgaataattaaatgaaaaaaatttcagttgatttaacattgaatttttttccttgttttttttaacccatttctccacatttttttgtagtagtttagtttcgtaatttctgcagtcacaacttttagtaatgagttataaacaattacaatcaaggtttttatagtaaacacatcttttactaaaaccacgtagaataattggaaatcaaacataatttttctaaagctcctaaatttttttagtttgtccttagaaatcaaatatatttttgaatcttttttatctaattaaccgcaatatctataatctgaaagtgttaggaccgattggtaacaagtgttatttctaactatatcaattttggttgtagaaaattttggtgtaaggaatttgaccgtagaaaatatagagacttttgcagttaaaattgcagatgtgaaaattttgaaacaattggtaaaaattatgagtttagaaattaaaactttaaataatataaacgattagattagttgtgacatatgcgatacaattttttttcatctctactgaagagatcgtttttattgatattgacacaattgatgacggtttcatatcattaaaaatgataatttagagaatgttttttccgattttaaatgatgctttcaactttcaatataaaagttaaatgtatttaatattttttgaccaataatattctatagtatattttttattggttgacttagatatagttacttatgcaaaaaaaggtaaattaaactaaacttttgtaatatgtgtaaaaaaccttaaacattacttaaaatcagagagagaataattacggttgtttagaatcctcattaatcattctctgtttcatttattaactttctgtatatcattaaccccacaagcattaaattactcactaatctttttggattctattattcattggtttatcgcttaggcaataagtacggaatcaaaaacattccactttctgaccaaaaaaaaaaaatcgtatatctctcagcgcgagggaagaagaagaag

SEQ ID NO: 7300 - DNA, 3000 bp, Unknown
  misc_feature (1)..( 3000): cDNA_ID_1817277_gDNA_ID_1621138_Annot_ID_172743 3000 nt of promoter + ATG
ggaaaaagaaaagaacaaaccttagatagaacacattctcagagagattgcagtagaattagacatttctcttgatcgaatttcgattccgaaacacaattgagaagattcacagcttcttgtcgtcaaattggtaggggaagctttttctccattatcataaaccctaaactaaaagtttctgcaaaaacaactattttatcgaactcttaatgggccatcaatgggcccatacttataaacttaaacccttttccaatttcagtcgtattttacaaaaaccatcaccgtcgttatcacagtaaccaaacaactttcatcgccgggtaagctccattcccaagctatttcgatctcgtttcacgtcgatctatttctagtcaagttaatctcttcttttagggtttaattagttaagacttgcgtttgattatctcaagttcagaatttgtttcttgatgatctaaaggaaggaattttatacttatcaaattgaggatttttgtttttggatgcagagaactgattaacatataagaaaatggcgtttgctagagcagtgagaagaccaattggagtcttttattatagtgttagtagtagatttagttctggaaatgagtattctactgtggcaagcaaattcgaaactttgtctcagtacaaaagctctgtaccgtctggttacacaagccttgttcgtggttttgggaatttcatacggagttttagttcggaagctcctcctgctgtatctgaccaaatgagtcttattaagcaacttagggaaagaactagtgctcctattaaagatgttaaggcttctttagttgaatgcaattgggatcttggtaagaatttggtttaggttttttgttttggtgaaggttgtgtatgttttgttgtgttttgaagtgggtttttttggatttgacacagaggctgctcagaaggatttgagaaagagagggaaagttttggcttcgaaaaagtcgtcacggactgctgcagaaggaatgcttgccgttgctcaaaatgaagggaaagttgctgttattgaacttaactgtgagactgattttgttgctaggaatgagattttccagtacttggttagtcccatagcaatttcacattggttgttgctgaatgatgggctttttgtttattttactgttccttgtcttctaaaattgacatgtcttgcaggctttagctatggcaaaacatgctttgctggttgagagtagttcgcagcaagtttctggtgtcttcccctttgggccggagctttttgaggtcagttttttatgtactcgcttgtttccttttttgttatttaaatttatggatttatgttgtttcctttgcactgtctgagatattgatatcaacttttcatttctaatcactctaatggatgctatcaggagttcaagcttaacctcgatcatccaaaagttaatggtgaaacaacggtttcaaacgctgttacagaagtagctgcaatcatgggagagaatgtaaaatttaggagaggtttcttgatgtcaaaatcttcagcaggcgtcctttctgcatatcttcacacaagtcctcaaccaggtacaatttgttcaatatacttcccattgtttctaatctctttttttatgatatttctgtgcatttctaactttaaaaaaaaaaatgagaatagggttgggtcgtatagctgggattgtatctctcgaagtagaaggtgaaaatactcaactagaggctattcagcgtgtaggctcagaactggctatgcatgttgtagcagcaaagcctttgtttttaagcaaagaccttgtttcttctgaagcaatggcaaatgaacgcgagattctaaagtctcaggttagtgtcactttatgttatgaaattgaactgtaatttgtaaaaagtacacaacctgcgttagaaaagtttgcttatcaaatgttgtatatgacaggcagaaagtacaggcaagaatcagatggcgatagagaagattgtggaagggcgtctccgtaagtattttgaagaagttgctctaatggagcaaaagtttattgtgaacgatgctataaacattaaggtatgtgggtcttagcttaaaacacctagtttaccgttttattacctctgcatcgcttgttgaattcaactcttgggctcctattccacagacactggtggataatttgtccaaggaggtaggttctccagtgaaggttaccgattttcttagagtcgaggttggggaaggaatcgaaaggtaaactaaccgtcacccgtatgtccagtacggcttatcattgttgtaagattagtcgcttatgaattttgttttttttgaaggcttgaagcatctgatgaaccagttgctcaaactgcttgaagacaaagaatcaacgacatggttttagatttacagaactctttccttctttggttcctttagagttcatggcttcaacgccttcttgagattatagaatctttctcatgattttgtttctcacacaatatggcaataagagtgattgtgcctaggaagctatgaccagaaaaaaaaaacatgtttgtgttctcctactcctactaagatcattatacaaaaaccttcacttatgtgtttgattttaaggtactcaagtatttgaataagcagatagtgagttcttggctcctccggttaccaacggtcgaaattgacggtttaatataattcatagacaaaaccggtcaactttatattatccacaatcaacgatcaagatcaacgagaactaatcttacggttgatatcatacatctgtattgagttacagtacaccacaaaacactcaataaacactaagcactcttcttctaccttttgattttcgaaaaacgcaaactttctgaaaaagcaaaaacttctgattctctcgagaatcatttactcttcacactgtccccgtctctctttctcttgggttaatcatg

SEQ ID NO: 7301 - DNA, 3000 bp, Unknown; identical to SEQ ID NO: 7298
  misc_feature (1)..( 3000): cDNA_ID_1817281_gDNA_ID_1621138_Annot_ID_172738 3000 nt of promoter + ATG

SEQ ID NO: 7302 - DNA, 3000 bp, Unknown
  misc_feature (1)..( 3000): cDNA_ID_2144432_gDNA_ID_1621138_Annot_ID_172737 3000 nt of promoter + ATG
tcgggctcagcctggcggaaaaaattgttatgggtctaaggcccataaagtggcccagaaataaactcgtcgtatttacacacgttgtcgtttctcttatcttctagaaaactgtatcccgtttttgttcttgtactctacacaaacagacaacttcaaattactcaacaccacgtcgtgaaaatccgatctacgtctctgtctctctccaatctctctgcgccacagaattgtgcgatttacgaaaatctctgaaacctccgatcgttaacggcgaccgccgattttcccggtaaaaatgaacgacggagatgtatcgaggcagatccagcagatggtgagatttatccgccaagaagcggaagagaaagcaaacgagatctcggtttctgctgaagaagtatgatctttagtgtttctgtttccatttatcagatcttatgatatgaatctctaattcaatcgtaagcggtttatctgattgttatcgatttggtttatttgaataatcgtaggaattcaacattgagaaactccagcttgttgaggcggagaagaagaagatcaggcaagattatgagaagaaggagaagcaagctgatgttcgcaagaagatgtgagttttctgatttcaatttttttgatcttggttaagttttaagttagatcgcttgttctggattacaatatctctgaactttgaaaaaattagaagtttatgatttatagatttgaagttttgacttgattgatttcaaacttgtaattttcttcattgatgaataagaaacatagtctggtttagtctaatcggcaaaactgaagactaatttagcaattagtctgatgtaagattatggtgtagtagtgtactgtgttgatctagctttcaaattctctaatattgttagttctctgtgaaaattatgttgatcttgttcatttactgtgttatcgtgtattactttgccagaaaataactgtcatacatgttttttcagtgattactctatgcagctaaatgcatcaaggatcaaagttcttcaagcgcaagacgatattgtcaatgccatgaaagaccaagcagctaaggatcttctgaacgttagtcgcgatgagtatgcctacaaacagctcctcaaggatctaattgttcaggttggtacttaaaacaaatccctgatgcattcaaataaatatttgatatttggaacttttttttgtatatcctactggagattatgtaatcgtgtcggatggcaatctttttttgtgtgttttgatccgttctgctgatgtcattttgcatttcgaataccttttggtctgttaaagattctctcttgaattgttgcagtgtttgcttcggttgaaagaaccttctgtgttgttgcgttgtcgtgaagaggacttgggtttagtggaagctgtacttgatgacgcaaaggaggaatatgctggtaaagcaaaggttcatgccccagaggttgctgttgacacaaaaatattccttccccctcctcctaaatctaatgatcctcatggtctccactggtaaaatttcatgtttctcatcattactttacatttaaatttttataaaagaacattatcagtgtttagatccggtttgatagtgtattttgaacatgtaatagctctggaggtgttgtgttagcttctcgtgatgggaaaatcgtgtgcgagaacacacttgatgcgcgtcttgatgtggcattccgtatgaaactcccagtggtatgaaaaacaaattctctaccgcatagattacttgttatgatccatcactcactgtctaggtttacttttttactttggttctctgattcactcattgttgttaacagatccgtaagtcgttgttcggccaagttactgcctgatgaaagaaaggaaaagagaaaagagattattcaaaccggtttgcgtttggttatttacctattttgggagagatttctctttgttgtgattctttgtattttgcaaaatcttactttggtgccaaacccatcgaacgcttctttttttcgaattcctttttttcattcctcctcgaatgtgtgttatcatggctatacaaataaataaaatgaaagacttcttttctttttcttcactttttctattcaatgtctatgctttatactagtggtttttcgtcatcatagataaacacttaattcataaaaagacccttgaatttttattataaggttagcaatttatccaacacgatcctgaaaatcgtccatcctagtatttttttcgtctaaacacctttaattgcggagttttgataagtttttaacagaaaaaaactcgaataagatatttttttggtttgggctaaaattgttatagacttggcccttgggttttatcccaaatacattttaggtatcacaaacaagaaaaacatagaagtaaaaaactagaagttttttgcgcttttgatctttgtccttttttctacaagttttttctccagactaatctcctcacgattgtctgaagacaagagtctacaagaccggagattcaccgttcgacaataatttccgtacctttcaaggttagatgttcttgcgcttaatttgacttgtgttctttttgtgaattttggatgcgcgcacaaggtgtttgttcatttgcctagacaaagtaaaattgatttagttattcttctcattcatcttctatagtatttgtacttgagccaatcattattcatctttggtgcaatctgaatctgacccatttgagctgttttgtctccttgttcaaattttgtgtgaatgtgtgtaaagaacgcagaatctaatagaagcttctctttagggtttgggttgttaggacatgcgtttcatcctctcaaattttgattttgtttcttttaatgaactcaagggttagtttgatgcttatcaaattgagggtttttgttttggatgcagagactgatttgacatatgaatg

SEQ ID NO: 7303 - DNA, 3000 bp, Unknown; identical to SEQ ID NO: 7296
  misc_feature (1)..( 3000): cDNA_ID_1817289_gDNA_ID_1621138_Annot_ID_172736 3000 nt of promoter + ATG

SEQ ID NO: 7304 - DNA, 3000 bp, Unknown; identical to SEQ ID NO: 7300
  misc_feature (1)..( 3000): cDNA_ID_1817277_gDNA_ID_1621138_Annot_ID_56585 3000 nt of promoter + ATG

SEQ ID NO: 7305 - DNA, 3000 bp, Unknown
  misc_feature (1)..( 3000): cDNA_ID_1817269_gDNA_ID_1621138_Annot_ID_56588 3000 nt of promoter + ATG
agttgcatcatgagaacaaagctaaggagcttgaagtgagtaacaaacgcttgcttgaggaatgtatgaaagagagaagggagaaggctaaggttaggaagacttttgaggagatgaagaagacaatggagagtgagagaactgctattgttgatgagttgaagtcgaagaatcaggagcttttgttggggaagaagaaagaggaagaagagttagtgaagatggagaataagtatgttgagttagctgagaagtttgatgttgttgaaaaggaatgtgcttacttgaagtcactctatgatgcggaagtagtagcttcggttactcaaagtgctgtaatctcaggggttggagagactgataatcttattggtcaaggagagaacgaggctaatcagaatgtgaacaatgctgtgacaggtatacatagacatctctgtacccaagtgttgtttagtttacaatgacatttcttttgaatctatctttgtgtgcagatgcgataatgataagtgatgatgaaaatgataataatccacctattgagagtaacataagctctcatcggtctggtgatagaaaccaagaagaagaaggcaggaacagaggaaactcagcgactgagaaccgagcttcgggagaaacctttactccggtatctgctaatcatccaccgcctttttctccttcatcgtcatcttcatcatcatcatcttcagacggcgctgagattgtgcttaagctgcctcgtaattggcctgaatgggcaatcccgaaaggtcccgggaaggattccaacaagccttagaacatttcagatgcaacagagagccaaaagaagtaaatttgaagctgcactcttaagttaagctagttatggaaatcttcttacatattgctttctgtttttgtcaggagtttatttaacaatctctggaactacaacaaactattctatctactatcaaatcaattattcattcatgagtataataatagctgaaactttctgtgttacaacaatttcaccataactaaaattgcatttgcatttgaatactgcaaacgcaaattggctttgtatacgcatcttgtttatatatggattagttttttctacataattaatgaaagcttttgtaaactaactcttgagtactaactaataagaaagttccgtggcaaaataatttccgaatcatcggataatcatccatttacgaggttaagttccgggaactgctggtgttaaggttctggaagatctccggaagattggcattagtgagtttgattctcttgctgatctgttgtttgccatgccatgaatatgtgcaacagctcttctctgtgtagtgttcatcacacatgcttcaaactaagcttatgcagctccttctcgactagcttgtcgcttgagttgtctatgccgcggtatagaggtttaaagtcgtcataaacctgaatctgacccttgaaatcagcattagacagtccttaaacttttagagccagcaaatatgaaagacaatcctgaaaaatggataatcataagaccacaaaagtcttttgaaaccatttaagatcaggagccagtacactatccgtctatcagaatctggcaataaatattatcagaagcttattgattatgaagttaatacatcttaaatagaatcagttaagcgttttttgtaaatctaaatcacatgtgaaatttctttatgtcacgttttcatttgtgtaaaacaatatcttttgatttattaagcaaataatttgcagctaaagctctcaagattcaaataaattgaaatgtaagtagtgtaagtagtgatttcttatagaaatagttgaaatctaaaagtattaggacactgatgtaagtattgttaaactaaagagatctatcaggaaatcaaatcactatagttttttttttttttttaaattccttgagtttatcaaacaaaaaaatgtaaatgtccctagcaagtactgtaggttcattttttttgtttcaaaagagtatgttatttcttaaaaatcgccaaagatagataagattcgaaatttgcataaatgtggcaataaatattatcagaatctttttattgaataatgaagttaatacaccttaaatagagaattaagcgttatttagatctaaaaccacatgtgaaatttctttatgtcacgtttttgtttgtgtaaaacgatctctttgagttaatttgcaactgaaagctctcagcattttacattaattgcaatataaatagtgatttctcatagaattagttcaaatcttaaactattaggacagttacgtaaacattgttaaactaaagggaccaatatggaaacacaaatcactgtagttaatttttattattatcttgagtttatcgtctatcgtgttcgaattctctgtcgcttacttaaacacagtcaaattcattttctgccttagaaaagatttttatcgaaaatcgacgtttttgaaaaaactcaaattatcgtcgttttgttctcagatttcttctgctctcttcttcttctccttcttcttcgttccaccgcctctgttgctttatcttcttcttccttccttcgattgttgattacgtcggtggatctttgttctcctctgtgttgttttcattgctagatttcgtcaatgattggcttctcacgattcgatttttccggctcctgttcttaatttcctctgaggtagattagtaaaactctttgtctcgtaaacattgttcgatgatgaaattagaaagttctcactcttgtttgccaaatttgggatatttctggaattgaaaatgaatcgtcatttttttcaatttctgaggattttgttacaattgttttttatttatgttagaattgagattgtgtgatgaatatcagtaaccctagacaattgtgaaatcaaagctatgaaaatcttttgatgctatgtttcctatgatacagagaatgatg

SEQ ID NO: 7306 - DNA, 3000 bp, Unknown; identical to SEQ ID NO: 7299
  misc_feature (1)..( 3000): cDNA_ID_1817265_gDNA_ID_1621138_Annot_ID_56590 3000 nt of promoter + ATG

SEQ ID NO: 7307 - DNA, 3000 bp, Unknown
  misc_feature (1)..( 3000): cDNA_ID_1817261_gDNA_ID_1621138_Annot_ID_56591 3000 nt of promoter + ATG
atttgaccgtagaaaatatagagacttttgcagttaaaattgcagatgtgaaaattttgaaacaattggtaaaaattatgagtttagaaattaaaactttaaataatataaacgattagattagttgtgacatatgcgatacaattttttttcatctctactgaagagatcgtttttattgatattgacacaattgatgacggtttcatatcattaaaaatgataatttagagaatgttttttccgattttaaatgatgctttcaactttcaatataaaagttaaatgtatttaatattttttgaccaataatattctatagtatattttttattggttgacttagatatagttacttatgcaaaaaaaggtaaattaaactaaacttttgtaatatgtgtaaaaaaccttaaacattacttaaaatcagagagagaataattacggttgtttagaatcctcattaatcattctctgtttcatttattaactttctgtatatcattaaccccacaagcattaaattactcactaatctttttggattctattattcattggtttatcgcttaggcaataagtacggaatcaaaaacattccactttctgaccaaaaaaaaaaaatcgtatatctctcagcgcgagggaagaagaagaagatgaagctaaaatgggaatcaatctctaatcttcaacaaaacacatatctcataaaactcgtcgctgcaacacttataacttgtctcgcttttcgtttcttcgtcttccgcttcggccaattttccccagttcaagtgtcggtgaccggaaactccaattcccagatttctccgacgtctgttatcttatcggataacgaagatcaaattcccgtcggtaagatttcaattatatcaataacattaacgatttcgctgtgtagaattttgttaaccttgttttttacggaaacttctgagatctagggttcttaaagatagtttacaactttagaagagttttaaatggttcattagcttctgttagtttgtgatgataagaatctgttttgttgtattagatattgaggtggagaagtgtgatctatttactgggaaatggattaaagatcctttgggaccaatctacacgaatgagtcatgtggtatcgttgtagatgctcaccagaattgcatcactaatggtcgacctgattctggttttctcaattggaaatggaagcctaatgactgttccttgcctcggtttgattctctgagatttctgcagcttatgaggaataaatcttgggctataatcggtgactccattgctcgtaaccatgtcgagtctttgctttgtatgctatctacagtaaggtttttagctattgcttgctagctatttgcagacttgaggataatgagatttgtgattgtaagttttgtttgttttttccatgtttcaggttgaaaaacctgttgaagtgtatcacgatgagaactatagatcgaagcgttggcattttccttcgtataactttacggtatccaacatttggtcaccttttcttgttcaagctgatatctttgaagactcaaatggtgtctcatcagctgcagttcagcttcatctagataaactcgacaatacatggactgatctattcccgagccttgactatgcgatcatctcttcaggggaatggttcttgaaaactgcggtataccacgagaatgctaatcccgttggatgccatggctgcccggagagttcgaacatgacggatttaggattcgactatgcttacaatacgtcgttgcgccatgttatggacttcatagcgaaatctaaaactaaaggcatgatctttttccggacttcgatacctgatcattttgaagatggggaatggcataacggtgggacttgtaagaaaacagaaccggtgggtgaagaggcagtcgagatgaaagttctgaacaagatattgagagatgttgagattaatcaattcgagagagtggttacggagatgggtcaggagagtgagaatctaaagcttctggattttgctggcatgttgctgactcgacccgatggtcatccgggtccatatagagagtttaggccgtttgataaagataagaacgctacggtacagaacgattgtctgcattggtgcttgcctggtccgattgatcacttgaacgatgtcatattggagatcatagtgaatggtcgaaccggtaaataaccagtttgcttgtatgtagtcaatggcttaaaaactggatgaattgaaaacagaggtttggtatataggtcatgtaaattttggtaaacatgaagagatttggttaacagctagagtttctaatgaaccggatagatcaccttggatgaattgaaaaccggttcggttcacgtagccattcttatggatcaatttatgtaaaatctgatttttctggatttggttttgtttagtttaatggtcaataaaatggtgatccaatccggtttagtaagttggtttggtgggcgagttcaacatttgggaaacaataatcagaaattatccataaataagaagaatcaaactaagatgatatataccagaagacaggtaactctgtgaaaatagtaaaattaaacacagagctgttaaattctggccagtttaatatttgctccggaaacttgaacatctctcactttttttatatctaagagagttcaccattatgaagcaattccaattataaacccatcaatttctcaataataatcgaagtttctcatctacgaaggcgacaaaaaaaccaccgaatcttaggttttgttcattcgaacgaatccgaatttcgcagtcctaatgatcggatttaatatttgattatacgctttcggtgacacacccttctttaggatacgaaagagtgcaacgcctttccaaagcaatcttaatcacattctcaaaaacaaaacaaaaaacactaaacggaaagtagaaaaact

SEQ ID NO: 7308 - DNA, 3000 bp, Unknown
  misc_feature (1)..( 3000): cDNA_ID_1817305_gDNA_ID_1621139_Annot_ID_56595 3000 nt of promoter + ATG
aacgacataactagattttataatgacaacataatttaccaaaataacattattaagtaggatcgtaaacttgagttttataaaccaactgcaccttgagttttattaaccgactcaaccagttgaataatgtttggttaatgacataaaaacctgtctcagcaatgtgtttgtcggacgagtgatatatacaagattatttggggtaattagtatatatcatattatgtaaattgtaattaaaacactaaggacatctccattggttaagatactctgagtatcttagcaataaaataacaaatacttttaatagatttcagttatcaaatttttttgtagatatctttttttccaattttcccttaaattaatatttatttgaaaatcatcaatacaattaaactaaaacccatgtctctcaaacctgacacatcaatattttcgttcaactagaagacataaaaatgtcggaattgtaagatgtaatgaagccaaatttagtttgaaacatcgctacgtaatgttttatctcgctagagagaagaaatttcaatttattggtcatatttttaataattaaaaaataaatcatacataaataaataagttaacgttttaactaattaatatgactaatggttaaaatataattatataaaaaaagacaatggtaaaatttcataacaattcatagtctccaacataagtattaacgaaaaatgccactcaaaacaacttcgtatcaactctacaagaaaaaaactaatcctcttgtttcttttaaaagaagaataagttatagattatgactttacactaaataagattagtactttgattattagaaactcaaacacaatttcatcaaaatactctgcagcataacacggatctttatctaatatatatgaaaattggttaatcctctccatatgaatgtcgtcagcattctcgaaactgtcatgtgtcatcgccatgtcatgaaattttaaacatgcatgacacataatatatagatttgcaaatcataaacatataaaatcttttcctctgctaagaaaataaaaataaattcatcagccaatcaaaaataaaaataaaatcttttcctttcatgagtttttagagcatctctaatgaaatatctaatcaaaatagtttctctaaaataatgataaaatattaaaatgttggagatagaaggtgagagaggttcttaaagttcttatttttgagaacccatgaattctttattagacacactcatgataatgccaaccttgaatgattatagtttttgtttacatatttaatttaaatagataattgaattatattaaaatattaatatttgttagcttaaaattccaaattaagagtcttacccagggccggtccaaccaaatattaatacttgacaaaattttcaaatttatctctatttttaagtttattaattgatgatattaaataaaacaatacattaattagaggtaaaaaaatattgaatattttcttaatatttatgaaaaaattttaaccgacaactaatataaaatagaaataatattatttttatattatggttttagtggaattagctagttaagatacccacaataaaaaaaactcgaattataaataatatgttattgtataaaacatttatgcatagtcctgttttatcaaaaggcttttaccctttcgaaaatatttagtttttttttttgaatcatttgagttaaatgtttgagtcttttttttttttgagttaataacccatgcttatatgtttatatctttgcaaatctgaaccccccaccccacccccaaacaaaaaaaggtttgcacatcatgtcagaggtgtagtggaaattactaaaaagggtaaaagcataacttttttaacagttcccaaaatggataaaatgcttaagatgagatgtcacctagattccctacatcagctacttctgtatatttagtgaattttaatattttttcaaataaattttatttttaaaaaatctcagttaaaaaaaaaatgctcttatgctcttcgataactagagtttgaagaaaaaatgaatttagataaaatacgatcagatacttagaaataaacaagttttgttttgatttttataaaatagaattatttaaaatttcatctacatttgagtcaatcctgttaaaaaccaaagttttcaactttaaagcgtttttttttgtgtggcagtgttcaactttaaggcgattagaattactaatatgaaaacaatcaaattgatgacctcgccaactagagtgcattacataccacttaccactatggtaacaaaaattcaatgttatcactcttttgattaaattgtatgtattcttattcgattttgtctatgttgttttttgatagctagaaagtaaagtttattcatttcatttataaactgtagataacagaataagaataattaaacgtgagggatagcaaagttagaactcaacttaccattatagtttgttctgttcgtataaaaatagaatgtatacttgtttcatctttcttgaagatgtatagtttcactttagtaaagaattaacgcactgcatgaagcatatgaactagcggttaccagaagagataaatattcttttaaaaaaaatggtcatcatctacgtcaatgtcatgatctgtctaattcatcgagaaacttgtggcaatcaaaagagaaacagaagaagctttagttttataaattcgtactttattctaaaattaaataaaatttaaaaaatatatatatatgactagtgaacaaagtctctatatatacaagtttcttctgccttcaatcattcatatacacaaaccccttagagaaacaaaaagaatacaaaaagaagagagagattagttattaacttattcataataagtgtaattacttcgtatttacttttttttggttagcagtcgactagtaatcaataatg

SEQ ID NO: 7309 - DNA, 3000 bp, Unknown; identical to SEQ ID NO: 7308
  misc_feature (1)..( 3000): cDNA_ID_1396358_gDNA_ID_1621139_Annot_ID_172762 3000 nt of promoter + ATG

SEQ ID NO: 7310 - DNA, 3000 bp, Unknown
  misc_feature (1)..( 3000): cDNA_ID_3050221_gDNA_ID_1621139_Annot_ID_172775 3000 nt of promoter + ATG
acttctaatgtgtttattcatttattccatgttattattattttctatatagctagagatcaatgttattaactataaccacaaatacatctgatcacttgtttaaaattaaacagttgcatttagattatacgatactcgtgagactggattcattgaaccggaggaggtacgtatgtaaactttgtctcaaaaaaaagaaaaagtcatgattaattatatttgacggttttcctcgacttggagaaatctataggtgaaagagatgataatagacgttctagaggaatcagaacttatgctatccgagagtatcattgattctatcgtgtctaaggtgtgtataacgcttaagtttatgagcttgatttaacattatagtgattttacttactatttttgtttacttatatttggcaaagacatttgaagaggccgattggaaaaaagatgggataatagatttggaagaatgggagaattttgttgccacctatcctttgacactaaagaacatgactatccctttcttgaagtaattcgtttgtttgtttttcctaaccattttcttaatattcgctgataaattgcatgttttagatacatctttcgttttacaaaaaaagtaatatatatacatctttcaaaaacagcttttatatatgtgtgtttatgcatatattactattatcttcttttattttatttttcttgttttataaatcgagataattattctaaaattaacttttattgtacagggacattccgaggattttcccaacctttctccggtaaaatcagatgaggtgtttgctagaggtttttgtttaaaaatatttttatccgaaaatcacataggtaatttgttataagaaatatagaaggttaattattatataaacatattaactatcgaaagaaatctttaatatttaacgaggatagaaagtaattgtttttaaccacaaagctaaagctgtgatatgaaaacttaaaagcaaagatcggttcgtgaagacaaaatggggttttggaaaaggaaaagaggaaaaagaaaaagaacaaacgtgtgaaaattcgagaaaaatggtaacacaaaaagaaattggacatgatataagttgccaaaaccaaagagaaaaaattgacatgatataccaatcaaatttttgaatcaggtcaactaatcaaattcacaacaatcatccacaatattatttagatttgacgctttcactgtttcacatgaaaattttacatttgacgcgatgacttgtggagtcacgatcattttagtcactcgttttaaacggatgcttcattcaaaaaatgtaacttatattcagaagactcctaacgtccgattcagatttacaaaaaaacaatatcattgaatcggaaaacagaaaagcatagtaatattctaagtatttaattataatcgtgaggaaatagttccgtaataatgggggaaaaatatatatatgataaaaccaaaatgagatttgcctgaagatgccatatgtctgatcaaacactctgagctgttgtgtcgatgaactcaccatatgccaagatacgctattagcgacaacacatttgtattgtcaaatgtcattaattaacatccacaggtccaacaacagagaaacaaaataattatcacaagtaaaatataaaattagtaatatacttgtacttataatttttggcttatgccttttaatttattttaacactagactcgacgaaactcatcactaacatgaccacaaaaaaaaaagattacaattctaaaacacaaagattaaaaaagaaaacataacgaagtaaaattaagactagacatcaactttacaagttgaaggagcgagaagaggaacttgtccgttagaagatggattaaatctcaaccacacatcacatctggcgtaaaatccataccgtccagtcttaatcgcaccagctttccaacgtagcctcccaaaaatcaccactctcatcaaaacgacgccgtaagcttcatcattttttaaaccattagctacttccggcgagactggtataccgttgcctcccatcaccggagctatcacaaccgtagatttatgtcctaaacgaagcggtggtagtggaagcggcggtgttatgatctgatctttgtacgttacgtacatagagagcttgtcgtagtgaatggagactctccggttagggtttcttgctaaaacgctgaactgaacggaggttgagattaacggcggcgctgtgaaattcaggtcgtagatggcggctccgacgacggtgagacgtggtttatgtggacggtagacgagccaaaggattaaggctatgatacctagtatgacaaggatggtgaagatcgcgccgcagattgcgcggcgagcatctccaccgcctcctccgccttctttagagtaagattctggcgttgaagaagcggagggagcgttcttgtgatctgctttggctgcgtgctctgcttttgcttctccttctcccatggctatactctacagatataagtgttaaagtgtgtatgtataggtatgtgtgtgtctatacgagaatcagagggttcggtgaagagtgaagactctaaagaaggaggaggagaagaaagaagataagtagatgcaaggttttgtctcttttctagttaataagagtaaacagtcttctagagtacagttttattaattgtttattaacttagaaagcttgtagttgtaattatgtgttaaagctaatctttttataaagtagccgtaaattactactgtttttacattgtgattttattttgttataatacttaatgtaataatataagatagagaagtactttcgaaagactccaaatctcggtgcaaccgttcacgtgacggatctgatgagtgatgaattttttaaaaatgaaaaatccaatgtaacgtgtatacatatggctatacataatcaaatactttgttgtca

SEQ ID NO: 7311 - DNA, 3000 bp, Unknown
  misc_feature (1)..( 3000): cDNA_ID_1817301_gDNA_ID_1621139_Annot_ID_172768 3000 nt of promoter + ATG
ttacgatagcaaacaaatgttatatgataattcagattgtatctcagtctacaagtattttgtagcgagaatgcaaaatctgaattctgttttaaaagtgaaattcttaaggaacttttttaggaagaacacatcaaatcaccaactaacgatgtgagcatgccaattatcacgactgtgcattcaggatcttgattgattaacgtttcttgcctttatttttaacaagtttcccttgcagaccttgttaaatgttttgtattcatattttcttttattctcgaaagcattaatcacatacatataccacaaagaaaagctacatgaaaagtaactaaaattgaattcaagatacttagggaaatgtttgtgttagggattaagcgaaaatgtgtttattcgtctagtcattctaatttttgtacttgcaccgtgtatacatgttattgaacaaaaaagctggacaaggcccacaactttatttgttgggttaatatgtaaacttatatggtctttggtataagtcgataccttcgcattaatatgtaaacttatatggtctttggtataagtcgataccttcgcattttcatcacttgaaggtgtgatttagtcataaaagcttaaccttgatttgcagaaaagtgatcacatacacttgaatctagcgacaagtaaacgaacaacttttggtcacggtcgctgatttatgtcgctatcgacatgtaaacaaacaggaccaaagtcatgacatcaccatttgtcgttaattttgtttgttcctcttttttttattattttttttttgaatatctgacagttcaagttcgaatgtcctatattttttagagatgagatctacatgaagttaaattcatgtcatttagagaaaaaatcccttccaacaggcgtcgaacccatcagctctatctcaaagatttactactggaccaataccacgttggttttgcttcttcctcttctcgtgagattcttctacttcaatgcttctgattcttctatgttcttaatctttcaacaaatacagtagtacctttaggatctgcccagaaggctgcggtatctttgatctcccttaccaggccccaatcttctcaaatcccatagcagtaaaacaattaagaatcgttggacttaggcttatctcagagattttaatgtaatgggttatagattacgaccggctttagattccgaggcatggccgacagtttagattcgtaatgatttagatatagtgcagccattgtgcttgagctacgtacatacgtccatgtcaacgatccactagctagtcttctaattaaattatttgtttttctttagtattacttttattttgttggtcactgagtcattagactattttgtattagtcacagtaatgacacacttctctttgatctttgggcaaaaccctactaagaaaattactagggttaaaactagatatggtgtatgaaagcattttttactttcaccgatttctccaaattcaggtattgttaattttagtgtagtgttcatagaaatattttttctcataagaaatgaaaccgatttagagtaaaaagtaattaagcatatcaaacaacttctaacagacgcagaatttaaaatatagcatttttgcgattcctagttccgtttttttttcactttttctaacaggttagttggatcttcacgtttgcgtgttgcaaactaaaatttgactatcctgttcaggacaaaatttgtctcttatatctagtagaatgtcacttgtaaaacttcaatatcgtcgcgagcatattagctaatagatctttgtagagttgttattttttgcccttttttgtttcgctaaaatcaatgtatgagttgttgtgcgttgtatatatatgcatgtccttgtcaatacatgacaaataaattggacattcatcatttatacttttttttccaacagattcatacgtattatatttgtgtaacttttgtatagtttggtctagttgtagacacgtcggtatcaattaactcattaaaacaacatatgaatatgaaaaagaaaaaaaaatataaacttgtcgtagtagaattttcaacctttatagatatcttttgatcacatttttaatatctctttccatgtaaaataaaagttcgacttaaaccaaacaaagaaaaaatgaagcttgacaagcaatatataacatggtattttaagatggtttacaaaaaaaaaaaaaattaacatattttagagtaaattatttggtgttctaaaaaaagagagagtaaattcttatgtaataaaataactcgtgaatgggacatatatattataatgatatataacagaatttgtctgttaaattatggtttagtttcataaattaaggcatatgaaattatggtttagtttcacaaataattaagagacactatatattgtattaagtttttatataagtttctcttttttacaaggttcatttttttcataatggcatttggttcaattttcgctttaaaatgttattttatatatatatctatatctatatatatatatatacagaaaaactttgataaaccaacttttattcaaatttatctttttttttctgatggaaagtataacttactcacctttttagtttcttatttaaactactaaatttaaatccggatttaaagattcctttgaaaatgatctaccaccagtaaattaaaatatattcgacataattttaacactagtgataaaaatttactacatatgttgatattatacttaggttaaaaaaaagaaagatatcctatgtggcaaccacctacaaactttattataaatataagtagatggcaaggcgtgtggttgccaaacacaaagaaaaacattcgacattacagaaaagaaaaaactataagaaaatcttaattaataaaataatatattcaggagggcgagagagagagagagggatgatg

SEQ ID NO: 7312 - DNA, 3000 bp, Unknown; identical to SEQ ID NO: 7311
  misc_feature (1)..( 3000): cDNA_ID_1817301_gDNA_ID_1621139_Annot_ID_56596 3000 nt of promoter + ATG

SEQ ID NO: 7313 - DNA, 3000 bp, Unknown
  misc_feature (1)..( 3000): cDNA_ID_1842353_gDNA_ID_1621139_Annot_ID_56599 3000 nt of promoter + ATG
tgttttagatacatctttcgttttacaaaaaaagtaatatatatacatctttcaaaaacagcttttatatatgtgtgtttatgcatatattactattatcttcttttattttatttttcttgttttataaatcgagataattattctaaaattaacttttattgtacagggacattccgaggattttcccaacctttctccggtaaaatcagatgaggtgtttgctagaggtttttgtttaaaaatatttttatccgaaaatcacataggtaatttgttataagaaatatagaaggttaattattatataaacatattaactatcgaaagaaatctttaatatttaacgaggatagaaagtaattgtttttaaccacaaagctaaagctgtgatatgaaaacttaaaagcaaagatcggttcgtgaagacaaaatggggttttggaaaaggaaaagaggaaaaagaaaaagaacaaacgtgtgaaaattcgagaaaaatggtaacacaaaaagaaattggacatgatataagttgccaaaaccaaagagaaaaaattgacatgatataccaatcaaatttttgaatcaggtcaactaatcaaattcacaacaatcatccacaatattatttagatttgacgctttcactgtttcacatgaaaattttacatttgacgcgatgacttgtggagtcacgatcattttagtcactcgttttaaacggatgcttcattcaaaaaatgtaacttatattcagaagactcctaacgtccgattcagatttacaaaaaaacaatatcattgaatcggaaaacagaaaagcatagtaatattctaagtatttaattataatcgtgaggaaatagttccgtaataatgggggaaaaatatatatatgataaaaccaaaatgagatttgcctgaagatgccatatgtctgatcaaacactctgagctgttgtgtcgatgaactcaccatatgccaagatacgctattagcgacaacacatttgtattgtcaaatgtcattaattaacatccacaggtccaacaacagagaaacaaaataattatcacaagtaaaatataaaattagtaatatacttgtacttataatttttggcttatgccttttaatttattttaacactagactcgacgaaactcatcactaacatgaccacaaaaaaaaaagattacaattctaaaacacaaagattaaaaaagaaaacataacgaagtaaaattaagactagacatcaactttacaagttgaaggagcgagaagaggaacttgtccgttagaagatggattaaatctcaaccacacatcacatctggcgtaaaatccataccgtccagtcttaatcgcaccagctttccaacgtagcctcccaaaaatcaccactctcatcaaaacgacgccgtaagcttcatcattttttaaaccattagctacttccggcgagactggtataccgttgcctcccatcaccggagctatcacaaccgtagatttatgtcctaaacgaagcggtggtagtggaagcggcggtgttatgatctgatctttgtacgttacgtacatagagagcttgtcgtagtgaatggagactctccggttagggtttcttgctaaaacgctgaactgaacggaggttgagattaacggcggcgctgtgaaattcaggtcgtagatggcggctccgacgacggtgagacgtggtttatgtggacggtagacgagccaaaggattaaggctatgatacctagtatgacaaggatggtgaagatcgcgccgcagattgcgcggcgagcatctccaccgcctcctccgccttctttagagtaagattctggcgttgaagaagcggagggagcgttcttgtgatctgctttggctgcgtgctctgcttttgcttctccttctcccatggctatactctacagatataagtgttaaagtgtgtatgtataggtatgtgtgtgtctatacgagaatcagagggttcggtgaagagtgaagactctaaagaaggaggaggagaagaaagaagataagtagatgcaaggttttgtctcttttctagttaataagagtaaacagtcttctagagtacagttttattaattgtttattaacttagaaagcttgtagttgtaattatgtgttaaagctaatctttttataaagtagccgtaaattactactgtttttacattgtgattttattttgttataatacttaatgtaataatataagatagagaagtactttcgaaagactccaaatctcggtgcaaccgttcacgtgacggatctgatgagtgatgaattttttaaaaatgaaaaatccaatgtaacgtgtatacatatggctatacataatcaaatactttgttgtcaatgattgacttatttggtgacaactatggtttcgtgcaacgtgataactatcactttttggccgtgttaatttttaaaaaaattagaatgaaatttatcaggttacggcctgtcaaagttagcaataacctaatatctgtttgcatgccagaatacggttatgtagaaagaaaattaaattatcatatttcacaattctttatcaactgtataaagcaattaataataaattaattagataccacatgtgtcatatttgttctaatgtttagaaaataaaagtacaagtcttttatgtccacatctccaacaatacttctgaccaaattccatatattattagtaagcttccaaaataaataataatcacatttaagaagaatctgttatttaatcacactaactgagataccgcaccaccgacactgtagtcaccgacaatgctgtggatgctacctgggcctcaattataagcccattataaaattgggcctacactaaaactattgtgtacagagagatatttgataatttgctgactgatacaagtctcacttccaacggccgatttattaaaaaaaaactccgacaa

SEQ ID NO: 7314 - DNA, 3000 bp, Unknown
  misc_feature (1)..( 3000): cDNA_ID_2168780_gDNA_ID_1621140_Annot_ID_56601 3000 nt of promoter + ATG
atttaagttgtatcataatttataatcacatggtggaacttgttaagaagttacgtaactcttaaacagctttaagcctctaacatagtcgtaatagcaagaaataatatatatgatgagagatgagtaaaataggaaaattcctttgttcagcaatgttggtatcgacctattaaaagtgaatctgcagatgaaaaagtgatatccttacatttatttgtttgtagtctgaaaagtggactaacgttcgtacaaaaggcagtgtttgtctctgtcttctccaacttttcgtgctctcttcattctatcaccaaaggaaaagctgaactactaaataacaaaggtcaagaactttaatattgattgatgtcaaaaaaattagtaataagtactgattttttcacatgttgattaataagtactgaatttgcagaaataaactaaaatatatgctttgaccaaaaaaaaaaaactaaaatatatgctttttcaaaaaaactaaaactaaaatatatgcagaatgagtttaattcattgcgaatatatgatgaaatacaaaaaaaaaattgcgtttttttttgtatcaactgtacccactactcatgttcgcaattccgtatgtttcgtggttattgcgttgatgtaacatgtatatccgtcgatgaaattagtagtatacgaaaattgaaaaccacaaaaatggtaccaaagaaaatgaacacgtacgcacacactaatcatatgtttgtaatttaatctactgtctcatataagtagacaacttagatattcctgttggatgctaactttagaaatctcaacgaattaaagtgaaatcataataggggatacattattaacagggtgaatgtcaaattgtttcaagatgaaggctcaaggctaggggtttaggggtatttgtagtcttgtagaaacataaagttaatattcattaggcaattgtcaaaaccatattgttccttttctattttttgatatatataccttgtaaaaatattccacatcaaaaatccgattcgctcaaaaaaaactctgatcgtatgattctagttaaataaataaatggatgaaagcatctattgcattgtcaatttcaacacagcgaaagcacggaacttcaattgttgaactctattcgaactccaagcttagtaatagcaaaatttctctccatacagtagtagacatgggcgcaaaaagttaggcccagtttttaatcaggcccattatgagatttacatctgagaagtggaaagtttgtattcttggtttatgtacttcacttgaattgctcttttccacaactccacacattattatctacgtctgctaattgctgtgacataactttattatcatctatgatcctgaatatttagtggttgattactacagagtattgttgttaaactcgatgtatgaaagtgcagtgcatttcttaacaaaatttaagtttaccttgtatttcttctcttctttaatcttcccaaaatatacttttgtgaatggtgatttaaaagcttttgagaccactcaaatgataaagtggggcttgtgacgtttcagacattgaaaacctcataatatattagtgggagaccttaaaaaatcaagtcaacgccgactaatccaacacagcgtcacacgttaacgtatgcaatacaacattaggatatttttatcacgcatcgttgtttactttatgttatgtaaaaaatgttagaaatcaaatcgaattacaaaacgtgtagtttatcttttctcaaaaagcctccaagtcgtcgttttcatgtacacacacatactccactcgttctcataattccgatcaaaatattatcatcattcatccatacgtataacccaataatttattcttattgaaattgaaaaatcaaattttccttaccgggtgatatcttacatttaactatttaagcaatcataaacagagaaagaaactaacatactcaattcactatcaagagtggaaaaaatcgtacaagtagacaaacacttatcttatttgtccaagtaagagttttatatctcaatcataagtaaacggccttatagtcaatgtatctcgccgacctatccaacacaagtcacgatgatgatccactggcttttgtttaaaagatttacaatcattgaatcattttgtctcattaaaattaaataatttgataaggattgttgatacattgttacacatgaaatgatgctctgtatcctaaacattttaatcatagtaataattccctagaagaaagaagaatatgattctttccgttgaccttttaaggatgtctaaatgggccatgatgagtgttaaaagtaagcccaattacaaaggagatattttagatgaccacgtgtcacaagcttagtaatgaagtcatttacacgacacaaataaaacagaggcgttgagtcaggtccgagagactcgtggtggggcccgagtaaaccgttatgctgcttcttaaatgactatattatccctaaacgctgcttccttagagtggagtaagataagggtaaatacgtaaatttaagagaatgcagagaaattgatgattttattaagaatttgtgaaattggccctctcttttcttaatcgcgtagtgccacccatttccagagaggacacagccttttctttcttcctctttctctcttactcattcgtttttttttccttcttctgattcaaatttatttgtttcttctctctgaaaacgtttttttttttgtttgctcttctttttggtagtttctgtttttgttaagctgagtttgaggagtgtgagtgatttgaattttgtctgattttccgggataaaagagcgtcgtcggagataggcgacggatattttggacttatcgtcgccgaaaagaagcgagtttttgaatttgaaaaggtggttggcattttggtaatcggtggatctgagtttgggatgtggtggatg

SEQ ID NO: 7315 - DNA, 3000 bp, Unknown
  misc_feature (1)..( 3000): cDNA_ID_1817313_gDNA_ID_1621140_Annot_ID_172807 3000 nt of promoter + ATG
taaatgattttatccattttcctctcgattctgcttctcttcgatggtggatcagttgaattttgaatcacctgtttcaaaatgtcaccttcaacacttttgacacagggtacaaatgaaaaaaaaaacagatctttaaagtttatacctttgtgtcatgtccagtgaagacaacaactccataaatatactcagtgtttctaagcttagaatctcgaagaagaagctgtgtaatcgacaatggtaatctctgttcttcaaaatgtaaagttccaacaaaagtataaagatctgcatttggatcttcacatttcacaacagcttttaactctttgaaatctgaatcttcatgtaaagccgatgaagtcgcttctaagccttgtttcactttcagattcgtttctccgtcgagattcatagtctctacataacaaatcgaatcttcgtagctagatgataacagcaaaagatccgccggaaaaaactcgtctttttcaactcttactatatttccgactttaagatccctccacccttctcgccggaatattccatttccgtcgtgaaccttcactttcctattattcatttcgatgtcctaaatatagaagaagaaaaaaacgaaactttgatttaaaaattgaaactttataatttgagagaaattcgatttgagctggtacctgttttttgcgaccccaatcttcgatagcttctttaaccatacttgcggcgatgacgaaggtgagaggtaagagagcactaatggggctgtaaggagagagagcagtcagcgataagactccggtgacgaggaagtagaaattggcgacacgacggaactgttcgaagagtgattttggtatgaaagaagctagagtgtattttgttgaccggacatagtttccgacgtagttacgtcgttcagccgccggagaatttggttcgttacagtaaacaactcgtgagaaaccaggtcctcctatgtgtgaatgatcttcttgaaagtttgatttacgacctttgaatgcgtatatattgcttagatgtaatcttcttctccgacactttgtcattgtttgtctgaaaatcctctgtaaagttttgggcaatggctaaaatttaggaaaaagaatgaaagaatgaagattttttggagctaaagaatgaagaaatttgagagagaaatgttgaatttttatgtgtaattatatgagttgatttggcattttagcaactcagaaaagaagaggaacgagtgtttttttataatatgaagaaaaaaacccaactttgaacgacgactttcaacggattattattttattgacggagttttattgtttattttttcgtattttcatggtatggaagaagttgaataaataaatatcttggaaatttagaatcctagggagtactgtatatggtattttttcgattaaaattagttttgtgaacaatacatagttggcaaaaaaaaatggaaaggtcaatacgtaattaagaataattagaaacatttgaataagaagaaattttgaatggaatgtaacagtgagctagagtcttaaaatgtatagaaatctctttaaaatttttatctaagaataaacctctcattgtcttgttctagtaataatagaggaacgatttacgaatgtgaaagagccgtggacgaagacgaagaggaagacgaagtcgttgatggttacatatttatctcttttgacaacttcttggaacagagaagaatagtcaacagagtgggaactggcaactagcaagtaattactatttactgtaatgattagtgaatgaataattatattttttaattgattgtttggttctaaatttctaatgtaaggattagtactattactattattatattatcaaactaaaataattgatttccagtgatctccgccaggctctctggctcgatctcctgattaaattatcttctctgacacagacacgctttttaacaaacacatgtgaaaattaatttccacctcatcatgtattgccagttcgataatgcggattcatctacataaataatattcaagtttggcaaaagaagaatatgtcatctagctcctttgcccaacttgagctcaatgacaaataaaattaggttattttgcatattcttgttggtaattcttcaaacaaataaaatatgtttccattcataattttccttagatctacaaatagtcataatttaaagagctttaaccatagttataagcttgttcaactcatctttttccttgtatataagattgttgtacatttcagattcatttagttagtaacatgatttacatgcttatgatcagatatattatttttagttatatattatcacaatatgttcatgtcattattatagtcacacatcttcgcagcaaatacgtcttacctactctcattatcatggctgcgcgattgactattcaaacaccatttcatgtcatgtatgagcaaattgagtcttatgtaatttaataatagtcattatcgctttgacaataatgatgcatatgggacaacggttttattcctatgtttataaatttaaagttagctttactaacagataagatattttaagatggtgtaacaaaaagatcaacaagaaaaacaaatgttcactttcacatcagcggtcaagtgacgactaacatttaatattctagacatcttcttagccctcttcttaattatcttgtagctctaacgggccagatattacattgggcttttgcgcatatttaactgttttaggcccaaaacaaatgtaattacctttttacctcactcgtcggcgatttactttttttaatcggggacttcaaaattcttgaagccgttgtgttgtcagagagagaagaaagagatagatttctcattttgggaaattagggttccaattttttcgaactaatgttcacgccacagagaaaacaatggatgtcaccggca

SEQ ID NO: 7316 - DNA, 3000 bp, Unknown
  misc_feature (1)..( 3000): cDNA_ID_3437914_gDNA_ID_1621140_Annot_ID_172803 3000 nt of promoter + ATG
tcaatctttcatctagcattcgtgaaggccaccgattacaaattagtgtggttgtacaattgtgataagtacattgttgatgcgtcgagtccaaacgtgggagtcacaaagtgcgagatttttgactttaggaaaaatgcttggaggtacttggcttgcactccaagtcatcagatattctattaccaaaagccagcatctgcaaacgggtcggtttattggtttacagaaccatataatgaaagaatcgaagtagtggcttttgatattcagaccgaaacattccggttgctgcctaagattaatccggctattgctggttcagatcctcaccatattgacatgtgcactctggataatagtttgtgtatgtcgaaaagggagaaagatactatgatccaagatatttggaggttgaaaccatcagaagacacatgggaaaagatttttagcatagacttggtttcctgtccttcttctcggactgagaagcgtgatcaatttgattggagcaagaaggatagggttgagccagccacacccgtcgcggtttgtaagaataagaagatccttctctcacatcgctattcccgaggtttggtaaagtacgatcccctaacaaaatctatcgattttttttccggacatcctaccgcttacagaaaagttatttattttcaaagtttgatatctcatctataaaaaaaaaacctactactactactacacctttcaaagactttttatttgcttgcagcttgcactatatatatagagtgtgtaagtttcccttttttctccaaagaattggttgtattgtgttaagttaatatatataatctatccatgtaatacaagaaatttgtactgacatcttaatcataataaaaagggttgtacatttataataaggtcatatatagttaatctactaaacaaattatattatatttagatttacaaaaatatagtcctgcgcaaatcatatcctcaaggcaaataggagtcatataaaaatcataaataattaactaccagtcttcttcattcataaaccatacaaaccataaatgtacgagtattcaaatcaaccataaactcttcttagtctttcatacaaattaaccataatattctgagtctttttcaaaccataaaccagaaacgaaaaagcatatgcataataatcaaactttttttaaaagtttacttgttcttgaagcttccctttcccttcttgttgttgttgttcttcttcttcgggtatccaagcttgcttgcctccctctgaacttcgctctccggaactatcctctttctctctctgattacttaacttggatactgtgaatgatgcataaaatacaaatcagcaagaaaataaaattagtaatgataaatgggttttattttacattcgctcacacttcttcttctctttttgttactctaataaagttaccactacaaataatatcttttttttttctttttttcattctcttttttttttcttgttaactatttcattataaaattaaaaattagaataaaggaattcaatttgatcaaataagtaaaaaaaaagatagcaaaacatgagcaatatataagcaaaacataatcatttttttcattatatacataatatagacttgaatttgagacattaaaccacataatgttaattagttttaggaaaatgaatcaactaaaagaagtttacatgttcttcaagcttttccattgccattcccctctttacgttgatttcccctctttatgttgattcatctataaacgcatccttccctcttcacttctttacataatctcatttctatagtaaaataaaactgtttgcaagaaaaaataaagaaaaatgtcaacaataggtgggatgataaaatgatagataagtactttgccgctgctagaaatacgacgagaacatgatcaagcgaatagctgaggatctaaaagtagtggagagcgaggtccaaagagaagcaaataaaatcaacaattttggatattactaaaattgcattgaaaatgtaaaacgccatcctttttgaaagaaaaagactccaaaacgatattttttatgaaacggatgaatttgaatgtgtttctgttttttttttctttataacaaattgtatgattctcgagatgagtgaaaaagcaaattttttatttgggggatcatactctttcatagacatgagatatcaaactttggaaataagaagcaactctttcatagagaaaaattcgtgaaacgaaagattttgtttggggatcatactccattagaccctcggaataacgatgcgaaatgaggatcttgttggtcttgcatatcacactggccgaaccacacccaaaagctattaccttggttttgccgttatgttctcctgtgagccaatagagcgtcccgttcacggaaaatatctagcacgtctttttagataaccattttaatgattaacatgtcaccacaaattttcttgttttacatggatagaattaagattaacttatctcaattaatacaaccaatcatcttgagaaaaaaaggaaactcaaacacaactatatatggttgagccatccacacctgtggcggtttgcaagaattagaagatcctgctctcacatcgccgtttccgcggtctcgtaaaatatgatcacctaacaaagtctctcgaaatcttttacagacatccgtgtgcttacagaaagttacttattttcaaagtttgatatcttatctataaaaaaccctactactactactactccttttgaagactttttatttgcttgcatccatacttggaaaatgactagatctccacaataagaggtctcttagcactgtcgtacagacaaatttggttctcaagttcgatctttgaacactttttcatcttgtggctttttggttttgatagatttcatactctctatcggcttcgttcctaggatatg

SEQ ID NO: 7317 - DNA, 3000 bp, Unknown
  misc_feature (1)..( 3000): cDNA_ID_2168826_gDNA_ID_1621140_Annot_ID_172801 3000 nt of promoter + ATG
ccggtgaaggagatcgaagaaatgttgagtttgaactagaaaaaaaaagagaagcagagagagcagcaatggagggctcacagatccaatttaaggcagttgtcagtaaaatttttttgtgtttgtgcagtgtgcagagactctgcatagagaagagagagagatagagagagagggagcatctctctgaaatcgtttaaaattaaatcatgaaaatagaaataaaaaaggtaattatttttactaataatgctctgagtcaacataattggtgttttctatggaccaatcctactagagcatagattatatgtatcgaatttccatatttgttttgaaacataaaaatatttaccaaattgttactgtcttttttattttttgttggtctcaataaccaaaatattcggtaccaatactcaattccatattcaaaatatgttgtgtgtttttttgttttatggattaaaataaaaggaaccaagtgttttacaagagatgtttagttgtaaagcccatataagcccaataaggatcaaataagaagttccccaatgtcgagcccagtagatgaaatgatagtccacataatgggatgaaggcgaatgagttgatccaaactctcaccaaatcgagaaccaagtttgcatgcactcaccataggagtttattttgtgttttatgtttgacgttctcgggggttttggctatatagaaaataagaagatcaaactaattaactatattaagaattgaatcgctttcaaattgattttttttaattccgtgtttgatcagtttaatttatcctaatcaaatactcataacccatatatgtgatattagaacatgaggtgatggtatactcaactgcttacacctactaactcctaattcttaaaatttgattatcaattacaattaacggttttaattataatgttaaagtccatttcaaattccagtcacaatttttattccatctaaagtaatttgatacaaatttgattttgcttcgaatatggttgttttgtcaacggttttttatatcaaatatagttttttttctcttttcaatgcaatcggttaggtggtatttgatttttccttcaaattgaattttaaaaaattcattttgttcttgatgatacagttcaatttatctgaattaaacaatcttaaccatattgaatattaaaacatgagtattgtatatttcattatgattacacctcatttacccccaaatctctttaatcaataaacttgacatgatcatgaaaaaaaatcattgtttaaaaaaaaaaactaaaacaataaacaaatatttgttttgatagttcgaatataatactgctaatacattgatgagtatttataagtaaaaaaacttgtagaatcttaaaaatatatttagatcgtcctttatcaataaaatttgtacaaaatgcgctttgtaatattttttctttacggttacatctttatattttatttttattttttgctaaagtgaaaaaaatagtgcattctttagagctttgaagaacgttggtagatcaacaatgagtcgtctggaaaacatgtcggcaagagatgcttacagcaatgtgactgatctaaaaacgatagccaacaaattcgtaaacggcgaatattaaattgaaaaaactagtgaattgagtatcacatatctgcgttaacgaatttagtaatttgttggacgaatgtagtaattcgttagatgaatgagatcaatcaagccatttaaaaaaatatatattcattcgcattgtagttttacacataccacctaacattgactataaaaaatatatatgaaaaagaaatctgttgcaagggagactaacctagcccaacaatttttaaagctctagggcaaaataaaaattcaggaccttatattcatgttaaaaaaaaaaatttatatatttgggcatatttatactaaaaattattttgtttgggtcttttgaaattttattaccttgaaaacaggtcatactttacacttaaatgctaaaacattgggctacattttcattttgttatttaaacggaccggtatgagtgagacatgcatgatgatttaagcttatctactcaataggattaggctgagactgatatgattccatttttcgagaccgtgtgaacatagttcatgataactactgtgtagtaaagtagtaacaagacttcaatctcaagttttaatgggttttgttcggtggttcaagcgtccttatcataagtttgtttttctgtcttcactacacacatcttaatattgagttaatccaattaacagtaggcatatatcatatatcatatatcagaacattatttgtgttatgattaccttttatattatcaaagtccctagttaatttggtttgtttacaaagacgattacagtatattatatatccaaacaaaatttgtaatgatgataatcagcccagtatggttcaattcaatgttattgaaatttgtttggtttttaaatcagacttggttattgagtcgggttggaaaaccaaattaaccacagcgcataaggacgaagccaaaatttaaaacagtagttgtacataacttcatttgttttttatcggaaaaatctcacacgataaagtaccagtcgacgacggcgactttctctatgatctgaccgtttcgctgaatctcacgtgaatctctgattttccgggaaaatcaattttctctcattgtctctctccctacattgtttctcatagcctacgagaaattacgtggtagcttgtcggaaactcaacttccgttgacggaaggcgcgagaaagaagcaagcttaggttcgatcggaaaattctagggttctctagtgtttaaacggtagagataatcgatctctaatcggatactgttttggatctccattcacaccctctggtgagctgattttgctttagagatcgccggcttagtttctcta

SEQ ID NO: 7318 - DNA, 3000 bp, Unknown
  misc_feature (1)..( 3000): cDNA_ID_3050248_gDNA_ID_1621140_Annot_ID_172800 3000 nt of promoter + ATG
ccctagaattttccgatcgaacctaagcttgcttctttctcgcgccttccgtcaacggaagttgagtttccgacaagctaccacgtaatttctcgtaggctatgagaaacaatgtagggagagagacaatgagagaaaattgattttcccggaaaatcagagattcacgtgagattcagcgaaacggtcagatcatagagaaagtcgccgtcgtcgactggtactttatcgtgtgagatttttccgataaaaaacaaatgaagttatgtacaactactgttttaaattttggcttcgtccttatgcgctgtggttaatttggttttccaacccgactcaataaccaagtctgatttaaaaaccaaacaaatttcaataacattgaattgaaccatactgggctgattatcatcattacaaattttgtttggatatataatatactgtaatcgtctttgtaaacaaaccaaattaactagggactttgataatataaaaggtaatcataacacaaataatgttctgatatatgatatatgatatatgcctactgttaattggattaactcaatattaagatgtgtgtagtgaagacagaaaaacaaacttatgataaggacgcttgaaccaccgaacaaaacccattaaaacttgagattgaagtcttgttactactttactacacagtagttatcatgaactatgttcacacggtctcgaaaaatggaatcatatcagtctcagcctaatcctattgagtagataagcttaaatcatcatgcatgtctcactcataccggtccgtttaaataacaaaatgaaaatgtagcccaatgttttagcatttaagtgtaaagtatgacctgttttcaaggtaataaaatttcaaaagacccaaacaaaataatttttagtataaatatgcccaaatatataaatttttttttttaacatgaatataaggtcctgaatttttattttgccctagagctttaaaaattgttgggctaggttagtctcccttgcaacagatttctttttcatatatattttttatagtcaatgttaggtggtatgtgtaaaactacaatgcgaatgaatatatatttttttaaatggcttgattgatctcattcatctaacgaattactacattcgtccaacaaattactaaattcgttaacgcagatatgtgatactcaattcactagttttttcaatttaatattcgccgtttacgaatttgttggctatcgtttttagatcagtcacattgctgtaagcatctcttgccgacatgttttccagacgactcattgttgatctaccaacgttcttcaaagctctaaagaatgcactatttttttcactttagcaaaaaataaaaataaaatataaagatgtaaccgtaaagaaaaaatattacaaagcgcattttgtacaaattttattgataaaggacgatctaaatatatttttaagattctacaagtttttttacttataaatactcatcaatgtattagcagtattatattcgaactatcaaaacaaatatttgtttattgttttagtttttttttttaaacaatgattttttttcatgatcatgtcaagtttattgattaaagagatttgggggtaaatgaggtgtaatcataatgaaatatacaatactcatgttttaatattcaatatggttaagattgtttaattcagataaattgaactgtatcatcaagaacaaaatgaattttttaaaattcaatttgaaggaaaaatcaaataccacctaaccgattgcattgaaaagagaaaaaaaactatatttgatataaaaaaccgttgacaaaacaaccatattcgaagcaaaatcaaatttgtatcaaattactttagatggaataaaaattgtgactggaatttgaaatggactttaacattataattaaaaccgttaattgtaattgataatcaaattttaagaattaggagttagtaggtgtaagcagttgagtataccatcacctcatgttctaatatcacatatatgggttatgagtatttgattaggataaattaaactgatcaaacacggaattaaaaaaaatcaatttgaaagcgattcaattcttaatatagttaattagtttgatcttcttattttctatatagccaaaacccccgagaacgtcaaacataaaacacaaaataaactcctatggtgagtgcatgcaaacttggttctcgatttggtgagagtttggatcaactcattcgccttcatcccattatgtggactatcatttcatctactgggctcgacattggggaacttcttatttgatccttattgggcttatatgggctttacaactaaacatctcttgtaaaacacttggttccttttattttaatccataaaacaaaaaaacacacaacatattttgaatatggaattgagtattggtaccgaatattttggttattgagaccaacaaaaaataaaaaagacagtaacaatttggtaaatatttttatgtttcaaaacaaatatggaaattcgatacatataatctatgctctagtaggattggtccatagaaaacaccaattatgttgactcagagcattattagtaaaaataattaccttttttatttctattttcatgatttaattttaaacgatttcagagagatgctccctctctctctatctctctctcttctctatgcagagtctctgcacactgcacaaacacaaaaaaattttactgacaactgccttaaattggatctgtgagccctccattgctgctctctctgcttctctttttttttctagttcaaactcaacatttcttcgatctccttcaccggatctcagattcttcagctggacttagatcaccggttgttgttttaggatctagcttcaatgttcgattcttagtagctgttttttgtgatcaatgttgtttttgattcgattattatg

SEQ ID NO: 7319 - DNA, 3000 bp, Unknown
  misc_feature (1)..( 3000): cDNA_ID_1817337_gDNA_ID_1621140_Annot_ID_172799 3000 nt of promoter + ATG
tttgcagaagattacacagtgaaggattgctgaacaaccttagaactgattgatgttctaggcttgttattttcatcttacagattggcttttcttcagctctcatcacactcacaagccatggagtatctgtttgtgctgcaactgcgtatattggatgaaaacatttcttcagtcttgaaaacatatcaaagaagttacctgctcacacattgtacatgtattgagatgattactaattgctccaaaacaggtatatactttttcattgagatagttaaaggtcaaaaatgtttaattgtggttttagtattcaacagtaaaattgagttcctctaaggtattatagtttacaaatcttctacatggaacatgactcaagtttcttctcttccagcgaccttggtgtgatggttactttgaggccgtacttcatgtacaagttagttgtgactctcggggctatgacatgatcttggacaaccttgattgagtacctcaacaaaactgaagcagctatcatcttcatctgcaggtaagcaaatgtttttcctatgcacagccttggtccagcattgaatacaacgtatttgaactggtcgtcactgacaaacttccctgcttggatccatctctctggtctgaaaatttcacaatcttttccccagattgattccatccttcccatggcatagattgagaagtaaacccgtgaaccttttcttacgaatgtcccatctggtaacacatcatcttcaatggcttgtttcatttccattggaattggagggaacagtctcagagtttctgatagtgctgcttgtaggtataccatgttgtttagttctttgactgtgaagaggctctcgtttttgctggttggagaatcccctcgctgtctcaagatttctcttatctcgcagatgattttgttttcaacctctgggtgtttctgtatcacccagcagaaccatgaaagtgcaacagaacttgtatctcgtccagctaatataaaacttgtgcaaaattgtctgaaaaatctaatggtggaaggatcaatctcattttcccttttatgactctctatctgaataatccttgagagaacatcagatctattgtctaacgtttcttcttccttgagctcgcagatacgatccacaatcatcttgtcgacgaacccgtgcacgaccccaacagctatcctgagacctttttcatatcctgtgtcgaggaacctcatgggcttccatataaatggagggatcatgaatctaaacagtgtagactctgttgcttcttcaaaagctttagcaaatggaacttggggaagatcaacagctagagtttccgggtcagcacctagacccgcaaggcagatgatgtcaaacgtcaagcgcaggaacacgtcttggagatcgaaagcttcttgtgactttgcgaaactctccatcaccttcaacagcttcttccttaccaaatgttgtgttgtctgaaaggaatgctctacaaacccggttgaatgcatttcggttatgatgatccgtcgttgctccttccaagaatcatcatcagcattaaagataccttcctcgagcagatcattgaaccggcttttaaagaaggtaccttttgggaagttcttgaagttagtcttgagcatgtactcgacatttgcaggaacacaagtcacagctccataagacccatcaagccaaactccccgataaagaaaggtacctcgacattttttcaaactccttgtgacccatccatagacatcatttatatgaaagaaaaactctaaagtaattccgaaaactggccatagcattggtccacgcttgttggttaacttctcacgcaaacagcagaaaacaaagagccccaacaaggaaagaagtagatcgaagagagaaagatgattataaagtcgctctgttaaagacattgtagtctcttctcagtaaactctctgcagttttgtttgtggtgatgtcattgtttcaagagtatttgaagaaagatttgcgatgcatttcatattttggttttggaattacatttgttgtcttcgtgtagaattggtctatatgaagaagatgagggtttcttgttggcgacgaaacgtaattaggctattacaaattgtgtgtttattgagaaaaacccgtgaaagaaaaattccagaaaaaatgcaaatttgcctgtcatgtcttatgtgaatctatctgacataagctgatgacaaactgaaactcttagaatcaattaacaaacaaaagaaagagcaatcgttgttactagcaagtagattacaaggaataaatctgaaaaaagattatagaattttgactttagggggaagaggtccaaaacacagaggacgagatattttagttttagatatgttcagcctagttaagtattaatcaaagaatcctaatctatgatgcttcaatggcgatcccactgattcacactttcacagtctaaagactcgagaacaatcgaaagactcaagtaacaaacatcaagattgtaaaaaaactatcttgtagtgagtagtggtgacaaattcatgatttttgaggtttgatacgttatataatataaccaaaacttgtagcactctgcaaacacaattattattgatttacataacctgaccctttgtttcaagagtctttcactactgtgagtctctacttctctcctacatgaagcctaaaaacaaagctgttaataaattcgctgttgcattgagacagtaagtatgcaccaagtaaataaactcttcagtattcaacaatcaacacccatctttaagaaaaacataaattacttggtcttaataaccggacagaaccaaagactaatcaaatcctgaaccggtctggttcaatagatctaaacctaaagtataaatcaaacgtctcaattgttttttcctagggtttcaatctctctcccaaaaaccaaaacgcaaaacctccgata

SEQ ID NO: 7320 - DNA, 3000 bp, Unknown
  misc_feature (1)..( 3000): cDNA_ID_2168803_gDNA_ID_1621140_Annot_ID_172796 3000 nt of promoter + ATG
caaaaggtaccttctttaaaagccggttcaatgatctgctcgaggaaggtatctttaatgctgatgatgattcttggaaggagcaacgacggatcatcataaccgaaatgcattcaaccgggtttgtagagcattcctttcagacaacacaacatttggtaaggaagaagctgttgaaggtgatggagagtttcgcaaagtcacaagaagctttcgatctccaagacgtgttcctgcgcttgacgtttgacatcatctgccttgcgggtctaggtgctgacccggaaactctagctgttgatcttccccaagttccatttgctaaagcttttgaagaagcaacagagtctacactgtttagattcatgatccctccatttatatggaagcccatgaggttcctcgacacaggatatgaaaaaggtctcaggatagctgttggggtcgtgcacgggttcgtcgacaagatgattgtggatcgtatctgcgagctcaaggaagaagaaacgttagacaatagatctgatgttctctcaaggattattcagatagagagtcataaaagggaaaatgagattgatccttccaccattagatttttcagacaattttgcacaagttttatattagctggacgagatacaagttctgttgcactttcatggttctgctgggtgatacagaaacacccagaggttgaaaacaaaatcatctgcgagataagagaaatcttgagacagcgaggggattctccaaccagcaaaaacgagagcctcttcacagtcaaagaactaaacaacatggtatacctacaagcagcactatcagaaactctgagactgttccctccaattccaatggaaatgaaacaagccattgaagatgatgtgttaccagatgggacattcgtaagaaaaggttcacgggtttacttctcaatctatgccatgggaaggatggaatcaatctggggaaaagattgtgaaattttcagaccagagagatggatccaagcagggaagtttgtcagtgacgaccagttcaaatacgttgtattcaatgctggaccaaggctgtgcataggaaaaacatttgcttacctgcagatgaagatgatagctgcttcagttttgttgaggtactcaatcaaggttgtccaagatcatgtcatagccccgagagtcacaactaacttgtacatgaagtacggcctcaaagtaaccatcacaccaaggtcgctggaagagaagaaacttgagtcatgttccatgtagaagatttgtaaactataataccttagaggaactcaattttactgttgaatactaaaaccacaattaaacatttttgacctttaactatctcaatgaaaaagtatatacctgttttggagcaattagtaatcatctcaatacatgtacaatgtgtgagcaggtaacttctttgatatgttttcaagactgaagaaatgttttcatccaatatacgcagttgcagcacaaacagatactccatggcttgtgagtgtgatgagagctgaagaaaagccaatctgtaagatgaaaataacaagcctagaacatcaatcagttctaaggttgttcagcaatccttcactgtgtaatcttctgcaaatggtttgagattcttatgccacaccaattcctgcgggcgttcacatctcataccattacattgctattatgtataagacttctctaagatcattttgaaaactcatcccaaactcatataacacatgaacaaacattggaaccgatccaaagatcactcccagaagaaacattgttatcattttcactgcattaccaaccctattgactagtggaattgtctaagatcaccatccatctgttctccctaacacaagacaccacttccttaaagaacaactccaagattggaatccaattgataatcaaaatgtatcattccaagctaacaagacttacaaaccaacgaggaaaatattcaaaactggaactcacaatagtaaagtaagggataacaaaacaatagaaagctcataattctcacaagaaaaaacgttgagaaaagatgaattaacattagaactcaaagtttgaagactgaagatacagttacaaaaggagacagagctaagaaaagactcaaacttttccaggaaaattcgagagagaaaactttactcttcgaaagcttcatcgtctctccaattttaactcttgaaatcttttgaccagctcccgaagactgaaaccatctcttactccatcggagaccccatcggagacaattctcactgaagtactttaagtctcatctccggtttcgaagtttgacattcattgttccagttttggctctactgtatctgaaatctccgccactggaaatatcctccgtgagaaacagtcaaacagagtcgtatctcacttctccgatatggcagtccattggcagcgatgctcgagttcactcagtgagttctcttttttcattttttgtctttttagcattctgggcccaaaccgttgggcctattatatgaatttcattcttgctacggcccatcctctcttgaccattgaacatcccaacaaataaatatcgtacaaggtgattgtcaccaaagacatgatgaacgcaaattttgcattttttgaagcattctttgcgtttgtaacgctttctgcaacatacaatttgcattagcatgaagccatgaacattaacgtttcgtgtcccacaagaaacttcatcttttattgaaatagactactaattcctcagagctagctactaattcctcagagctagctgtcttctgcaagaatattgcaacaaaagtggagttcttatgccaaaacagaaaacacatgatgaagttgattattcaaatactcttttgaatcttcaatttactcattacattttcacatcaaaccatctgaccacaaacaacactagaaatttcactgagagaaacttaccatg

SEQ ID NO: 7321 - DNA, 3000 bp, Unknown
  misc_feature (1)..( 3000): cDNA_ID_1817357_gDNA_ID_1621140_Annot_ID_172793 3000 nt of promoter + ATG
ggactagaaagatctcttacaactttaaagacatcggattcgcgccttacggtgaggaatggaaggccatgcgaaagctctcggtggtcgaactcttcaccgccaaaaaacatcagtattttaggtctatcagagaggaagagaatgacttgttggtcaagaaactaacagaattggctctgacacgatccccggtgaatttgaagaagacccttttcactttagtcgggagtattgtgtgtcggatcggattcgggtttaatcttcatgagtgtgagttcatcgatgaaaatagcatctccgaccttgttgacaagtctgagatacttgagatgacttctatgttctctgatttctttccaggaggaatcggtagattcatcgattggatctccggtcaaaacaagcgattcgataatgttttctcggacctcgacactttctttcaaaacattcttgattatcatcttaagcctggaagaaaagtagcagatagctctgatataatcgacgtggtgatcaacatgataaagaagcaagagaaagatggagactctttcaagctcacaacggatcatcttaaagggatgatctcggtaatgtttttggacctttattagttgtgtagactaatcttcccttttttaattaaatattcacacaatttttgttctgtcaggacatatttctagctggagttagcacaagtgcctccacactgatatgggcgataacagagttagttaggaaccgtaaagtgatgaagaaagtgcaagaagagattaggacaacactcggagacaagaaggagagaatcacagagcaagatctcaccaatctccattacttcaagcttgtggtcaaagagatattcagattacacccagcagttccatttttgctaccaagagagacattatctcatgtcaagattcaaggctacgacattcccgccaaaacccagatcatgatcaacgtctatgcgattgctcgcgatccaaaactttggacaaacccagatgagtttaaccctgacaggttcctagacagttccatagattacaaaggactaaattttgaactgttaccgtttgggtctggtaggagaatctgtccaggaatgacgatgggaatcacacttgttgaatttgctttattgaatttgctttacttctttgattggggtttgccggagaaggaagaggcggacaagatcatcaccggcaatggagttgctgttggcctagttcaagttcttctccactgaaaatctgatagatgtttctttttttggtttgcaacatttttttagtattggttatattgaatgcttgtgttttaaccttgcttttttctttagagacattctattaattagtaaccctaattgacatgagtaaaggaccaaaaatgttgtcatagcttagaaactctataatccaaaccaaccgaaaattttgaaatataccctaattgacatgagtaaaggataatttgacaaatttaaaatagtaaacttgcagtttgcactattgaaattaaagataatgttgacaaattctttatgaagccaaatcacattattgtataaccacaagtataatgtatatatttatatatagttggtaaaaacattcaagttcacaaccacatggtcattaattacacttgataggtagagagtgaagactaattcattgtgtatgtatccactacaccaattattcattgacttttggattcttatcagaaaagcatccgtgagtttatatgaaaggtcaatcgatcattaatgcataattccataattgtcgatataactcgattttgcaaactatattcttcaatcttgttgcaaaaaatgtcaatcttgttacgtgaataatggcatatgcattattatcgggtatcatcatttacaatcagagccaaaccaaacaaagagaactaaactgaaataatgttctttctttttttgtcgacatctatattagattgattcaaataactttcgatgatacgtacttaataaagacaagtctacgtaaacagacaaagaccaaaaattcaaaatatataacgcaaccaaaccggtccgcaaaaacgaatacttaatgcggtaatatgcctagttaaaatcgacgtaataaaagcaaaaatacaaccattgacagccctatagtcaactatagaaaaagataaaagtcaactttaaaaattgtcaaacgtttgtgagaaaacttgtacgtttagcaaaaagagattttgatattagttgcgttgccaaaagaagagagtaaactgcctaataatggacgtaaacgaatcaatatataactattgacaacctaaattacgtagtcaactgtataaaaaacgatcaactctgtcaattcaaaccttgacattatttgccaaaagaagagaagaaactgcctattaatttcaatataactaaaattattggactaggtctaaatagggtaaccaataaatttgaaaggtacatcttataaattacaaaattttggaaatttcatggaggcaattaagatttatgggcccgtggcaccccatgtgtttggatactttgacgatatttcagtttcaataatacatcattactcatggatgaagatgaaaaatagttttgtgctttaaagacagaggttgatggcttttgtggcatatctctctatagatcaccagtgttgacaattcttgtgttctgtcatctacagaattattcataattgttcatgtagcacaagtttttaaaacgatgaattctttaaaataattgacaatgactgaatgaataaatttattaaaaatgattatcttaacaaaaatacaagttgcaaccaaagaaatatatgattcatccaagtagtatataaaaataaaatctcactgtctatatatgtctctcattaaacacccaaatcaaatcgaaccaactaacacaaaagaaaagaaaaaaaaaacagagtatcaaac

SEQ ID NO: 7322 - DNA, 3000 bp, Unknown
  misc_feature (1)..( 3000): cDNA_ID_1817361_gDNA_ID_1621140_Annot_ID_172792 3000 nt of promoter + ATG
tcattcaacaaaattctaaattttgtttttttaagtaaaaaatgttatagcataaatgttcagatttttatgtcgtattatattgaattaaatatagaacaaagaaaaataagatacagaacaaagagaaattttgatccaaaaaaaaaaagaaagagaaataagatctagaacaaaaacgatacattcagattgattattgaaatcaaataatcgaatttataattgaatttgatggaatttataatgtattttttgtcatggaaataataaagtttgttaatatagtaggcacgatcgaatctggagcttcaatttttttttaactaattgttatggaagatgctggaatgatctctttttacaagaaagctcctctcattcttgttccggttaaacaccattaatgacatcggcacacaaaaattcaaacaccgttgaagattgtttgctatactttatttttatcaataataagttgcggtacttggttaactgtatacgtacttctatttcttatagttgtgcgataattaccacaagtccaaaaaagtaaaatatgaatttgataaagcagtgtaaacctgagattttcaagatttgggcctaaacccattagagaatgctacgtagagaaccattgggcccataaacttattttattcccgcaaagcctgagtggattcgaaccactaccacaaaaagtaagagtttgggttatttgattttaatcattcactttgaattattatagacaccggacagtgacttatgataaagagatttttaacctttaaaactaaaacactaaaatacataatccaaagaagacggaacaaaaaacaaaaacagagccaggaataatgtcagtcttcctctgtttcctctgcctcttaccccttatcttaatcttcttgaaaaatctcaaaccatcgaaatggaagcttcctccaggcccaaagaagcttccgatcatcgggaacttacaccaacgccgggaattacatcccaggaacagtcggaatctttccgaaaagtacggaccaatcgtgtttctccgatacggattcgtccccgtggtcgtgatctcgtcaaaagaagcagcagaggaagttctcaagacccacgatcttgagtgttgtagccgaccagagacggttgggaccagagcaatctcttacaactttaaagacatcggattcgcaccgtacggtgaagattggagaacgatgcggaagctctcggtggtcgagctcttcagctcgaaaaagcttcaatctttcaggtatatcagagaggaagagaacgacttgtgtgtcaagaaactctctgatttagcttcgagacgatctttggtgaatcttgagaaaaccctttttactttagtcggaagtatagtgtgtaggatagggtttgggataaatctccgtgagtgtgagttcgttgatgaagatagcatcgatgatcttgtgcacaagtctgaagatgtcataaggaattctatcttctctgatttctttcccggattaatgggtaggctcatcgagtggatcttcagtgagaggaagagattgaatagactttactcggaagtagacactttctttcagaatattcttgatgatcatctcaagcctggaagagagagctctgatatcatcgatgtgatgattgatatgatgaagaagcaagagaaagagggagactctttcaagttcaccactgatcatctcaaagggatgatctcggtaaatctataatctttcaagataagtggttaaaaatcttgcatgcaacacagtttgtgacttttgttttgttttacgtcaggacatatttctagcaggagttggaacaagctccactacattgatatgggcgatgaccgagctgatcagaaacccgagagtgatgaagaaagttcaagacgagattcggacaacacttggggacaagaaggagagaatcacagaagaagatttaaaccagcttcactacttcaagctcatggtcaaagagatattcaggttacatccagcagctccacttttgctcccaagagagacattgtctcatgtcaagatccaaggctacgatattcctgctaaaacacagatcatgatcaacgcttacgcgattgcacgtgatccaaaactatggacaaaccctgatgagtttaaccctgataggttccttgacagctccatagattacagaggactgaactttgagctattaccgtttggatctggtaggaggatatgtccagggatgacaatggggatcgccattgttgaattgggactattgaatttgctttacttcttcgactgggggctaccagagaaggaagaagccaaggagatcatcaccgggaatgaagttgctcttgaccttgttcaagtttttctccactgaatgtgttttggttatggaatgtttgtactacactaagcttgattctaaattaataacatcttacaagtactgaaaatagtagacagtagacactatggtttatcttccattagaaacaattaaattataaaatcatttttgttaaaacagattaaattctctctttacacaagccataatactaattaattaagaatagggttacgctacgttgggagttgtttaaaagtacatattttcgtcctttttgcttctcccactaccatcaattagtggttgaaacagaaagcttatcagacagaaattggcattttcggatatgttggatgcacaaagtggtatataatacgtaagacttattcgtgtcaatcatgattcatgaagctatctaacctctacaagactacaaacacgtagaagtttggactactcatttaataatcgacaacaacccatgagctgaccataatgaatattattaaacaacccaagttgtttattttctcttaatcgttaagcacttcatctgaaatacaaaacccaaagaagaaagagattaaaaaaaactagagggcaacaaaa

SEQ ID NO: 7323 - DNA, 3000 bp, Unknown
  misc_feature (1)..( 3000): cDNA_ID_1817365_gDNA_ID_1621140_Annot_ID_172790 3000 nt of promoter + ATG
ttgatgctttttaccagcatgtgattgatgatcacttgaagccatcaactttggattcctccggagatattgttgccttgatgttagatatgataaagaaaaaaggacataaagatgatttcaagctcaatgtggataacatcaaagcagtcctcatggtaaagttcaaattttggttcatatatctttttatttttcaaaccattgaataaacacttagtttaaactactaagcttattatgtatatatgtctgtttatgtgatgctcagaatatatttctcgcggggatagacacaggcgccataacaatgatttgggcgatgaccgagctcgttaaaaaacccttagtgatgaagagagctcaagaaaatatccgaggcgtcctcgggctcaaaagagatagaatcactgaagaagacctatgcaaatttgattgcttgaaacatattgtcaaggaaacattaagattacacccaccagttccatttttggtcccaagggaaacaatatctcacatcaagattcaaggctacgatattccaccaaaaacgcaaatccaagttaacgtattacgtatggacgatcggacgtgaccccaagcgttggaccgaccctgaagaattccgccctgaacggtttgcaaatacttgtgtagattttagaggacaacactttgactttctaccgtttggttctggtcgaaggatctgtcccgcgatatcaatggcgattgctaccgtggagctaggactgatgaatttgcttgactttttcgattggagattgcctgatgggatgaaagttgaagacattgatatagaagaagctggtaatgtcacggtagtcaagaaactacttatttaccttgtgccccttcaacgtcattgatgagaagttaaagaaagctccatgacatggaaagaatacgagaagataacctataattctctagatattattgcgagatatataagaattaattcatgtttgatgatcaacattccaaaaacaataatttatataataataacaaatcttctatttaaaccattttgcaatgattggattgagattcggtggctggctgtcactttatcgcagttatcgatctttttgtctaccaaatgatatttcaaagagtcaattagtagtatggacaaatatagtaataaaaatcaattatgattctgtggctactatatatggagtttatcaggccacagactgagacggaagaatgaggattatgatgttccaagagtagtggaaattttttagtaccaccaaccaacatttcgtcttaggacgagaattaaacacttgtagactttataataacatttcgtccaaaatagtgggcactaaaacaaatttattattttctttaaaaaaaacacgcttttcattataatcgagttcaaattttcaaaaactctagaagtactctatttacgatataaacccatttgaagtcaaggctaagttcacattcataaaatcatgactcatgagcgacgagatcaataataaacaaattttcagcctacatttctgatttcttgcacgttatatatagcttgaattgttgtgccagttaggtgattttaattaggttaacttctctacttaatttggatatttgcatgtggtgtctaccacgttacgtggttttagggttattatttatattttactaaagtttatatataaagttcgggctttaggaatcaagcgatcaagtcaaaaaaattgttggataaattttttaacgtatgttttgttttaaccaacttagaaactttgtatttctcgtggcagtttttttcccttttcagttctcgtgccaagcttaagaatatgaaaatatactaattgtgatggtgattcaaacccttaacaaaaaaaaaaaaaggtgatggtgattcatcacaaccatatcatcgggatgtcacattcaatactaaaggacgagacctccaccgaaacaaacatctataaatccaattttagttaatgtttttttttgtttgtttctgaacagttcaatagcctataagtagttatatacaaaagtaataatgcaaggaaacttggatctatcttaactttgattgatacaacagaattgacatattcaaaaaaatatggatgtcatattcaatttttattatttttgggaaataaaatacaatatggatgtcacagtgataatatattaatatgccagcaaacatgtaaaccatcatctattcatctacgtttcctctaagaagaaataaattggattcgaacagatttagaactctcaacgtcatcagaaattagtatatcaaagagagtggatttccaacgacatcattattttccaccatataatttaaacctcattaataaggtttcatttgccgtttaaaggcataatcatttgccgttttcctctataattctcttaaagttataatttaaaaccccaataaattagtaaatttgacaatgacataaccaaaatcctaattaattataaattttgatcaaaaatctattaaattttcaaattcgaagtctactcacctatttttaatcttactctaataaataaacttatctatctctatatatccatactatgtaatcgttgacttaaaaaggtataatattatacaatcgttgacattaaaaaccatataatatacaatgattgagaaactgcttatccactcaaccaatcaaaacaaagtgtaatcggaacacgtggattttgaaccacaagacttggtttatgcttgtgtcacatttatgatttcaacgaagataatatccacaaatctagtaacttctgtatgcgactctacaaccacttgatttgaagagttaacgtctcaatcacgtcgtcaatccctgtcactctatctctatcttataaagaagaagactcttcgaagttctaaactcatagaaacagagccaacaaaacaaaaacagaggaagaaaaacaaaa

SEQ ID NO: 7324 - DNA, 3000 bp, Unknown
  misc_feature (1)..( 3000): cDNA_ID_1817367_gDNA_ID_1621140_Annot_ID_172789 3000 nt of promoter + ATG
tctgatttgaagttatgagagaaaaactctttgattgacatctgattttggtttatctccttctggatcagcttatttttattgtagcttctctgattttcgatgggtacttatattttttttttcaatttgggatttttcatgattctgtagggtttgcaaagatgaagcttgatactagtgggttcgagacttccatgcctatgattggatttggctcgagcagtgatatgcttgatgagctttcttctgtaccctcgtttgatctaccccgtactaaagaggtgactttttttgtttttgtttgtgattcgaagcagtgtgagtgaattttcaatgttgtttgattacgaaactggttttatttgttggtttcagtttgatggatttcagaaaaaagctaaagacatgttgaagcatgcaaaaggaacaaccactctcgcttttatcttcaaaggtggtgttatggtcgctgctgattctcgggctagcatgggaggatatatctgtatgttctcttttatcactttacttttagttttgtttgcagactttgacgatgtttagctgtgagctctcttaagaattcctccaaaaatatgcatcctttcgatatagttgactttggtagaaacactagtacaatgaagattaagttagcttgttgttggttttggttttgtgctggagtgtcaaacaaatttctagttttcattctgttggccattaattgtgaaccagtagaggaaagaaaacgttgtgtgatttttgttaatgttttaaatctgtttaccacattcagcctcacaatctgtgaagaagattattgaaatcaatccttatatgctcggtacaatggctggaggagctgctgattgccaattctggcacagaaatcttggaattaaggtacctaactagaaatctttttggccgtgtctgaactgataacttggatctttgattaatctttctctctgtggttatcgggaatcttgctgccttgttatatagtgatttttttatatatttctaaaagcagcagattcatttaccttatcaaatgctttaagttttagttctgtctatattaaagaatgacaaagattttgcttgtttgatgttgaccctaagatcatacaagcctctttgaatgctaagcatgcaatttcagttgagcatgtggtggctttagatcccctttttttctaatcaaacattctgtagcaagaaagttcagctttttttcctctgtacttagatagcaaataaataaagaacttagtttgttgaatgcgatgtgaaattttggcatgttaataccattgtagacttcttcattttatcaccaacatcttgtttgttgattttatggctgatctcttaatttatttgtctatccaagtgccgtctacatgagctggcaaacaagaggagaatctctgtttccggagcttcgaaacttcttgccaacatgctctattcataccgtggaatgggactttctgttggtacaatgattgctggatgggacgaaactgtcagtaaaaccaacttcatatcttcaacactgttattttcttcccacgcaaaaggaaattttgaaatgctaaatccgtttacttcttgtataatagggtcccggactatactatgtcgacaacgaaggaggacggctcaagggagacaggttttcagtcggttctggttcaccatatgcttacggtgtgctggacagcgggtaagtcatttcccaaacaacatcttcatcgcttttgtcccaatctcaaaggctaaaaaccaaaatctaatgatgttagttaagcaaccgtttcatatttatgattttacttgcatcatcaggtacaaatatgatatgtcagttgaagaagcttccgagttagcaaggagatcaatctaccatgcgacattccgtgatggagccagtggtggagttgctagcggttagtaatctgaatgcatctgtggttcaaatgtaatatttaactttcaagattctgatttagctcataagtttgttctcttctcatatgaccagtgtaccacgttggtcccgaaggatggacgaaactatcaggagatgatgttggggagctacactaccattactaccccgtggcaccagctaccgcagaacaagtcatggaggaagcaacagccgaataaaaatcctgtttagttttctaatcgttcactccctttcttgttgttgcattttgtggtagtatatactgagttgtctctagctgaagctttggtattctattttactgatctgaaatgttgctcgcggattattctctataagattctctttttctgcaatcacattcttctcttactcggtgttttaaattccaatatagggaattgtgattgttttgcaccattttgttagttaaccagtctctccctatccaactctatcggcaatcctcacagatttgctcgtgatagctggtggctggcgttgtagagactagagagcaaagcttagtttggaccacatgaattgcttcggctctgtcccatcttttttatcaacctaaattcccaatgatgataacatccaccaactagaagagaagagttcatggttttgctttcgtctctcgtttcatcaatcttttttaaacacccctcaggaaacttgcacatcagtcaacatggaagtgtctcagtggtcgacaagggcatagttctgtcttaaatgatgcgatttttaccaaacggcgttcctattagcaacataaaaagccatgaggtccataactcgtcttcgttcaatgatccaatcaatcaatcaatgatttttgaaccacacgacatgattatgttttttttttgtcgcattcatgacttgaaaatttaacgtatcgatcacatcatcaaccccttataaacaagactctttgagattctaagctcatctatccaagaaacagaaaccaaggaaaccaaaaacagaggaaggcaaaa

SEQ ID NO: 7325 - DNA, 3000 bp, Unknown
  misc_feature (1)..( 3000): cDNA_ID_2168780_gDNA_ID_1621140_Annot_ID_172782 3000 nt of promoter + ATG
ctctcgtaaaacgactccgtataataactctttcaacggctcatcatcttcttactcagcatcgaaaacggcatgcgtttcttattccgaaaacgaaaacaacgagtcgtttttcccggaagaatcttctgatactggtctattacaagaggtcgttcaagagttcttgaagaaaaatcgcggcgttcctccttctccaccaacaccaccgccggtgactagccatcatgacaactctggttatttctctaatctcactatatactctgaaaatatggttcaagagactaaggagactttgtcgtcgaaactagatcgctacgggaattttcaagctaatgacgacggcgtaagagccgtcgcagacggtggtttatcgttgggatcaaacgagtgggggtatcaagaaatgttgatgtacggaactcagttaggctgtacttgccgaagatcgtggggatagctagatattcatcatgattatgttttgagttttggtactatcgacttagtttaaagttgctacctttcccaatgttggatattaactaaattatgttttaagttgaatttgctaataggatttcataattataatcaagtttataatatattttcgtagctaattaaagtttatatccacgtattctgacacattacgcgcttaatgatttaagttgtatcataatttataatcacatggtggaacttgttaagaagttacgtaactcttaaacagctttaagcctctaacatagtcgtaatagcaagaaataatatatatgatgagagatgagtaaaataggaaaattcctttgttcagcaatgttggtatcgacctattaaaagtgaatctgcagatgaaaaagtgatatccttacatttatttgtttgtagtctgaaaagtggactaacgttcgtacaaaaggcagtgtttgtctctgtcttctccaacttttcgtgctctcttcattctatcaccaaaggaaaagctgaactactaaataacaaaggtcaagaactttaatattgattgatgtcaaaaaaattagtaataagtactgattttttcacatgttgattaataagtactgaatttgcagaaataaactaaaatatatgctttgaccaaaaaaaaaaaactaaaatatatgctttttcaaaaaaactaaaactaaaatatatgcagaatgagtttaattcattgcgaatatatgatgaaatacaaaaaaaaaattgcgtttttttttgtatcaactgtacccactactcatgttcgcaattccgtatgtttcgtggttattgcgttgatgtaacatgtatatccgtcgatgaaattagtagtatacgaaaattgaaaaccacaaaaatggtaccaaagaaaatgaacacgtacgcacacactaatcatatgtttgtaatttaatctactgtctcatataagtagacaacttagatattcctgttggatgctaactttagaaatctcaacgaattaaagtgaaatcataataggggatacattattaacagggtgaatgtcaaattgtttcaagatgaaggctcaaggctaggggtttaggggtatttgtagtcttgtagaaacataaagttaatattcattaggcaattgtcaaaaccatattgttccttttctattttttgatatatataccttgtaaaaatattccacatcaaaaatccgattcgctcaaaaaaaactctgatcgtatgattctagttaaataaataaatggatgaaagcatctattgcattgtcaatttcaacacagcgaaagcacggaacttcaattgttgaactctattcgaactccaagcttagtaatagcaaaatttctctccatacagtagtagacatgggcgcaaaaagttaggcccagtttttaatcaggcccattatgagatttacatctgagaagtggaaagtttgtattcttggtttatgtacttcacttgaattgctcttttccacaactccacacattattatctacgtctgctaattgctgtgacataactttattatcatctatgatcctgaatatttagtggttgattactacagagtattgttgttaaactcgatgtatgaaagtgcagtgcatttcttaacaaaatttaagtttaccttgtatttcttctcttctttaatcttcccaaaatatacttttgtgaatggtgatttaaaagcttttgagaccactcaaatgataaagtggggcttgtgacgtttcagacattgaaaacctcataatatattagtgggagaccttaaaaaatcaagtcaacgccgactaatccaacacagcgtcacacgttaacgtatgcaatacaacattaggatatttttatcacgcatcgttgtttactttatgttatgtaaaaaatgttagaaatcaaatcgaattacaaaacgtgtagtttatcttttctcaaaaagcctccaagtcgtcgttttcatgtacacacacatactccactcgttctcataattccgatcaaaatattatcatcattcatccatacgtataacccaataatttattcttattgaaattgaaaaatcaaattttccttaccgggtgatatcttacatttaactatttaagcaatcataaacagagaaagaaactaacatactcaattcactatcaagagtggaaaaaatcgtacaagtagacaaacacttatcttatttgtccaagtaagagttttatatctcaatcataagtaaacggccttatagtcaatgtatctcgccgacctatccaacacaagtcacgatgatgatccactggcttttgtttaaaagatttacaatcattgaatcattttgtctcattaaaattaaataatttgataaggattgttgatacattgttacacatgaaatgatgctctgtatcctaaacattttaatcatagtaataattccctagaagaaagaagaatatgattctttccgttgaccttttaagg

SEQ ID NO: 7326 - DNA, 3000 bp, Unknown; identical to SEQ ID NO: 7324
  misc_feature (1)..( 3000): cDNA_ID_1817367_gDNA_ID_1621140_Annot_ID_56608 3000 nt of promoter + ATG

SEQ ID NO: 7327 - DNA, 3000 bp, Unknown; identical to SEQ ID NO: 7323
  misc_feature (1)..( 3000): cDNA_ID_1817365_gDNA_ID_1621140_Annot_ID_56609 3000 nt of promoter + ATG

SEQ ID NO: 7328 - DNA, 3000 bp, Unknown; identical to SEQ ID NO: 7322
  misc_feature (1)..( 3000): cDNA_ID_1817361_gDNA_ID_1621140_Annot_ID_56611 3000 nt of promoter + ATG

SEQ ID NO: 7329 - DNA, 3000 bp, Unknown; identical to SEQ ID NO: 7321
  misc_feature (1)..( 3000): cDNA_ID_1817357_gDNA_ID_1621140_Annot_ID_56612 3000 nt of promoter + ATG

SEQ ID NO: 7330 - DNA, 3000 bp, Unknown; identical to SEQ ID NO: 7320
  misc_feature (1)..( 3000): cDNA_ID_1817345_gDNA_ID_1621140_Annot_ID_56615 3000 nt of promoter + ATG

SEQ ID NO: 7331 - DNA, 3000 bp, Unknown; identical to SEQ ID NO: 7319
  misc_feature (1)..( 3000): cDNA_ID_1817337_gDNA_ID_1621140_Annot_ID_56617 3000 nt of promoter + ATG

SEQ ID NO: 7332 - DNA, 3000 bp, Unknown; identical to SEQ ID NO: 7318
  misc_feature (1)..( 3000): cDNA_ID_1817333_gDNA_ID_1621140_Annot_ID_56618 3000 nt of promoter + ATG

SEQ ID NO: 7333 - DNA, 3000 bp, Unknown; identical to SEQ ID NO: 7317
  misc_feature (1)..( 3000): cDNA_ID_1817329_gDNA_ID_1621140_Annot_ID_56619 3000 nt of promoter + ATG

SEQ ID NO: 7334 - DNA, 3000 bp, Unknown
  misc_feature (1)..( 3000): cDNA_ID_1817317_gDNA_ID_1621140_Annot_ID_56623 3000 nt of promoter + ATG
ctttctagttgcctctgcgagcttgctttcggcagagtaaatcttgttttccacgtctgaagatctcccgtttacactagcaaccagagcatttgcttcaactaatttagcttcagaactcagccttatcttgctattctcctcttgaatttcacgaagagccttctcaagctgcagacaaaaataaaatgaaagaacatatatcaaagaaaattcagaatacaaacgaagtaaaacatctaactaatacagaaaactgaatctcctgtctaaggaagctcaacagaaaagaagaacacctcaaaatcaatgcatcacataagtagataaagcttatattcacaagagcaaacacgtagaaaaccaaacataatttgaagatatccataatgttaaagctaaagaatgctacctcttgcacacattgcttttccagacccaaggctttcctcaagttttcttcacgttgttcaaccgtcgtcaatgcatacagatgtgatgactgttcccttttaaggatttcttgagcttcttggaatgcctgatttagttgttcgtgctttgaaaccaactctttgttctccataagaagaagccccatattgtgctgatagccatataactgcacagaagaaccaattctaagaggttaaagcctgtatatttgtacttatcaaaagccataacaaagagtcaaaacactcatttcaactttcagacagctaaaggttaccaattgcatcataaacccatgagagcagaatattcaaattgttgataaaggttacctctttttcaagtgtagagatcttttcaagaagagcttcttgatctttcttctccattgaagcctcattcaacaaacccacttccctaaaccttctccaatcacccatatccatatcatcagtgtgacctcgagaaacgccttgtccggtcagtgttccaatcggaggcggaggaagagtcggtattactaggtcatcactgaaagcaaccgcctttccttttctatcagcgtttctagggttagtaacaccgccgattttatgcgtctcgcttctcggcgtcattgccggtgacatccattgttttctctgtggcgtgaacattagttcgaaaaaattggaaccctaatttcccaaaatgagaaatctatctctttcttctctctctgacaacacaacggcttcaagaattttgaagtccccgattaaaaaaagtaaatcgccgacgagtgaggtaaaaaggtaattacatttgttttgggcctaaaacagttaaatatgcgcaaaagcccaatgtaatatctggcccgttagagctacaagataattaagaagagggctaagaagatgtctagaatattaaatgttagtcgtcacttgaccgctgatgtgaaagtgaacatttgtttttcttgttgatctttttgttacaccatcttaaaatatcttatctgttagtaaagctaactttaaatttataaacataggaataaaaccgttgtcccatatgcatcattattgtcaaagcgataatgactattattaaattacataagactcaatttgctcatacatgacatgaaatggtgtttgaatagtcaatcgcgcagccatgataatgagagtaggtaagacgtatttgctgcgaagatgtgtgactataataatgacatgaacatattgtgataatatataactaaaaataatatatctgatcataagcatgtaaatcatgttactaactaaatgaatctgaaatgtacaacaatcttatatacaaggaaaaagatgagttgaacaagcttataactatggttaaagctctttaaattatgactatttgtagatctaaggaaaattatgaatggaaacatattttatttgtttgaagaattaccaacaagaatatgcaaaataacctaattttatttgtcattgagctcaagttgggcaaaggagctagatgacatattcttcttttgccaaacttgaatattatttatgtagatgaatccgcattatcgaactggcaatacatgatgaggtggaaattaattttcacatgtgtttgttaaaaagcgtgtctgtgtcagagaagataatttaatcaggagatcgagccagagagcctggcggagatcactggaaatcaattattttagtttgataatataataatagtaatagtactaatccttacattagaaatttagaaccaaacaatcaattaaaaaatataattattcattcactaatcattacagtaaatagtaattacttgctagttgccagttcccactctgttgactattcttctctgttccaagaagttgtcaaaagagataaatatgtaaccatcaacgacttcgtcttcctcttcgtcttcgtccacggctctttcacattcgtaaatcgttcctctattattactagaacaagacaatgagaggtttattcttagataaaaattttaaagagatttctatacattttaagactctagctcactgttacattccattcaaaatttcttcttattcaaatgtttctaattattcttaattacgtattgacctttccatttttttttgccaactatgtattgttcacaaaactaattttaatcgaaaaaataccatatacagtactccctaggattctaaatttccaagatatttatttattcaacttcttccataccatgaaaatacgaaaaaataaacaataaaactccgtcaataaaataataatccgttgaaagtcgtcgttcaaagttgggtttttttcttcatattataaaaaaacactcgttcctcttcttttctgagttgctaaaatgccaaatcaactcatataattacacataaaaattcaacatttctctctcaaatttcttcattctttagctccaaaaaatcttcattctttcattctttttcctaaattttagccattgcccaaaactttacagaggattttcagacaaacaatg

SEQ ID NO: 7335 - DNA, 3000 bp, Unknown; identical to SEQ ID NO: 7315
  misc_feature (1)..( 3000): cDNA_ID_1817313_gDNA_ID_1621140_Annot_ID_56624 3000 nt of promoter + ATG

SEQ ID NO: 7336 - DNA, 3000 bp, Unknown
  misc_feature (1)..( 3000): cDNA_ID_1817429_gDNA_ID_1621141_Annot_ID_56629 3000 nt of promoter + ATG
cttgttgctcaagccactgtttgtgctatttggaagcagagaaacaaccttttgcataacttacaagacattctaccgtctatcatcttcaagaatatagaccgtgagatcatcaattccatcaacgcaaggtgtcatcggagaaagtttagatcgcttatgagattgtggatcagatagttctgtcttttggttattataattgtttgcttccttgttttttctttctttttgccaaggaaccaaagctttaggtaatcaaaaatataaatccaactctatttcattttatatgatatttactcacttagcaaaaaaaaaaaaaaaaaagttatattacaatttgctggtactaattaatgacttttatttgtatgtttaactagagcccaacccaaatttatcaaacgcacatttttttttgacaacttcttttgaattttctatttaattatatggctttaaacaaaagaaattatgatattgtgaaattgttttaataggtcaaatatattcaaatcaagatatttaacggtttgagtaaaaataagcttatagcaaaacttctgaaaatatatatggtcacgtacatattttgcagctaggaagtggacttatattactagctaaccaaaaacttataggtgcaattacagttttagggagatttttttagttctttttatttttatattagataccgttatgtttcttttcccgcaaaatctaggtacttttgatccgaggaatgatttttccattattagttaaatagcgatactattaaataaaagaataacttctactatctatgttcattttaattgattttctagaaaactacatatattaaaaaatatatattaaaactgattagaaatgtattaatttttttaaattatattttttttataattttaaaccagtgatatttaattatttgttttaaagtttaaaattcatcaataataactaataaatagtgaataaaaaatctaaaaaattaacttttttgaaacaattgtttttcctaaaagatcaagtaataagtaacagaaatagtaataaactattttcttatctcaatcattgtaaatagttttaaaatgaaagtggaatacaagtttcagttataaattataattcacactcaataacatattttgaagcaaggaagtgtacctatattaaatttcaatttcatggagcttgaacatattttgcatcaaatgagatcatgcagttttggatgttattcaactcattcaacatcgattgctataattcatgattctccatcttttcaacctgcttttcaaagatggctactaccgaatatgttgcctcatacttcattagattctacatttttttatataataaccaggatgacctttgtatatttttggccaagacatatctttataacttattaaaatgtccataaaaagcctttgaaaaatctcatgagaaagtcacaagcccatgtaaacagtgagtaaggtagtagctacacatatagtataagccagagtcgtagatcaggatcaagtgtgccatgagaaaactttggcttgtatgcactaaataacaaagtgaactagcatgttagagaaaagaagattacggtggcaaaaatattgtacttagagcatggtgcggtgcgagaaagttttgacaaacttttcttagagagagttttacatcaagatcaaaattacgtcaataactaaaagattatggcaaatgagcaccgcaaaaaataaatctcagtataaacctcaccattatcggaacactcgccggaaatctaagaaatgaggactctatcaagttagcctctatcaagcttctccgatctttagtcgatctatggatcttgcagatttaagagttttaatatcagcagtttttcgtaatcggtctccagcttcatattgcaattctattaaagaaaagttcaaatttggggttcataagagttatagtccgaatgtacgttttacaaagatttctcaagacgttgaaaaaaaattgccaatagagaaatcaacctcaacacagctcaaatctaaacaatgccagctcaaatcgaccgactataacaacaagattgttttgatggttcatcaactactcatatgtgtcatgacataccatttttcggaaaaaaatgagagcaaaaaatgacaaaaagaaaatgtggttgtgaaacacatctcatgtctcgttggtgcataactcataaggggaaatcctagactcgaaattaaacttgcatatcaccatagcacattatgattagtggagtaattgccaccagcaaaatataaatagttgtatgttttatatgaagacatagtatgtaaggtggtagaatggtaaagaatgcccccattaaaaacaagaggtagtagctttgaacccttttagcaatattttgcctccattaaatgttttggttggatctgcccttgacaatagctaaggtaatgtctatgtgttctccttctaacacagataaagaagtaacatgaagaatgacttagatagataggcttgagatcgtactgtttgtggtttgtttagtgattcggtagatggtggaagatttaattgaactctatccaattttcacgacattatagattgtagaaaatttgcattaacagattttaaattgattttttttttcactaaacatataattgaagaaatttattacaagtcatctttacttgaaagattttattactaaaaatcccgtttagtttatagttttaagatttcccaaatttaatattttccccaacaatttgtttaatactcctaatttagatttgttaatgcaaccaaacaatatgagtacttatttacaaaacctaaatactacaggtaccttttcgcaatttcccaaaactaaacacactcttcttcttcctcccatagaaacacaaaagccctaaatctcattttcttattacccgtcggagtgaaatg

SEQ ID NO: 7337 - DNA, 3000 bp, Unknown
  misc_feature (1)..( 3000): cDNA_ID_1024400_gDNA_ID_1621141_Annot_ID_56630 3000 nt of promoter + ATG
cattttaaactaaaagaataatctaaaaccactattttcagctttgattccaaaaacacaataattcttttaagaagatgtacaaaaattcgaaaaaactaggtagatttgctaaatttatccccaataattacaaaaccagataccaaatcaaaacacatgtatattatttccgaactggttcggattaattgattttcaactcatagaaacagcataaaacataggggtaattagaagaagaaaaattatggtaatgtaaatttaaaataatgtagacaaaatcaattaagatgttgtatttgtttaattcttgaccgccactatatgtaaagcctattcttgttcgacgagcagtttgctatttttgaaggctttaaagatttgtttgtcggtcttcaaaaattatatatgattcttttttgtgttttgttctcattcaaacactaccgaaaatcactttccggtagatcatctatcatgaaattgctccagcacaaacatgcttaactgtaaagttttttcgatatgtttaatcgaaaagataagtgcatttcgtggatatagatgatctaattaatttttaaaactcttttcattcactactatatatcctgaaatcgggatgttacaatttatttctgaatttttttaagtgtctcctacataactagatatgttacaaccactatggatcttatttctaaaaagtattgaatacatcatgtctaaattgattaattctcaaatatactacattttatgctattttctgtaacttccatcagaatccaaaatttttttttaacataccataaattttaattttatgatttatgaaatatttatagattttattattttaatatttttaaaaaaatccaaaataatagtatctttttagctaaaatttcttttactgtattttaggatatttctctatctaattgtacaccatacatataaccataatttggtgtaattcagatttaaattaggatgacatcaaaattagtcaaaatcaaaatagcatctctattttattcttatacttccaaggaaaaaaaataaaagagctttaaacgtgtcgttatagctgtaaagctggtgatggaactggtaagttggtaactgcttcgaccaccgtacgaatatggtggttactggttaggctacacggtaatttcttttatttacctgcagtgagaaaggtaaataataatgagtgagagagtaatggataattctgaatttgtaatgtcattgtcattgttttgtcagtaagtgatgctttagttaactcatgtttatccatatgggccattctatgtttcatatatatatatatatatatatatatatatatataatatgttattttactttttataattttgattcttagtctttatcagaaaagaaaaagaattgattcttagttcttggatttatgaaaagtaaataattatgtgcaaagagattctttgataatttttcaatataataaaatattaagaatattatttaaaaaaaaaaaattgagggaagagattcatttgattttacgaaaacgctaaaacgagatggattaaatgttagcctttttcatgacaaatatgttgtaaagcataatcatgtacaaggtaaaataattttgggtttttagtgtttatgtcgtaattctataatttttctcaactacttttttctttgtataatttagcatttttaatatcaaacacttttgattccaaatacagtttatttttattttcttaagactacttaccaaacacacataaacggtttttaatatctaaagttaccaaatgtatgtatttcaaaaaacaatcatcagcaaatttagatgttttgaatttttattagaagaaatgcattgcatggttataattagaaaattaaaataaaatataaatcaggattatatgaccaaaaattgttttaacttttacttagcatttacacataaattaacagaaatataatattttttaaaaaataattttcttataataaaaattgttatattgaaattcgaatattaagatttggcaagtcgccaaaatataatcacactcaacaaatttatattgtctcactaattatctgttcataatacatatatcaaatgtataaatcttaatataataaattttaaactaatttcaactgtcatactaaacaagagtttatacaagtctttacctagtgttatactccctctggaaatgttaaagcttattgtttaagaaaacatattatacacctaaagaaaactatgcattcgttttgtgccatgtgttgttttactagtcgtgactcgtgattctccatatcattacgttaatcccaactctcaactattattatgttattttttactatagaatggaaacttgtagattacttatatgaaggttgattaaaatgtaattaaaatctgtatcttttttataaaaaaagtctcttcatatatgttttagttgatgagtgatggacaagtaaaaataaataaaataagtacatacgttttgttttagtgatataaatatatgatgccaaaaatgtacatatattttctggataaatattagagttgtagatccaggtttgctatgatctagctctgtccgaaaattgcagagcgtgatcttttctctgtagtacgaccgatttgttttactttatccaatcgttttaactttttcaccacggttaaaaaagttaaaatcagatctctaaccattttctcaacgaacctcgctaatatttctcatttaatcaaaatttaatcaccattaatcctttggttgattactcttttgtcctcttcttcttctctcttctctttcttggtggctctcttcttatagccactgttccctttttcattgtattcctcaaatctctttacttgatcgttggttctctcaaaaatcagatttttatttctgggttttgttcgattttgtgatcatg

SEQ ID NO: 7338 - DNA, 3000 bp, Unknown
  misc_feature (1)..( 3000): cDNA_ID_1839328_gDNA_ID_1621141_Annot_ID_56632 3000 nt of promoter + ATG
tgtttgtttatgggtaagtagaggcctagaacaccatgtttggttcatttgtcttctttgttgtaaattcccgataactcctgttactagtaaatataaaacaaattatcagttcttgtaatgaaaaaaaaaattttattttgtttagtaaaacatagttgtgctacagatttttctgaatattaataacatatttacagtaacaatttttttcaattgtcattagttttgacgaatacataacattcttactaaaaaaattatataaattaaattttaaatgtcatataattttactttaaacaaactataacgtaaatattatgaaagcagaaaaatgtagctagacatattatcaaatagtttatctctaactaaaaaataaattatatagaggtactttcaaaatattctataaatttaccctttttaaaacaaaatattaatatttcttatacaaaacagatctagcttaatacattttctatagggcacaaaaaagaaactattgttaatgaaaatgaagcaaagaaaacatgtcgagaaaatgtatagcaaatataaattttcgtaatataataagaccattaatataagaaattaaccaaaaataggtgaagaaatttaaactatacgttttgggtatcggttttcttggtctagcacaaaatgttttactcaatttttatgttttatataaagttttcatcaaagagctttactcaatagtcaatataatgtagttagatagtgaaatttttaactttgaaacaaattttatataacataattgaacaaacaaaattattatatgatatttgtatttatttgttttaaaaagactatatgttacgtataaaataattacaaaccttgcacaaaaatgacgaagagagttagaacggtaaacgagaatataatgtttttattcatcttagctgatataaatgattatatatatatatatatatatatatatattttaatctgaaaattgattgtgtttaaaaagaaaaaaagaaaaaaagaaaaaaagaaaaaaagaacgaagaaagcatacatatatataagaagttaggtatatcccacattataacttatctatattaagccatctatctccttaaattccgattgagctttttactcatttgatatgttaaaagctttttaccagctagtcctatacaaaatatttttccaaattaagtaaaagtgataaattagtaaaattcatatataatttagagaatagatatactaaaatggaaaaggttataaaaatagcattttggttttcataaaaaggaaaaattaatttagaatgtaactattgaaatagacttttgtttttcagtttttttgtgcaaatacttgatttcattcattcaatcaaaacaaaccaaatcaaagtacaatgataggaatgattccaagatcccaatgtttataacatgaaaagatagagtgttccctaatgcaacataacaatagattaggtagtccgacttgtgattcataagcgcttggagacaaatgttagaaaggaaattggcacaagcaaatccatggtgagtcgatagtgacggttgattgatttcgtgatgttgaaaaaaattccaagactttgattcttgcttgcatgagacgttttacacagtttatcataaaggtaaggaagatcggtagcttacacagtttagaagccaaaagctgaggatgaaaacttgtaaatagagttctcttcgtataagagaaggagatggttagtttctccataaagaaaccaattgaattcatggtttctcattgagcgagggataaggattcggaagactctcatagtcggatagccttagctttgtagctctaagaaataggtcgggatctctcatggaagatgcaataattttttgtgggagcttgatctgatccgtaaagatgttggtgattgtgagatacttgagatcattttaaaatattgtcgacctaaagtgaacgtacatagaggatccattatcaaagtcgcaccaccgatcaaggatcatcaagtttatgctttcataaaacgtggccagagttgagtttagcgataaggttcctagatgataagcgcaagaccaattcatcaaaatcgattcacatctcatgtcatgtcctcggccacataggtaagagaatcgatgcatctatgtaatggacttgacaaaagaaaaaaaacaaaatttggcaaatcattctaaagaaccaaaattacttcgtaactagtgaaagtccttttaagaattcataacttagaaatttgtaagttatatgcgagcaacggaaacattcggatatttttctagtaaaattaaataattagagttttttttaaagaattaacggctagaggagaaattaaattactatgggtatttttttcagcaaaaaaatagttggatttttttttgttgagaaatttcccttttaacaagttccaaaataaaaactgattatagtagaaaaaaagattggaaattgataatactacttgaattttttatatgccttaaatagtatataattgttttcaaactttagaaacattaaatattaattagattttagacattatatagagtttaaatattatgaaaattataaacttttataaattttaatattattctattttaaaactcttataaagttaatatttataaatttgaatattttaaaatgaatatactaattcatagtagaaaattgatactttggaaattggccgttgttaattggaaaacatcacagaccataaattgggatcttgcgtgaatccatcaaagacctttctctgactcttattctttctcctccaatctagggttactccgaattcttcttcgtgtccctctccgattctctgcacgttgtcgctgttgtttcctctgaaatcgtctcgaattgaaggatcttggatcttttttttgctgccattgatcggttcatctttcaaat

SEQ ID NO: 7339 - DNA, 3000 bp, Unknown
  misc_feature (1)..( 3000): cDNA_ID_1817421_gDNA_ID_1621141_Annot_ID_56633 3000 nt of promoter + ATG
atggtgaggcatagaggtgtcttacgcgaatccatgagagagtctggagatatgctcggaagcgtttagtattgttgctcgaaggaaatgagggtcccaacgactcgtgaggagcggggtatgctcctaaggtaccggtaactcgagggacatggtgtctttagagtacgaggggtacggtggcttcgggtgacgatccgagagcacgctttagggtgacgatccgagagcgagttttgtggtattattttctccaagtgtcgtaactcgatgactttgtggctgagagtgagccgacacaactcagggtttgactttgagtggggaagataatatgtgtgatatccgagataccgtaggccgaggcctgagagtgacggtttatgctcgaagattgcggtctgagagtggagagtaagttgtgagcaacaatgactagtaaatcgtgagtatatcgactggatagagagacctagagggggtctggttggagggaatgcagactgtagtgatggttgcacggagttcctcggagtggaagggtgaagctagattcgaagacgaatctatgttagtgggggagaattgtaacgcccgtgaaccagaaaatcggttaggatttgtttttaaatcatccggtttaattggttgggttaattggaaaccctagagtgtgcctataaaagaaggaaactcgaaattagggctttagttagccacttttcgttttataaaggagaaaaagagagaaaaggagaatgagcagaatcgttagggtttgggagaaatcagtttcgtcatatcaaatcgtggtaaaaggtaacaaaatttggtagagttattcccaaatcctttatcgttattctccagtttacagaattgaatttggattaaaattggttgagttattcgcagtttcgtgagacacgttttctcagacgcgaattaggaccagcggagattgaaactgagatcgtggtctcgtctgttttccgatcggcacgagattttgtgggcagctttgtgacgtctgcagctaggattttaccggagcgattgaatagttaacggttagcttgtattttagggtttcgtctttgagactgtttgtttctggtgttttcctgtccagtttgcttcaaggttgcttttggttgtggacttgttgtaggacgtttctggactgtttccgacgcaaggagagtctctcctgggtttaattgctattagaatcaatttgttaaggtgagtgcgtgaccatgagcttatctaagcgattgggttgtgtgatttgttttgtgtgatgatatgtaagtgttgtgaatgtgttttgggtgaattgttcaatgactggtttgtttgtattgtattcgtgattatacctttgtatttgcttgtgtgtatagttcgtagatgggagtatcgcctcactaagtatttatgataatacttacgcatctcattgtgttgttgatgcatgtaaagataaagtgtgatcgtggaatcataacaaggaagagaggatgatctaggaactcgtttgttttatttttggtgtttttggttattggaacccggttaggattgtcagttattcttggttttgttggtcgatttatttatttattcataaaatagtatttttgacttgcagtttaattattatgttattagttggtttaattaaatatttatgagaatatttaattatatttaaaaaaaaaaaatgggtcaagttgtttcacaaacatttaaatatttctagatgtacctttgctctttttctcttttcattcattttagaaaatgatgaaattattataaaaaattcaaaaactgtattaattatttcaagttacaattctacgtattagtatacaaaaaagatcattataaaaaagttgtcagccaaaatttaatattaaacatcccgtaagtttaacgaatccaatgtatttcaagcagaagtccacatcagttgtctccgtgtaaaatggtatatgtctttgaaaagcatcacgtttgtaaatggaaacacaatgaacacgattacacgaataataagttaataacaacaaaggaaacatgatgtgtttgatgaactttgtggttgtggccatatttttgagaagaaacaaatctatttggtattttctatttaatatgtttgaaacattttatttatactgatatccgaaagcttaatataacaataataagtaatgtaattgtaaaataaaattttaattcatcactttaataaagaatatatttaattaatcatttttaatttatctatttttacattatattaactaataattaattataaaatagtaatatttatcaaaatgatcaaataaaataaaaatattaaataaatagtttagtaatagaaaattgtatttttattatgcttctgttcctttttgtttgatcttttaggaaaaatacaaatattaagaaaacgtattaaatgttgttttaaatgtattattttttgtgatttacaatttttaagaactctaaaccaataatatttaataatttgtattgaagtttacaagttatcaattataactaataattattgcattgaaaacctaaaaactcaatttttttgaaataatttgtttttcttaaaaaaaaaaaaggacaaagggagtattaggtaaaagtttgatgctaaaactatactcaaatggtgtatactgtattggcaatggttcatggttgcctggttggtagcaaaaaaacacagatataattacgttaaggctatcattaaacaaagagggtctcgcaattaaaactacactaattcattgtttacaagaaaagaaattgttacttctttggaaattggccattgttaattggaaatcgtgaatccaaccaacaagacatttctctgactctcttcttccttcttctcctccaatttagggttccttcaaattctctctgatttcgtttgaaattgggggctcctcttcgaag

SEQ ID NO: 7340 - DNA, 3000 bp, Unknown
  misc_feature (1)..( 3000): cDNA_ID_1817409_gDNA_ID_1621141_Annot_ID_56637 3000 nt of promoter + ATG
gaaaactatttagagttgccttattatatagaactagatgattacccgcgctacgccgaggttttttcggattttttgtattatttaatttaaatttaatttttatttatctaatcattcactcatgcaataaacaattacttttagtattaaaaatatttttttctaacaacattctcaacaatgcatcatacatataattcataaacaacgtttgtcttaaaccaatttaagagagggtagtgttggattctagaaacctaagaatttgatgatagagctccttacgtatgcttcagcctcagtgatttattatataaatgtcataagagaatataaatatcaatttaagagaataacttattcaaatcattaagtaattcacgactattatacattcatactttgagtttggattacaaaaaaaaaatcttcgagtatgagaaaactattaaaataattttattgaaaaatcatataaataaaaataaatttagtaatagtataattaaatatgtaaaataaaattaaataagaaatatatcattaacctataaattagaagttgaagagcttacattaattatttaatagacacatgtcaaatgctaaagtgatgatgtgtcaatcatacggagagagttgaccaactttcatatatatgattcagtattacaagaaattaaaccaagaaactactttaatgttaacaattcagaattaatacttaaaattcaatgtatgcagtaatttggccaataaactattctagtgttccgaatttgatcatttttaatctcaatattgaactatatagctttaatgtatttttgttaaaaattaaaaaaaaacttttaaatttgataaacccaatcagaaacagaaacaaaaacagaaaatattgatgatgataattgagtcaaaagtagctggtaaatttatcacatctttcccaaaagggaaatctatataacttcaatatacaaactataaagtaatttagcaaagaaactagtttaatgtcataatctgaccaattattatttaggtagttacgtttatagtcatttcttcaagatacttctctagttttcttatgtcttatcacgaattgtaatctctgatagagaattattcagagttgcttaacatttaccatcgaatattaattagaagaattttaggcaagactactcatagttaatatttaaattcaatatagcacacctattgtttctactatgttgagtaattttttcaaataaataacagaacattttttttgagaaaatttcatagaaaatctaaaatattaccacacaatacataaacaatatttttaaataaaagtttataaatttgacgtttcttatataaaaaaatgaatttgaagaacatatagacatggtacttgtagtaacgaaagtgtggtttgattaaatcagatttaatctatttttatttatatcatgtattgtgaaatgattctcccatgaattaatgttgtattttataagctagggatcagtttttaatataattattttagtaggttgtgataaaaaaaaattgtgtatattattttaattatattatatgtggtagatttgttacttgttagtattgctgaggcggatggaatctcggttagatgggttcgatttcgatttccaacctaaacattgctaaacatttttcttttatttaggtaaatgaaggtcaaatatggcatttctaaaccaagcaataaccacagtctaagttgaccaaaaataataaaaagttaaatgtctctagcgatgtcgtttggttgagaattgtattcttctcctctctctcgtcgtgacgcttagggatttggttcttctgcttcttagcattataaattaatttagcaagaaaaactacttatgtgttcttaatctgaccaattctaatctattgtaggtatgaagtcattttcccatgatatttctctattctttcttaacattcgtatttatctatgaactatttaaagttgccttattatatagaactcagtattacaagaaatttagccaagaaactaatttaatattaattattcaaaattaatacttaaaattcagtgtatggagtaagttagctaataaactattctagtgttctgaatttgatcattttttatctcaatatcgaactatatagctttaatgtatttttggtgaaaattaaaaaacaaacttttaaacttgataaacccaatcagaaacagaaacaaaaacaaaaactattaatgatgatgattgagtcaaaagtagctggtaaataatcacatctttcccaaaagggaaatcaatataacttcaatgtaaacattatttgagctctaattaattcggatgacaaaaaaaaaaaaattagcaaagaaactagtttattagtgttcataatctaaccaattctagcctaggtaggttatgtttatagtcatttctccaagatacttctctagtcttcttgtaatctctgatagagaattattcagagttgcttaatatttaccattcaatattaattagaagaattattaagactactcaaagttaataattaaattcaatgtttgaagtaatttagccaaacaaatattatagtgttcttaacctaatcagttttattctcggtagagaattattcaaagttgcttactatttttaaattagtgcttgaattaatttaacttacatacaactatagtgttcttattttgatcagttctaatcttattagagaacaactcaaagctgcttaatattgaaaatccaatgtttgaaataattatagattttttaatttgaattatgtcaagattgaaacattgactctcaaaaacaaagcaacccacatggttgtagaaagagtcctcgaacgttagaccttatataaagcctttgcttcattgacaatcttaaacatcgaaacatttatctctttatcatttcaagagggaaaatg

SEQ ID NO: 7341 - DNA, 3000 bp, Unknown
  misc_feature (1)..( 3000): cDNA_ID_4254981_gDNA_ID_1621141_Annot_ID_172848 3000 nt of promoter + ATG
catcgaatgcatgcattgacgtttcagatgactgtgtcttttcgataacttaatgaaattgattttttcacaagataatttctaaacctaaacaaatctatcatttttgaattttcgtttaacattaaactcacatctaattacttcacaatacttaatggggttgaccgatatcaagtgttgtttcgaatttctaacttgtgtttatgttttttttttctgtttttaaagtttcagtcattggccaattgtgtttcttccgttgatcagtttgttttcatctcaaataatcaagcctatggcaaggtaatattcaaatctttcatttctacaaagaaaatcagagtattatcaatacatatatccgtttctcaataaatatcatttcacataattaataaagtatataaaaaatatctcgtaaaaagcaattattcttggtattgtatttattatttttatatttgtttagaattggattggaattatgtattttctatggaaattcatattgaaatctaaacaatactagtcattttaaaacagaaaaataatttgaaaggagtagtagcaattaagattgccagtgcactggttattggtattagttaaatattttagaccaccgaccgcatttaaagaagtagttaatatgtataagacaaaataagaaacaattattgaaaacaaaaacaaaaaagaaaagaccattaactctagattcacattgtgacatggtatttaatgaaaagaccattaactctagaccgcgttattgaagatataaggtaaaactacaaaaaatataacaaattgaaggagcctttaaataattaggcaaatgttatatcttgcgttcctgcctccgggcatgatgtgctaaacatttgtctaccaactcttgctttcacttgcattgataaaccaaatacgaccaatttaaacacatgaacctcaaccttaatgttggcctaagagtctcctaattgaatgatccaagattgaagtaatcaaaaaaggcagtacacctatttcaatgacaaggcatttgtatgaaattggttagtatattttttttctagacgagaatatttaaaaacgtaacgtacgcaatatgacgtcaaaagaaacaacgcagcatttatgaaacgatattgtattgttgtgcttggttaaccaagtgacattaatacattaattcgtttttatgtacgtttataagatttcgtttttaaacgcaccaaaaatatataaaaccatctttgcaatgaaggaactgcttactacactgctcgcttgtccaacaaaggttttttaattgatctttcgggaaacttatgattccaatggcggttttatcgaatggtcaccggattttgttgaattcatcatattttgtcaaaacaaaattcagatcttagaaaaatttataacattgatttgtaaaaagtgtataagatagtcctttgggattaccttatcgttcaatggaccataaaaatagctcgtttaggttccattactttccatcggagtaaatacattagtccaaataattcgttttcgtaaatatataagcctaaataattgtgtccaccaatttgtatgttggtgtgttttcacttgcacactggtaaactaaagacaaccaattctaacgcatggatattggggtcgtttagctaagggacaaaatttgataaataatgaacttagagacaattagtttttctatctttgtaaaaagacaaataaagtaaataaatagatatgaagttgaaaaagttcaaaaaaaaaacagcctcagcttttgccttgcgtgatagaacgagttcacggacatgcaacgagcaagagcgagttgacatgcatttaataacggctagactaacttaatcgcacacagatattaacaaattgtctgcttgtataatattgaccttttagtgctttatatatgtgttttcacgtgtacacattctagaatcgtataatatctgtttgtatgttaaaacttctccaatctgaaaaaaaaaacaataattaatagtctagccgttactaatatgcatgttaactcgttcttttttgttgtatgtgtattatttcacatgacaagctttaacctttaaaatgcactcaactcgttccttgcacaaaaagtcaattgaatatacgtattgtcccatacgcaaggcaaaaaagcagagataattattatttttttaaatattttccaacgtcaaatctattttttttgtcaatataccttaaaaagaaaaaaaactaattgtctctaagttaattatttattaaattttgtctcttaacttaacgacccagaaagcctccttggttcaatggttgatcaagggttcattaatacttatatactaagaggtttggagtttgaatcccagctactgcaatttattaatagatttgcagattaattgaggcaagtgtgcaggagatctacaacgatgtacaattatagccgttcgccaggattatacgcagagaagatatttttggtatccatcaagcgcatggagaagaagaatgaggtgtcgtatatcgtggatctaataagggaaagaaattatgcataataaaattgtctatgtaacaactctcgtaatctgtaatagaaaaaaaaaaactaaacgacctagatattcatgcgttaaaattggttgtttttttagttatcaatggaaaacacaccacatcagaattggtggacttgggctaatatatttatgaaaacaaatagtttggggctaatgtattatctaatgggctaattaataaaacttaaacgaactatttctaaggcccattaaacgatagggtaagcccaaatcactatcttacgcccctctttatattcatcgccactgaaactgagaaaagggttagtttcgctgcgctgtttcaagggttttcgtttttatcttttcctccgaagaagaagataagaggttgaagaagaagaag

SEQ ID NO: 7342 - DNA, 3000 bp, Unknown
  misc_feature (1)..( 3000): cDNA_ID_1817398_gDNA_ID_1621141_Annot_ID_172843 3000 nt of promoter + ATG
tcatactccacgtaaaagagatatgttcgaggcatacatcaaatattataatcaatcatcgtgctaacttatactacaacaaaatattaatataaatttactatccaatcttacgaattcgtgcaaaaatcatctaatttttttgccacaatggcaagaaactattaaattttgatgacgtggacacgcacatgtaaaaaacgtggatgtcaagtcataatgttaacaaactgttttttttttcatttccttcaattctggtttttgttttttaaaagttgtgtataaacataaataaatatatatatttatttatatatttccaatggattctccaaaactcttatactcactttcagcatattcttccatcgtgaaaccttaccaaaaaactaatattaaatttctatggtcgtgagtatgcttaaaatgtacctactatttatgtgtagtggtttataaaatctaatattattggaaacattttaaccattgaatttttgatgacttaaatttttttttagataatttaattcgttaaaaatgtaaagatccaaataacatggtgttaagtgtccctactaaaaaattaaaagtggtgttaagtgagacttaacaacaaatcatacaaatttcagaattcacctaaaatcattaaagtcatccaaaaactcattaaaactcaaactgatttaaaatataagattaaatgttttattctatatcacttagaaaactgaaaataaaataaaattgtttgttaacactatgatgtatcattcacgtcgtttcacacatggtctacattatctattatagtttcttgccaccatgacaagaaatgtataattttgcacaaaatcataaatttagatggtaaattttaattaacgatttgttcacgtatgaattagtattcatacttatattttaattgaacttgtcgctttagttgaggtaagaaaatactataatagtaatgaaatctcaccaaataacaatcaaaaatttatttcaatcacataagatcttgtcaaaatccaccaaatcatcatgcgtgtttttcaacatctctccaaatcttctaaaaattactaatccaatacaccgcctaactaatgtatttggtaataactcttgatatgtacaactaatttacgtgttctccaccataggttatatctgttaactagttacgtacgtcgaccaaaaacatattactttatcgtggttttatcgttgaattattcactttcatgttgggatatcaagatttgaatctttcaatcatgattttaattatagttgtcaaatgtcatatcaaaaatatctattttcttatagtttttaactgattagtatgagtttcgatttggaatatttcagatatgaacatacaactaaggaacaaaatattgatattagtttcctatatctttttatttattttaaatacaatagcagatcacatgtatatattttaactcaatagttacgtcgaccaaaaacatataactttaaatatcgtggtttcattgttgatttattcactttcaggttgggacatcggaatttgaatttttcaatacgaattttaaacatagttaaatattttcttatagttcttacttcttaacgattagtatgagtttagatttggaatattttaaatatgaacatatagttaaggaacgaaaggcgatcacatgtttgtagttcacctaagtattgtagttataatctcatccagtacctggagcagttgagctaatctttagattaagcttgggcaaaaaatccggactaaaatacttgaaccgaaaccgatccaaaaaatcggtttgggacgagtacggatattacctatttactttattgagtcttgaattgtcgtacccgtgagtatagggtaaaatccaacccgaacctgatactcgaacatgtatccgcttacccgaaattacatatacttattcatagatttatatatataaaatcttattttatatttaatatttgaactaaatacatttatatccaaatatctaaaaataattaccaaaaactaaatacatttgtaaatacttaagactaaatatttttatacgcaagatacttataagttttttggatattgggacaaaatttcggttatgtgggtaaaattcagatatttgggtaaaatattcaggtatttagataaaattttagatatttggctataaaatacctgaatctcaaagatacccatttttttggtatttagcggttctaaaattatatatccgaaccgacccgaaccccattggatccaaaccgaaacaaaacagaaattttagatttatcttattgggtcctaaacttttctacccaaaaaattcttatccgatcgaattttacccgaatattccgacccacatacctgaatgcccaaccgtactttagggaattacatccgatgcacaaaagaactaacaattttgtactatcattaacaccacccatttgcaactccgaaagacgatcacatattgtagatttaaaatgcaatcttaatcacattttcactaaaagttttccttaacgtatttggtgggcatgatttaacagctcaatttggcaggtcaacgaatcaaccgtgctttaaacgttgtaatgtttttcaacttaagataagactcgaaatcaattaaaaaaacaaacaaaaatcatagtcattgtttttctttgttaattcatatacactcatacaaaacattgacaacttatctattgtttaatctaaataatacaattatgtacaagtgttactttagtaatactgccgtccatataacggcacaaaacggagaatgacgtcaccattgttgatgtcacacctccatgtaacttctgttataaacgcattaaacgttacacttgtgtatattatatagatctctgtccctttatatttcatcttttgacattacaaaattacattaccaaacacattaaatg

SEQ ID NO: 7343 - DNA, 3000 bp, Unknown
  misc_feature (1)..( 3000): cDNA_ID_2151397_gDNA_ID_1621141_Annot_ID_172832 3000 nt of promoter + ATG
aaattgttttgatttgcgaattttataggtgagggggtaatatttttgaacagctttagaagtgtagaaatatagattgatcctttgttgtgatgttcaacaccaagaagatgtgtatccttttggaacccattgatattaatacataatatcatattattgagcagacatgcaaaaaaaaaaagcttattaataattcccttttttttatatagaaataacttttgtagcttcagctatgaggaaacattgatgtttgaatttatcattaggacacgagtatggttgtgtcacaaaaattccctagacatcctcatacatgaagcctgatacaccttggttagttggttctattctataacgagaaaacggtacatgttcggcctaacaatcatcatatgaacttgcgtttactattatcaataaaactaagaatttaacccgcggtgctattatgctttaaaaaatataaatttattttttaaaagattaactgaagatatatcatattaatttgtattttaaaatatagatatctatccttgtattatttagtatatgattactattatttaggtttcaaattttgaagtatagatatgaaaacctatatttttttaagtaacaatgtgtggtagattttaaaattttgaatattttgtctgcagtataccgcgggtcaattttttatagcttgtattttgagttatatttgttttgttaatattgtatgtttttgtgtttaaggttgtatgattgtattttgattgttaattttatgatttcatccgtaatatacctttctttattaatattgatcaaaacccgtcatcccatataaatccgtatatattatctcgttagctaaattattagtgttataaaatccaagaaaataaattattattgttctaattccaataatttaggatctcacccgtggtataccgttccttgaatgatttaaaatatatattactaatatagattttaaatttatcatataaagtatatgatttcaagttttgtgcttttaatttaaataaaagaacggtttaagtgatgataaatatagttttttttcctgtatgtgtatatgattttttatgtgaatattttaattattataaattagtatttttattgctatgcaaaatgttaatataaatatttgctataaattggatttatgcatattttgtgaagtaaaattcacgattttttttcaaaaagatatatgaaaagattgtgtagagatttttagaaacaaattaggcaagatatagtttggttaatatcttttttaatttttttaactaaataataaatgccagtggcaagcattgtaaataagtcccaactccaggatttattccacaaaatggttacaaaaatgtatatgtagatattaaaataaattttaacttaataagataaaaaaatttctaattattcaaaaaatcagcaatgttccatttagttaatattttatttttcacaagagattgctttccttttttcatcttatatatttacccaattttattagagatactttcttttatttctattaaatatttctgttccaaactgtaacgcccgtgaaccggaaaatcggttagggtttgttcttaaatcatccggtttaattggttgggttaattggaaaccctagagtgtgcctataaaagaaggaaattcgaaattagggctttagttagccacttttcgttttataaaggagaaaaagagagaaaaagagaatgagcagaatcgttagggtttgggagaaatcagtttcgtcatatcaaatcgtggtaaaaggcaacgaaatttggtagagttatttccaagtcctttattgttattctccagtttacagaattgaatttggattaaaattggttgagttattcgcagtttcgtgagacacgttttctcagacgcgaattaggaccagcggagattgaaactgagatcgtggtctcgtctgttttccgatcggcacgagattttgtgggcagctttgtgacgtctgcagctaggatttcaccggagcgattgaattgttaacggttagcttgtattttagggtttcgtttttgagactgcttgtttctggtgttttcctgtccagtttgcttcaaggttgcttttggttgtggacttgttgtaggacgtttctggactgtttcagacgcaaggagagtctctcctgggttcaattgctattagaatcttgttaaggtgagtgcgtgaccatgagcttatctaagcgattgggttgtgtgatttgttttgtgtgatgatatgtaagtgtggtgaatgtgttttgggtgaattgttcaatgactggtttgtttgtattgtattcgtgattatacctttgtatttgcttgtgtgtatagctcgtagatgggagtatcgcctcactaagtatttatgataatacttacgcatctcattgtgttgttgatgcatgtaaagataaagtgtgatcgtggaatcatggcaaggaagagaggatgatctaggaactcgtttgttttatttttggtgtttttggttattggaacccggttaggattgtcagttattcttggttttgttggtcgaattatttatttattcataaaatagtatttttgacttgcgctttaattattatgttattggttggtttaattagatattttgtgggaatatttgattatattttttaaaaaaaaaatgggtcgggttgtttcaatttggtatcagagcgattacggttctaggatgtgtagaaaaattaattgatgaattattttcctgttgattgatgtgggatgagctagggtgttagcatattgaggattgattatggagtgtttagtcaattgtgtgttgttggagtcctagcatcatcttctccgagccttaaatgagattccacggtaagttgtttgtgatatattcgtttgttttagtttcttagccatttgttcttgagtagcgcag

SEQ ID NO: 7344 - DNA, 3000 bp, Unknown; identical to SEQ ID NO: 7338
  misc_feature (1)..( 3000): cDNA_ID_2992375_gDNA_ID_1621141_Annot_ID_172830 3000 nt of promoter + ATG

SEQ ID NO: 7345 - DNA, 3000 bp, Unknown
  misc_feature (1)..( 3000): cDNA_ID_2151380_gDNA_ID_1621141_Annot_ID_172824 3000 nt of promoter + ATG
ttttcaactcatagaaacagcataaaacataggggtaattagaagaagaaaaattatggtaatgtaaatttaaaataatgtagacaaaatcaattaagatgttgtatttgtttaattcttgaccgccactatatgtaaagcctattcttgttcgacgagcagtttgctatttttgaaggctttaaagatttgtttgtcggtcttcaaaaattatatatgattcttttttgtgttttgttctcattcaaacactaccgaaaatcactttccggtagatcatctatcatgaaattgctccagcacaaacatgcttaactgtaaagttttttcgatatgtttaatcgaaaagataagtgcatttcgtggatatagatgatctaattaatttttaaaactcttttcattcactactatatatcctgaaatcgggatgttacaatttatttctgaatttttttaagtgtctcctacataactagatatgttacaaccactatggatcttatttctaaaaagtattgaatacatcatgtctaaattgattaattctcaaatatactacattttatgctattttctgtaacttccatcagaatccaaaatttttttttaacataccataaattttaattttatgatttatgaaatatttatagattttattattttaatatttttaaaaaaatccaaaataatagtatctttttagctaaaatttcttttactgtattttaggatatttctctatctaattgtacaccatacatataaccataatttggtgtaattcagatttaaattaggatgacatcaaaattagtcaaaatcaaaatagcatctctattttattcttatacttccaaggaaaaaaaataaaagagctttaaacgtgtcgttatagctgtaaagctggtgatggaactggtaagttggtaactgcttcgaccaccgtacgaatatggtggttactggttaggctacacggtaatttcttttatttacctgcagtgagaaaggtaaataataatgagtgagagagtaatggataattctgaatttgtaatgtcattgtcattgttttgtcagtaagtgatgctttagttaactcatgtttatccatatgggccattctatgtttcatatatatatatatatatatatatatatatatataatatgttattttactttttataattttgattcttagtctttatcagaaaagaaaaagaattgattcttagttcttggatttatgaaaagtaaataattatgtgcaaagagattctttgataatttttcaatataataaaatattaagaatattatttaaaaaaaaaaaattgagggaagagattcatttgattttacgaaaacgctaaaacgagatggattaaatgttagcctttttcatgacaaatatgttgtaaagcataatcatgtacaaggtaaaataattttgggtttttagtgtttatgtcgtaattctataatttttctcaactacttttttctttgtataatttagcatttttaatatcaaacacttttgattccaaatacagtttatttttattttcttaagactacttaccaaacacacataaacggtttttaatatctaaagttaccaaatgtatgtatttcaaaaaacaatcatcagcaaatttagatgttttgaatttttattagaagaaatgcattgcatggttataattagaaaattaaaataaaatataaatcaggattatatgaccaaaaattgttttaacttttacttagcatttacacataaattaacagaaatataatattttttaaaaaataattttcttataataaaaattgttatattgaaattcgaatattaagatttggcaagtcgccaaaatataatcacactcaacaaatttatattgtctcactaattatctgttcataatacatatatcaaatgtataaatcttaatataataaattttaaactaatttcaactgtcatactaaacaagagtttatacaagtctttacctagtgttatactccctctggaaatgttaaagcttattgtttaagaaaacatattatacacctaaagaaaactatgcattcgttttgtgccatgtgttgttttactagtcgtgactcgtgattctccatatcattacgttaatcccaactctcaactattattatgttattttttactatagaatggaaacttgtagattacttatatgaaggttgattaaaatgtaattaaaatctgtatcttttttataaaaaaagtctcttcatatatgttttagttgatgagtgatggacaagtaaaaataaataaaataagtacatacgttttgttttagtgatataaatatatgatgccaaaaatgtacatatattttctggataaatattagagttgtagatccaggtttgctatgatctagctctgtccgaaaattgcagagcgtgatcttttctctgtagtacgaccgatttgttttactttatccaatcgttttaactttttcaccacggttaaaaaagttaaaatcagatctctaaccattttctcaacgaacctcgctaatatttctcatttaatcaaaatttaatcaccattaatcctttggttgattactcttttgtcctcttcttcttctctcttctctttcttggtggctctcttcttatagccactgttccctttttcattgtattcctcaaatctctttacttgatcgttggttctctcaaaaatcagatttttatttctgggttttgttcgattttgtgatcatggcggtcattgagagcgtcggagctaatactactgtggaagctggtggtttgatctcgccgtcgccgccgtcttccgtcaccagtcaagaatcaggagcttcttctaacaacgatcacggtggaaatggaatccatgatgagatcggagtccacgtggcgagatccgacggtggtgagagttttaagcgtgatatg

SEQ ID NO: 7346 - DNA, 3000 bp, Unknown; identical to SEQ ID NO: 7336
  misc_feature (1)..( 3000): cDNA_ID_1817429_gDNA_ID_1621141_Annot_ID_172823 3000 nt of promoter + ATG

SEQ ID NO: 7347 - DNA, 3000 bp, Unknown
  misc_feature (1)..( 3000): cDNA_ID_2151370_gDNA_ID_1621141_Annot_ID_172819 3000 nt of promoter + ATG
tccactttatgaaattatagtccactaactcacatgggcatggtctcatcatgcacttctagtctctctattctctaatttagattactaactctaaatccaacctaccaattcctcctaataatagtgacaaaaaatgttcctctttaagagaataaactttaaactgattgatattagagatcccttgatattatccatattaattgtcttaaattcgatgttcatcttgattaattctatgtatgaactactcatatatataccaaatgttaactgcatgatttataccattgttaactttttctatcttataactgaaattaaatatttgatattaaagaataaagaaatggggttcatgcattacaaaagaattagaatcttatcggtaaattaaatatagaattcttaggagctttatcaaaaactaccaaataaaatgtgcctaaacattcactgccaataactttttgacatggagattttgactagtccaagcaaaactcattcatatatgagaccttttctcgatgctacataagttaataaatattaaaagaatctcagtttcaaagttgtatttttggctaaaaccattattttgtagtcttcgaggtcttgtcgtccttcatttgcacgcctcgtttttattatcgttcgtatttcgtatctatcatgtatgcattaggatcttatgtttgtatgagtattaaattctgaaataagtttttgattgtgtccgtgacatttcaattaagcataaacccttattactagccaaattggaagttggttggaaattagaaaattaattttctgataagagtaatgtaaactgaaaaatacttttgagcattttcctcctactttttatgaaaaatgtataaaagtattccgtgtattatcattttttctctaaagaactcccaaatattggttaatgtatagtgtgatcattagagtttgaacaccttgttggagagtgatctaaactgatctaccaagatcgaacaaaacaaccttagatcatattaaactgattgagactaaccaaaattacaaacttatactgcaaagccatagtaaaaaatcttagataattgtgaatatatattatttatattattatagtttaggaatttagctttatagtatgtatattatttattctgtagtgatcttgaacttcaatttattttcatctttgtataataacagttaatactaattattttgtaacatacacaccttttttgttttgtttttattctcatcaaatttattgtttttttttttttttacagcaaatttatttgttttgttcaacatagcaggatagagaaacactgacccactaaaatacatcacctatgatttctgattactactataattctgatccaagaaaaaagcaattactctaaattcatatatatatatatatatatatatatatatatatatatttttttatcaatagagttgaaaacttttaaaaatagcttctgctagttttagcaaaaaggtgaaaaccagagtaaaagcattcttccaaataaaatagggtaaaagtattactctaaattacactttttctaatcacaaatatattaaaaattgaattttgtagattattattataaaaataattaataattattctcacacatttttattaaactctcatcatattaattaatttggtttaacatatcataaaaagagacaaactacgatttctaaccactataagattacttatccccaacataacagttcttgaagactacattctctagccacccaacttctatagattatcacaattttaactattacaggctctcttttcattttgcaatttcctaagaaacgttctatattgtgtaaacacgtgacaacaccaatgagctaaatcacaatttacaaaagaactaattcttttttcaaagaaaacaataaaaatcatgttgggaactttggattcttggtacaacgaggcattaaagtctgtggctctctccttcttgaaaatatttacaatgtcatcttggaccgtcaaaatcttcatttactatattacattaatggtggtatatatttaataatcccatgtaacatctgtgcaagtgcacttgcttattaatatagaacataaccagaaagctgcaacaattctgatgcacccttgtttgttatataatcatcatcacaaatatttttagtctattcttagttcagttatttttgttttatcataagcatcattttcatcaacagctgttatattttctactctgttcagtggagatagtgaaactgttgcttttttttggacgtttgcgaaactgttttaaatgtaaaataatcaagcacgagagagattatccctccttaattttcttgattaaacttaagctaatcgacaaagaaaaataaaataaacctttaagacgatattccttattttagcacataatttatctaagttataatttcaaaacaaaattcaaattacagtatttagtctctacgaaaattaaaactaggaaaattaagaaagttacaataagtttttttccaagtataaatatattttatgagagatgaggtttattcttttatcaaaaaaaaaatgagaggatgagaattatttatgtaatttatagttttttttttgttatacgagcttaccgtatatgtatttacaaaaggattgtaaaacacaatcgttttttaatttactaatatcagctagttaacatattgttaattactattatttgtttgtttaagttatataaatttttatttaccaaattaactcatttatttatgatgtttgtcgtgtatactatatatatacacattcatgctatcttccttcgtctcgtggtatagttacttacatgagcatcaacttcacttatagctaacttttttcttctctttctttctctctggctcgtcgcttttagaaaacgttaattcaatatg

SEQ ID NO: 7348 - DNA, 3000 bp, Unknown
  misc_feature (1)..( 3000): cDNA_ID_1817405_gDNA_ID_1621141_Annot_ID_56638 3000 nt of promoter + ATG
gctgtgaatcaggagaggattttaactcctctcactgcaacaaaaagctcataggagccaagtacttcatcaatgcttttcttgcgacacacgaaagcttcaactccagtgagtcacttgacttcatttctccgagaggctacaatggtcatggaacacacgtggcaaccatagcgggcggttcatacgtgcctaatacaagctacaagggcttagctggagggactgtgagaggtggggcaccacgtgctcgcatagcagtgtacaagacttgttggtatcttgatttagacatagcggcttgctcatccgctgacatcttgaaagcaatggacgaggcaatccatgatggtgttgatgttctctctctttctctaggctttgaacctctgtatccagaaaccgatgttcgagatgggatagctactggtgcattccatgcagtcttaaagggtattacagttgtttgtgccgctggtaatgcgggtcctgcggctcagactgttggtaacacggctccttggattttgacagtggctgcaactactttagaccggtcctttgttacacctatgacacttgggaacaataaagtgatattggtaacaacaagatatatacaccataatgttttcacaacataatgtttaatgatctgtgtcttattgtgagtttggtaactgtattacagggtcaagcaatatacacaggtacagaagttggctttactagcttggtttatccagagaatccagggaacagcaatgaaagtttttctgggtaatatcgaatcttgaactataagaagaagattgatacactatattcacccttgttcttgtaatgcagtacatgtgagcgtcttctcatcaactctaaccgtacaatggcagggaaagtcgtgttatgtttcacagaatcaccttacagtatttctgtaacaagggctgcacattatgtgaagagagcgggtggtctcggtgttatcatcgcaggacaaccaggaaacgttctcagaccatgtctagatgatttcccttgtgttgctgttgactacgagctagggacctatatacttttttacatacgttccaatgggtatgaaaacatagactaacatcttcaccacttagacaagtaagaaaataagaaacatgttgttttatggtagatcacctgttgtgaagatacaaccttctaggacacttattggacaaccagttggtacaaaggtagcaagtttttcatcaagagggcctaatccaatttcagcagcgatcctcaaagttagtcaaaatctttacatgttctgttttgatcagactcaagaaattatcttgccttagaagttatcaatcatatgaatgcagccggatatagcagcaccgggagtgagcatattagcggctacaaccactaatacaactttcaacgaccgagggttcattttcttgtcagggacatcaatggcgactcctactatttcaggaattgttgcacttctcaaagctctgcatcctgattggtctcctgctgccattagatcagctattgtcactacaggtgcttatcttcttcattcaatatagattagacaaatcaagaacatactgatcttgataatcgtttttactctgtgtagcttggagaacagatccatttggagagcagatatttgcagaagggtcacctaggaagccagctgatccattcgactatggtggaggccttgtgaatccagagaaagctacaaaaccaggtcttgtatatgacttgggactcgaagactatgttctctacatgtgttctgttggttacaacgagacttcaatctctcagcttgtcggtaaaggaactgtctgttcgtatcccaaaccatctgttcttgatttcaacttgccttctatcacaattccaaatctcaaagaagaagtcactcttcccagaaccctcactaacgttggaccacttgagtcggtctatagagtagcggtggagccaccgttgggcacccaagtgaccgtgacgccggaaacgctagtgttcaactcaacgaccaaaagggtctcttttaaagtcagtgtctcgaccacacacaaaatcaacacaggttactactttggaagcttgacttggagtgactctctgcataatgtcaccattcctctctctgtgagaactcaacttctgccctactactacgatgagaattgaacaaacaaataaacaaacactaaccatttgtgacttatgatgagtttgtactgatgaaagcatatacattgataaacccaatcataaacaaatacaaaagtatgtgatgatgatgattgagtgaaaagtagctagctcgtaaataatcacatctttccgaaaaggaatatcaatatttttccatgtatcaacaataaagaaattagtttagtgttcataatctgaccatttctaatccagacaggttcacttctctaagatacttctttagtcttcttatttcataacacaacttttaatctctggtagagaactattcagagtagcttgatatttaccatccaatattaattagtagaagaactattcagagttaatatttaaaattcgagattaagagtaatttagccaagaaaatattctagtgttcttaacctaattagttttattctcagtagagaattattcaaagtttcttaatatttttaaattcaatatttgaattacttttaacttagatacaactctagtgttgttatgttgatcacttctaatctcattagagaactattcacagctgcttaatattgaaaatccaatgtttaaaataatatagattttcaatttgaactatgtcaaggatgaaacattgaatctcaaaaacaaagcaaccgacatggttgtagaaagagtcctcgaacgttagaccttatataaagcctttgcttcattgacaatcttaaacatcgaaacatttatctctttcttctttcaaacgagaaaatg

SEQ ID NO: 7349 - DNA, 3000 bp, Unknown
  misc_feature (1)..( 3000): cDNA_ID_1817401_gDNA_ID_1621141_Annot_ID_56639 3000 nt of promoter + ATG
cttggcatgtacaaatttctataatgtttggtagaaatgagtttttaataataagaatagagtttgttaattcgtaccaaaaagatatataatctaaagtttcatttcaaagattatacttttaaaaaatatttattttgtgaccaaaacgacttgtgataccacgtcattgccacgttctcagtcgagtcagcacaataaaccgtcgttgactatttccgtcaatattagctttgatttagccatttttagtgaagttcatgcatgttatttgaatattttagtttttcaggttgtaataaccattgtgactttgttagttatatgaaaagtacagtacgatgaaaaatttcagtgtgaaataaacctttttccgacaaaactataccactagacatctcttttcaaaactaaactgtttttacacaaatggtccgtttaagtccacggtctttggacccaccaaaacaaccttatttataattggattggccataatcttagagggtcacaagtcgcaatcattgggatggagagagttgtgtttataaagagttaaatgaatgtttaagatttgccaaatatggtaacgtaagcttgggaccaaagtgggaagctgggaacatagttgtgtggatgattggttcggcttatcgttggatgagttcgtatccggagtaacattgcatgacctcatgaaaattggagcattaaccttttgcacaagcctttttttcagttacttgggaaacaagaattagcaagaaattttcatttttcttgtctcatctaggttataatttttcatgttcgaatatatttcatttttcgtgggaagtaggaattataattaaaaacagtgtagtttacaaaaaggcgacgataatcaatagcagtgatggcgttagagagattcggtattgcctagtgtttattcatcatatatactaaattttctataacattaattaataaatttagttttcttataatttttatcctaaaccgaacaaaaaaccaaaataaaatttgtatctatttggtataaaaaacggaagaataatatataaaaaaagaaacctaaccgtttaaatcgataactgaatttccatgtctaaactaaatctatctttgcataattatattttaattctttttgcataattccaagttggttccaacaacgaaaatacacaaatctctagtatagttggtgtttacaagttatgtccttttaattatttttaactgttattttttcttattgatggtagaaaaacaaaatagtaactgttatatgattctgatgattttagagaagctgatgtgatttattgtaaaatattttccaattccatctaaaatcatgagatttggatttctgtatttttaactaaagaagtcttatcaaatcttctcaaatcctttaaaattaataagaataaaatccacaaactatttttaataacaatgaagtttaaggtagatttttaaattttaataacattggattttattagagtttttaaaatccatgataaaatttaaatacccttaaaatacacaaatcacttaaaatactagattgaatatatacccttctaggattacaaaataataaacttttccaaaaaaaaaaaaggaaaacgttgtaagaaaaaagaggaaaaaaagttggaatttagattccttgtatgatacggcaaagtttgttctctatataaacaaacttatttgcttcttttcttcattacaaaaatacacaaagctttttcgagttcataaggatatctcttttcaagtcgagtttgattatagaatcatgaattcattgttcactatgtttgattccttttgtgcagagattatgaggaacaaatttacatctaagtcaccttctcatggatcatctgcttcttcctctggtgttcaagccgtgtcgattgagaagacaccaaagaaggtcctggtggagaaagtactgaggtttgcgccggagtttgacgggcttcattgcttcgaaaccatagttccttcttgattattccactacgattttcctttttttttttttttttgatagattttgtcatgaaatagttacgaaagtgttgcttaaatacaaacatgaataattatatggattggattatgtcacaagtttctttatttgctcctagtcttcgttgtttttttaaaatttcatattggtgatgatgttcttccgaattataattttattctctttttatgcaacaatgaacaatcgattcacggtcatctaaatgcgaaactagtttaaccaaactttgcaagagattataattttttttacagctgactagggtttaggcatttaaacctaacttaatttggtttaaccaaaccaaatcaaacctaagtttggccaattcagtttagatttggtttagttggtgaccttattggcaataggaatcatgaaattcagtaaccaattcggctcggaaaccaccaaaccgaaaattccaaatatttttttaacaaatatagccaaaataccaaaaattgtcgaaattttgtcctaaacgaaatccaaatttaatcacaatcttttacacgagattcttttgtagtttctaattccttcggagctaaggaatgacgaatgagcatgaaacatacttaggtttgctctgatgatgtgttcaatacattgcaataaactagattttagttgacttagaacaggatgtttgatatattctttacacattgtttattggattaaagtaaaactctgtgactctgactatatgacgaaagataacaaattcaaacaagaaaaacttagaacaattccaagaaatagaaacattttggtcaaaaaactcatctaaaggccacatcgatataaatgtttaaggttccccattattagtccccaaatacattctcttgtaatgagaaatcatagaacatcaatctttgtggtactaagtttggttataattctcaatg

SEQ ID NO: 7350 - DNA, 3000 bp, Unknown; identical to SEQ ID NO: 7342
  misc_feature (1)..( 3000): cDNA_ID_1817398_gDNA_ID_1621141_Annot_ID_56640 3000 nt of promoter + ATG

SEQ ID NO: 7351 - DNA, 3000 bp, Unknown; identical to SEQ ID NO: 7341
  misc_feature (1)..( 3000): cDNA_ID_1843167_gDNA_ID_1621141_Annot_ID_56642 3000 nt of promoter + ATG

SEQ ID NO: 7352 - DNA, 248 bp, Unknown
  misc_feature (1)..( 248): cDNA_ID_2918439_gDNA_ID_1621142_Annot_ID_56644 3000 nt of promoter + ATG
gaattcctcagaggcaatgatcaggttgtcattatatccgtaccctcttttcattagtgagtcgagtagaatgattaaggatttgaaacttggttgctagatttgttagaagcctgtttcatcaccttcatggaggtgtattttagcctacttctatgtgatattgctttgaacattcgatgcttcttcttcatacacttatcttgttacatttccatttgttatagttccaacaattacgctccatg

SEQ ID NO: 7353 - DNA, 3000 bp, Unknown
  misc_feature (1)..( 3000): cDNA_ID_1444414_gDNA_ID_1621142_Annot_ID_56645 3000 nt of promoter + ATG
gatatacactctgcgagtgttgtcttcttggactcaatcctgcaactctcaggcgtcttttcttcttttatctcccaaaccggtacagtctcatttgtttctgttgaagcctcttccttcttgtcggcatctttgcttgatgttatggtgacactctctgtagactcttcatgagaatgattaacggtttccgaaacttccacggttcctcctgctgaagtgtcttcaagaaagagacatactacagcacaatcatcattcttggaagtaggatacttaagcctccatgctcgaaccgccgtgtcgactacagcacgagctgcagtatctcgactaggagctgaagccacaatatcaacagcttctttgttcgacaaaacatcccatacctagcattagagacactttagctccaaagatttcgatagtaaccagtgagaagaataagaagagtaatgtgtaccccgtcagtagctagaataatatactgatctctttcagtgagtctatggtagttgatatccgggacagagattagaccataatctttaaggcagaagtccccaaaagctcgagccattgctaaaccaggtgaatcgctgttcggtaaccacacacgcgcaacctcaggctcgtcttgtaaggcaaacactctacctttacatctatggattcttgctgattcacctaaagcaagtacatagagaagaaaatcagattatgtttccaaagatgatcaatagtgacaacataaagaagagactagatatacttggcaaatcaggttttaagtctatggtcaattgtacagccaccaaagcattgtcttggtctcttgtggctagaacggctctcgagtcaccaatatttcccaccaccagatccttaccctataaaggaatatataccaaacagtcattgaacagagccaatgatagagtaaataaccggtgatcggactttcacctgtttgattacagtgacagaagttgttccgctgcagaaacaattgatggttggatgcatttttaactccttatccatctgttgacaagtcttgagcaaagcccttttaagagggagatacatctcggggaatagcttttcgtccttctcacatagctgtaactcacaccattgctcttcatctacacaagtaggcgcagagttgaggccattcttggagctgctttgttctgttcctgaggtcgttttcagttgagttgataatgtgaaaggtaacatatctcggactctctttgaaaccatatgaccaaatggaccatgtccatcaaatacaccacataacactgtatcgcttctcgaacagaaattctgtaacaagttaaacaagaagaagatataaaaaagctaaaatacatcacaagaagaacatcaatagcaacaagaagagcattgtaactgtagcagcaacagcataacaaaaaggcttctaaacatcaaacaatccaacatttcatcacagtgaactaaaaccctaataaaaaaaaagtgaaacacgaacctcccagacaagcatggcgtcttggttagttccttttttgccttgttgtgtgtaaagacaagcaatttcactagaaccattgccaacaagccgacccacgacttgttgaatctcactgatttcgccgccgctgtataagtctctaggcctccgcagcctcccggagctctgtctctctacagtagtagtggcggtgcttgtagctccggtttccttcctcgtggtcttatcaattttcgaatgacacaaacccatttgcaaatccccaatctttcaaaacaagttaaagcctttttcttaaaatcgatagttagaaatagaatctaccagagacctgtttttttgtctggggtttggtcggcaataaattcccgtttaaagactcacagcttccatttcaacatcaacaagaaaaaagactaagatagagagaagcaaaaatcacatctttacaaaacattagtgagtagagacaatcaagaatctcgtaaactgtttaggattctctgtttgagaagagacaaaacttgaacacagaccagagcacaaaagtgtttactaactccactcccgttaagactgactattcaaaaaagtacttatttttagtcaaaaagaattagagaaagagagagagatattggaaagaggtcgcagcttggtactgcacgtgagccactttatcactctttaaatgttttctgccccttcaaattttaaaaatctgattttactgaaacatttagtattagcaagaattgttcacgtaattgacatagaacctgaaacgtgtctcttgcctctggtcggatgtttcaatcaaatgacaatcactgtatatatgttttatagtgattagtctaagactccaaatttatcaggttctatgtctaacattgcatgtaaaaaatcaatatttccgaagtccaaactcttcctaagaatatgcatcaagtgtatataattgttacatacgttgtttcttgtgaaaaaaaaaaaaatacactagattctcctcctatcaaaacctaatgtctaagagaagtaaaagtctatagtgtgtgatcaattactttacaaagcaaactaaattatggttattgccaatttaaaatagttcaaatttcccaaactccatcaaaacttgggcttttctcggattaagttggttgaaccgttaagcggccctctaaactttggacaagggattgtagtggatttttgaaaaaaagaatcccggttaacgaccttaacaaatgaaatgatcgatcggttgttgacccagcttttgagccaccgccttaaccaaacaaagctgttaagatcgaaccagtcaattctcagctctgagcggtacggttaattcatttcttatctatcacacaaagttgaatcgtaaccctaagcgaattcaacaatcgagagagcgagagagatcaattaaccccagcgaatcgaatatgccgaagaagatg

SEQ ID NO: 7354 - DNA, 3000 bp, Unknown
  misc_feature (1)..( 3000): cDNA_ID_1817494_gDNA_ID_1621142_Annot_ID_56646 3000 nt of promoter + ATG
tacccctgaagagcaagaatcaattgaacgggtacctacacttacattcctcaccaccattatctcaacatgtaatgccatttctcatcccttctaacacttgcgttaaacctttctgatcagcttgaggcaatggggtttgatagagcaatagtcatagaagccttcctttcctgtgaccgtaacgaggaattggctgcaaactatctactagagcactcagcagattttgaagactgagttccgagccttttaacctgaacaaagcacaagattttgttttgtttctccaccccttttatctgaactgttactatgctcagagaatcaaatgattatatcttacacctccatatttaccttgaagaataatctgcgttttccacactgtaaacacaattcattgtgtttctctctactgaaatgattattaacaatatgatatggttttaaataaattgtggtcatactcgcatgttgtgtgattgtgattattccagctcacaggtatccttattaaatcgatattgtctggctatatcatagtgtttatacacaaagcacaagaaacaataagcaatgttacacagtatctctcactaaacatattttctgggaaacaaaagattttcatcatgctctctgccatgcatctccttcttcatcacaccttccattgttctgactccaggttgcatttcactcattagcagcagcagccgcagcctgttttaacaataatccatccctattaatcaacacctctgcctactacttccagagacctttaggtgtgttaactgcaaacttatttgctacaaacgcaagatggattatcacttacctggttaagaggattatctggtgatttcttccacatcttccatatcaagtccttgtactgtgtgtgagttagacctggtttctcagacttgagccttggaagttccacttcttcatatgcctaaatcacaatcatagaaacaactcagtatatagatccaccagaatttggctttgcgtatcatgatcaatctatcaaacaattatcatttcaacaacagaactctcctaatatataacttcaaaaattcatacaagaacaatccggattgtctgctaatatgatccactacaaggagcaactactaatttcctctataatgacggaatctgaacatcaaacacaagtgctatgaatcaagaagcattatagcaaaaggcacacgaggtataccttaaaagaagccttgagcctcttctccgggtgtcgatcaacgggcaggttatctgacacagtaatccgtgcaagagcctcgtcaacggtatgtgcctcgatgagagaatcatcgcgattggtattggtcaccagaaccatcttttcatactcatcttcccctgccatgcgagtctgtttcttcttagagtcttctgctttcttagccagagccacttgatcttcctcgcgtcttcggatgagctcagcctctgtgaccttaggaaccggcacagtgacgcgattcgccttcttgtctggctttttcaaagccttctccaactctttctcctcctgctcagccagacgcttcgcctccaatttcttagcggcggtctctgccttcttctccgcttcctcttctcgcttcttcaccgctttggatttgggaccttccgcctcgcgccagtattgttcctctttctcccgagtctgacgatccttctgctcagcctccgcggcgttcttacgagatttggcgacctccgccttgctgttcagacccatcttcttcggcatattcgattcgctggggttaattgatctctctcgctctctcgattgttgaattcgcttagggttacgattcaactttgtgtgatagataagaaatgaattaaccgtaccgctcagagctgagaattgactggttcgatcttaacagctttgtttggttaaggcggtggctcaaaagctgggtcaacaaccgatcgatcatttcatttgttaaggtcgttaaccgggattctttttttcaaaaatccactacaatcccttgtccaaagtttagagggccgcttaacggttcaaccaacttaatccgagaaaagcccaagttttgatggagtttgggaaatttgaactattttaaattggcaataaccataatttagtttgctttgtaaagtaattgatcacacactatagacttttacttctcttagacattaggttttgataggaggagaatctagtgtatttttttttttttcacaagaaacaacgtatgtaacaattatatacacttgatgcatattcttaggaagagtttggacttcggaaatattgattttttacatgcaatgttagacatagaacctgataaatttggagtcttagactaatcactataaaacatatatacagtgattgtcatttgattgaaacatccgaccagaggcaagagacacgtttcaggttctatgtcaattacgtgaacaattcttgctaatactaaatgtttcagtaaaatcagatttttaaaatttgaaggggcagaaaacatttaaagagtgataaagtggctcacgtgcagtaccaagctgcgacctctttccaatatctctctctctttctctaattctttttgactaaaaataagtacttttttgaatagtcagtcttaacgggagtggagttagtaaacacttttgtgctctggtctgtgttcaagttttgtctcttctcaaacagagaatcctaaacagtttacgagattcttgattgtctctactcactaatgttttgtaaagatgtgatttttgcttctctctatcttagtcttttttcttgttgatgttgaaatggaagctgtgagtctttaaacgggaatttattgccgaccaaaccccagacaaaaaaacaggtctctggtagattctatttctaactatcgattttaagaaaaaggctttaacttgttttgaaagattggggatttgcaa

SEQ ID NO: 7355 - DNA, 3000 bp, Unknown
  misc_feature (1)..( 3000): cDNA_ID_3050355_gDNA_ID_1621142_Annot_ID_56647 3000 nt of promoter + ATG
cacggccggtaaccttcttgcagtaatcatatcataggatgacaaactgaactcattcacataaaagtggaagcctttacctggaagataaatgcattataggttgacttcttcggtaactacttccctttaaaacaactgttttcaccctcacggtttccagttagcctcaagtgtccagatgtctgtgcagtgagtattacagcaaaagcttccactttcacagtgggaccaaggtcttactcagagaaggaacacactgattccatgaatattattggaaaataatttaaagagtgtcagaaacccttattggaaaatacgcaaccataatcaactgcaaactaacacacagctaagtttatggctataattggagtttccatgcaagcatgaaaaaaaaaagatatgctaaatttcagtctatcttatttttgtacataagccaaacgacacttctgtaaaagaaatgatcatataacaacgtgaacttacttgtttgtaaaaagacaacagaagatatcaatgacaaccaagtgctttccatggttccttttaactacttttacatctcacgatgcaacaatcaaagaattgaacataccaattttatacatcaagaaagattctatcaccttggttaagggggagaagattcttccaaggatacacaaccaatgatcgacccaccggctggaatgcacattggtttggtctctctccaattcagaggtctatccaaagggttacataccctcacaacaggcaatctcacaatgtcaaatctccctgcccctgattcttcccatttaaggaccttacctcctataacatagagttcattccttagagctgcaaacccataaccgaaggcttctaactctctcggatgattaggaagaacaacagaaggaactgaaccaacattgtaccattccccttcatctgtatccctagtcttgatcaagctttctccccaatctacaatagtatacacccgatcatttttcatcacctgaacagcaaactgcatggctctagagaaaggccagacatcctccacagtggaccaagtcatgtctcgtggattaaaaacttcagatgaattttgctctgcaaatcccacctggtcacttaaaacatgaaagcagcctctgtacgataaccccgagcagtccatctgtggtctaggcattgctggtaattcctcccacctgcaatactactatgtcatactccagtttgatagcttttcaggtgaaacatgagaaaacttttaaaactatatcttgacccatcatagaaaaaaacaaaaagagtacattgtggggttaaatatgccagttctatcctacacgagaatataaaccacattagtgtgggaaaaaatacctatcagcgacaggatcataaacctcagcagatgggattcccctggaatgagttaaattacgacctccagcaacataaaccttgccagagacagaagtacaagcaaagtgagtccgtggtgttcgcatactagcaaccattttccattgtttcttaaacggatcaaaccgcatgacatctttagtgacaacaggcttctgatgaggaaacgatgacaccgaaggcgcataacaacccccaatcacaagaagacaattggaaacacaaacacacgcaaaaccagaatgatgccaaccatcttgaacagctctagttctaggcaatggatgccatcgatcagcttcaggatcataagcaacccactgattcttagaacgttccgtcaacacaaacaaccagctccctgaccatccatttctagctttatagcacgagtaatcagcaccacgaactaaatctctccagcctctggaaacacattcgagcactccatgatacccatgagaaagcttcgctatgcatctcaaagccaaatcatcaggcaaacctgggattatagactgctcgattgattccctgaaaacaagtttcagccactaacgatcagacttattcaatcaataatcaacattcaatgttttaagacaaaacatgattttgaagagaaaaggtaaaggattgagatttagattcaactttgtgaaggaagaacaagagagctaacacttacatgaaccgaatcgtactcgagagattgtaaatgtatcttctgatccccttctcgaacttgctttagaacaccaaaatcgcgcttcaaagtttatcactttcccggaaacaaaaacaccattaacgataatcgaaacggaaactgcaatcagaacgatatagttatgatggaactaagcacagtcagagagaaactcaggattctggcaaggaagagaggagacggaagaaacaggcatgagatggatagatccattataatgggtcgaaaatttaaatattctttattgatcccttcatttatatgttctttctgcttcttaacgcatactttcttaaataactaatttaacccataacttttccaagataacaagttaaaaccgcgtcgttttatttcagcttcgtctttatctcatctttcttgcgacgggccctgctacccggtgcgtgacaggttgaatcattctcctccgattcacggtgattccggcgactacagactcaacatttaataagccgatctcttacatggtacgagctcggacaaattgaagaatacaaaggtccgagaaataatttggtaagcaattcgatcctttaaacgatgttatttttgtcaatccgagtcattgatgagggattatatctgttactgaatctctctgatcttcccctgataatggacttcatgatcctgtaaatttcagattttgagccttgtgcctcaaaattgtagtcaaaggccgcgtttttgtctcaatttgtagatctttgttgttgtttctgttggatcttacgtatatatccttgatcattttaaaatttcaatggaagtgatccaggctttgattagcttttaattatataggaataatg

SEQ ID NO: 7356 - DNA, 3000 bp, Unknown
  misc_feature (1)..( 3000): cDNA_ID_1817490_gDNA_ID_1621142_Annot_ID_56648 3000 nt of promoter + ATG
cgtacccttgcgccggctcatctctttccctgaactgtgtcagtaagcaaatgttaagattgataatagaaaaaaggaagaaaaagatacattcacatatcaaacattaaacttaaaaattatcaagtttacatagattttccttgactttcagcaagaagatactttagagtctgaactcgggttgccaaaatggtgatctttcttctcatcgatgaagcatgacgtagagcataagatgatgtttcggccagtgaacttctttctaatatcattccatcaatctcctctgagagttttaaagtctcattctgttctctgatccatgaatcacacaaagaagccattgactttgattaatcctacataatcaaaaatccaatacagatcactttcagacaacttttaactttaccaaggatgtatataaatgcaacaataagaacaacaaaaatccaactagcttacaagaagcaacaacttcgataatggtattggcacatgtattaaaggaagatcggagcaattcagcaacatatatatctctaaaagagaatcaaattgctcaccaaggacctttaaataatacatcattgtcattgagaaagagatcaacttgctgagtgctgactttgtagccacgcagccagacggcagtttccttcgaaagaagacatcttctaaatacgagaccattacttatatgatcgtagaaaggtaggcctacgttgacaattcttggcgaaataaaaaaaggaacatgcattacactatctcttgttttgcctcttacaaatgtagagattaagaaacagtacacatgtataaaatgaaggatcagatacgtattttgcgaattttgtttccagtgatgatgatatgaatattggtgttttacaaaatttccacaatgttcttcttataacaaactcagacaagtttcttcgtggaagattctacagataatttttgtttttttgtctctgtgtttgacttgctaccacttcttaaatctttatgaagacagcaaagagcaaactgtgataactgcacacattatatattacttaaagggttttggtaacagaagagaaatgaaaagctcagccacaaatgtggaatgaggaaatacattgcaaccattcacatagagagtagaggccagtggacctacagaggaacttataagttgtctgatgttggtattacatatacttaaccaacatccatattacaacagcaagaccgacgatccccagcactgacaagagcattgacatgcaagagcaaccacttctcatattcttgttcatgacagcaaggctcttctgcactctctgtaataagataacagatcaatgtctttaattagccattagcttaagcataatgtggttcttggttgagcaaaccgaaaacagatcaccattacatcagtgttactcctaatgaaagtatggatcaactaaagcttgggattcaccaaagtaattagtttgttgaaatatttaagagttgaagcatatattacccttaagcgagagtcagtaacatccacatggtaatctaagtcatcctgcataaaggaaaatccaaatgtgttagtatccgaaaattcaaatcaaaggcgaaaaaatgaaaagctagtgacatacaataagcctagtctgcaagtcaagctcttcactaacagccagagcaatgtgttttgtgctcatgactgttccctccaattgctcaagtccttcgtcttgttctactcacaggaaaataaaacattcaataggaaaaaacaaatacagaaatcaacatctgtattacgtttactaggataagagaggttttacctctcataacttgtcgttgatatccaacaattccttggttatccatgccagtaactctgctcatggaatcatccggcttgatatctggcccgagcaagctgtctctattggcaaagtttgacatgttcaaagcattcgccatctggtttgcttttgacctcagattccctaccatatcctttcgccgattcatctctttctctgaactgtgtcagtaagtaataattcagattaacactaaccttaaaggtgtctaatttacagatttaagcaattaggattggactagtaaatggcttacataggttttccatgaatttcagcaagaagagactgcagactatctaatttgttaccgaaaatggtgatcttccttcgtatagctgaagcacgacgctgagcatcaggccctgtgacagccgatgaacttctttctgatatcattccattaatctcctcagagagttttaaagcctcgttgtatgctctcatccatgaatccgatgaagacgccattattcctatataattaaaagctaatcaaagcctggatcacttccattgaaattttaaaatgatcaaggatatatacgtaagatccaacagaaacaacaacaaagatctacaaattgagacaaaaacgcggcctttgactacaattttgaggcacaaggctcaaaatctgaaatttacaggatcatgaagtccattatcaggggaagatcagagagattcagtaacagatataatccctcatcaatgactcggattgacaaaaataacatcgtttaaaggatcgaattgcttaccaaattatttctcggacctttgtattcttcaatttgtccgagctcgtaccatgtaagagatcggcttattaaatgttgagtctgtagtcgccggaatcaccgtgaatcggaggagaatgattcaacctgtcacgcaccgggtagcagggcccgtcgcaagaaagatgagataaagacgaagctgaaataaaacgacgcggttttaacttgttatcttggaaaagttatgggttaaattagttatttaagaaagtatgcgttaagaagcagaaagaacatataaatgaagggatcaataaagaatatttaaattttcgacccattataatggatctatccatctc

SEQ ID NO: 7357 - DNA, 3000 bp, Unknown
  misc_feature (1)..( 3000): cDNA_ID_1817486_gDNA_ID_1621142_Annot_ID_56649 3000 nt of promoter + ATG
ggggaacagcttgctgaaactgaaatgcaccattgtgtgggatagattgaggatactgagcaaaggaggttggtggagcagactcagaatactgcatagaggattgttgaaaatctatccctgttaactgcgaagggccaacaccattgattccctcggtgttcctgacatccagctcagctaaattgtttgcagaagagctgtccagtccattaagggttgagttgcttcttgatccaaggtccatgtcatttacagctacaacatactggaactcagagtcaacatcacttttgttaacccccaaaagagcaccatccaaatcactcacagagaacagaaacattctaagcttttgcgaacccccacggttttccatctcattatactcctccatcatattcagtagatcttcgtcacatgatacagacaccaaggcatcaagatcttcaccaggaagttgatacttgacaacatgagtccgatagtagatttcaagaactttttgcctgagctcctgccaagaaatgtcctttcttatggaaataatgtgtgtttcacctccaacatatctaagctttgaatcacctggacgtggaagtattttcccaccaaagctacaaaggactttaacctttgctgttaaactacctgaggctgaagaagatgcatatccatggaaatttcctaaacttctatcttgacataatgaagcttctggtgctgaatggatatgcccgagtttatttccaaactcgtgaaccggggggtttgttctctcatactgcctgatgccatttcccaccatgctcatcctggaaacatctgaaccaaattcagaccctgcgtgcccgttataacctgtgggataattgatatctccagctgcaatgggatttgcagacctttgagaaatgacacgatcacgcagaaactcaagagaaaattcctctcctgtttgtatggagtaatgaagccccggcttaacatctgcaggattaggtcggacatttgcattcgagagacccgtttgatcaggcgtaaatccttgtgggacagagtcattcacatatccaggttccatagcatgttgctggaacggatgtggtggtctgtttctatccatcacaacaacaacaacaacaacaacaacaacagtccttcaaattattctaactgacaagacctgtaacaagaatctgacatactgaactataaagaatcactgctaaaactttaaagatgccaaattgcttcagagattgtaggctacaaatttcccctcccaaatatttaagctgcaaaaaaaaacaattgggagaaataattaagttttggcagaagttgaatcctccagaaactatcaattaaacacagactactcatcaaagttcttcccatttgcaattgtagatgaataatccgaccagaaaactccaaaaacatgctttttgttccaaaaatggaaactttctctacaacaaccttaaatcaattaatccaaaaacctcaatagaagtaatttaagaaaaacaaaaccttcgctcgatttgaaagatttcaccataccaaatcgctaaaattagcttcagacaccaaaaaaataaagaatcagaaaatggcaaagaatccaaaactgatagaacaataccacaaagaaaaaatgtagagcttgacaggtggaatagattcaagaaggattgtgagagctagtaacaatcaaaaactatcttcttctctttgttcaaatctaagaatatgcatcaaaaccctaactttttatttttatctttatttttgttgattttctctcaccttctctaggtttcctcgttgcttactcaaaaaatggtaaaatctgcttaaagaaatgataaaaatgaccaaattgcttctttttttttgtattgtaatggaaagaaaaatacaaaatggttcgtgtccgtgcgactcggttgctttataaccagaagaaacgagaaccgtacatctatcgatgttgatgaaaaatagacggcggagatgaaagaagaataagattttgggggtgaaggagtaagtgagaagcatggaatcaacaagtctctctccgtagcttatgttatacggtttgcattaaatgggactctcaatatcatcagatcctaaatgaaatttaatggaaattagaagaacgtgcgtatggatactttcaatctcattttcgttataaagtttctctctttatatttccttacgtaatgttttttttttcccccacacgaattgtcattttctgaattccattaatctgattccatttcaatttgcattgaattcagtttcggaaatttcatttcaatatgctgtgggatttttggccgctacaagtaaatgttttttttttttttttgtcgaccgctacaagtaaatgtaaccatcccaatgtttattttggttcgatatcgaattttaggcccatttttaaattaaaggataaaaggaccatgactaattttgggcccattttgaaattaaaggaccatgactatgggctcctttgtttcattaattgtcacccaaatagtgatctatattttaatgaaaaaaatctcaagtaccggcatatccattttaaaacgttctgcttaatgaaaaacttcgtctcacagtaaaaactaaaaactcttgtgtttcgtttgaagaggctcaacatgaatatctttggcatttttcgttttgttttgataaagaatatcttaaaacatttaattacaaacattatcctcttttttcgtggtttctgctgtatctacggagcccactactgaaatatgttatggcctcaattcatatgggtcaaggtcttcgttgatgtatcatgcaaaattaatataaaagtgaaaaggttgactcttgacttatctgtgttagagaaagagagagagagagagaggtgtgcctgagcctgaacagaacttctggctcctgaaagaaagagagagagagagagagcaaatg

SEQ ID NO: 7358 - DNA, 3000 bp, Unknown
  misc_feature (1)..( 3000): cDNA_ID_1817482_gDNA_ID_1621142_Annot_ID_56650 3000 nt of promoter + ATG
caacaatccagagcttagagttccacctgcattgtaagttgatcttttcactttcaatctaaaaaggcttatgcagaaacattatataacttacttaaaatggctggccaagttttctcacatctatatgatccgagaacattcacacactttctctttccacatttatttagatgtggatctctgcattcatcaatgtctacggacacaaaaattccaaacttcacataaggttatatagtacactcaagccctctattcaaagaagttaataggtaccttggcatccgccaggtatgtagggatttccttcgtaaccattgtgacacgaacattgatagctatcttcgaaaaatgtattgcctttgcatagtacacgctttgaagtcatgtaggaaagatcaagacgccattctagctctattgttgtatattcactgtactccattaattcgggaggagtaaacaaggaccctgacaatgtgaattgagtcaagaaggcaacctgacatccttgtttatttggttccagtttctctacggttgcatcaaacacttgaagttgaagaagaggtggtatagtcatctggcagcatttgtaaccaacacaactcgtgttagctcctttgtaagaccgtatctcatttccacatgtcgtctcacatcccacgatttgtaaccctgtgacattcatgaacgccttgttgttgcatccaacagctgtgaacttattgttttctgatatgaagaatgggctgcccttcaaattcaaagacgatgatgaataaccatctctgttgggacaacctgaatgtttcaatggactctggatgtagaatttgttgtacaccgatatggagaaagggtctccaaggttgaaggaagtaactgctcgtcggatccttggcaacaaaagtatcggttgttggtctgatgagcttttgcagacaatctcgaaccatttgttcttgtaacaacctttgcctatcccaaaagggtaaggaacactaacatttccgcaatggtcactgcaattacgaagtgcaagaggaaaagtagaagcagctgcgtattcacagattcgcaacagaagcataacaacaaggaaacgtttcacatcaacacccatttgctctctctctctctctctttctttcaggagccagaagttctgttcaggctcaggcacacctctctctctctctctctttctctaacacagataagtcaagagtcaaccttttcacttttatattaattttgcatgatacatcaacgaagaccttgacccatatgaattgaggccataacatatttcagtagtgggctccgtagatacagcagaaaccacgaaaaaagaggataatgtttgtaattaaatgttttaagatattctttatcaaaacaaaacgaaaaatgccaaagatattcatgttgagcctcttcaaacgaaacacaagagtttttagtttttactgtgagacgaagtttttcattaagcagaacgttttaaaatggatatgccggtacttgagatttttttcattaaaatatagatcactatttgggtgacaattaatgaaacaaaggagcccatagtcatggtcctttaatttcaaaatgggcccaaaattagtcatggtccttttatcctttaatttaaaaatgggcctaaaattcgatatcgaaccaaaataaacattgggatggttacatttacttgtagcggtcgacaaaaaaaaaaaaaaaacatttacttgtagcggccaaaaatcccacagcatattgaaatgaaatttccgaaactgaattcaatgcaaattgaaatggaatcagattaatggaattcagaaaatgacaattcgtgtgggggaaaaaaaaaacattacgtaaggaaatataaagagagaaactttataacgaaaatgagattgaaagtatccatacgcacgttcttctaatttccattaaatttcatttaggatctgatgatattgagagtcccatttaatgcaaaccgtataacataagctacggagagagacttgttgattccatgcttctcacttactccttcacccccaaaatcttattcttctttcatctccgccgtctatttttcatcaacatcgatagatgtacggttctcgtttcttctggttataaagcaaccgagtcgcacggacacgaaccattttgtatttttctttccattacaatacaaaaaaaaagaagcaatttggtcatttttatcatttctttaagcagattttaccattttttgagtaagcaacgaggaaacctagagaaggtgagagaaaatcaacaaaaataaagataaaaataaaaagttagggttttgatgcatattcttagatttgaacaaagagaagaagatagtttttgattgttactagctctcacaatccttcttgaatctattccacctgtcaagctctacattttttctttgtggtattgttctatcagttttggattctttgccattttctgattctttatttttttggtgtctgaagctaattttagcgatttggtatggtgaaatctttcaaatcgagcgaaggttttgtttttcttaaattacttctattgaggtttttggattaattgatttaaggttgttgtagagaaagtttccatttttggaacaaaaagcatgtttttggagttttctggtcggattattcatctacaattgcaaatgggaagaactttgatgagtagtctgtgtttaattgatagtttctggaggattcaacttctgccaaaacttaattatttctcccaattgtttttttttgcagcttaaatatttgggaggggaaatttgtagcctacaatctctgaagcaatttggcatctttaaagttttagcagtgattctttatagttcagtatgtcagattcttgttacaggtcttgtcagttagaataatttgaaggactgttgttgttgttgttgttgttgttgttgtg

SEQ ID NO: 7359 - DNA, 3000 bp, Unknown
  misc_feature (1)..( 3000): cDNA_ID_1817478_gDNA_ID_1621142_Annot_ID_56651 3000 nt of promoter + ATG
gaaatgtggatggatcctgcggtcagtgctgaatggattgatgttggagagactaaaggccagaaggttcacctctcaagggatcctgatggtcagccttatcttacacagaccgagatgagggtaatctataagaaatttcaaacattccaatacaagattgatgtggatttctagttagacctttctttctttctgcctctacttattgagatcaaccccttacattttcaggctgtttctgatataactgtccggaggcattttgattccatcttggattcggtatgcttcattagaaaactagtagttttgagcttggttttagctactgtttaggttattgaaattatctatgcccctttatgatcttgaagttttgcaccttcctattcctctgcaggaaatgatatgtgcaattgctgagcttgaaagtgaccgaaagcctctcattatgcggtacagcaaaaagaccaaagaaactggccttggaattttacaagttttcgaaaagacagcagcatggttggctgggtacaaaacgatttctagtttctctccttttcaagaagatcttaagtttataaaaaaatcttatgttccggttttggtcaatctttattgcaggggccaaggctatcaggcatataatgtagatgacaatcctgatcttcttcacaagccctttataaatgtgtactttggggcagcttacctgaaatggttaacagactatcagaataagtatgatatatattgtccctaagcttacattgctagctttacaatttcagtgacaacaagtctaagttcctcttggaattactttaaatatattttactttccatgtgcagccagagaagtgaagagtttgttgtcagagcatacaatggtgggacaaaaaaggcgactcacaagtcgacattgccatattggaaacgataccttgcagtgaaagaaagtctcccttcaaggttgttgcttcttatctctgcttgctctatgtacctagtttctgctgtcatattttatgcatggttgcacggataaggttttgtgttgccgtgggctttcatattgttaattttgttcatactactaataaggtagttgcaccaagaagttgagggaagcgaagctaaaacttcagtctctttggtaattgttgttgcagaaaacatggcgatgctggcccttcaagctttcgtcctacgaatcccgcttccccaggctcaagtaatctctccctctttttgtatcgttctgtatcatataacaatgtctccacgtgtataaacatgcacctatgtcaaacatataaagatctctaggagcatcgtgcagtgtggcaatgctttagctctatgctcatatttggagaacctctatcattctcttataagttctgatatgaactgaaatataccctccggttgaacagacaccgatttcacatactgggactctcgagcttcccccgaagatatggaagatatgtggaatcagtctgaaatatgtaaagagtggacaaaatctaaagaagaaaggggaaaggttcgtttttcacaagatggtgaaaagaggccttacctttctcgaggggaacttaaggtactgtgtgtcttttaattgagcttgcagtttgacagatatttcccgtagaacaataaccaaaattgttctcaccatgttgccttccaagtaatgctatattttctattttaggctgttgcagaaataattgtttcaaagtacttcagcacgaaaggaattagagttgtaagtgtgcatatccgctaattatcacctgctgaggaaacttatattgggcatcttttagggtttattcatttgctattctgataaaatatgttccatatcactggtgcagcctcttgtttgtgcgattgctgatactgtgtgcatgcggtttgtgaacggtattaagaaacatgtaggaatactcggagtggactactcaaccgcttcatggttatactcgtaagtttgtgaccaaacttcgtttctttatggtttgcattaaagccttaaccaaatattaaatccaaatggggctgttttttctgaataaagggagctaggataccgagcatacagagtcgattcagcagacgatctaaccaaaccatttatctctatgtactttggtgtagcctatttggtttggttatcggaatatgaaggaaggtacgcttccaactccaactctctacttaaaaatcctgatcttgcaaacatatcttactcaaaacatattcaaactatgtgatacgcagtcaaagaagtaatcaattcattgtccaagcatatatgaaaggtcctgaccacgtcgatcttgaggaatcatgtccactctggctcaagttcgagcaagctctgagttactatgaagagtccaagaggtatcattgttcataaccgcaactattttattctacactctgaaagaacacaaatctgatttatgattggttttgatggttcttttcctcatcagggattcaggaagctgcgttatcctatgagacaacgtttattaagacacatatgatgaagattaacggatttagctttggtttcgtgtgtttgttatcacaagatttcctttctggtttctgtttttgactttaaatatctttgtcattttatttgtacgatgaatgattaactgtgtagaaaatttaacaaatgacaaactggttctttcaaagagtaaaaacaatcttcaaatatgcaaaacattcaaatcttcgaaattagctcaataaataaaccgcgaaattaaatgggatggtaaaagcttaaccggcgattccgatattaagtttaggtttggataaaccgggtttgaactccccctatcatagtttacgcatatatctccagaacaatctaagaacggcggctaacgaacgtatttttccggcgatacttcgaaaccaatttcttcatttttttcttctgattcataaagaatg

SEQ ID NO: 7360 - DNA, 3000 bp, Unknown
  misc_feature (1)..( 3000): cDNA_ID_1817474_gDNA_ID_1621142_Annot_ID_56652 3000 nt of promoter + ATG
acatagttgagtctcgaaaattcagtaatatacagtgacatataacaagagggcacaaggatcaaatacctgtggtcgcgtggactgttgtcatcaagccttcaagaataccaaattcctcatgcaccacctgccagatacaagtgcttaagggccatagacaactttatttgactttaatgaagctcttcataatgagctatatacaggacaaaaatgcaatgctacaaaccttggcaagaggtgcaagacaattggtggtacaacttgcattggagactatatccatgttaggcaggtatgtcttttcatttactccaacaacaaacatgggcgcgtccgctgaaggtgcagaaatgatgaccttcttagcaccaccctgcacagacaatgaaaggtcaagaaaatcatagaccattttaggagttgaatgtttggaattattaataatataaggcttggtattaaatgttagcatcaatgaaactagtagatcaacaagcgtgttcaaatgaaagtgcataccttcaaatgtgatgaagcttgtccaacggtggtgaatacccctgaagactcaacaacatactcagctccaagatcagcccacgggatttcagctgggtctctgaggaagaacaattaagatgttagactctaaaaaaggataagcataaaaccctaccaataggatattagtggaaattgattcataatttgaccatactagacagatacacatgagtcaacattttgaggcaatacctcttgctgacaactttgacttgttttccattgatctccaaagttgaatcatcaattacattgatagttcctttgtaatttccatgagtagaatcatacttgaacatgtaagcctgcataagaggaggagagaagatttggtttaagtttgatatattatcccatgcctttaagtatgattaatattacgtgttcaagcacgtggatcagttactatgagtaaggaaaactaaatgggaaaagagtatgagcaacagttataagatattcctggcgaaaaatacattagaaactagtaagagcaaaaacggcattgtaagttgcatctactacttaccatgtacttggcatctatgaatggatcgttgactgctacaacctcgatatcatccctaaaggttgcgatgcggaggaccaatcttccaattcgaccaaaacctgtctcgcacatataaaatacagtcatcaataagaaatgaaaaggtagaggactagaagcaagtcagacggaataaactatctgatgatgttgaatttcaaaatgaatccagcaatggaaacaaaaaataccgttgatcccaacctttgtctttccactgctccttgaccctatacaagtcaatcaaatcgaagttactgtcagaatgcagcaacaaacacaagtaagaacatcaattaaatttgtcttcttactatgaacagcaggaggtgcttccgtagctgtggccttgatgggttgaaccctcttcgcattgtattttctgtacatttgaacattaaaacattgttgagaaccaaaagaaagcatcgtaaaagatttacatgtactacagagtttgtcacataactgtaaagttgaagattacccggttgaaactgcagcaccagaaaatctagacgaggtcaggctatgactgaatccaagacttgacgtgacctgatcatttgagacaaaacatataataaactcactgaaactttaatgctgcctatcatcgattcagatgctcatcagttaactcaggccaaacgactaggaattcaatatttcaactacatgtgaggactcaagtagagaagatagcgatactatagaaacaccaagttgactttacactgagaaattgaaaccagaaccaaagacaaaacatcacctcctactatctagtatctaccaaaactccaagcgagctaaaacatattaaatggaacacaaacgcaagagtgagaaacgaaaacgtttaatacctgagaatgattgtacgatgacgatggataaagctcgacacgaggagctgcggcggaagtggcggcagatctgaggagagaagataaggccattgctaagctaccagaaacagagagatctcgccgccaaaaatcctaaccccttccgctgaatggcttttgagtgtagctctggagccacgaaaatgttcgtttgagtaaaaaaatgagacaaatgcaaattgcaattgcaatttctcatgtaaaatatgcttacgattctgcaaagacgatgactgtgttctgatgcgtcgcggcccatcgtaactacttttgcgatgagatctaagggttgagatttcacggaggaaaactacaaagccgcgtgtaccggatcggcgtcaaggcccatgatttggtgggcctttggtcatatttgaataacgttgacgtatcttttgttgtttattgagttttgccacgcgaaaataaaatgggcctgatttagtttgacacgtgtcaagtccagctggctctccctctaaaaatggcttctgtactgttaaaacttaaacgacgacgaggctgagccagctccgatatgccaggtggcattttcttcgaaagaatcgtgctgtttctgcagttggctcgtctcacagtcccctctgtgtgattaatttgcttttttggctctcccgtcaaaaatggcgaaccgtcgaattctctgtatctcttgaatttcccagagattaatttgaatcttcatcatcttcttctctctggattcgccgagaaaccttcttcctctgcttctctcgtcgatattctcttccttcccgcttaagccttcggctaggtctgatatttcgattttcttctttacatttggcaaacatgttacttatggatgttgttaacgatgtgttctaaataagcttctgtttcctcttgtttttcgtttgtttctgatagatatcaatggaaaggtcgtatagcaatgcaagaatg

SEQ ID NO: 7361 - DNA, 3000 bp, Unknown
  misc_feature (1)..( 3000): cDNA_ID_1817470_gDNA_ID_1621142_Annot_ID_56653 3000 nt of promoter + ATG
taaggctttaatgcaaaccataaagaaacgaagtttggtcacaaacttacgagtataaccatgaagcggttgagtagtccactccgagtattcctacatgtttcttaataccgttcacaaaccgcatgcacacagtatcagcaatcgcacaaacaagaggctgcaccagtgatatggaacatattttatcagaatagcaaatgaataaaccctaaaagatgcccaatataagtttcctcagcaggtgataattagcggatatgcacacttacaactctaattcctttcgtgctgaagtactttgaaacaattatttctgcaacagcctaaaatagaaaatatagcattacttggaaggcaacatggtgagaacaattttggttattgttctacgggaaatatctgtcaaactgcaagctcaattaaaagacacacagtaccttaagttcccctcgagaaaggtaaggcctcttttcaccatcttgtgaaaaacgaacctttcccctttcttctttagattttgtccactctttacatatttcagactgattccacatatcttccatatcttcgggggaagctcgagagtcccagtatgtgaaatcggtgtctgttcaaccggagggtatatttcagttcatatcagaacttataagagaatgatagaggttctccaaatatgagcatagagctaaagcattgccacactgcacgatgctcctagagatctttatatgtttgacataggtgcatgtttatacacgtggagacattgttatatgatacagaacgatacaaaaagagggagagattacttgagcctggggaagcgggattcgtaggacgaaagcttgaagggccagcatcgccatgttttctgcaacaacaattaccaaagagactgaagttttagcttcgcttccctcaacttcttggtgcaactaccttattagtagtatgaacaaaattaacaatatgaaagcccacggcaacacaaaaccttatccgtgcaaccatgcataaaatatgacagcagaaactaggtacatagagcaagcagagataagaagcaacaaccttgaagggagactttctttcactgcaaggtatcgtttccaatatggcaatgtcgacttgtgagtcgccttttttgtcccaccattgtatgctctgacaacaaactcttcacttctctggctgcacatggaaagtaaaatatatttaaagtaattccaagaggaacttagacttgttgtcactgaaattgtaaagctagcaatgtaagcttagggacaatatatatcatacttattctgatagtctgttaaccatttcaggtaagctgccccaaagtacacatttataaagggcttgtgaagaagatcaggattgtcatctacattatatgcctgatagccttggcccctgcaataaagattgaccaaaaccggaacataagatttttttataaacttaagatcttcttgaaaaggagagaaactagaaatcgttttgtacccagccaaccatgctgctgtcttttcgaaaacttgtaaaattccaaggccagtttctttggtctttttgctgtaccgcataatgagaggctttcggtcactttcaagctcagcaattgcacatatcatttcctgcagaggaataggaaggtgcaaaacttcaagatcataaaggggcatagataatttcaataacctaaacagtagctaaaaccaagctcaaaactactagttttctaatgaagcataccgaatccaagatggaatcaaaatgcctccggacagttatatcagaaacagcctgaaaatgtaaggggttgatctcaataagtagaggcagaaagaaagaaaggtctaactagaaatccacatcaatcttgtattggaatgtttgaaatttcttatagattaccctcatctcggtctgtgtaagataaggctgaccatcaggatcccttgagaggtgaaccttctggcctttagtctctccaacatcaatccattcagcactgaccgcaggatccatccacatttcttctaaatcctctggctcaacacaatcattccagaacgtgaaactgttggccattcttgcattgctatacgacctttccattgatatctatcagaaacaaacgaaaaacaagaggaaacagaagcttatttagaacacatcgttaacaacatccataagtaacatgtttgccaaatgtaaagaagaaaatcgaaatatcagacctagccgaaggcttaagcgggaaggaagagaatatcgacgagagaagcagaggaagaaggtttctcggcgaatccagagagaagaagatgatgaagattcaaattaatctctgggaaattcaagagatacagagaattcgacggttcgccatttttgacgggagagccaaaaaagcaaattaatcacacagaggggactgtgagacgagccaactgcagaaacagcacgattctttcgaagaaaatgccacctggcatatcggagctggctcagcctcgtcgtcgtttaagttttaacagtacagaagccatttttagagggagagccagctggacttgacacgtgtcaaactaaatcaggcccattttattttcgcgtggcaaaactcaataaacaacaaaagatacgtcaacgttattcaaatatgaccaaaggcccaccaaatcatgggccttgacgccgatccggtacacgcggctttgtagttttcctccgtgaaatctcaacccttagatctcatcgcaaaagtagttacgatgggccgcgacgcatcagaacacagtcatcgtctttgcagaatcgtaagcatattttacatgagaaattgcaattgcaatttgcatttgtctcatttttttactcaaacgaacattttcgtggctccagagctacactcaaaagccattcagcggaaggggttaggatttttggcggcgagatctctctgtttctggtagcttagca

SEQ ID NO: 7362 - DNA, 3000 bp, Unknown
  misc_feature (1)..( 3000): cDNA_ID_1817466_gDNA_ID_1621142_Annot_ID_56654 3000 nt of promoter + ATG
catactcttttcccatttagttttccttactcatagtaactgatccacgtgcttgaacacgtaatattaatcatacttaaaggcatgggataatatatcaaacttaaaccaaatcttctctcctcctcttatgcaggcttacatgttcaagtatgattctactcatggaaattacaaaggaactatcaatgtaattgatgattcaactttggagatcaatggaaaacaagtcaaagttgtcagcaagaggtattgcctcaaaatgttgactcatgtgtatctgtctagtatggtcaaattatgaatcaatttccactaatatcctattggtagggttttatgcttatccttttttagagtctaacatcttaattgttcttcctcagagacccagctgaaatcccgtgggctgatcttggagctgagtatgttgttgagtcttcaggggtattcaccaccgttggacaagcttcatcacatttgaaggtatgcactttcatttgaacacgcttgttgatctactagtttcattgatgctaacatttaataccaagccttatattattaataattccaaacattcaactcctaaaatggtctatgattttcttgacctttcattgtctgtgcagggtggtgctaagaaggtcatcatttctgcaccttcagcggacgcgcccatgtttgttgttggagtaaatgaaaagacatacctgcctaacatggatatagtctccaatgcaagttgtaccaccaattgtcttgcacctcttgccaaggtttgtagcattgcatttttgtcctgtatatagctcattatgaagagcttcattaaagtcaaataaagttgtctatggcccttaagcacttgtatctggcaggtggtgcatgaggaatttggtattcttgaaggcttgatgacaacagtccacgcgaccacaggtatttgatccttgtgccctcttgttatatgtcactgtatattactgaattttcgagactcaactatgtgttttttttaatcttattctttgcttttgaatattcagctactcagaaaactgtggacggcccatcaatgaaggactggagaggaggccgaggcgcaagtcaaaacatcattcctagctcaacaggcgctgcaaaggtacccaaatttgtacagttatatataaacatagcatctggaatcatatttaagccatgacttttttacttgtctcaataggctgttggtaaggtccttccggaactcaatggaaaactaacaggaatggccttccgtgtcccaacaccaaatgtctctgttgtggatttaacttgtcgacttgagaaggatgcatcgtatgaagacgtcaaggcagccataaagtattactctcaaaacctgttcaactaatttgcgtaccattctctatacatgaataaaacatggaacttgtaataacatctcatgattttgatttgaaatctctaacaggtttgcatcagaaggaccacttaggggcattcttggatatacagaagaagatgtcgtctctaatgattttcttggagattcaaggtatgtcactcttaaatattgtagcggatcatttaaaatcttggtactcaaaggttgtggccattgtcaaaaaaattcaggtcaagtatctttgatgctaatgctgggattggattaagcaagtccttcatgaaacttgtctcctggtatgacaacgaatggggttacaggtaacagttagtctctctcatttctttaccatcacatttaccatttgacaatacccaaagactaaaatatgcgtgggtcttgtaatgttacagcaaccgagtccttgacctgatagaacacatggcgttagttgcagccagccgctaaaaccatatcccgccaacgttcgttaggtagtttttgttacattgggggttcgattactgaaccttccggttttggctccaagttttatgtaaaaccatacgatatctaataatatggggaagattttttttgttgtacgaagaaatattgttagcagctagtcgaaaccttttctatatataaaaattggtttccaaagattggaattttctggttatatggttttttgttagcttcaatatctcatctctaagttatgaatattcgaaattgtgacagtgaaccatcgatgagtacacgaagatgtaacgttgagaatgagattatgactttgtacagcgtagtatatgatgaaatattgacgtgacatccacttataggcaaaatgatgtgatagcaaataatatctgcaaagtaaaaacataaacgatctataggactttgttaataatacgatgcaacataaaaacccactcagagaaaatgctggtaaaaagaggaaaagtgtgagttaacaaaaggcagaaggggacaaaaagctttatgcaatcgtgggaaaccactttgatctaaaaaactgtggacgtagtatttaatcattccttatcataatccaaaatgtataataaaaagatatctctacttaacgtggccatatagaaaaccttttaagatgaaggaaagagtaatgtaaaagaattggtaatggtatacatacatactcgtgattttatgaccatggctttttgcatcactagtgagtaatgcccacctacttcgtcaactcaacaacttatgaataactattcaattttttttttgccgattatgtgcacaattttaaaacagaagacaaatgtaaagtatatgactataaaatattgactaaataactttccggcgattttgttagtaaatgttaagaaaatttgttctttttccttgtagaaaaggaatgattctaaattactatcccaaaaaaaaaaaaagtaataacttgtttcgaagagtttgtgtgtgagtcgtatatgccgcttaactcctatattttctttctctttctcacaacttcccctagaaacacttttttcggaattcgaacgcacagcgatcggata

SEQ ID NO: 7363 - DNA, 3000 bp, Unknown
  misc_feature (1)..( 3000): cDNA_ID_1444414_gDNA_ID_1621142_Annot_ID_172855 3000 nt of promoter + ATG
tcatccttcaccgatatacactctgcgagtgttgtcttcttggactcaatcctgcaactctcaggcgtcttttcttcttttatctcccaaaccggtacagtctcatttgtttctgttgaagcctcttccttcttgtcggcatctttgcttgatgttatggtgacactctctgtagactcttcatgagaatgattaacggtttccgaaacttccacggttcctcctgctgaagtgtcttcaagaaagagacatactacagcacaatcatcattcttggaagtaggatacttaagcctccatgctcgaaccgccgtgtcgactacagcacgagctgcagtatctcgactaggagctgaagccacaatatcaacagcttctttgttcgacaaaacatcccatacctagcattagagacactttagctccaaagatttcgatagtaaccagtgagaagaataagaagagtaatgtgtaccccgtcagtagctagaataatatactgatctctttcagtgagtctatggtagttgatatccgggacagagattagaccataatctttaaggcagaagtccccaaaagctcgagccattgctaaaccaggtgaatcgctgttcggtaaccacacacgcgcaacctcaggctcgtcttgtaaggcaaacactctacctttacatctatggattcttgctgattcacctaaagcaagtacatagagaagaaaatcagattatgtttccaaagatgatcaatagtgacaacataaagaagagactagatatacttggcaaatcaggttttaagtctatggtcaattgtacagccaccaaagcattgtcttggtctcttgtggctagaacggctctcgagtcaccaatatttcccaccaccagatccttaccctataaaggaatatataccaaacagtcattgaacagagccaatgatagagtaaataaccggtgatcggactttcacctgtttgattacagtgacagaagttgttccgctgcagaaacaattgatggttggatgcatttttaactccttatccatctgttgacaagtcttgagcaaagcccttttaagagggagatacatctcggggaatagcttttcgtccttctcacatagctgtaactcacaccattgctcttcatctacacaagtaggcgcagagttgaggccattcttggagctgctttgttctgttcctgaggtcgttttcagttgagttgataatgtgaaaggtaacatatctcggactctctttgaaaccatatgaccaaatggaccatgtccatcaaatacaccacataacactgtatcgcttctcgaacagaaattctgtaacaagttaaacaagaagaagatataaaaaagctaaaatacatcacaagaagaacatcaatagcaacaagaagagcattgtaactgtagcagcaacagcataacaaaaaggcttctaaacatcaaacaatccaacatttcatcacagtgaactaaaaccctaataaaaaaaaagtgaaacacgaacctcccagacaagcatggcgtcttggttagttccttttttgccttgttgtgtgtaaagacaagcaatttcactagaaccattgccaacaagccgacccacgacttgttgaatctcactgatttcgccgccgctgtataagtctctaggcctccgcagcctcccggagctctgtctctctacagtagtagtggcggtgcttgtagctccggtttccttcctcgtggtcttatcaattttcgaatgacacaaacccatttgcaaatccccaatctttcaaaacaagttaaagcctttttcttaaaatcgatagttagaaatagaatctaccagagacctgtttttttgtctggggtttggtcggcaataaattcccgtttaaagactcacagcttccatttcaacatcaacaagaaaaaagactaagatagagagaagcaaaaatcacatctttacaaaacattagtgagtagagacaatcaagaatctcgtaaactgtttaggattctctgtttgagaagagacaaaacttgaacacagaccagagcacaaaagtgtttactaactccactcccgttaagactgactattcaaaaaagtacttatttttagtcaaaaagaattagagaaagagagagagatattggaaagaggtcgcagcttggtactgcacgtgagccactttatcactctttaaatgttttctgccccttcaaattttaaaaatctgattttactgaaacatttagtattagcaagaattgttcacgtaattgacatagaacctgaaacgtgtctcttgcctctggtcggatgtttcaatcaaatgacaatcactgtatatatgttttatagtgattagtctaagactccaaatttatcaggttctatgtctaacattgcatgtaaaaaatcaatatttccgaagtccaaactcttcctaagaatatgcatcaagtgtatataattgttacatacgttgtttcttgtgaaaaaaaaaaaaatacactagattctcctcctatcaaaacctaatgtctaagagaagtaaaagtctatagtgtgtgatcaattactttacaaagcaaactaaattatggttattgccaatttaaaatagttcaaatttcccaaactccatcaaaacttgggcttttctcggattaagttggttgaaccgttaagcggccctctaaactttggacaagggattgtagtggatttttgaaaaaaagaatcccggttaacgaccttaacaaatgaaatgatcgatcggttgttgacccagcttttgagccaccgccttaaccaaacaaagctgttaagatcgaaccagtcaattctcagctctgagcggtacggttaattcatttcttatctatcacacaaagttgaatcgtaaccctaagcgaattcaacaatcgagagagcgagagagatcaattaaccccagcgaatcgaatatg

SEQ ID NO: 7364 - DNA, 3000 bp, Unknown
  misc_feature (1)..( 3000): cDNA_ID_1817462_gDNA_ID_1621142_Annot_ID_56655 3000 nt of promoter + ATG
tgcaatcgtgggaaaccactttgatctaaaaaactgtggacgtagtatttaatcattccttatcataatccaaaatgtataataaaaagatatctctacttaacgtggccatatagaaaaccttttaagatgaaggaaagagtaatgtaaaagaattggtaatggtatacatacatactcgtgattttatgaccatggctttttgcatcactagtgagtaatgcccacctacttcgtcaactcaacaacttatgaataactattcaattttttttttgccgattatgtgcacaattttaaaacagaagacaaatgtaaagtatatgactataaaatattgactaaataactttccggcgattttgttagtaaatgttaagaaaatttgttctttttccttgtagaaaaggaatgattctaaattactatcccaaaaaaaaaaaaagtaataacttgtttcgaagagtttgtgtgtgagtcgtatatgccgcttaactcctatattttctttctctttctcacaacttcccctagaaacacttttttcggaattcgaacgcacagcgatcggataatggcgacggagcatataactcgtacgggagatgaatacaatgtcgagcttttacctagtgacgacgatgcgccgccgcttgaatcgtcttggcgtctcaacctcgacgcttttcaactcccttcttccaccggtggccgtcacgacggacgtactcgcttttctcgctattttcgtactccaagtaatttttttattcttcttcatgtttttgttatctgctctcaatccgtaaagtgtgcatagagacgtgtacgtaaaatgatcagcgaccatgacttgtgaattgtggatatgaactttgatcatgtgtatgaaaaaaaaaaaagtagttatacaaatgtgtagttgttgaaatttttttgggaaaataaatttagaaattcagtctagaaggaaaaaaattagagtgaatgattctctctgtttaaaaccccttgctattgatttgattcagtataaaactttttctttttgttgattcaaagtttttgatgggatctttagcttctcttttggagtttgtatatacccatattctttgttttaaagttatgtggatgctgaatcagattaatctctacagaggttataaggcgttttagagtgatttgagaaactgttatacccatcaaaggtcgactatcaaattgttaaatcttgaaaatggactttaactttgaacccttttctctgttgtctcaatgcaggaaaggaacgtagagtctctgaatactacaagaagcaagagaggctcctcgagggtttcaatgagatggagactatccacgaaaatggttttgcatctggtgttccaactgaggtctggcctctactgttctttctttagtttttttttcttatggtatagatattagatgaatcctcaagcttgtttggtttgaacaggaagaaatgaagaagcttgcaaagagtgagagacttgcggttcacatatcgaacgcaacaaatttggtgctttttgtagcaaaagtttatgcctctatggagagtagatccatggctgtgattgcttcaactttggactctcttttggatctcttgtctggttttatcctctggtttacagctaatgccatgagaaaaccaaaccagtttcactatcctatcggaaagcgccggatgcaacctgtggtatgcttcttctgttttgatctcttaacccctttgtttggaacttacttgtctcacaagaaaatagaactgataatgtaaatttacagggtatcattgtgtttgcttccgtgatggcaactcttggactgcaagttttgctagagtcaggaaggcaactagttgccaaggtactttacatattttcaggtaactgctttcatcggttaattaatgtatttaaccaattctgttttttgttacagagtggtattcatatgaatagcacagaggagaaatggatgattggtatcatggtctctgtcaccatcgtgaagtttcttctaatgctttattgcagaggatttcagaacgaaatcgttagggcctatgctcaagatcacctctttgacgtcgtcactaattcaatcggcttagcaacagctgtcttggccgtcaaattctactggtggattgatcctaccggtgctatacttgtaagtaactaacttaggaatctaaaatgatcaagaaatgtctcgtcggattactaaaacgttttttttttcctttttatggttgcagattgctttgtacaccatagcaacatgggcaagaaccgtactagagaacgtccattcactgatcggccgctctgcgccaccagatttcttggcgaaactgacattcttgatatggaaccatcacgaacaaattaagcatattgacacagtaagggcttacacttttgggtcacactactttgtggaagtggacattgttttgccagaggacatgagactacaagaggctcacaacatcggagagactcttcaggaaaagctcgagcagctcgctgaagtagaacgagcttttgtccacatagactttgagttcactcatcgtcctgaacacaagtgtaactagattttaagtagtaatttgtagtactataattagttctttagtttatgtactcttcgtgtcgtttttgtctatatagatacttgaacgttgtgccgtctctgtttatcgaatgcgcattgtgtgtcgtttgaagctaatcgtcgacattaatagcgtttcaaacactaaactcaaaataaagataaaatcatatataataaaataatgaattttaaatgaaaaccactcaaaatggtttttatctatcttccgacaaaattccgtgcttcattgctcttctccacaagacaacatttctctggctcagaatcgacgccatggaaatgtaaagaagaaacaaagacgagctctcaaatccagcagca

SEQ ID NO: 7365 - DNA, 3000 bp, Unknown
  misc_feature (1)..( 3000): cDNA_ID_1817459_gDNA_ID_1621142_Annot_ID_56656 3000 nt of promoter + ATG
tcttccggtgaattgagttatcttatcgtacggacaatgactcattgcaggttgctgagccgtttttcttattggctggtccaaatgtgatcgaatccgaagagcatgttcttcgtatggctaaaagcatcaaagatatttcgacaaagtatgtgtaaccatcaccattgaagctctttttcttgttgtgacatcttgtgttcaactgtgttggaactattaaaataattgacaagggggaaaaatgtttaacacagtggagaccttgatcctctcatcacatgagcattttagcttattgagcaaggtgtttacttatatagttatagttatgcatgttcatgttgattgtgaatgttgtaggcttgggttgcctctggttttcaagtcaagtttcgataaagctaacagaacttcatcaaagtccttccgaggtcctggcatggctgaggggctcaaggtaaatcattccctcttctttgagttgcaagcatggatgactctttatctggtgctcttagaactgcgcatttgaaaaccttcaggagtatattgatgtcaaagcgatcttatatctataaattcttacgtcttttagaaccttcagtatgagctgacaccagcaattgcatttagctcctggctataatgcaaccatttacatttacggaaactagtattgatgtggcttcatttttttgtgtgtagttcctgcacaagtatactacaggtagtaacttttctgtttctctcgacagattcttgagaaggtgaaagtagcatttgatctaccaatcgttactgacgttcatgagtcgagtcaggtattttgagttttagtcacatcagagattcaagattcgaaaaatctttgttcctttctaatgcttcgtttgtttttattagtgtgaagcagttggcaaggttgcagatataattcagataccggcgttcttatgtcgacaggcaagattctaacatatgcttttcttcaactcttttttagctatcaaattttcatttactgtttgaatttatcatttatatacagagttcagggttttaactattgcctatatctccagacagatcttctggtcgcggcagcccaaagtgggaaaattatcaacataaagaaaggacaattttgtggtcactctgtgagttatctttttgatctgtacaaacttttgttccctggtatattgtagtgactgatttcatgtatatccattttaaggtcatgagaaactcggctgagaaggttagactcgcagggaatccaaatgtgatggtttgtgaaagaggaaccatgtttggatacagtaagttaactgttctttgtgtcaatagaattcaccaatttttttgcaaatagagactaaaatagactaaaagacactggatataactcctgagtgtccttacattttaattttgttcctcagatgatttaatagtagatccacgaaatttggaatggatgagggaagctgattgtcccgttgtgagttaatattgcttcttgttcttttcttgttgtgggagtttatatcttggctttggctttatactttgatgttttgacactcgtataatataatttagttattggcttcaggttgctgatataactcattcattacaacaacctgcaggcaagaaggtatggtcattagaacgatgctctgagtaatttaagaaaatgcttggtgttttaaagctaaatcagaattggtctaaactcaaacataccttgtttatatagttagatggtgggggtgttgctagtggtggccttcgcgaattaataccatgcatagcaagaaccgccgtagctgttggtgtcgatggaattttcatggaggtatccaactttatcgcaagttttgtcatctcgctgaatctttgttccaatttggttatgaaacttggttcattttccggtgaattaggtgcatgatgatcctttaaatgcaccggtcgatggtccaacacaatgggtgagttttactttttttcagaccatatccattagtctaacacaatgcattcttgatcatcgtttttcttcccgttcagcctctgcgtcatctagaagaactgctagaagagctcattgcaatcgcggtaagccctttacattatcccataaaaatttaatctgtttccttttgttgtaacattggctcttataacatctttgcagagtgtcacaaaggggaaacaacagttccaaatcgatctcacgccttatcgtgattagaatcaaagggtgtgttagtgaccgataaatcaagatagaaatgttgaactctctttgtttgttttctcatcatttgctgattcttttctgcattttgcaggtccgtacgtcactttgggtgcaactacatcttcttgataatatttcaatcttgtcggagcaataagcattatttggcaaaacacatctctccacagtgactaatgtatattcaaagtagctgatgttgcctgatatgatatcaaatgtctaagtttgttttatttttgaagaaataaacaacaattagaagttaaattactttttatgtcaacataaagcactttttctatacctgatcttgtagtcttttctttaagtttttttacataatgcatggtttctttctatggacttgaaatttatgttgttgcacttgcacagtatcctctgagaaactgaacaaactaacaaaatgcaaacagtgaagttcttttattttattttttcagaataatagaatgatgggtctgacaagctctaggttggattaaaatgggcttgggtaaacaaagcccaaacaaaagcagaaaatacgtagcaacagaaggggcataatcgtaaattagataggctcaatttcaaatacttgagaagcggcgtcgctacttttgggaatttgcaacggtagaactctcttgcaattgggtttctgggaagaacaaagcagaagatctggagatttgaggaaaatg

SEQ ID NO: 7366 - DNA, 3000 bp, Unknown
  misc_feature (1)..( 3000): cDNA_ID_1817455_gDNA_ID_1621142_Annot_ID_56657 3000 nt of promoter + ATG
tgtatttgggatctgtcacatacttctccttcttttggtaaataaattcactatgagaatagatgtttaccgtttatgagaaattatatgtatagacactaacccataagactagagcggctcttatgataagactatatcacatcatatataatttttttgtttgatagagactgtctttagtttgcaaaataggcccatagtttgttgggaactaactaaagtaaacgctgcgaccaaggtggaaagtttgttggtatcactgggtcaggaatcgatatgtcagaatcatgtaaaatggacatgagtggttgcaacttgcatggagtggcaactggcaagccattttaatacaaaatttcttttgattttggtccagcaagattcatatttattgtgtttaatacaaaactgaaaacacgaacaaaagttatataacataattccataatcccaaatgattgaaatggggcagtgaaatagcattaagaaacacgattcaactattacaggattacatgtgagacaagaccttattgttgacactacaagtgctgtagtgcattgtaacataagaaagtaaactggggaaagctaaaacgatttcttttcgtaagacaccagtccatggattccaccttctatctgtgctgcaccggtacgagcctattcacaacatcaaaaccatcaacgtaaatactaacaacaaaacagcggaaatcgcagcttaagatagttttccaaggagtagaattaacgacatacctcgagtctaagggtattatctctcaatagctcgtgagcagactgcaaagaagaagcaccgagatcttgaaaaccttgcttcacggcatgcattgtgtatggtataaacttcaacactgagcctttatctgcaaccgctccaaccactccttgtgcaatcttgagtttcgcggtatctcccaagtatctctggtcgcttcctttggtcattgcttctaatgaacccatacctctgtatttcttcactctcctaccgttctataaaaacagaccaaacaaagcaagatattgaggaaaatatcaaggaagttggttaatcaatatccaaagtaggaaggtgtgtgcaattactcgatattcataggctccaggagcctcggtgcttccagccaagaagcttcccatcatcaccgttgatgctcccagaactagagccttcacaatgtgacctgagtttgagatgccaccatctgcgataacaggtacaccgtgctgagcagctagtgtcgagactttgtacacggcagtagcctaagagagaaccaatcacaaaaaataaaagaacccgactttgtaaggtgcaattcatggaatcaacttagcactttatttcaaatatgaaagctttttcatttacctgtcctcgtccaacggcacaaacctcttgtgttgtgcatatagatccagatcccataccaactcttaacccatcaactcctgctttgatcaagttctcagcctggtacatagtcaccacattcccaccgaccacatccaactccggatacgtattcttcacatacttgatcatctcaagctggtaaatcgagttcccttgcgaactatccaacaccacaacattagctccagctttcactaagtgctctagcctctccttgtctgattcccttgtccctatagcagcaccaaccatccatttcttgtctgcaccaacagttcctgaccctaacttgggatatcctttaaccctctccacatcgtcttttgttactacgttcacagtctcaccttccttctccagaacaacaaaccctttctgcttatcttccaaaaccgcctcaatcttgtcaagatcaatatcccatggcacatagtaatctttgttctcacaactcttcatgtaatcatatatcttcacctccttttggtcatctttcatactcgaccactccgattttgaaacataacccaacaatttcggtgtcaatgttcctgattcatcaaacaaacaacaacgaagttgtcaaatggaaactatttcacaattttgaaaatgaaagtagctaactttcagctaaaaggtatgaaattgattgtgaaattatacccgtctgcgagacaaaaacgaaggaagaaggaccaaaatcatcaacagaaccaatctggtgctctgggcatttaaaaacagcatcagacgcaatcggaacttgaagcgatttagcgtgacggataacggaagcttgagtatcgatgtcgcagttatagtgcacgattccgattcctccaagagcagccattgcagcagccatgtgggattccgagacagtgtccatcggcgaagcgacgcatgggatcgagagtgggacgcgcttgctgagacgcgtggatagcgagacggcgtcagtggaaaagtcgatgaagtgtggtagaaatatcacatcgtcgtaggtgtatgagtatccttgtgagaatagcttttcagctgaaaatccatcttcgaatcctgacatcttcagtccaacaatggcgtcgatgccaatagagagaaatgaacagtgagtgtaagctagggttcagtggaggagtaggtgaaggtttaggtgcgaaagatgacaaacgaaaatgttggtgaaaagataaaaccggaaccgaagaaattaaaccaaatcaaatagaattttatttattaaccgattggtttaacgatctatgaattgaattaaaaccggataatgattatccacgccagggacagtactgttggcgtatccgaacatcacctctcggccattggcaatttctattttggcatctcactgccttcactcacactacaacttccagttaaaggtcagaatcctaaatccttgatttgtgattttcttcgatgcagatcaatgtagagaaattatcataagttctttcgtgaattttagattctgattttggaagttgaggttttgttatctgatcttaagctctactatagaaatg

SEQ ID NO: 7367 - DNA, 3000 bp, Unknown
  misc_feature (1)..( 3000): cDNA_ID_1817451_gDNA_ID_1621142_Annot_ID_56658 3000 nt of promoter + ATG
taatgcttattgctccgacaagattgaaatattatcaagaagatgtagttgcacccaaagtgacgtacggacctgcaaaatgcagaaaagaatcagcaaatgatgagaaaacaaacaaagagagttcaacatttctatcttgatttatcggtcactaacacaccctttgattctaatcacgataaggcgtgagatcgatttggaactgttgtttcccctttgtgacactctgcaaagatgttataagagccaatgttacaacaaaaggaaacagattaaatttttatgggataatgtaaagggcttaccgcgattgcaatgagctcttctagcagttcttctagatgacgcagaggctgaacgggaagaaaaacgatgatcaagaatgcattgtgttagactaatggatatggtctgaaaaaaagtaaaactcacccattgtgttggaccatcgaccggtgcatttaaaggatcatcatgcacctaattcaccggaaaatgaaccaagtttcataaccaaattggaacaaagattcagcgagatgacaaaacttgcgataaagttggatacctccatgaaaattccatcgacaccaacagctacggcggttcttgctatgcatggtattaattcgcgaaggccaccactagcaacacccccaccatctaactatataaacaaggtatgtttgagtttagaccaattctgatttagctttaaaacaccaagcattttcttaaattactcagagcatcgttctaatgaccataccttcttgcctgcaggttgttgtaatgaatgagttatatcagcaacctgaagccaataactaaattatattatacgagtgtcaaaacatcaaagtataaagccaaagccaagatataaactcccacaacaagaaaagaacaagaagcaatattaactcacaacgggacaatcagcttccctcatccattccaaatttcgtggatctactattaaatcatctgaggaacaaaattaaaatgtaaggacactcaggagttatatccagtgtcttttagtctattttagtctctatttgcaaaaaaattggtgaattctattgacacaaagaacagttaacttactgtatccaaacatggttcctctttcacaaaccatcacatttggattccctgcgagtctaaccttctcagccgagtttctcatgaccttaaaatggatatacatgaaatcagtcactacaatataccagggaacaaaagtttgtacagatcaaaaagataactcacagagtgaccacaaaattgtcctttctttatgttgataattttcccactttgggctgccgcgaccagaagatctgtctggagatataggcaatagttaaaaccctgaactctgtatataaatgataaattcaaacagtaaatgaaaatttgatagctaaaaaagagttgaagaaaagcatatgttagaatcttgcctgtcgacataagaacgccggtatctgaattatatctgcaaccttgccaactgcttcacactaataaaaacaaacgaagcattagaaaggaacaaagatttttcgaatcttgaatctctgatgtgactaaaactcaaaatacctgactcgactcatgaacgtcagtaacgattggtagatcaaatgctactttcaccttctcaagaatctgtcgagagaaacagaaaagttactacctgtagtatacttgtgcaggaactacacacaaaaaaatgaagccacatcaatactagtttccgtaaatgtaaatggttgcattatagccaggagctaaatgcaattgctggtgtcagctcatactgaaggttctaaaagacgtaagaatttatagatataagatcgctttgacatcaatatactcctgaaggttttcaaatgcgcagttctaagagcaccagataaagagtcatccatgcttgcaactcaaagaagagggaatgatttaccttgagcccctcagccatgccaggacctcggaaggactttgatgaagttctgttagctttatcgaaacttgacttgaaaaccagaggcaacccaagcctacaacattcacaatcaacatgaacatgcataactataactatataagtaaacaccttgctcaataagctaaaatgctcatgtgatgagaggatcaaggtctccactgtgttaaacatttttcccccttgtcaattattttaatagttccaacacagttgaacacaagatgtcacaacaagaaaaagagcttcaatggtgatggttacacatactttgtcgaaatatctttgatgcttttagccatacgaagaacatgctcttcggattcgatcacatttggaccagccaataagaaaaacggctcagcaacctgcaatgagtcattgtccgtacgataagataactcaattcaccggaagaaaataaaaaaaataacactgaacctagtaaaaaaaactcaaccttgagctgatcatacagtagtgacgctgaattcgccatttctatagtagagcttaagatcagataacaaaacctcaacttccaaaatcagaatctaaaattcacgaaagaacttatgataatttctctacattgatctgcatcgaagaaaatcacaaatcaaggatttaggattctgacctttaactggaagttgtagtgtgagtgaaggcagtgagatgccaaaatagaaattgccaatggccgagaggtgatgttcggatacgccaacagtactgtccctggcgtggataatcattatccggttttaattcaattcatagatcgttaaaccaatcggttaataaataaaattctatttgatttggtttaatttcttcggttccggttttatcttttcaccaacattttcgtttgtcatctttcgcacctaaaccttcacctactcctccactgaaccctagcttacactcactgttcatttctctctattggcatcgacgccattgttggactgaag

SEQ ID NO: 7368 - DNA, 3000 bp, Unknown
  misc_feature (1)..( 3000): cDNA_ID_1817448_gDNA_ID_1621142_Annot_ID_56659 3000 nt of promoter + ATG
ggtatgtatcttccaatcgaagcaattagcggacaacaagctcctccaacgacaagagcctgtctaaacatcattgttgccgagcttctcacacaagttggaaacatttcaaccataaaaactgccataaggttaaatccgattctagcgcagaagaatgttccgagttcgaaggcaaacgcgatctctgttttgccgagaatgctgagaacgaaacagagcacccctgatgccccaccgagtaaggtattcacaagaacagagcttcttctgttgaatctctccaataagatcggagtgataacaaaagtaggcaactccaccaatgcatttagggtttcactcaagtagatgttgacgtctatgtctctagctgctaaaggaacgccgtaatacgatattcccaacccaaacattatgatcataacaactaaaatcctacgaaaagcccattttcggaagaagaagtccttaatcgagtaagttggcgcttgttcaaagttttcttgcttgaggggtaacttagaaaccactgattccaaataagctttttccttcggtgacatctttgtgagaacatcaatggcttctttatcctttccttgcatgtgaagccaccgaggcgattcgagtgcgaagaggtagaggaagatacagtaaaataccgctggaactgatgtgtatagatatagatatctccatgaagaatcttgtgcaaggaaagcgattccagacaacgacataaaccctaaaacgaatagggtaaatggaatcatcgtagctctcggtctccatctggtggagactcgctcactgatgagaaccaacgcgtatgaccaggtctgtgatcgcgaaaatccaatgataaacttaaggaatgtataaatccatacattggttgagaagataacagagattgaagtgattgacattgcaaaggttgagaacaaaactagtttcttgcgacccaaggaatcgtctggaatcaaagcaagaaaaaaccctccaacaatggcaccgatgtagaaagcagaactaggcatacctctgagtaaagagctcgagcactcgaggccaaattcggaaatgacggatttgccctgggagccaccgtcccattcccaagctgatcttggaagcttgcagatgtcggaggctgaaggatcacagatcgtgtggttaagacagtgccacgtgggataagcatctgtgtacacggtgatgaatatctgctgagcgtcgaagagcaaagctagtccaacgagggaaatctggaaaaattgccagaatccgaaatctgatagactttgttcgacgatcttgtcgaaagtcaatgcttctaatctggttttttcgttgactccagaatcatcggtgagatgagacaacaatggttctgatattggatcagccattatcgtttagtttcaaagcttttttgttttggtgtatttgaagaatttgactattggtattatggtatactctcattaattcattcttatcaaactactgtataaatataagtctgaaatctgaatctgtgttatcattaaatgaaaatgtcaaatctatataaattattaaatcattccgtgtttaatatgcgttattataatatttcaaacgtgcttcatgtgaagcttgggtccacgaagtcaaagtatgaattcagttcattacggttcatactcattagtcgtggatttgctttatctaattttataaactcaactttacttaacatgtaactattattactcagtacctataatagttaaaaaaaaaaaaagaattaatacctaatttcattattaaattatatgcatagaggaaatataggttggtcatcttccatgacagataatcctttcttttttttggcgtcaaatacaatgaatcggttacactactatatgccttctccagctcatataataggaatgatgaagaggaatctttcgaacgacaggataggacaagaatgtctaccaactaaagtttcttcttttgtcacaaaaggggaaggaaggctatagttttttttgtcgaccgcatctatatttgtaggaataattatttaatttgaaagggttacattgatcggattagttcacatacatacttgtttgattggtgacattttaattttgtgagctttgaaaattatcaatcaattcgatggaccaagttaaataatcctaacctctaatccgatactagccaaaatttctcaaacaaaaatttaacaatcagtgaaatgattgataaacgaaaaagtcaaatacgaaacaattaacgcatatttttgaaaactaaagaataaaagatatatcgaattaacaaaattagttttttttttctcattgtcaattctttcgtaatgagcttttctgcgacgtcctcaattgccttagggggtggatccgctgaggcttctgctgccaaaaacacctcaaagcgtccaaaatgtgatctctaacctattccctaatttttgttacattttgtcatttgcggttatttttctgatttttttgtttcttttgcggatttgacaaatctgtactttgggatcgtacctagtgtttctggaatgcctttataatttccacctcgtaatggatcagttcttctatgttatgaacgtattgaaaataatgttaagaactcagattctttctttgagatgttgctagtctctcgatcatcatattctatgatttctttatcaatgcaaatgactaaaatttacattgtgtatacagatatattatataggaaaaaattccgattattaatattagtctagtacacacaaatgggtacttgcgttttcttctttgtttggtatgttctagtaatccatttcatgtgaaagtttaacaagggtgtagttgaaacccattttgtgttgttggactaatgtaactcccaataaattaaaatgtgtgataccttttgatttctctagtcttaagataagtttcttagaatatg

SEQ ID NO: 7369 - DNA, 3000 bp, Unknown
  misc_feature (1)..( 3000): cDNA_ID_1817537_gDNA_ID_1621142_Annot_ID_56663 3000 nt of promoter + ATG
cagtgcaacttgatcattattgaaacagatttattatagcgttttacagcatctattgattgtaattttgtacttatcttacaataagatatatataaatatatttttttcctcacaataagattcaatctaagaatatgaatttattgacgaagatgtaaaataaatgaaactggctttttttatgaagatgtatatcaagaaatgataataattcatagaagaaaaaatgataattataaagaagtagaccctaaaataaatagttaaccccaaagtggttgagtgggggatcacatgcagcaaattaacggcggtggggaagaaggtctgagaaattaaccaagagatggctcatcctcagccattcacttagccatcgagagatctcaaacccattaatcatttaacttactgaacatatctaataaatgtgtgtttatatatgtaatgagttagacgccaaaaataaattatagactagagacatgtcctgctagctggatcctagtcatcacggtctcacgagcagtattgcatccaattttcgatcacaatatttacaaaaaattcccaccactctaaagttgtagtttattctctatatatagagtaacataaattgattggacatgcaaatcaagtcaaacataaaagtaaacaaaaccctatctcttcctatatatggccgactcgactcggccgcttctctcagatttcaactcgtccgagtcaaatcttccgccaccaagatcccttgaggagacgatagagcgatgcattggagacttcgggtgggcacagtttctccaagccgctttagtctcattcgcttggttcttcgacgctcaacaaacattcatcaccgtcttcaccgactcacaacccatgtggcactgtgacaactcggaccgagtcgactcagtatgcaacacatcctcctccaacctctgcaccttacccaaccaaacctggtcttgggacttgaacccacacgtttcaatcatttccgagtgggggctacaatgcgccggctcgttcctcaagggatttcctgcaagctcattcttcctcggctgtctaatcggcggcttagctctctctacactcgccgactcatcgctcggtcgtaagaacatgctcttgttgtcgtgtctcataatgtctctctcttccatgttaacagctttctcaacgagcatttgggtttatgcgtttttgagattcttgaacgggtgtggccgagccacgatcgggacttgcgcgcttgttctatcaacggagttagtcggtaaaaaatggcgaggacaagttggagcgatgggtttcttttgcttcacgctagggtttttatcgcttccgatgttaggttacattaatgaagggaattcttggaggaatctgtatgtttggacatcgataccgactttaatctattgctgtttagttcggagtttcgtccgggaatctcctagatggcttatcgtaaagggtcgtaaagaagaagccgtctcaattctccaaagcattgcttctaatgcaatcactatgagcttcacaaacttatgttttgaagtagaaaatgatcaatccaagtcaaatcctgatgtttatgatgcgttaaagatcttggtgaggaaaagttggtcgtttagaagattattagcggcaatggtggttggattcggtatcggtatggtttattatggaatgccattagctttaacgaatctaaacttcaatctttacttaggggttgtgttcaacgccttgtctgagttcccagcttttctgataacgtttttcttcattgataaaatcaataggagagatgcgttgatcggatttacagctctaagtggaatctctagcgctctaatcgcggtgttaggacaacaactagggtcattacagattgtgttagagctcgtttcgtttttcagcgcatgcaccgcatttaacatgacgcttatttacacaattgaaatgtttccgacatgtgtgaggaactcggcgatttcgatggtgaggcaagcattggtgtttggcggcgtgtttagtccagtgatggttgctgctggtcgggaaaatcagttttggtcgtatgggttgtttggtttgatcataggattgtgtggattgtttgtgtttggattgccggagactagaggaagtgttttatgcgacactatggacgaggaggagtataagactttggcaaaaagacaatttattggttgatacttgatactgttgtcttttgttgtaatggttaaaaagtttgcaggcttaaaccagttcggtattgattcaaatcaattctgattttaatacttataaaccacgggttaactccttacattataagtgactgtctcatctgtaccggaccataaaccaaattcaaccaaccataatccccctttcaattttgatctattcaacaatgactcatgcatactttatttcccttatctcatttccatattcgaaatgtaagctctaaaatggtactcttaactgaaactaaaatatatataaaaaaaaaaaaatctacatttcttgaagaaacatttttaaaattaactatagttgctaaattactattttagattgacatatatatatatgtagaccaactaattaacccactgaaatgcaaagagatggtctgaaaatcaaaacagacatctaaacgtggttacctacccaagagctcaccagcctatagtatcccattccctttatattgaatcactttagattatcttttctctttcatctttccaattccactctatattaaagaaatattattttaagaataaacaggatcgtattttcatcatatgccaatatgttatttggatttaagattgttttcgaatctataaatactaattaacacaacaaacaatttccaaatatcgtagtgttcataacgaaacgagcacacaactcactaaacactcaaacaaaaatacaaacattaagatgatg

SEQ ID NO: 7370 - DNA, 3000 bp, Unknown
  misc_feature (1)..( 3000): cDNA_ID_1817533_gDNA_ID_1621142_Annot_ID_56664 3000 nt of promoter + ATG
acatgttttcggatgatgggagactaggaaaagccgaaaaacatcatcttgaggtgattttcaacactctaaactgtttgccaggttttagtcccgtggattacgtggaccgatggttaggtggttggaatattgatggtgaagaggagagagcgaaagtgaatgttaatcttgttcgtagttacaacaatcccataatagacgagagggtcgaaatttggagggaaaaaggtggtaaggctgctgtggaagattggcttgatacgttcattacgctaaaagatcaaaacggaaactacttggttacgccagacgaaatcaaagctcaatgcgtcgtaagtaaaatgtaacttttataaaagagtgtatgttatacacagaaattgtacactaaataagccaaacagaaaaaaaaaaaattatgttgaatactatatattgactaaattgcgagatctacacatatataatctaagtatattaattatttgttattctggtgttttttacaggaattttgtatagcagcgatcgataatccggcaaataacatggagtggacacttggggaaatgttaaagaacccggagattcttagaaaagctctgaaggagttggatgaagtagttggaaaagacaggcttgtgcaagaatcagacatacgaaatctaaactacttaaaagcttgttgcagagaaacattcaggattcacccaagcgctcattatgtcccacctcatgttgcccgtcaagataccacccttgggggttattttattcccaaaggtaaaacatatagggaatacatatgttttttatttacataagatttaacgtttatagctagtaagtttatgcatgagcttcgttaacaaaataaaacacatggttttggtttgtggctacatatgatacaacctaaatttttttgtaatacttttttgtttaaaataccaggacaactagtaaatttatacataggtttccttaacaaaatctcgatacaattttgcattatatattaagaaatattgatgattggacaggtagccacattcatgtatgccgccctgggctaggccggaaccctaaaatatggaaagatccattagcatacgaaccggagcgtcacctccaaggagacggaatcacaaaagaggttactctggtcgaaacagagatgcgttttgtctcatttagcactggtagacgtggctgcgtcggtgtcaaagtcgggacaattatgatggctatgatgttggctaggtttcttcaaggttttaactggaaactccatcgagatttcggaccgttaagcctcgaggaagatgatgcatcattgcttatggctaagcctcttcttttgtctgttgagccacgcttggcatcaaacctttatccaaaattccgtccttaaaaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggttaatgattaccgtgtttaattgaaatggtgtgaagaattaggttaactataccatatgaggttaatgattaccgtgtttataaattgaaatggcgtgaagaattagactacatgacaccaacaagaatgttttcctttatcaggataaacgtgttcacctacccaaggtattatttatttattcaaataatagatattggttatgtttcgcacacacacaacaacaacaaaaattagatgtagaaatatttcactggaattcacctttcaatgttttattgatgaaattgatagagcggagagtattcaaaactttaaaagaatagtttttttaaacagaaaatagataaaaatccaaaagaatagttataagttaaaaaaataattgaaccatagttgatgattttttttccccggatttttggaaatcaaaaatgaattgaagtgaatcaaagttgatgataacaagtgaagaccagtttaagacaaaacaatcggattctttggttaactccgattcatgatccagtttgctgctaagctaagagaaagatcaaaaatgaaattttcgggagtaactggtaggagaatgggagatggaaagccaaaggttggataagtgtataaaaagagagagtcggatgttcataaattttgtaataaagaactgcggttaaaatcttggatccctccactccacggctccactgtgtagagtaaattcttgacgcatgttcatagacatagtaatacgtgaaatgttgtgattcgctttttttcctttggagggaaaatcccccttgtatttgggatctctcatgttccattaaccttatccagattccaatattgaaatatcgaatatatatagtcgtgtatattagtgattaaacatatatcacaacaccactttacagtcacatatacatatatatttgaattaagtgttcaagtttgtaatatgagttttgtggatctagcaaataaaattgaaaggaattatatggataaatttattttgttaattcaatatattttttatggataattaattttaaaaattttactctctttttttttacggctaaaagacgtttacattcaaaatacaaaacaaactgtttttgtgacaaaactaaatcccttgaaatagcagtatagacgtagtagacattaaaaaatctatagagcttttactatcgctactcatcaaactagatataaaatatatataaacgtgattaccgtagtacctacccaaaagcccaaaccctacgtgagcatcacatgcatgatatcgattctataaataatccacacaacaaacactttccagatatcgctagtgttcatttctaacaaatgcacacctcactacacgcatacatacatcatg

SEQ ID NO: 7371 - DNA, 3000 bp, Unknown
  misc_feature (1)..( 3000): cDNA_ID_3050319_gDNA_ID_1621142_Annot_ID_172888 3000 nt of promoter + ATG
aacttttcccatttaatgaaggtaagttttagtaaaaaaaaaaaaaaaaaaaaaaaaaaaactattattacaacaacatcaataaatagacatatattataatttctaattcaaatagtttatagttggtttatgatgtgaacacactattatatatacataacttgttctattagaccattgttataaacaaaaagtcagtgaatatgatcttgacgttgaatgattttgaccaaatcgaattgcagtagggatgcatttctgaatttcattgcacataaggcaaagaaaatataaatctcttttgtttttgccaagaaatatacatataatcctaattaatttgtttggcaaacaagatcttgctcaactgctaccgacgtatgagtatgaccattagtatcacaccagtcaccaatcaaatgcataatcaaatctattaataaaaacatctttctattagtaaaaaactttggtgtttcaccaaacaaatacattatattgtacatacatactgtcaccaaacatatatacatcctctatttagtatttttgttttgtaacttttgttgtagaaaaaagaacaaacgttgcaatcaattaaaaatatggttctctattcaaacatgaaacaactatagaatagagagaattatattgttaaacagttgagctcatttcagttttatacattttaatacgtttgagaccgaatagttgaattagggagccatctctcctttaaagggataatatatgacgctcaccagtactagtccaaagtataattttatacattttaacatagaattattaatttgttgtaccacatttatgcagtccaaccgcaataagatatagaccaaatttcttatattgtaacatacgttcaccactcttcgttgctagctagttagcggtacaaatattaaaaggcaaattcaactattattcacaccttagtaaacagaaaatgtactacggattcatttcattgtacttgtggtattttatttacgaaaacgggcggccgaaccaaatcaaagactagagacagaggcgtgccaatagcaacacgtttgctttcgtcatgcaaattgggatatttcaactttcttccattttttcaacctagtttactaaacttttctttttccagtgcgaacctaattggttctagttaaaataacattttcgtaagttgttcaccaaacaaaggaacatatgattataactttactagagatgcatgcacaataatgctattgtcgaataaatacttatatcttctccaaaaaagtttctttattatgttagaagatccatcaatatactaattgatttttggttatatgttttgatttaaagacaaaactatacaggacatgcatgtgagaacaaaaattgttgttgttgtagttgctagttgagttttatttatgttgccaaaataacaccatgtcaactttaattttcgtcatataatttaacgtaagcatgatgtgtttcgtcatatcttgtttggcatatggaatataaatcatactattgatttggaatctttaacttaacttcctattaagtaagcgattgatgctgatatgtatgtttctttagattgatgaacgtaatattaatcagtagtggatatacattgtatctttagaatttaggttagtatattatggccaaaatgactaaattgagtaccataaactaaagttaaagtagtggtaaaagcttacgatattgttttataacaattttcaaaaagtaaaagatatataaatgttagaggttttggataaccatattgttctataacattttaaacatatgtcatatatgtttcgtttataatatttatgacttgaccaaataatttgtgtatgttatttaaatccaaatatatatgagaaatatatagacgacatgattaaaattatttaaaagagtcatgatgagagggatggagactaaaaaaaagaggagaaaaagatagaacgtcgagaaatgttgtgtgtgtataaagtaaaggaaagctaatttgatcattgtattcgaagaaaacaaaaaagtatacacatgttacagggttataggacccattttctttaaaataaatccactatggactgatgtacatattttttcttactgttcttaagcatgattttatatgtataatatggttatagattagaattttattcagccttccacgattcttaaccctaaccagtcaattttttcttccttataaatatgagtgccaatcggaaggtgatagcatccttacgtcttgtttggtagattactaagtcaagttttattcatgaaatttccacttatcaaactttctcattttgttaaaatttaaaaccgtttttcaaaagttggtatagccatagacagaaaaaaattattacaatcctatctgatttgactcagacaccctaattagtcaaatctcaaaattagctaatattaactaacgagttgcgcattttgcagcagtacaacaaaattagtcaaaataatttaggataacagcactaatcacaggaacaggtatttttttttttcctttcttttgacatcataaagatggattcaacttatagattggtcagaggcaatctttataggtttcatgattgaataaaaaatatgagactcagtatctaagtttcaaacatgtttcatctgtgtttagttgattacattttcataatagtttattaatgacatatagaaatgcgaactatacaattataaaaaagatgtgaattttgccagatactcatccacaatatagacaagtttttaacctcaacaaatctgatgtgacatttgtcaatgtctgtggtttataacatgtttctcaatgtcaggatcacacacaccacttctcatgtataaatacacataaaagcaattggatttggtaagagggaatctcaaaagtgtgtgtctgtgagagaggagagagagaatatg

SEQ ID NO: 7372 - DNA, 3000 bp, Unknown
  misc_feature (1)..( 3000): cDNA_ID_2992570_gDNA_ID_1621142_Annot_ID_172881 3000 nt of promoter + ATG
ataaacgtggttaccaacccagaagccagaggcatctcaaatccatttgacatgagtatcacactaatgaccgtttaccatcatcactcgttctcacaactattattacaccaatcaagattcctattcacgttatcatcatcaccgatctaaacatattcgtccaggcccacaaggtcaaaacggattaatttaccgaggagatcgccttgagaagcgttttaaggagaaggacgcctgacctgacattccctaccggtctgttcttgtccatctcgctaacaacaatgtttggtccgtgttttttgtttttctttggcttagctcattgtttttctttgacttagctcattgtcaactatacataacatttgggtggtcttgcataatagttgttatttaattagaggtcagcacgtcaccgttataaacatactgtatatatattccatatctctagtattgaaataatcgttgtgactaagttgttatttttttccattaatcctacctatataaaataaaactgtatattacttgaatcacaagtcactgagagacggtcaaatctacccatttgtttttttaatctacataaaaatcttaaatcacaaaaagaaataacttcaaatgcaccatcaaacaaaactttccagatgaacttcttgtgttttagtagcatataaatggtttatcaacaaaacggtcatgacaatacaagcctggtcgttgactatacccccgtttcttgagaaacactctagcttcggaaaccaattctttgttcgtaatcttcttcttatcctttctcggcgcggacaatatcatctgaatcgcatcactgaatgctccataagcttttccagttcttgtcacataaacatcctctgatctctgatctgtttgacatccacttaatagaatcccattgtcggtaacggcattcaatcttgaagctccagaatcacctgcatcaacctcgcagtttcctaggtcacttaaacctctctgacgattcgggcttgggtcttcaccgaataatttgagaagtgtctgtctaattctcacaggttcgatattggtttgcccggtttgttccttgagaagacttaagtagctttcgaaaggtagatatcttgtttttatatcaagcgtttcgtctttctctaattctatctctcctctaaagctttcttcgccacctccacggtctctctgagattttgagactccacaagtcgctaacaaattcatcacaatgttaaggaagtaactagcaatcccgagttttggctgcttcatatggctttcctcgatctgctccttaactttatcgaccggcttcatatggctttcaccgatctgctcctttacttcctggatgagaccaccactatgacaagagtccgagattatcgtcaactgacaaccttcttttacacgtgacaccatttctctaaattgctggtctacaaacacatttgtgcaaaaaaaaaaaaaaaaaaaagattagaaaaaacaaaaaaataatcgtaaacactaaaattcataatatcgatgtaaaaccagtggtaacacaaaaacgaccaagacttgttattttcaaactctatgaacttatccaaaaacgcaaaagatttgaggtaaatcgaaattgcgatcaaaaacgtattgctctgtttcaagaaacagagcgctctgttttctttatgcagctgagggctatgttttaaccaagaattttgtttggatgaatgcgtatgtactcgaagaaagaaacatgaaacaataaaaaaaaaaaaaaaagacgtcaaacccatacaaaaagggattacttttgatctcataccctttattagattcatatcgcacggagtgatacactcgtcaaaccctgtagggtcttctgagtcttctatcccaggagggattctcgtgccatgtccactgtaatgaaagaccagaaaatcgccagattgccctgatgcgatgagattatccagttcgtcgcagatattcttgcccgtaggttgtatacatgatttgtctgtgtctatcattatgacgatgtccttgttggcgaacccgtaaagctcgattaggcatttctgcatccggtggacgtcgttgacacagccacgtaactccaccgcggttcctgggtagttgattcctatcaaaagtgctttcttcgccattgacgaatgaatgaattatacctttgttttttctttatgaattgcatttatttttcactttatttataaacgaaagacttagcatttaaactaccacgaaaggtctgaagacggaccaacatgcttgactgttattttgcctcttctcctaagagaaactttgtgtggtttgctgttattggccttttacgtctcatttttaattttttccttggtctttcttttttgagtggcggctatttccattgtcgtttttattatcaaatgttaatataactctcatgttactcttaataaaaagaaagtgttaatggactatggtctattattaaggaaaaaaacatgagtgtcattaagttaatcgtctggaatagtctacgggtggccaaaaaggaattatatgagtaggtttcattcattttaaaagagttggcattagcttgttgacaaagaaaaaataataaaaaggctggcattttctttactaattattccacatgcggttgtgaatctaagatccataaattaattcctattttaggaaactaaaattatgctcttgacttttgaatttctgtttgggtcgcacttagctgatccaaaaatgaaaaattcaccaattatcaaagtgagacaaaaacaaaacggtagtccgtagtaaatagcaaacacaatcggaatatgtaaggtccaatagtcaatattagctcaatagttaaggcccaatagtacttttaggccttttgtgtctgtaccactaaagcctccataggttcccttcgtttctgtgtaaagggcatga

SEQ ID NO: 7373 - DNA, 3000 bp, Unknown
  misc_feature (1)..( 3000): cDNA_ID_1817533_gDNA_ID_1621142_Annot_ID_172879 3000 nt of
tcaacactctaaactgtttgccaggttttagtcccgtggattacgtggaccgatggttaggtggttggaatattgatggtgaagaggagagagcgaaagtgaatgttaatcttgttcgtagttacaacaatcccataatagacgagagggtcgaaatttggagggaaaaaggtggtaaggctgctgtggaagattggcttgatacgttcattacgctaaaagatcaaaacggaaactacttggttacgccagacgaaatcaaagctcaatgcgtcgtaagtaaaatgtaacttttataaaagagtgtatgttatacacagaaattgtacactaaataagccaaacagaaaaaaaaaaaattatgttgaatactatatattgactaaattgcgagatctacacatatataatctaagtatattaattatttgttattctggtgttttttacaggaattttgtatagcagcgatcgataatccggcaaataacatggagtggacacttggggaaatgttaaagaacccggagattcttagaaaagctctgaaggagttggatgaagtagttggaaaagacaggcttgtgcaagaatcagacatacgaaatctaaactacttaaaagcttgttgcagagaaacattcaggattcacccaagcgctcattatgtcccacctcatgttgcccgtcaagataccacccttgggggttattttattcccaaaggtaaaacatatagggaatacatatgttttttatttacataagatttaacgtttatagctagtaagtttatgcatgagcttcgttaacaaaataaaacacatggttttggtttgtggctacatatgatacaacctaaatttttttgtaatacttttttgtttaaaataccaggacaactagtaaatttatacataggtttccttaacaaaatctcgatacaattttgcattatatattaagaaatattgatgattggacaggtagccacattcatgtatgccgccctgggctaggccggaaccctaaaatatggaaagatccattagcatacgaaccggagcgtcacctccaaggagacggaatcacaaaagaggttactctggtcgaaacagagatgcgttttgtctcatttagcactggtagacgtggctgcgtcggtgtcaaagtcgggacaattatgatggctatgatgttggctaggtttcttcaaggttttaactggaaactccatcgagatttcggaccgttaagcctcgaggaagatgatgcatcattgcttatggctaagcctcttcttttgtctgttgagccacgcttggcatcaaacctttatccaaaattccgtccttaaaaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggttaatgattaccgtgtttaattgaaatggtgtgaagaattaggttaactataccatatgaggttaatgattaccgtgtttataaattgaaatggcgtgaagaattagactacatgacaccaacaagaatgttttcctttatcaggataaacgtgttcacctacccaaggtattatttatttattcaaataatagatattggttatgtttcgcacacacacaacaacaacaaaaattagatgtagaaatatttcactggaattcacctttcaatgttttattgatgaaattgatagagcggagagtattcaaaactttaaaagaatagtttttttaaacagaaaatagataaaaatccaaaagaatagttataagttaaaaaaataattgaaccatagttgatgattttttttccccggatttttggaaatcaaaaatgaattgaagtgaatcaaagttgatgataacaagtgaagaccagtttaagacaaaacaatcggattctttggttaactccgattcatgatccagtttgctgctaagctaagagaaagatcaaaaatgaaattttcgggagtaactggtaggagaatgggagatggaaagccaaaggttggataagtgtataaaaagagagagtcggatgttcataaattttgtaataaagaactgcggttaaaatcttggatccctccactccacggctccactgtgtagagtaaattcttgacgcatgttcatagacatagtaatacgtgaaatgttgtgattcgctttttttcctttggagggaaaatcccccttgtatttgggatctctcatgttccattaaccttatccagattccaatattgaaatatcgaatatatatagtcgtgtatattagtgattaaacatatatcacaacaccactttacagtcacatatacatatatatttgaattaagtgttcaagtttgtaatatgagttttgtggatctagcaaataaaattgaaaggaattatatggataaatttattttgttaattcaatatattttttatggataattaattttaaaaattttactctctttttttttacggctaaaagacgtttacattcaaaatacaaaacaaactgtttttgtgacaaaactaaatcccttgaaatagcagtatagacgtagtagacattaaaaaatctatagagcttttactatcgctactcatcaaactagatataaaatatatataaacgtgattaccgtagtacctacccaaaagcccaaaccctacgtgagcatcacatgcatgatatcgattctataaataatccacacaacaaacactttccagatatcgctagtgttcatttctaacaaatgcacacctcactacacgcatacatacatcatgatgagctttaccacatcattaccatacccttttcacatcctactagtctttatcctctcc

SEQ ID NO: 7374 - DNA, 3000 bp, Unknown
  misc_feature (1)..( 3000): cDNA_ID_2169576_gDNA_ID_1621142_Annot_ID_172877 3000 nt of promoter + ATG
aacaaccagtgcaacttgatcattattgaaacagatttattatagcgttttacagcatctattgattgtaattttgtacttatcttacaataagatatatataaatatatttttttcctcacaataagattcaatctaagaatatgaatttattgacgaagatgtaaaataaatgaaactggctttttttatgaagatgtatatcaagaaatgataataattcatagaagaaaaaatgataattataaagaagtagaccctaaaataaatagttaaccccaaagtggttgagtgggggatcacatgcagcaaattaacggcggtggggaagaaggtctgagaaattaaccaagagatggctcatcctcagccattcacttagccatcgagagatctcaaacccattaatcatttaacttactgaacatatctaataaatgtgtgtttatatatgtaatgagttagacgccaaaaataaattatagactagagacatgtcctgctagctggatcctagtcatcacggtctcacgagcagtattgcatccaattttcgatcacaatatttacaaaaaattcccaccactctaaagttgtagtttattctctatatatagagtaacataaattgattggacatgcaaatcaagtcaaacataaaagtaaacaaaaccctatctcttcctatatatggccgactcgactcggccgcttctctcagatttcaactcgtccgagtcaaatcttccgccaccaagatcccttgaggagacgatagagcgatgcattggagacttcgggtgggcacagtttctccaagccgctttagtctcattcgcttggttcttcgacgctcaacaaacattcatcaccgtcttcaccgactcacaacccatgtggcactgtgacaactcggaccgagtcgactcagtatgcaacacatcctcctccaacctctgcaccttacccaaccaaacctggtcttgggacttgaacccacacgtttcaatcatttccgagtgggggctacaatgcgccggctcgttcctcaagggatttcctgcaagctcattcttcctcggctgtctaatcggcggcttagctctctctacactcgccgactcatcgctcggtcgtaagaacatgctcttgttgtcgtgtctcataatgtctctctcttccatgttaacagctttctcaacgagcatttgggtttatgcgtttttgagattcttgaacgggtgtggccgagccacgatcgggacttgcgcgcttgttctatcaacggagttagtcggtaaaaaatggcgaggacaagttggagcgatgggtttcttttgcttcacgctagggtttttatcgcttccgatgttaggttacattaatgaagggaattcttggaggaatctgtatgtttggacatcgataccgactttaatctattgctgtttagttcggagtttcgtccgggaatctcctagatggcttatcgtaaagggtcgtaaagaagaagccgtctcaattctccaaagcattgcttctaatgcaatcactatgagcttcacaaacttatgttttgaagtagaaaatgatcaatccaagtcaaatcctgatgtttatgatgcgttaaagatcttggtgaggaaaagttggtcgtttagaagattattagcggcaatggtggttggattcggtatcggtatggtttattatggaatgccattagctttaacgaatctaaacttcaatctttacttaggggttgtgttcaacgccttgtctgagttcccagcttttctgataacgtttttcttcattgataaaatcaataggagagatgcgttgatcggatttacagctctaagtggaatctctagcgctctaatcgcggtgttaggacaacaactagggtcattacagattgtgttagagctcgtttcgtttttcagcgcatgcaccgcatttaacatgacgcttatttacacaattgaaatgtttccgacatgtgtgaggaactcggcgatttcgatggtgaggcaagcattggtgtttggcggcgtgtttagtccagtgatggttgctgctggtcgggaaaatcagttttggtcgtatgggttgtttggtttgatcataggattgtgtggattgtttgtgtttggattgccggagactagaggaagtgttttatgcgacactatggacgaggaggagtataagactttggcaaaaagacaatttattggttgatacttgatactgttgtcttttgttgtaatggttaaaaagtttgcaggcttaaaccagttcggtattgattcaaatcaattctgattttaatacttataaaccacgggttaactccttacattataagtgactgtctcatctgtaccggaccataaaccaaattcaaccaaccataatccccctttcaattttgatctattcaacaatgactcatgcatactttatttcccttatctcatttccatattcgaaatgtaagctctaaaatggtactcttaactgaaactaaaatatatataaaaaaaaaaaaatctacatttcttgaagaaacatttttaaaattaactatagttgctaaattactattttagattgacatatatatatatgtagaccaactaattaacccactgaaatgcaaagagatggtctgaaaatcaaaacagacatctaaacgtggttacctacccaagagctcaccagcctatagtatcccattccctttatattgaatcactttagattatcttttctctttcatctttccaattccactctatattaaagaaatattattttaagaataaacaggatcgtattttcatcatatgccaatatgttatttggatttaagattgttttcgaatctataaatactaattaacacaacaaacaatttccaaatatcgtagtgttcataacgaaacgagcacacaactcactaaacactcaaacaaaaatacaaacattaag

SEQ ID NO: 7375 - DNA, 3000 bp, Unknown; identical to SEQ ID NO: 7367
  misc_feature (1)..( 3000): cDNA_ID_1817451_gDNA_ID_1621142_Annot_ID_172870 3000 nt of promoter + ATG

SEQ ID NO: 7376 - DNA, 3000 bp, Unknown; identical to SEQ ID NO: 7366
  misc_feature (1)..( 3000): cDNA_ID_2169563_gDNA_ID_1621142_Annot_ID_172869 3000 nt of promoter + ATG

SEQ ID NO: 7377 - DNA, 3000 bp, Unknown; identical to SEQ ID NO: 7364
  misc_feature (1)..( 3000): cDNA_ID_1817462_gDNA_ID_1621142_Annot_ID_172867 3000 nt of promoter + ATG

SEQ ID NO: 7378 - DNA, 3000 bp, Unknown; identical to SEQ ID NO: 7362
  misc_feature (1)..( 3000): cDNA_ID_1817466_gDNA_ID_1621142_Annot_ID_172866 3000 nt of promoter + ATG

SEQ ID NO: 7379 - DNA, 3000 bp, Unknown; identical to SEQ ID NO: 7361
  misc_feature (1)..( 3000): cDNA_ID_3050343_gDNA_ID_1621142_Annot_ID_172865 3000 nt of promoter + ATG

SEQ ID NO: 7380 - DNA, 3000 bp, Unknown; identical to SEQ ID NO: 7359
  misc_feature (1)..( 3000): cDNA_ID_1817478_gDNA_ID_1621142_Annot_ID_172863 3000 nt of promoter + ATG

SEQ ID NO: 7381 - DNA, 3000 bp, Unknown; identical to SEQ ID NO: 7358
  misc_feature (1)..( 3000): cDNA_ID_1817482_gDNA_ID_1621142_Annot_ID_172862 3000 nt of promoter + ATG

SEQ ID NO: 7382 - DNA, 3000 bp, Unknown; identical to SEQ ID NO: 7357
  misc_feature (1)..( 3000): cDNA_ID_1817486_gDNA_ID_1621142_Annot_ID_172861 3000 nt of promoter + ATG

SEQ ID NO: 7383 - DNA, 3000 bp, Unknown; identical to SEQ ID NO: 7355
  misc_feature (1)..( 3000): cDNA_ID_3050355_gDNA_ID_1621142_Annot_ID_172859 3000 nt of promoter + ATG

SEQ ID NO: 7384 - DNA, 3000 bp, Unknown
  misc_feature (1)..( 3000): cDNA_ID_2169551_gDNA_ID_1621142_Annot_ID_172858 3000 nt of promoter + ATG
tcaacattcaatgttttaagacaaaacatgattttgaagagaaaaggtaaaggattgagatttagattcaactttgtgaaggaagaacaagagagctaacacttacatgaaccgaatcgtactcgagagattgtaaatgtatcttctgatccccttctcgaacttgctttagaacaccaaaatcgcgcttcaaagtttatcactttcccggaaacaaaaacaccattaacgataatcgaaacggaaactgcaatcagaacgatatagttatgatggaactaagcacagtcagagagaaactcaggattctggcaaggaagagaggagacggaagaaacaggcatgagatggatagatccattataatgggtcgaaaatttaaatattctttattgatcccttcatttatatgttctttctgcttcttaacgcatactttcttaaataactaatttaacccataacttttccaagataacaagttaaaaccgcgtcgttttatttcagcttcgtctttatctcatctttcttgcgacgggccctgctacccggtgcgtgacaggttgaatcattctcctccgattcacggtgattccggcgactacagactcaacatttaataagccgatctcttacatggtacgagctcggacaaattgaagaatacaaaggtccgagaaataatttggtaagcaattcgatcctttaaacgatgttatttttgtcaatccgagtcattgatgagggattatatctgttactgaatctctctgatcttcccctgataatggacttcatgatcctgtaaatttcagattttgagccttgtgcctcaaaattgtagtcaaaggccgcgtttttgtctcaatttgtagatctttgttgttgtttctgttggatcttacgtatatatccttgatcattttaaaatttcaatggaagtgatccaggctttgattagcttttaattatataggaataatggcgtcttcatcggattcatggatgagagcatacaacgaggctttaaaactctctgaggagattaatggaatgatatcagaaagaagttcatcggctgtcacagggcctgatgctcagcgtcgtgcttcagctatacgaaggaagatcaccattttcggtaacaaattagatagtctgcagtctcttcttgctgaaattcatggaaaacctatgtaagccatttactagtccaatcctaattgcttaaatctgtaaattagacacctttaaggttagtgttaatctgaattattacttactgacacagttcagagaaagagatgaatcggcgaaaggatatggtagggaatctgaggtcaaaagcaaaccagatggcgaatgctttgaacatgtcaaactttgccaatagagacagcttgctcgggccagatatcaagccggatgattccatgagcagagttactggcatggataaccaaggaattgttggatatcaacgacaagttatgagaggtaaaacctctcttatcctagtaaacgtaatacagatgttgatttctgtatttgttttttcctattgaatgttttattttcctgtgagtagaacaagacgaaggacttgagcaattggagggaacagtcatgagcacaaaacacattgctctggctgttagtgaagagcttgacttgcagactaggcttattgtatgtcactagcttttcattttttcgcctttgatttgaattttcggatactaacacatttggattttcctttatgcaggatgacttagattaccatgtggatgttactgactctcgcttaagggtaatatatgcttcaactcttaaatatttcaacaaactaattactttggtgaatcccaagctttagttgatccatactttcattaggagtaacactgatgtaatggtgatctgttttcggtttgctcaaccaagaaccacattatgcttaagctaatggctaattaaagacattgatctgttatcttattacagagagtgcagaagagccttgctgtcatgaacaagaatatgagaagtggttgctcttgcatgtcaatgctcttgtcagtgctggggatcgtcggtcttgctgttgtaatatggatgttggttaagtatatgtaataccaacatcagacaacttataagttcctctgtaggtccactggcctctactctctatgtgaatggttgcaatgtatttcctcattccacatttgtggctgagcttttcatttctcttctgttaccaaaaccctttaagtaatatataatgtgtgcagttatcacagtttgctctttgctgtcttcataaagatttaagaagtggtagcaagtcaaacacagagacaaaaaaacaaaaattatctgtagaatcttccacgaagaaacttgtctgagtttgttataagaagaacattgtggaaattttgtaaaacaccaatattcatatcatcatcactggaaacaaaattcgcaaaatacgtatctgatccttcattttatacatgtgtactgtttcttaatctctacatttgtaagaggcaaaacaagagatagtgtaatgcatgttcctttttttatttcgccaagaattgtcaacgtaggcctacctttctacgatcatataagtaatggtctcgtatttagaagatgtcttctttcgaaggaaactgccgtctggctgcgtggctacaaagtcagcactcagcaagttgatctctttctcaatgacaatgatgtattatttaaaggtccttggtgagcaatttgattctcttttagagatatatatgttgctgaattgctccgatcttcctttaatacatgtgccaataccattatcgaagttgttgcttcttgtaagctagttggatttttgttgttcttattgttgcatttatatacatccttggtaaagttaaaagttgtctgaaagtgatctgtattggatttttgattatgtaggattaatcaaagtcaatg

SEQ ID NO: 7385 - DNA, 3000 bp, Unknown; identical to SEQ ID NO: 7354
  misc_feature (1)..( 3000): cDNA_ID_1817494_gDNA_ID_1621142_Annot_ID_172856 3000 nt of promoter + ATG

SEQ ID NO: 7386 - DNA, 3000 bp, Unknown; identical to SEQ ID NO: 7372
  misc_feature (1)..( 3000): cDNA_ID_2992570_gDNA_ID_1621142_Annot_ID_56666 3000 nt of promoter + ATG

SEQ ID NO: 7387 - DNA, 3000 bp, Unknown
  misc_feature (1)..( 3000): cDNA_ID_2991367_gDNA_ID_1621142_Annot_ID_56670 3000 nt of promoter + ATG
aagtaattgcataaaacaactacttgagacttcattttgttttaccttcctgttcaaactgcttcttcagctcctctgctggtaacagtgtttgagaggaatcaaacatctacataagaatatgttatcatatatctggtttcaaagagcagatataacggtaagcccttcaagttagacggtggcttactaggggaaaagggacacacttgctaccgggtatatgaccactcggtaaacccttccaaggttctggagcaataccgtcaaatctgtgaaacagagtaaattctatatcagatcctatgagcggaatcaacttaaaaccattagcatattatagtgaaattacaatccagaacaagcaataattttggcatgatacctagcctttgaacgcgcatcgatgtgctgataagtcttatcctcgatgttttccttcacctgtcaattatccagttagctcccctagtttactagcaactatgtataaacttcatttaagaaacggtaacctgatcaagtgccaatacaagatgtggccggaacttcgtctgaaaagttattgggctaatctgtgcaaatggcaaagatgtgaataaaccatatgtagcaggtaaaccaactaaatatgcaattttcagatacatcagattggcaaaaacttttcgatgaatgaatcaacttactgtttgtccttgatagatcttctctatagcctcagttgctgcactggctttcaaaatggcatcatttgaaacactggattcaacgtcatagcctgaagcacgccatttcggcaagcctccatcaagtacccatactttgtcatgtccaaagactctaaacatcctgttttaacaaaaggaggactcatcgatttgataataccagagaaaacatattgaggaatgataaaaaggctaatggacatgagattcataactcaccaccatacacgagctgcactaaagagccccattccatcatacacaaccactccatcgttgttctcgattccaagagcagaacaaccagcagcaaaagcttcctcagatggtagcatgtgtcgtaactgcacatgtaattcaaataatatacaatactttttggttgttgcgcatacagacacatagaagctcacagccagaaggcttgccaaagctattaatgggaatctctgaacagaaaagagtccagatttttgcgtcaaagaaacaacaatatgttcaaatgactgcaatgaagaatagttactgataatatttcatttatacatataagcgatggcagtgtaaactgtaaagtcaataagttagaaataaacaacacaataacatcttctcaagaaaaaagacagtgattctcacatttgtttttcgatctgctattccattcaaatcaaagaagagagcacctggaatatgagcaacctgtagacgaggacaacatacaagtcaatcaacattcagtcgtgtagtgaccctgatgaaaagtttcatagcgctcattcagaacaaaggcttatagcttatttacgtagttatttacaaaagtgtaaatcttctcacttgatactcttggattggatttctttgctcatgtgccatgtaccatgaggcatccaaaacctgaccatgaaacaaacaagttacataagaatcatggcagaaaaaggctacaatctcaacaagtgcaaactataagcattctgagacgaaaataaacacagcaagaacgtcaggttacctttatatcagcatctccaagattagagtggagccaatcaacagacacaacaggttcattggtagatatgggtgcgtaattagcttttgcctcagatccagaagaagccatgactcgaccaaagtgagtagatttagaagctggataggcagagcgtaactgtgagctgaatgctctcttctgcaagtaatcatttacaatctcggaattacaaaacagaagatataaaaaaatcgaaactttgaacacaattcagtagagtgaattatacaagagaaagttaaactcagatttgaatcatgtgactcagatattatcggatatctacacacagctaactataactcccaatgtgaaacctttctaaactcgaaagcccactactagtagtacccaaattatacaaacaatttaaacagtaactagaagtgaatatctaagctcagagaaggtcgaaatcgaattaagaaacaacttaaattcaaaaaggttgcgcaattacgagtcttgtgatgaggaacagcagatagagagggattaatctggcagtgaccagaaaccaataaagttgttgagaaaagtgtcgaagccaaatcacctcaaaataccatgtacagaacaaattgctgagttaaagccgccaaattttgctacttccagattctctgagctcgcaactttttcaagcttcttcgttctcaacgatgctgcttctgccacctagatgattaatagattatcactgatcactagtgatcaggataagtgacgcgactaacgcatgtttaattatataaaattcacgtttgccttctctttgatataattcgcgttcgcgttctctttattaaaaatcgcgtttctgataaaacgcagtcgtttggttttacttcccttttcttcttccagaaaagaattcgtaaaatctcacttcaaccttctcttctctgcaagaaacctaaaagcctatttatttcacctctctctctctctctctgcaactaatcacttgttcgatctcgaagctgaagctaaaggtaagctattctcttcacagcgctagttcttttccgaagattcgtgtcgatctcaaaaatcccattctatcaaattgtttttaagactctaatgatttaaccaaaccaaaacctgaatcgtttgatcccggtgacgttgaaaccctgaattccggggaaattgatcctactcgtttgtgttgttcacagctttcgctaatttgcttaaggagct

SEQ ID NO: 7388 - DNA, 3000 bp, Unknown
  misc_feature (1)..( 3000): cDNA_ID_1817513_gDNA_ID_1621142_Annot_ID_56671 3000 nt of promoter + ATG
gatgtgtttcgtcatatcttgtttggcatatggaatataaatcatactattgatttggaatctttaacttaacttcctattaagtaagcgattgatgctgatatgtatgtttctttagattgatgaacgtaatattaatcagtagtggatatacattgtatctttagaatttaggttagtatattatggccaaaatgactaaattgagtaccataaactaaagttaaagtagtggtaaaagcttacgatattgttttataacaattttcaaaaagtaaaagatatataaatgttagaggttttggataaccatattgttctataacattttaaacatatgtcatatatgtttcgtttataatatttatgacttgaccaaataatttgtgtatgttatttaaatccaaatatatatgagaaatatatagacgacatgattaaaattatttaaaagagtcatgatgagagggatggagactaaaaaaaagaggagaaaaagatagaacgtcgagaaatgttgtgtgtgtataaagtaaaggaaagctaatttgatcattgtattcgaagaaaacaaaaaagtatacacatgttacagggttataggacccattttctttaaaataaatccactatggactgatgtacatattttttcttactgttcttaagcatgattttatatgtataatatggttatagattagaattttattcagccttccacgattcttaaccctaaccagtcaattttttcttccttataaatatgagtgccaatcggaaggtgatagcatccttacgtcttgtttggtagattactaagtcaagttttattcatgaaatttccacttatcaaactttctcattttgttaaaatttaaaaccgtttttcaaaagttggtatagccatagacagaaaaaaattattacaatcctatctgatttgactcagacaccctaattagtcaaatctcaaaattagctaatattaactaacgagttgcgcattttgcagcagtacaacaaaattagtcaaaataatttaggataacagcactaatcacaggaacaggtatttttttttttcctttcttttgacatcataaagatggattcaacttatagattggtcagaggcaatctttataggtttcatgattgaataaaaaatatgagactcagtatctaagtttcaaacatgtttcatctgtgtttagttgattacattttcataatagtttattaatgacatatagaaatgcgaactatacaattataaaaaagatgtgaattttgccagatactcatccacaatatagacaagtttttaacctcaacaaatctgatgtgacatttgtcaatgtctgtggtttataacatgtttctcaatgtcaggatcacacacaccacttctcatgtataaatacacataaaagcaattggatttggtaagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggtatgtctatgatctttaaaagcctctttctttagcttttctagtcttctggttctgattctatctatgcatgcaatgaaggattgttgaggtgtggcaagagttgtcgtctgcgatggattaattacctcagacctgatgtgaaacgtggcaatttcagtgcagaggaagaagacaccatcatcaaacttcaccagagctttggtaacaagtatgtgttatcttgttaatgtcttgttgtgggctcaaagttttgattttgacaatagcttttctgcattttggattcaggtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatcacaagctaacaagtaacaaccacctagatttggaaagctgacagatgaaaattgattcatcacctaacagtttctacataagaacaaacatagacttctcttccaaaatagatatatcttcagccaagagagtaaaacttgaagaacgaaaatgttttagctttcacagattctgatgaatacatcgattgaatcattcacacagtttcaattgcaaatgctgaatttcaaaggaatcatttttttttgttttgcttttgtttgtttctgtagatattagattcacttacgctacatctgagttctcaaccatg

SEQ ID NO: 7389 - DNA, 3000 bp, Unknown
  misc_feature (1)..( 3000): cDNA_ID_1817506_gDNA_ID_1621142_Annot_ID_56675 3000 nt of promoter + ATG
aattggtcaataggttacagatggttggatgaaatctctgcggctaatttaagttcaatattcttgaagattacacgaccaagaagtcaaatagaatagtacaggaatgatatatcaatcgagtacagcgcgggcccttcgtttttgtcgattatttcattataatgaatttctttccatgataactttatgttttgttatctgtttaacgtattttttgttgataaaaacgtttttttttttacgttattaatttttatagtttatctgcccgacaagaattgtaagttcctcaacattacaaataaattttggttagtttaaatgttttaagcacttcttgtctcctaaacgttatccgcatgtttcaaacgtacaatataattccttcttagaaaaaaaaaatcaaatagatacaaggatataaaagacatcgaggcagaaacaaaacatcgaccaatttcggagtcacactagacaagttgttcacgacacacttgtccccatgcgtttttggatatttctaattcgtttttaattaatgaaaatgttacattaactaaacggcatgtttacagaaaaaaaaaaacaaaataaaacgacatacttatttaataattttattaatgttcttcagtacgactttccaactatttccatatttttctatataaataaatacacacaaaaattagcgatatttatagaaaagagaacagacaagtttatgaaaatcaaaagaaagaattttatttttggtttaaagtttaaactgacgtgtgattaaaggtattaaagagtggcaggtgggtttggttgtacggtcatttattcatatagagtgtgacccaccaactctctgcctgtccttcttttctcttacccccagtacggatccttcttattttatcattatttattttgcattcatatcttaaagacttaaaccttgacgtcacttacggaagccaaaaaaaaaaaaaagacactgaaatctgatgaaagaaaaacctgaaacctaaaaaacatatgaaggcctgtcggctcggcctcaaatcattgcgatttatcttgggccttcacaataataaaggcccatcatatttttgaataagactctagtttctgtattcgtttgtactcatgtatacgctaactactatatacactgatacacaagttaagcaaatgtgaaattaaaatagataaagaaacaaaaaataataaacgttaccaagaagaaaatgagttggtggtgattaatttgcggctaattttgggggaatataaaaagaaaaaattaccgtattttaaaaccggtctatataggatcgagcttgctaacaccattttagtaagagtcttgattggttcgctttaatttttcatttttgtatctgactgccgcaaactaagtaatatcaacactcaaaagtcacgataataaacattataaaaccttttcttcgctgtcctacgaacgtaccatattacttgattccgaaccagacaatattagacagacaaccaaactaacacaaatcattattctataagctgcggtctaacctactattcaaaatttagttttacttcacgtattaaagaaaggtacgaataacagcgatgagactggattttttttaacatggtaattaatataacgataagtacataattaaacaatactacaaaataaaactaaaaaacaatttcagcgacatctttgattacagattctaagaaaacaccagagaaagttagattaaaatctccctgagcttgttgtgtatcactaaacctcataaacgatgccgttcttggctcgccgactcgattatctggtgagatattctggaaaatagcgaagaatctgagaaagacaaaaataatcagagcaagaagataacatatccgagatgcgttgaagaacaagtgatatgctgcaacttgaagacaatacatctttttctcttcttcttcttgtctatttcgagtattaaaaggttaaaatctcagaagatgatgtttttttttcttagcatcgagatgtgtgtatatataatagtatacgtgtgtgtgtgatgtttgttgtgtatatatgtaatccgtaatcgcatgtacgcgtgtatctaacgcacacagacaatcagacatactcgacgacaccactgtggtccgaacaaagcaataaatgttcaaagccgatagttgtctctcattgatttggtactgtagtccggtttggatggtataccaggcgatacaacctattacctaagtggaggagattaagatccgattaattgtttaatcgtctgaataattaatgcaaaccggaaaaaaccggttatatgtttatacatgtaaggaaattgaatacacgtagatacgaaattgatatgcatttcaatacgtgtctggtgattctgctcaactgcttagatgtagacatctcaacttgtaaccagaagatactgaaacctttattattgcatttctaaattttagaattctattttcttatatactatatggaatactttaatgccacataataataaatgagagaattcaggtcattatatgtcattttggagtgtaggaccaaaatggcactaacattttcaattttattttattttgtgaaaaacaattttgagaaactttaaaaagtgtattttttttcctctggtttggactttggagggaaaagtaatcaaaagtgtattcttaaaattcaaacaagaaaaattcaaaatagagacaggaaaaagatatgtagccaatgataaaatgccaggtgtaaagttctgttttgtctttttgatttcccttctgcaacaacttacaggcaatcggacaattccagagctaaaaaaccctaatcttctcgggcttgtcatctccaaaattcagggttcaatttcttcaccatagaagatatagcgttatctccggcgtctaaggggactttagggacattcttgtggtggagaa

SEQ ID NO: 7390 - DNA, 3000 bp, Unknown
  misc_feature (1)..( 3000): cDNA_ID_2992592_gDNA_ID_1621143_Annot_ID_56680 3000 nt of promoter + ATG
ctggaaagagaaagttggtttggctgaggaagaacttcacgaagaagcaattaaaaaacgttttgtgaataattatataccacacacttcacgaatgagtatcaatgagtttacacaataattattttatttttatctagttatgtaaaacaataaaataaattataatttgaaatagaatacgatcgcgttaagcgtcaactaaatgttaatatatattagtctttttgatattatttttgttaattttagaattttgaagattatgtgctaaatttgatatcaaaatttatttttgtgctatttgtgagaactgacttttttattcaatgtatgattaaacgtagaaagcttgttaggattgcaaaagtttaatattccagattttctcatctaactaaaatttgaaattaaaatttctgattataaattttattattagtaaaacgttcatataaatttactgatatattgtaagaaagtacatgtagaaaataattagaagaacattttactgtattatttgggaagtacattttaaatgtaaccttactttttgtaagtaattatataggtatgccattaaaaataaaattttaaagagtaaattaatttataaggattaaaaagtcaaatactaatttaattaattaaatttaattaaaaaacgaaatatatttttaattaacaaaaacaataaccaatcaaaatcaacatataagatttgatatctaaattttaattaatttaatttaattacaaaaacgaaatacattattaatttccaaaaaagtaaccagtaaaaattaacaaattagatttgatatctaaattatcatattaattttttattaattattatagttcacttctcatctttatatgattctatttttgcgaaaaataatatcatcattataaaaaataattagagttttttcgcatatgccataatttgattttttaaaaacgaatataaactgttcaatacatgaaaaaatattataacgggtgaaaatagatttaagaaaactttctactgagtaacgggtcataatttgaaatatttatattcaatttcatacatattatattgaaaatttataatcttatatactacaataattaaaaacatattagattttcttatatgtatgatgtgattcaatttttaatacaagctggaaaatcttagaattgacgggtttagatcgatattaatacaagatggtatactacaggtgaaactcttaaattagcaatcaaactacaagtgtataatcttaaacactaaacaatatacataatattaacaaaacatatacaactcacagtttaatatacatttaaaatcaaataaaataatatcatatatttttaaatcatctttacaataaaagtttttagtttaactaaaatataagtctacctgcggtatacagcaggttaatatctagattatagggcttattggatctaaagatgggtcatcaaatatttcctaaactgaagcaaaatatattgaatattcaaatatctatctgttaccaaattataaacaaataagttcgtaaaataatttaatattttatatacgaaattaattaaatcttaatcacataaaaattagcaaaacaaaaagtattcaacaattaaaaaattatcaaatctctgtgttatataagttttgatactatattcgaataaaatgtaatatactttttcaatttgtattctttaacaaatttaagctaactaatatatttgcttttttggtggatttgggtaaaagtgcattcaggtcatatgatacattttcctattgaataaatatggtgcactcctatgttattagttaaaatgtttagattataattcagagtcatatcattaataaaattaatattaataaaataaattgctttttggaagacggatttgaagggacgggtttttgaatcaacattaataaaaaagtaaaatataactaatccaccgtttcaatacgggttaaatctttaatttattattttttaaaactactaatattaaacatatcaaatcatcctaatttagaaaagattatataaaaccaaaaatgttatgtggtatgtataatattactatatataaaattaaactataaaatataaatgtattagagaatgatacaatttgcaaagcttttatatataaaaaataattcttaaattttaaaaattactactttaaaaaaaaaatcatgggacgggtaagaaattacataacggattttattttagaattgggttatatggtggatgtatttgaatcaatatttataaaatattaaaatattattaatatgatgttttaataggggttaaaacttcagttttttaacaattgtctcatggattcgtggtataacgttacctaataacaattttaaactgtaaaatattaatattttataaaattaaaatttgcaagttttaatatattactttaaaaaaaaatcgtctcgcggtataccgcggtttaaaatctagtaacaaaatatttgaagtacacactaaaccaactcagtaatctaattaagtaaatacagaatggacatattttttgataattttcaattattattaaaattcttcagtaaacagatttttaatgaaaaagatgattagatgatgttttgacggttgaaattggctataggttatatagtttagatttgttcagattgataaatagtctaaaaaccactttgaataaatattaggattgggccaagcccataacacaatattgggtcagattttagtacatattatgggcctatgttagcaagatatcaccgagtacgtagcaacttagattctaaagtctaaactaaacaaaatcgtaaataaactgagaaaaagcctccgtctcctcctctctctctattcatcagcctcaacctctctttcgtcgtcgactcagtttccgatttagggttacccaatcttcgccatg

SEQ ID NO: 7391 - DNA, 3000 bp, Unknown
  misc_feature (1)..( 3000): cDNA_ID_1807729_gDNA_ID_1621143_Annot_ID_56682 3000 nt of promoter + ATG
tcatcttctggtgtatagtgtaggtgtgttattgtacccggattagctaattggagaagatacagataggtcggcaaaaacctgtaatttgctatctcatccccccttacattttccactgcaacctcttttgctctccaagcggtagaatatgaaatccgcacattcagatcatttaggagcagctgtggtaaatcgacagctcgcggcccaccctgcgtagaactgtatctgctcctcacaacttccccgaggaacttataattagcatgtttattgtagttcttccgagagtcgatgttacacgtatgtgtcgtagcatacgaagtgattttgaaactttctgaatccttcacgacgcgagcagtcaattgccatggacaagtctcatcaacgcacaccatcttcaatgttttaggacatgactgaggttgcttgaagcaaaagcattgctttatcgcttgaagagacattgtttgttgcaagacttttctattcttaaaaacacttccaacaaacaaagtttcgcctgtggtgctgatttcaacctgtgtctcatcagctcaaaaattgagtaagtcatcgaacacaggagcagcatcgttaccgagattcgccaactcgccaccatgtaacttaggaaattcattatacacttggtaagcctcagctgcggtaactacaccattatcattcagtgtcccagttgaggaagctccaataccgtcgatcacttcatccccggtgacttcgtctatacaaataagattggaatccctttgcccttcgcagcgtgtaccgtaacccaatggagaaattgtttctttgtcaggtacattaagaccagtgtacgtacacgtttccaagagacgactgaattcccctgtatctccgccaggtacactaacacccgtgtacgtacacgtttccaataaacgactgaattcccctggatgttgagcagtctgttgagtgagactgacgtcttcctcaagatttccttgtacatattcttctactattacatcgttccacttgttgtaatcgtatttttcgccaataccttcactaccgtctgtggtaggatacagggtacttcccccaatagatccatccacaccaagataatcatcacacccatcatcatcttcgttgccctcctccacttcatcctcttctgttgtatcgtcttcaacatcggcttgctcctctgcatcctcattattttcatcaacatttgtagcactatcaaacacacggtcactttcagaaacttcaccatgagacctagagacagtattcccgaacgccttcactgtattattgaaagagacgaacaagttgagagaaagatacccaccacgaaccaaaaaaaaacgtttcgagacccatctgactgtcaatgtatacaggagggtgtttagtatctatcagcactgacatttctcccagcatccagtagctaattatgggattgatctcggtggacttcaaactgaaagcctctcggagtgtacggacaaagtccgtgtacgtcatggtttcctgaacgcgtacacaacgaccaaagatgccttccttaggttcaaatttccattctccttctttgcatttccactcaccgaccatagtaaatacgggaatatccataacccacctgcatcataaattcaggagacacacattaaatgcaactgaaaaatactatacatataaaaaacaaatggaatgtcgatactacacatttataaacctaaataccaattatcatttgactattttaaacaaacaaatatagattttgcaaattttctgataaaaaaatggagttcgaacacaatcaagatcctaatatgacataacaaaaaacttcttaaaagaacttcattacttacacgagcaatgcttgttttggctccaaacttggtacaaaaacaagatcaacacttcttcagcagcaatgtccgttctcaataattctttgttcttgggttcatcttctttatctcaacaatttttttattaattattatcaataatttttttaatattatttgatgtaatgatgattttgcattaattgtgacaatagtcacatctaaactttttgggggcattaaatgttgatgtcacttcggaataatggaaataatctcacttgtaacggaaccgaatcgcgtcaacgtgaaacaaaaaatctttaactgaaccggaacagtgtacgtaactaaacctactaaactaaaccgtacatttcaacaattactaagagagaagcgcaagggcagaaacgtcattttgcagacgaaaagacaaatgatgaaaaccacatttgactttgacaatccatggaaataaaacatggtcaacgggtgtgacctacaatttacccttttttcaaccttcttttgtcatccatttaagaaattttggcaaaacgttttttttttttgtgggtgagaagcatattctatattttttttgtaaccaaaaatgtttaatattgccatgtgacaaataacagtaactaaccttatcccgaaaatggcaataaatatggaaccattacccaccctcaattattgcaatttactctcctccaatcatcctccactcaggtacgtactcgctctctcttctctatctaatttcgatttttcttgaatatttttatccatccccaaattctgtgatatcccctactaaagtttaagtatgtaataaactttcaagcatttatgaacaaatcaattctgtggctatgttgatatcagttgcacacacataataagctataactgtataattaatgtttactctttttatgattttgatccattacattcctagagagacgtttttatgttcattagtaaccaattaaaaaaggataaaagaatttacgttttgttataattttcaagtgtataaacttctaatttggatgaatttgtgtaataattttcagaagatatcaaacggaattcaacggccacgatg

SEQ ID NO: 7392 - DNA, 3000 bp, Unknown
  misc_feature (1)..( 3000): cDNA_ID_1817565_gDNA_ID_1621143_Annot_ID_56684 3000 nt of promoter + ATG
cgggcagctaaaagaggtaatgaataaaccatgactttgttattattcacttggttcttatgaaactcgtaaaatttttgtttttaatggaaaatgaaatgcagttttcagtggattatccgaatgaatatatcacagccgttggtggaagctacgacactgttttcggttacggatcagcgttgatcaagtcattactcttcaaaacctcttatggaagaacctctccaatccttggtcacacgacattactagggaatccagctgggaaagaattcatgctcgagtccaaatatggaggaaagcttcttggtttccatggacgttctggtgaagctcttgatgccattggacctcacttctttgctgtgaactcttctcttaagcactttaaaccgcaaggtgggaatggagggagtgcttgggacgatggtgcttttgatggtgttagaaaagtgcttgttgggcgaaatggtaagtttgtgagttatgtcaggtttgagtatgcgaaaggagaaagaatggtaccacatgctcatgggaagagacaagaagctccacaagaggtatcttcatagaaatatttgtgttgtttcttgtttactaagattttattggtctcttttgactggataaatttttgaatttggttgtagtttgtagtggattatcctaatgaacatattacatcggtcgagggaacaatcgatggttacctttcgtcgctgaagtttacgacatcaaaaggaagaacctcccctgtttttgggaatgtggtcggtagtaaatttgtgttcgaagaaacaagttttaaacttgttgggttttgtggtcgatccggtgaagctattgatgctcttggtgcacattttgcccctcttcctgctcccactccagctcccgcgcccgcgcccgcgcccgctccagctccagctccctcgcccgctcccgcttctgcgcccgttccagctcccgcacccacgcccgctccagctccagctcctcctaacaaagtggaagctctaggaggaaatggtggaacaatatttgacgatggtgctttcgatcatgtaagaaaggtttatattggtcaaggtgattctggtgtagcttatgtgaagttcgaatacagaaaagatgggaaaagagagacacgggagcatggaaaaatgacagtgttaggaacagaggagtttgaggttgagtctgatgattacatcacatcaattgaagtttctgtcgacaatgtctttggttttaagagtgaaatcgtcacttctcttgtcttcaagacctttaagggaataacctcacaaccttttggaatggagactgagaagaaattggaacttaaagacggtaaaggaggaaaacttgtgggattccatgggaaagctagtgatgttctttatgctcttggcgcttatttcgctccaacaacaaattcaactacgccatcgactccttctacatctaagaaactacaagcaagaggtggaaatggaggagcttcttgggatgatggtgtttttgatggtgttagaaagatacttgtaggtcaaggaaacgatggtgtagctttcgttacgtttgagtacaacaaaggctctcaagcaatcctcggtgatcgtcatgggaagcaaacattacttggaactgaaacggttctttcttctctccagtctgtttctagtttcacccaaaatttgatttcttgacctaatgttcctcctcttcttttcttttgtagtttgagcttgattatccaagtgagtacatcacttcggtagaaggttactatgacaaaattttcggagttgaagctgaagtggtgacgagtctaacgttcaagactaacaagagaacgtctcagccgtttggaatgactgctggggaacatttcgagcttaacgaggacggttacaagatcgttgggttccatggcaaagctggtgatttggttcatcagatcggagtccatgccgtgcccattttcaccaattacagatgtgttttctagtttctttctctgatgattccgttaaataaggtccatggaccatggttatggatttgtgtgtgtttcactgttttagtgtcaatgctttatgcgatcatgtgatgttatgccttcatggtatttgatcactaataaaggatttttcttgtcaatctctttttagatttttgttaaattttcgcatatgaaaataaaaattaaaaaataactcatttttcaaaaacaatatttctaaaatttcaatgaaatattgcaaatcattttgtttgcattgacaactccaaacctctttgaacaagcgtgggtctatcacaagttatttgttgcgacgccatacataccaaacctatcaatatccagaagaaaaaaaaaaaccggtgttgtgtgaactccttccatgagttccactcttttttttttgcagcaaaaatggtccacaaaaaattgttgtttctttctcaattttttcaaaagaaattttcacagaagtggacgaaaaaagatttgctttcaccgtttgtcaaagtgagaactggttttcacgttttgtcttttcattcaatttcggaccaaattactctgggaaaacttaataatggcacaaaccaaactgtgcagcagttcgtatcggttaagttgacgacgtaaaccaaaccctacagcagttggtttcggtttagttgatgcggttcagttttgaaaaagacaaaaaaaaaaactgaaacgaagaaacccgaaaaaacgaagaagagaagagagtaacggagagatttgagagagaatcagaaagcgaaacgaaattcagtatccattgcttcaaaattcgacataactttgaattgttgggtagttgaattgagccactgaactcccacatccggggaagtgaaagttactgtttttcccggcgaagccaagagaaagttactgtttattccggcgaaatttgaacctccggcgagatagcatctttagctatg

SEQ ID NO: 7393 - DNA, 3000 bp, Unknown
  misc_feature (1)..( 3000): cDNA_ID_1839138_gDNA_ID_1621143_Annot_ID_56685 3000 nt of promoter + ATG
aatggtgactgagaagaaattcgaacttaaagatggtaacggaggaaaacttgccggattccatgggaaagctagtgatgttctttatgctcttggtgcctatttcgctccatcgacaacttcgactactccatctactaccaagaagctacaagcaagaggtggtaatggaggagcttcttgggatgatggtgtttttgatggtgttagaaagatacttgttggtcaaggaaacgatggtgtagcttttgtcacgtttgagtacaacaaaggctctcaagcaatcctcggtgatggtcatgggaagaaaacattacttggaactgaaacggttctttcttctctctagtctgtttctagtttctccaaaaaaaaatatttcttgatctaatgttcctctttttgtcttttgtagtttgagcttgattatccaagtgagtacatcacttcagtggaaggttactatgataaaattttcggtgttgaagctgaagtggtgacgagtctaatgttcaagactaacaagagaacgtctcagccgtttggaatgactgctggggaacatttcgagcttaaagaagacggttacaaggtcgttgggttccatggaaaagcgggtgatttggttcatcagatcggagtccatatcgtgcccattttcaccaattacagagttgctatttaggtttttttcttctgatgattccgtaaaataaggtccatggaccatgcatgcttatggattagggtgtgtgttttagcgtcaatgcttctatgcgaacatgtaatgttctgcattcatgtgtcttatcatcacttgtcgattttaataaaggatgtttcttttttatctcttttttggtctttctatcataacttggaagagccactgatggaacttgtgcagttttaatttcttgcgacgaatactttgaacgataaccaatactaaaaatcacaacaaaaaaagaaataacatttttgatcatttgttaactggtaatttttttcgaaagaaacaacgtgtaaatctgcttcttacattctattatcctgtgtggggatgttttagtgtcaatgatttatgcgaacatgtaattttctattgttctgccttgctggtgtcttgtcttgtcacttgttgatttttcatagaggacgtttcttttcaatttctttttagatcttggttagtttttgtgtatgttttacatctaaaaaactgcaaaaattgatgtcaaaaaaaaagatgtcaaaaaaaaaactgcaaagaaaaagccatatttttaaagtatttatatttttagtttttcataaaatatgttcttaaatttcaaacgcctaatgggaaaaatgttttatttgctgcaaaagtttattcataaaataagtaacagaaaatatatgctgaaaatgttaaatgttgttggttaatattttaaaaaaattacacaccaaaagcatcatcagcgaaattagacattcacttacttgaagcgtcaaagggttaaatgttcgaacccttcttccttcatatcacttgattttaattttttctttttttcttgcttgtaacccattaaaaccagggccactatgttctggcttaatgtcttgggtaagatctttctagttgtacgggccataaaatccagtatcacacgcttttgatggccatgacccatgaggccggtgatcgggttaccttgtgccgtccgtttgactttgattgatgatttcttagtcgaacatatactggccgtgtttaatatattggtatcatatacttcttggcttgaacagtggccgtgaagctcactcactatgggcgctatagagtctgaccatgtaataatcctttttctagggacccgaagcttttgctgtcttgcttatagaacaatttcgtcgagatttatcgacgtgtcgcaaccagattgatagacagaaattcaccccaagaaatataggttttaatagactggtttagttatattgcaaatttccaaaaatatgcgatgcataaatttttttgatggatattaaaaaaaataggtgcctattgatttttgttactttttggttggtataacaaatgtatggtttattggctttatatttgttagttggaccatgtgggaagcatttctctcacgtttaaaaaggaatgtaaccgtttccttttcaagaatttataactcctctcattgtcacaaagaatataaagactttgtctaagtgaggttttcactttcacattatataagaatttttttactattccttgctatcactatccacaaactcgcaagttactctctcattcctcatcgtaccctctttactcaggttactatgtctcagtctcacttctttttttgttttactcgagttttcttgagtattaatcagcgaaaaaacgtattttgaatattttatgttttgtgtttcttctctaactagtgactacttctagatttcaaagaacttataaacaaattattatattattttcttttttctttccaattttgtatttcttccttcttaacaatagctttaagctaggcttctttttctctttataacgtcaaaactgattagtttgttaggaaattgcagaggcaaattaaagtaatgatagtgtaaaccatgaatttgtcaaaatccagaaattttttctaatgatttcctcttgttaagtatgtaaaaataataattatgtcaaagactcaaaagaagacaaagatctgaaaaagtatttcctgaatcatggaacctgagaaataatattcaacaaaaaaagtaattaattatctagggttataacgttttttgcttcacagttgtgataagtaaaaaaaaaacatagtttgtgttgcttcctcttattctgtttttcatatgaggagaccattcggttctttgtttcttagtgtgtttctatgaaaacgtttccatctttcaggtattttctgaagttaaaagatagaaataatg

SEQ ID NO: 7394 - DNA, 3000 bp, Unknown
  misc_feature (1)..( 3000): cDNA_ID_2152269_gDNA_ID_1621143_Annot_ID_172911 3000 nt of promoter + ATG
ataaactttcgtttatgtttttagaaagtgttatttttttgggataattgtaaacttcgaacgatggataatttaaaaatgaatagaaattgtaatgtaaaaaaacacacgaaatcagtgctttttgtcttaattaaaaagaccagcttgcaaagtcacgcaacgtcgaagctctaactttctcttctaaaagtggcttactttggtcgcaaagacacaaattttaaggaagaaaaaaaaacaaaacaaaagccagataatttacttgggagaaataggttcgataattcgattttttcgatgaattagagtaaccttgggagcaaaatgcgaccacgcttcgtcatcttctacacaattccaagagaaacgagtagaaatcgtcagtttgggatattttgtggttttatgatttataggaacgggttgaatccttaaactgttgaatccttgatatttgtttgaagtactcttcatctactttcctcacaaaaatctacttggcatgtagatcttgagaattctagaatgtggatacagttgaaatgaacctctaattatttttcttagaaatcacttgaacaatccggtgtggatgagtagatatatactacataaaaataaaatctttcaagtcatgcttggtactaaatctctctgctaatttagtaatacaaattaatcaataagttttgacgtataacacaatttatcatgcaattacacataattaaagtaaaaaccttttttgattttttttttcaacttcattatcaagtatatattatgacgtgtgatataattgttgtattcgaagaactaaactacaaaaacgagtgaaattaagaaactctgtcaatttcatggttggtacttcaataatctctatgctaattggccaataattatagtaagtttgtgtaactaacattattccatttggaaatataaagtaaagatgtacgcgttgtacgactcacgtgatcacccagtcactcacaagtcaaaaccttagtaacaacctctaatataaatatatcacatttcacatcagtgtatttcgaaatttgataacataaataatttaaattgattttgtggattgacgacttgcatatgaactaaagttaaagttatttgtctctgttaattagtcatataaattagtatgttttgacgtgtttattctttgaaattgtgtacaaaaaaaacaataaattgaaaaccttttaagaaaatgttaacttgttatatatattttgacgtgtgattctgttgtaatgggaagagctaaactacgtaataaagcaaatctgtcagtttcatcatgcttgggtatccaatgatcttaatgctaattggccaataattttagtaagtttttatcgtgtggagctaggtgaaacttcttctttcgtttattttagatgtacgcgttttacgactcaacaagttcaactaattaaatatcacatgtgtgtttagtaggtctctatctctcaaacacacaaaaaatcactagagaagaacaagaatggagaatccaaattatttcgatacatttcctgaacatctacaaatggagattctgtcacggttgcctgatctacaatccttgggtaaatgcgtatgtgtctcaaagcaatgggcatctttaatcagctcccaagaattcatagatctttactcgagccgatggatgtttaacgatcttgatcacaaagcgctacttgatctgctactcacctagactaaccttgattaaatcttcaacgtgagatctgaagagtttagtgtcattgttcgtctcatatatttctattgtccgttcattaatctttaattatgcaaaataataatgttgtctctcgagtatatatctcttattgggattatttgaatccatttctattgtcgtacgttaatctttgttatgtactataaataataatctttcatcgatcaattcagatgtaaaatttaataacgtgatagatcggtagagtcgatgaaacttttttttttctctaagtagccaaattgaattcgaataaatgattttctcagcctgtatggttaaaatttgagatataaaaggatgggaaaattgataaagaagagaacagaaagtgcatgccaattgctgcaaattgtaatgttactgttttaagttgcaacctgaagtttaagttacataactatgcaacaaagagtcttctccccgaagactcatttaactatccgatttcaaatcctaaagcaatcaatatcagtaaatacagatcttagataccaaaacttaagaaacaaaagatactttcctatggttaaaacttaaaagatgaccatttacaatgcaacgacgtgtgataaagatgaagccctaaaaaaaaaaaaaagagaagaaaatgaagccgtaaactaactattggacatctacaaggtacctgttgtcggcgatgtcgtctgatttatgggcttttttgttgtcaggcccattatcgtgtttgcttcattaaaccccatcagttgaaacactgtcgtttctcttgtttgagttggccggaaggtgtggtgctttgtggtagtggaagtttcgagaagaagtagagattgaccaaaattaagttgcgagttctttttaatataaacaaaaattaaacatatagaaatttagctattaggagttttagattttaatttgataattttctgagtttattaagttgtttatcgattcatttaatattttttggtaaaggttaactattttaggtcaaagttgttaagtcaaccataagttcaaaaatattgtgcatacgatacttgaggaataaatgtgttgattgcaaatacttgaggaataaaatgtgcattttcccctgttttgctcattcatttatattttcagttgaatttcatatttctgctataattctaataggtatgcaaatatgctgcattattcaaagaagagtgagaagaacagagtaacatatg

SEQ ID NO: 7395 - DNA, 3000 bp, Unknown
  misc_feature (1)..( 3000): cDNA_ID_4371052_gDNA_ID_1621143_Annot_ID_56686 3000 nt of promoter + ATG
ccaagtggtgacacgttatcacgggatgaagaatggagaaacgcaggaggtaaattctctatagcccttggtcggtatatacaataaactgaacgaggtttttataaataaatgtttctatttcgaatggtatatgaaataaatatactaagcttttaagtttttttttggggtatgaaatatcaaatacactaattgtgtatttattgcagtttgctgtggactttccgaatgaatatatgacatctgtggagggtacatacgaccatatcagtgagggtaactatttggttcttacgtcattgactttcaaaacgtcaaaagggagaatctctcagacatttggattggtcattggtaccaaatttgtgttggagactaaaggtaatgttatcagtgggttccatggaagagatggtggttcttttgatgctattggagtatatttctctccaatgatatcttcctaagctacagaagtttgttcatgcatggcttcacgtatcttttactactttaaaatacttatcgattccgatgttgtcaactatgaacatctatgtaacgaaataaaactttatccaaaactaatttcaatatgtcatttaaaatattttcgatctatattttataataaaacttcaattttacaattttctatgataagagtgaaaataaatctttattaaaaacttttcccacagacaaaccaaactaaaattaggtcaagggagataataaattattgcgccttatgtgattagtggtgtccgcattcgatggaacttggctaagatctaacgagtctctactcgaaaaagaccgagccaccggagctccaaagccctgagttgctctccgagaactttgcctgaagaagtagccaccctactcacaccagagaacaaacactaccaaaaccactcaccacacgatggctccctcgtgaccaaatatgaaaggatcttgcctcaccaagttggaatcttcgacggaacaatcgtcataggagccgaattgccatttttagagcaacttcatcacattaggggagaaaatcatccagaggttaatcgcgtcaagaatttctactattgttcccagtctcctagagccgtacgtctttacaaaattctaatcgtttcaagaaaatacatgtgaataggcgcataatggccgctttatggtttagacatgtaaccgtgaaatacatctacttcatgtaggtgactatataatagtatagttgacatatgtgatcatgcattctcttatatttcgtgtagctagcaaatttttccctttttatttttattttaaagttatagctttttcttgtgtagccactgcgatggttagtactatatatagtaattgttaactgtagctgttgatatatcaaaataatgatatgatcatatatggaattatgtatattaaaatgaatttgtttatttgtatgaaaaaggtagtttatttcttaatgacataattttaaactatataataacacaatgtttactctagataacactccaattgagaagtcttacttttaactaataataaaatttctatatttatctaaacattttctgtaaaattaattatcttatttgatctaacaatttggtatctatctaattgatccatttgacaataactaaaatattgataaaattaaaataattgagatttacttttattaagaaaaatatagacttatatagtcagtcatacagaaagtttgatggcatattatcgttaggtgcacatagatttttgtcatattttgtttggtgtaacaaattcattggttgcttggccttttctcttctttttttcacaacgtggaaagcattttactacaaatgtaaccgttttcgatcgttacaacccctatcattgtcacaatgacaaactgtttataaaaatattcaaaacaaaacattaaaacttatatgagaacaaattgtaaacgcgagataatgtttttgacaaataagttataataacattaacgtaaatttatctccaaaaacataacaaaataaagaaaaaaaaaacttatcccgaaaaatagcttaataaatagggtaatattagtagataaccaaataaaacatataaattaagaaactagcagagagaaagttttttgttacaaaataaccatggacctacgttgtcggaagaaaagaaataacaaagctacccttcatttgttgtaagatgaacagtaaacgaaacacatctgtgtaatttttcaaaatagcatgtaacattaaaatttcacatgttatatttagtttaaaaacatgttatttcaaaaaacgttatgaatttttaagaaaaaatattattatgaaattcttttacatgaacagaatctttaaaaaaaaaaaattacatgtgattttaataaaaaccatatattactaaaaaataagaatatatttttaaggaaatcacgtgtgatcttaataaaaaaacgtgtattactacaaaatatcatgataaaaagagatattaaactgaatagaatgttttttccaaaaaataccatgtgttttttataaatactatgtaataagagaaaataacaaaataaaaagaggatattatgttatcgcatgtatttcggaaaataacatgttacaaaggacatttacgtaattacacgtgttctccagcatgtttccgacaagatactgtaactcaaggttagtttgtacattcttttcaaatctatagtcatttattataaatactctaataaatatcacaccattcgcctccgcaatccacaacctcgcaagtaactctcatcctcgctgtactgatcaggttactctttgtctctcttctttttctggttttcgagttttctttagtattatgcattcaatatatcatatcaaaaaaatgcatttacaggagtatactagtagtaaaaagtaatagcttttataatttcagaagaaaaaactctgaaagatg

SEQ ID NO: 7396 - DNA, 3000 bp, Unknown
  misc_feature (1)..( 3000): cDNA_ID_1817562_gDNA_ID_1621143_Annot_ID_56687 3000 nt of promoter + ATG
tcatttttaattgtaaaaaaaataaaaaaaatcaatgtaggtttactaacattatttttcttcattgcagtttgcgatagactatccaaatgaatttttgatatcagtggagggtacgtacgactcaatcctattccccgatcattacgttttggtcattacgtccttgagtttcaaaacatcgaaaggtagaatatctcccacatatggggttgtgtctggtaccaaatttgtgctggagagccaaggtaatgcaattgtcggattctatgggagaaatggtggtgctttcgatgctattggggtttatttctctccgatatgatttcttcgtaatattaagctatgaaggctactaaacgtatatggttccactgaaaaacttaccaacaacttcaccaattttatcatgttgttttataatgctcacatctattaataaatatttactatatgatgttcctcatcttctttaatttcacattgtatttcgagtttgcaaatctatgtaataaaataagggtctctatttcggtattatataaaatattttataacattggataaagtgttaaaaaacaaaatcatctctaagattattctgtttttgtgcgtaaatgtttatatatcaagctaaaactcaatgagtaaaaatgagaaaatcaaaaatttaaacaaattgtgacatcaaaagtatttcccatttgatgtaaaataattgattaaattatacattaattaactttaacgttcatcatatctccatttaattgaaatggagtaaccgttggggtattaatgccagtcctataactggaacaacgttaactagccttggttccacgctaacaagggcacaactaatattaacatatacaagtgagtctaagatattcttacaaaaaaaagtgagtctaaacgaatatataaaagacattaaccaatttatttagtgccagttagttttgaatttaaccaaatgagctttaccaatatatttatactctttaaggtaaaagtgtgaacgtatcatctctaactaaaactaaaaaattgtttctaacactgagtattaaaaatcgccctacagtttaaattgccagaaataaaagaaaacgagaaagaactaaaccgtttaaatatcaacatttgagctaagaacttcaatcttacaattaaacacatgaagaacgcgggaaaagtaagtaaccaattatctaatagtccaaagtcaaaattcatggtctttcgtattctttaacacacgatctgagattgaattaatcaaatacaagtaggttttcagtatatatatatttcgtaatcatgattcgattcaaataatacgttttgcggttttggtgtgagactttttgttaagagatatagtcatatacatgtcacatgtgtatctgatgaactgatttgggcatacttcatgctccaagcatttaggcttaagatatcaacattttgagatctataattaaagcaaagagatgtgaacctatttcctattgaccagattacatggtccttatttattaatcagatcgatctgatattgaatcagattaattaaatgcaagtaggtttgaattatatctttcataattaggcattgattcagatatacgttttggacttttggggatgtgagaagacgcagtgacaagattaccgtaattgtgtggcttaagaaaattgttttttttgggattgttaagccactctattaaaatcgttataatttttatttccatctgcaagtattttgaagatgttgaatgacactataatgaacactaagaagtctaaaacttagatgtttttgggtaattatatgaaacaacacaaatgcataacaatgaatcttctcgaccacagagtcgaataagagtaagaagacagaaagggaagtatagaattaaatcttctccaacatgcaaactcatgctagctcatcttaactaatccaggtcagcaaaacaatctaacgcaacactccaatacaatcaacttcatgtgataacaaaatgatgatctaagtttcttcatctcgaaatctgaaatcacgataaaaatgtatttagtctactgaaaataaaatgaaaataaagtactttaaaaaaataaataacaatttcactatttcaatatttaaattaaaactcgagtaggtattaattaaattaagaaagaagaaatctaaattactatttgatatttctagttgactggtcaatgataaagttcaaaataaatcaaagtataatacttcatagtcacataaagttttgttttgtttcttataatggttttaggtcaatctcagttcacattgttcaaatatcctaaagtttttaattcaattggttaaaggatttttaatcaaagattgtttctgaaggttttgttaaaacactataaataccttcaagaagataaaaatttgataattgaggaacattattttaaaatgcctaatggccactagtcagatttttatacatacactaatatgcaaatgtgaaagagccaaactgtgtctataaataagcatcttcatcctcaacttatggattcatcaaacactaacagcataattatcgatcatgttcatcatctatctttttatctttctctcatctgccattataggtaattaagctcgctatgtctcttagaccattaatgtttttagatgaaagagaacagctagaattccctataaagctccaaattaataattttctgttaattgaaatttctgcttttttatcatgacctcaaattcggctttgatataaaatttccaaagaacttaaaacgatacttccttctgtttagaacaaagttgatgattggattaaaaaaacagttgttttcttttgaatattcatagtcccaacataaaataatactaacgactatgaaataataaaacaaaatataacctaaatcaattatatgtttaaagattcaaatggggttgcaatg

SEQ ID NO: 7397 - DNA, 3000 bp, Unknown
  misc_feature (1)..( 3000): cDNA_ID_1808779_gDNA_ID_1621143_Annot_ID_56688 3000 nt of promoter + ATG
tttatcaattcctcaaagtcaaaattaaaacacttaatcttgaagcagtctgatatccggtccatgcattactttcttatatttccgacaccatactgttgcttatctaaatttcctattaagtattaaccatgttggtaaagttgaacctaaactaacatttttttttcttctaaatatctggaaatttaagcctaaaggccctatgtatttttcagggaagacccatattcaattaaatttaacttttttggagaagaaatcatttccaacttacgttgaaccaatcatatttatttgggagatttaccactagaccaacaactcgttgataactaacaactttttaccctagtataattcaactaatcgaactatccttgacctctaagagtactggagtacttgatattaagctttctaaatccactgttcctgtcacaggctaggttaattttgtttctttttgaataactaatattttctattggttaggttaagttactgattcactatctaatttaatttggacgaattatttgacatttacccattgtggggccttaaactatataaactattaaccgaggaacattccatatgaaaccgtttggtaaaacatgagtttggagttccatcaaacttattaagcagtcttataatggttgactaaattcataaaaatttcctcaaaagtcaaaacttgattcctttttgtttggcctcaccgtaaagtggaatcatgaagatcattaaattgtcgtagatctcaaggtttcatttttgttggtcaaatccttaagtaataagatcactcttttagggtttccacgttccatgagaccgatcagaaaatgcaaaatcagatttgactatttgagatttcgtcttaaaccatacagatttaataatttggtcaaaccatattccctcatatataaaaccgtttttctaacattaaacaactatcaccggaaacgtatgtctaaatcgattcatgattacggattttgtaagttttgtaacatctgcgaactttcattaaactgtaaacggataatacaagaagtttactatccatggaggtggtgtatgaaagaattgatacaaagaagctagagaggggaaattaattataaatgtatattcgtgatatgtgttaaaatgtcttgttaatatttttatttgttaaatacaaccttaatcatgcttggaatcagtggtcgagctcgaataatatgttatggaggtcatatattatataactgaataatagtattaaattatttatttttaagtaagcttagaaaataaattttgtaaaggttatggggtcgttgaccccctcctcattagctagctacgccactgcttggaagctggaatggccactaaggtaacgatatatcatcattatgcatactgatctggtaggagttatttggcagtattttggctcttgggttactctaaatttttattttttttaaatatcatcgataatttttgactgtatatttacagtcttagaaagttgttggaactttccgacgaatttccgactaaaattttcaagtttcatcaaaaataaacagaaaattctgatgcatgcctatccgacaaacctatctcgatacagataccacgtttagttggaaactcatcggaattttcgaacaacgttttgacaaaatctctcgatggaaaaatgtggttgaaactttctccaatattattttaacaatatttttttgacatctgcatcgacaaatttctggaataatcctagtttccgaccatcgtttgccaatgcacaccatgtatggagagaatataatgattgaagacactagaaggatggccatcctccatatcccagcccatctacaagattgacaaaaatgtaattgtagtcttatcagctcccttcaataccacgaatcaaacaaaactcgagggactccttacgggtttgttcagtacaaggggattagctaaaacttcatctccttgatgctcactttttttcttattttcgatcattcaattctattttctttcgttagattgtaaataaacctttttgatgagcaatagatttacatttagaaaagaaagtatattcattttggtaagaaaaaaaaaatatataggtcaaatggtaaattgaagcaacttgcccctcctaaattcatgatcaaatcccacgttagctattatatgaaatgtggataaatattattattttttcctatttagaatttaaataataataacataattgtttgtatctttaaaattagtatagtattttatcccctgcatgtaaattttatttctaaatccgcaactgcatgtacgcctttaggttaacttactttgatatccaaacattagcatccatattgttctttcattaagattacgtttacgagtctattggttcagtgaactttctttaagaaatagtattagtatatataacaaactacttaaaatgatgaaacttgagaactgagaaacattaatctattgccttagaggccactagttaaatatactagtaatatgcatttgtgaaagagctaaaacttggtgtataaataagcatttcgatttcagcttcttcatcaatcaccatagcacatcgatcatgattttcatctatatatttctctttctctcctcagccattataggtaactaagcttccttatgcaccgttttcattcacaccattcatgtttcagatatttgctagagagaacataaagtacacttttcccctatattttaatctaaattatgtacataattgtgtatatgtggctccaaacgttagttggataattacaactttctttcttccattttctttaacacattgatgcttggctagaaagttaatgttctcagtaaaattaataatgacaagaagattatataacacaataatagtattcaatttttatgtataaagattcaaatgggtttgcaatg

SEQ ID NO: 7398 - DNA, 3000 bp, Unknown
  misc_feature (1)..( 3000): cDNA_ID_3593683_gDNA_ID_1621143_Annot_ID_56689 3000 nt of promoter + ATG
actcaccagaaacgccatgaaaaaatcgcttaaagatttgggttttatgtttttttgtttttcccgagaaaaattacaggaagttggtagcagatacgaaaatggttaatgggtttaagagaaagagaacaaaaaggagtttgattctgtctttttgagtgggtttatttcattgtccgatgatcaaacacggaatgtgatgtttctcaacaaattggagaagcagagatttatgatttgatttgacggcgagaattttgatgacttggagaaatattgaacagagaatgatgaaggagtcgatcacaaacatcaccagatgcatagataggtaatcaattaattaatttaatttaattcatatagactggctcttattgtgtgtgtgtgactcagttttgtatcgctgtatgtttattattaaatttgatattttaatgctactaaagatgcatgtcagtgtcattaactcgtgatatgtgttcctttgtcaataaaaaatacaaggagaaaaaaaatatggacaatttatggcccaaatccatgttgggagaacttggtccaacagaaaatttcagcccatgttgatggcagagagcctaagagcctaaacaatcaatccatctaatcatcgtgacaatcgatctagtaagacaaaggccttgattgggaaaaaaaaaaaaaatacaaaggcattgagaatgttttgtagttttttttttttttttttttttttttttttaaataaacttatagatttatctagtgagtttcagtagaaatgtaccaaagtattttagagtggacttctctctaaaagcccaccacaccgtcggttccgattttgaaatgctttctgactaatgtcagaggtagccaaatcgcatgttactgaataataggtaaattacttgaacttttagctcaaactcaaactttcgaaacatatgtgatttttgtttgtaaggtggattgaacttaggttagttccttccaacattttcccaattctcctttaacactagaccacagttgtgtgggcggtttttgtttttcaaaatctcattttcataccaaattgttaataatactcaagaacaccttataagctagatagattacaatctaaagttgcatgataaaagtggagaagaatcggctgataaaagtggagaagaaacggccttagactgaaactgaaactatagttcaaagtttttctataattaattaggaaacaaattttatagtaatcttccagtcatgatgttagatttttatttatcctattatttaggaaatctagttctacttcatctacgttattttttctcaaaaagcaaaactttttttttaaaaacaaaaatttaataacaaaaactaaaactaaaatctaaaatcgaaaaactaaaaaccaaattcagaaactaaattaaaaaaacagcatccatttcatggccaaaacattagatattaatgcttctaactgtctatgaagagtgagatataccatgaagaggttcaaagttaatagaggatgggtgaagtctctggtttggatctcgtctttagatggccttattatgactttaagtcatctttgtacagtttttagtatcaaatgatcttaaaatctatttcttagctttactttcaccaatctaatgtgatattccccatctagtccctcgaaatagtttttcatgccgaatttttcatatatagtatatcacattatccaaagaaaaactttcgaaccaaccctaaaagcatctataccaaaacagattccccatgagccatgagaaactatgttgaccaaatctatgggttcttaatattaatttaagattctgattttccctaatttgtgaaatcaacgtcttctgcccataaatcgaacctcgaaatcgacaatactattatatataattaaatcgttatggttccactttacggtgaagttaggcgaaaaaagaagtagttaagtgtcataaactcaagtatgaacagaaggggagtacatattcaggggagtaattaactaattaagtgttataaactcatcatgaggatttgtgaaagtgttttccagaacatgcatgtgtgcatatagaaaatctaaaaaacatataagtccacgtacgatattaataagtttaatttaaatgttacacaattaatcaaaacatattcatttgttttcaagctcaaaaacgttttggttaaatgtaagcctgtatataaaaaaaaaacacaacttgtaaattaatttgatatccaagcattataaatccatgttttttaagaaatagtttctttctatatcgcttgaatcgacgttattttaaaattaatgcatgcgtgtaagtgtagctaaatacttttaaaaggcgaaaataagaactgataaacatttttctataatgcctcataggccactagttataaactagtaatttccatatgtgaaagacccagaactgtgtgtataaataagaatcgtcagccatggcttcttcaccaatcaccacagcacagcgatcatggttatcatctatatatttctttttctctcctcagccattataggtaactaagctctccttatccacacttttttatttacaccactgatgtttaatactaaggagatcagcttccttatgatccactatttacacacgccaatagtcttattccctcttcttcactaaaatatatataacactatcacataatgttataatgagataataattacatatgaacataacactatatatatagtaagttttgaatatggtatgaatttattttgtttgttttttggcaacatcaaatataggtttgttataaattttgcataaaatttccaggcaagccattccttctcttttaaaaacaattggtggtgtcttggtatataatatttattttcgagacagaaagtatattgaatataattagaaaacacaataccctaatttaaattttatg

SEQ ID NO: 7399 - DNA, 3000 bp, Unknown
  misc_feature (1)..( 3000): cDNA_ID_1817556_gDNA_ID_1621143_Annot_ID_56692 3000 nt of promoter + ATG
tgagggttactacaatgatcatgacgaatctggagtcattcaggcacttcgattcaagactaatatcaagacctctgaactaatgggatccaacacgggtaagaagtttagacttgcagccagtgaaatgaagattgttgggtttcatggatacgctgggaagaatctaaggtctcttggtgcatatttcactccgattactcctacaaaattggcatggcaaggtactgctctaggcacactttgggatcatggtgctttccaggctgttagaaagctttccgttttcgagattggtggttatataacgtgcctcggtataacctatgacaacgatggcaaagtagaaaagcgtgaccacggaatgcaagatggttaccctggagaagaagtagaggtcagaattcctataactatatattcgttgtttaacagaaaataaaataaaatacatccctcgaccatatatatacatatattgttggatagcttatctgaagctccttttattgcagtttgtggttgactatccaaatgaatttatcacgtctgtggtcgggaccatgagtactgatagggtagcatcattgacttttaaaacatcaaaagggagaacctctcaaagatttggagacagaactgctaatttagttgaatttgtccttgagaacaaagattgtgctattgtcggatttcatggatggtggactcctagttatcttacggctcttggtgcatattcttttccgatgcctctttctcctgcttcggaaaagctagaagcacaaggtggtgatggaggagcttcgtgggacgatggcggtaatttcgaaggtgttagaaagatatgcattgggacaggtgagattggtatcgtttctgtcaagtttctgtatgaaaatgacactcacgagatagtagtgggagatcatcatgggaacaagaacctgattaaacatgaagaggtgattactacttcacttttcttaattaattgttcaattacgtaccctaacttagttatataattgagcttgatattattatacttgattttctaatttttatttgtagttcgagctggattatccgggtgaatacctcacattagtggaaggtagttatgacatagtacctggaagtgaggaaactgaagttataatcatgctcatgtttacgaccaacatgcgagcctctccatgttatggactcgatgataacccaagctttgtgctccaaaagagaggtcacaagatcgttggattccatgggaaatcaagtaaaatgcttcatcaacttgggatccacgtactccccatcacccacccttgatcatgtttatatgacttagaacgaaacattctcctcctatgttttcattaactttgattcgtttctcctctttctttttttccctctgttttgattttgtttcttttttctttgtttgaacttttgaataattcatgttctaagaaagtgtatggagttggagtgaagctcattgtgacttatatatctgttttcaataagttgtttccaaaagcaagaaccattttgaagattccacgaaaaaaggatataagctaaatttgttttttatgaagttcatttttttggtatataatcgtcggtaacacaatttcatcaacaatttgttggtagagtactgataacaaatgcgtcggtaattgttgttaggttactacatgccaggaattttttggcaatttgtcgacgtgagtttccaacaactaattagtaaaacaactttcatactactattaaccatctctatgaaaatcctaaagattatgtagtgaacttagttaacttaaatttaaattatttagttgcaatctagattttttttttttttttttttatggttctaataatatttttattaaaagatttataattcaaatcaatttaatttttctttttaaaatagttatttaattttataaattttatatattatatatattctaaacgtttttcgtcaaatattctaaatattttataaattttagataattataatatttatttttaataaaatataatattaataaaattttaagactttcttttctaaaaatagttagaattgatataaatatattaaataaagaaatattaataattataaatattaattaattgataataattaatgcgaatgacattctttttaaataagttacagatttatttgccaaaacctgttgttaaataataatgttagatcgtacgttcaccacgttacgatgttgttccacgttacgatgtactattgttccacgttacggtaagactataaacatgtttagatgttggaagtttaaattgtatggcctccctcacgacacacgagcaaataagaagatggtaacttaattaagattattatatagtctcgttggaccacggatgatataaattcaaaaaccttatccagacagtaagaacattaaaactttatataatattggtctctcgtggatcacgattcatatttaaaaaatcatttctaacaatgaaactgtgtataaaaaggcaccttcactagtacctgcacatcactcagcattgttcttcagctctccttatcgctctctaaaatccactataagaggttctatcttcttataatttggaaagtatatagcatcgaaacactttgaatgtaaaaatatatacatattataatagttatgcagtacttaaatatgcttagttaattagtttgattaaaatatgtagcttagtggttaatattaatatttagattgggttaccacttagcttagattcaagctttcaacactacgtcaacccacgtaatatatgttgttaacaaaaaacttagttttcttcaagaagtgagtgtttcattactcttgctttaatttgtgtatgcaaaatgattttgcgttttttccttaagtaataaaaatgaatttatatatggcagattcgtaaccgtaagtgatg

SEQ ID NO: 7400 - DNA, 3000 bp, Unknown
  misc_feature (1)..( 3000): cDNA_ID_1817552_gDNA_ID_1621143_Annot_ID_56693 3000 nt of promoter + ATG
tatatttgtattgaatataaaatatgttttttgattataatacatcaaataaaactttttaaatattaaagtaaataaataaaattttgaatatttttgttggtcaacgttggtcaatattagtcaacgcccgagtcaattaatcagtataccaaaattgtatgtttatagtgttaactacaggacaatctaccgttcatatatgttgtcatataatacatatagctgaaaatacaatgtttaaccatgtattcttttttcctattcttttatatttcaaataggtatcaattgtttttctaatctatatatataaagaggcacgtcctaccctcaacttacaaaacaagatagcagtctctgttccttctattacaatatctcctccagcaaggtcatctatatatatgcaggaaatttgtatttatatttcattataatctttaacaaagccaaggaaataaatgcaagggttgacaaaataaaacaaacttaatacaatgcaagtagggttccatacttccattatttgcaaaatgtctatctttttgattcgtgaatcgaatttaccatcctgtaaacgatattcgcggggaagactttgtaagctttttttgttttttttgttttttttatcacgacttcgtgtagtcttttaaaataagaatttattagtattttaaagcagacttatttaatcttacaaaatgacattataatatattaatgaccaccgaagtaggagtcttgtaaaatgattcaatggtagctattgagtcgaatttacaatcccgaaaacaataatcgcgggacggctttgtattgttttttttttgtgtacgacttcatttaatcttttaaaacagcaatttttatatttaccccaaatcattttaattatacaaaaatgatgaccagttttcagttctattccagaaaacaattttccatgtttaatctattgaattaaatacgctgtttttcttgttcaaaaggagaaatggaaataatcccgagtttctgtagagaatagttggttaaatattgggttgaattataattggtatattgtaaatacacaattaataaattaaccacaaatatataaaccaaaataagaaaacactctaatatttatttgtaaatcactcacaatacaaagtttataacttaataacaaatacactcaaatctcacaccactctttatttttctcaaacctcacactctatttctacgttgcatgatattgcaacttctctctcttgtattgtatgttatgggataattgctctcgtttaattcctctcaatttatagagagttcgcagcctacttttgttgactaaatgagcaaccaccacttcttattttcaacaataaacactacttaaatattcaacaaaaaacactgctttgactaagagttaccgcatgtgaaagtgatgatgcaattctttcaacagtttcatctcttcttctctattgcttccgtttttgtttttatataacgaattaaactcaaaagcttgtgtttacttgctttaatttagaacttgaactttggctgattattgaagagaatctgcgttttgtttgtctccctcaactcaatccatgataagattctagaaatccaaaatgtccactcgacgttgagattcttaaaaagatgaaaacgtgaaatctaccaaattctaatgcttttacaaggttttaaaatatttttaaatgtttcataaaagtgattataaaactcaattcttcttgttttacacattatataaaaggtattgttttaaaaggtcttaagaagattttaaaggttttataaatattttaaaatgtcttatttttgttacccggttctaaattttttaaaaggtgtttggaattttttataaagattttaaaataaatttgataaaaataattctcttatgtcgtataccatacgctaggtcaaatcaccctaggcaccgccataaacatcgaaagaaattttggattgtttttttgtgaattttatttttggtttgtatcatttggaaaagaggcgttgtaaaaaagaatttaaaacatcatttcttatataattaaaaactattcaaccaataagaaaatatggtgaattataatttcgccatttgtgattttttaatctcatccaaataatattgtaaaaaagactaaaatttgtgtataaataaaggcccatttgtagaagtccctttgcttaatgtttgaccaagagttcattaatgcttctacactaaaaggtctggggttcgagttccaactactgcgttttattagcagatttgcagattaatagaggcaagtgtgcaggagatctacaacgatgtacaattatagtcgttcgccaggattctacgcaaagaaaatattgaagatgtctatcaagcgtatgaagaagaagaatgagatgtcgtctgtcgtggatctaataaagatcggaaggaattgtccgtaggaaaatcgtttatgtaacagttttcataatttgtataaaatcataaatctagacggcaagaaaaataagacccatttaatcctttccatatagatccgccatagttcagtcggatgtctctctttcctctaccatcataggtcaacgttttctctctaaggtacatttctttacatcaatgtttcagagctctatatcttatctgaattatattgccaacgtaatgagcatccaagatcaccaaaggttacttagtattagattatagttgcatctgcttccttttcaacaagaatcttgatcttcttccttcaataaataacttgtgttgatcctctgctagaaaaggtatataaactttttccctttttaattaaaatcccaaacctatatatgctaattactgactaagaaacacaattcccatccatatgtgaagattctaatctgttcgagatgaccgaatgattggaagcggaagggagcaagcagaaaggcttatatatg

SEQ ID NO: 7401 - DNA, 3000 bp, Unknown
  misc_feature (1)..( 3000): cDNA_ID_1817544_gDNA_ID_1621143_Annot_ID_56697 3000 nt of promoter + ATG
gttgttatagaaaaaaaggaacgtggaagacactacaaatcaaattaaagtcaaaacatcaatttcgtggcatatgtaaaataaaaaaattgtaggttgatgatatatattcggacaagtatctgcaagaagattaaaatatataacgggcagagagaaagattcacgtagggaaagatgcaagcatgtcactatttcttaagaatgtttatatgtaatcaacattatccatttaggtttactacaatctacatttaacaaatgtctttttttcccataacaattaacaatgttaatttgatcagaataacatttgatgttaaatctcagctatgctaaacctctaagtctaaacacctaacatcagatcatcaagtcgacgagctttgagatcattagagaaaaggatcttgaagcaaagcaacaagaacacctccattttgactacaataatgaatttattcctagtttcatttgggtcaagggtccgcttgattctgacttgccgaacagtgatattcgttccataactatggaaaaacatttcttttataagatttagcatctgacgaaagatctgatccatcttccaaagtatacaggccataatgtagatacaccagaagctaaatcttgaaaaagcagagagattgcttcactaatttggcagttgcatgaaccgaagcaagcaatcaactataaccagtagaaaaatctcctgcaaatatagcaatctttttttgttatgagtaaaaaaacaaacgaaattaatcattctatttttccaaatagaacaatcagtggacagattgaatatcagtgacctatatagcctatatgaaacaagtccaccaattgcaacagccgtgatacataatggactgggctgaatttaggcccgatatgaagatagcggtccaacgtttaattaaaacagtcaattctacacttttttgtgtgtacgtactctataatgaaaatatattggtaattgaaaaagttaagacttgaattgaaaccacttaaagaagaattgaattcatcatgatgaacaattcaaatcagtagtataatacaattcttttacaggcattattgggaaaatgaaggaatagtactagttaaattaaaatatttgaaagagagttgacaaaataaaagaaagaaatttgagaatagagaaaaagaaagaaggaaagaaagaaagtgaagcttcagctttaagacggaggagacgcatgcaaagaaggtaatgatgttgtctctgtctcctacgcagacctctctcccacgccttttgttattttttatacgcctctgaccttccccattccttcttacctttattaccctcctattcactcttttaccactcgtttactactagttaaaacttagaagtagtaatatttattggtataaacctcattaatttcatattgtgggcataaatgtaggagtataagattagcatccgttagagattagtcacaaacattacaacattaaacgttaacattatctatgttgttttccatgattagatcgaagaaattgcatgaccatatcaatgtgctgttagttcagtgataaatcttttaggtggaagtgctgagttcgaaacatattgggatgaatctcttttccataaaagatgaatttaaccgagtgtttttgagtctgaattttcaaatattaaaaaaaaaaagaaaattgcatgaccataatttttttatttataaatataaaaactatagtataataaaaaaactatagtataacaataggtaattttcacaaatagcaaaaaaataaaatttattacactagtataagcatttgattgcctttctcttcaatttgactgcctttttctcgtttacaattttcactgattatatatttgagaatgttttaagctttaattaacctttttttaaccttttggaacaatttttttgacaattatacctatttagaccattttcgtagagtaaacaagagaaatttggttttccctcgaggtgttgttgtttgttggtttatgaaattgaaatgtgccaatcataaaaaaaaacaaaagaaaatgccaacgaaaaagctaatttcacaaacgcaacagcactatcaaatcacattattaaaataatattattattttaaggccaaaaaaaaaaatcaaagttgccatgaacgagctagaggaaaaaaaacacacaaagtagataacatctaaaaacaacaaaacagtacagtagctccatgattcgttttctacatacatctcttcttcatcctctcttctactttcctctttcctctttccttcttcgaataaatttctagggtttttcttttctctaaagttttcatttttatttcaatgagagctcgaagaaggagaatatgggtttgagaactgataatattatggcttcgtttcgaggtggaatcggggtttctaatggctgagtcaactcggtgattctgtgttatagtcacgagcaaatataaaaaagtttgtaactttcttgtttttttaggtgtgtgtgttcagagaaaaggtcgaatcttttttcggtgtttgtaaaagggaaagttgtaatcttaaagtctgtttttctttcttgtgttttggtatttagctcataaaagccgaggagtaatataaaggataggttttgtctttgtgtgcccttttgagattgcatgaagaaaaaaagcctctagtgtgttttgaaggaaacagaattcgatatttatgcggtaatgtgatttgtgaagctactccaagtgcttaggatttgagatggcttagatttggtagttgttcaagctgtggagtttgtggtggactaagaagctctctgtctcctttgtttagtatgttgtggttatcttctgtttagaaggatttagttattcatctggagggggtagtagggtcatttgtgagattctgtgattgtgaaataagaagagttttgctgaggagtaatg

SEQ ID NO: 7402 - DNA, 3000 bp, Unknown; identical to SEQ ID NO: 7401
  misc_feature (1)..( 3000): cDNA_ID_1817544_gDNA_ID_1621143_Annot_ID_172935 3000 nt of promoter + ATG

SEQ ID NO: 7403 - DNA, 3000 bp, Unknown; identical to SEQ ID NO: 7399
  misc_feature (1)..( 3000): cDNA_ID_1817556_gDNA_ID_1621143_Annot_ID_172929 3000 nt of promoter + ATG
